United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 18

SEQ ID NO: 71981 - DNA, 375 bp, Glycine max
  Peptide Sequence Number=SeqID_188759
atgtcagggtctgcctttggcttcattggtcgtccaggctactgttgctgctcctgctcctttaactcctctttccctgccttcttagaaggtttttatctctcatctttctttggttactacaccgatctctttggtcgcccctgtcatagctctaccttccactgttgttgcacccgtgccgagggcggtgtgacggctgcgggtgcttcagaaatattgcctctttcttcttcaacttttccgatttctacttcggatgttttggcatcggcgccgccttcccccttttctcgccctagtgtttccctagatcacgtctacacttctcgtgatactgacttgatatggagcataggatatatgccgaagtag

SEQ ID NO: 71982 - DNA, 648 bp, Glycine max
  Peptide Sequence Number=SeqID_188760
tgtctagaggaaacgatccagatggaagataataatggtcagttcattactgagggaacatttctccagatggaagataacaacggtctattcattatcacagatggggatattcttattcctagaccagaagctgaatggacaaatgatgatctggccattatggagctaacaccaaaagcaaaatacactctgacatgtgttttatctaaaaatgagtacaaaaagatttgcagacaaaaaactgctaaagagatccgggactcattaagcataaactatgaaggcacaatggacgtcagattaaggaaagtcacgactttgaccagacactgtgaaagctttgccatgaaagatgaagagttagtggacgacatgtttggaagacttcaagtgtgggaaccaaagaccacaaccattcaagaagtaagagacctaaagaatcttgcatgggataagtttcttggtattctaagagtcaatgaagttcaccttcaaaaaaaagatcatctacaaaagaaggattatgttgccctcaagtttggagaaataagctttagaagaaaagaaaagaagaacttatccaaaactcttaaagtacagatggctgaatctgatggattagaaaactcttatccaaaactctga

SEQ ID NO: 71983 - DNA, 306 bp, Glycine max
  Peptide Sequence Number=SeqID_188761
atgattggaaccaataatcagggattttcccccaagacagacaacaacaccaaatccaatggtccgatctttgagcacaaaccttctgaaaggaagatatatcctcctgtcacctccaactcgaagtttcatcttgtagtgcacaagcctatctttcataaaaaggcaaactactacaaaggtaaggagccgatggcagaagacaatgaagccaatgctctaagacaatatgacagactcaaagctcactacttaggtttagaactagacaagaagcctccaacagacgaagttcatcatgtagtg

SEQ ID NO: 71984 - DNA, 1077 bp, Glycine max
  Peptide Sequence Number=SeqID_188762
atgggtggccctataaaggagcgtcgtggaacatgtagtcgcatgattctaataaatgactcagatgatgattatcatgttttacctagaaaatgtggaaaatctgatgatagaaatgataatccaccaagtgaaaaactatttctggaaaatgttgcgtcgttggccggttcagcattggttaagcctaatggtgataacctggatatggcttgggaatggaattccctaaaagacataagcaataaacgggctgtaacttgtgatttttgtctaaagaccacaaatggtggtataaccagagctaaaaaacatcagatagggttggaaggagacgttagtgcttgcaaaaagatcccaccttcaattaagctcaagattaagcaagcttatgaaaaaaagaaggctgtgaaatttgggctggaagaagaaaatgatgatgatgaggtggaagccacagaagaaattaacctaagagctggaaaaagacgtgccaagggaagtattacgcaaggctctatacatggacatatgaatacgctgaaaattattgaactatcaaacaaactcactcttggaatggccaagaggaaaacatgtataagggatgctagtattaaaaaagcaagggctaaagctaatcgatgcattgcccaattcatccgtgagaatgaaattcctttcgaggttgcatgctctaaaggctttaagatgatgattgaagctgttggagattacggtcaacaattgaatcctccaagctaccataagttgagggctcctctgctaaaagaacaatcagagcttacaaaggaaaaacacaagccacatgagatagagcaaactcagtatggagaggcgattgaagatgaaccggttgttgagccgttgaggttgacttgtggagttgttgatgatgcaattaagcttggtgagccatctagactcactattgaagctcccattgaagaggaaaaggaggaggcgaaacaagaagagaacccgaagcccaagcccgagatcaataagaggtatgcaaggaaaagtaggagggataatgcacttgtccaagtctag

SEQ ID NO: 71985 - DNA, 183 bp, Glycine max
  Peptide Sequence Number=SeqID_188763
atggttaagggtgaaagtggcgacaatgttgcattgtatgactctgaattgttgtctctggaaatggggtgggatttgatggaaagttgttcctctggtggaaagcttagggttccattggtgaagcctgatgatgactctatggatgcaaagtttgttgctttggtcttcaaatctatatag

SEQ ID NO: 71986 - DNA, 192 bp, Glycine max
  Peptide Sequence Number=SeqID_188764
atgtcagcacaaagggaagctataacgatccctcaggataagacccaaacacaggcgaataagagaaatatgggtttgaaggtcagtgttgaggaagttcgagatgttgatgctcgtgtccctgtacctattcaagaggataaacatggacctaagggaccggtgaaacctaatgacgatcccctatactag

SEQ ID NO: 71987 - DNA, 207 bp, Glycine max
  Peptide Sequence Number=SeqID_188765
atggttaacatcaatccttccactgggagaggatcgggctcacacaaagagaagtttcatacttatttgggaatggtagctagaaaaaagattcctattgtccacaacagttggaaaacaataccagaatctccaaagaacatgatatgggatgacattttgggaaaatttgatataccagaagtgtctgctttgaagaagaagtga

SEQ ID NO: 71988 - DNA, 657 bp, Glycine max
  Peptide Sequence Number=SeqID_188766
atggagttcggagggaacatgttccgcctcggcaacagagaccaaaatggaaacactaacaacaacggtaacgctttcgcttgggattcatgggaaaaccccactaatagtaataataataataataacaataataacagttctagactggtcaacgcttttcacatccccgtcgcctctgggattccgtcgatggatgatggatccgtccacgtgatccttcatgagacggcaggactggccagcgccgtcatgtttcttcctcaaaacggcggggttttgggtcaccgccagcagcagcatccgtacggcggggatgggtcccacgtgcacccggacccgcacctcatgtccttgaagctagggaagaggcattactttgaggacactagtgggagtggaagtgttgttggtgctgctacttttggtggagggttggtgttcggggataagagagggaaagggtactcctccggcggtggtgcgggggtgaaggcggcggggtttgcggcggcgacggtgccgaggtgtcaggtggaagggtgccacgtggcactgctcaacgcgaaggactaccatcggaggcacaaggcatggaacaaaggttttgccaacagtgtagcaggtccaaattctcttatcatttttctcaaataa

SEQ ID NO: 71989 - DNA, 264 bp, Glycine max
  Peptide Sequence Number=SeqID_188767
atgtctaaagaagttgatatgaatgtagaaactgaagacgaacctgctgttgcttatgaaattggttttgtgacggtaattgtgaggtcagacacaaatattggtatgagagaaaggacgtcatttgtgttaattggttgtgaaaggagtggtcagtatagggtcaagaagaaagatttgttaagaataatgactggcagtagaaaatgtgggtgccccattaagccgcatggaagactagtggttggaggcaaaggatggatg

SEQ ID NO: 71990 - DNA, 100 bp, Glycine max
  Peptide Sequence Number=SeqID_188768
atggcacatgagagagttgatatcagtgttttggttgtggataatgatgatacttctttggccattgttgctaatgtactcaactcattaggatacaaag

SEQ ID NO: 71991 - DNA, 819 bp, Glycine max
  Peptide Sequence Number=SeqID_188769
atggctgcccggttttcggctatcaattcgcgcaacgcggcactgcatcttgtggagagatcagaaggagaaagccaagaatcacttcttgatgacagaagagagagagcacaccctcctgctgatcataagaatggagaatctccaaccattaacatattgtctaacatcaaaggaagggtgaatgctttgccttgtcgtactttcaaagctaaatactacccaaggaggaatttcatgggtgcatctttagggaacaacccatcttttgtgtggcaaagcttattttcttccaagatggttttgaaggatgggtttagatggagaatcggaaatgggaaggatattgacgtttggggaacaaccatggctttagaagggaggaaaatgcttgcatctcaaccccaatcgtggaaggagggcgcgaccttaaagaatttgttacgaacaagagacagactccgaaccaccagaggagtatcttgtccaattatttgccctctaagcaacacgaatgtggagtctactgctcacatttttgctatgtgccactatttgttgtgggatgggaaacaagaatcggatgaagaagtgattcaccgaggagatatgctattctatgactggagtagagctaagaattactatcctactgaaaacaccaggaccaagctcgctgttaactcaacttggtcaccacctgctgctggtgcctttacgtgcaatgtggacgcgagtttctttatggatgtaaatgtaacaggcatgagactatctgtaagggatgaccgtggaagccatgtagtgtcaagaacggag

SEQ ID NO: 71992 - DNA, 165 bp, Glycine max
  Peptide Sequence Number=SeqID_188770
atgaattttctgatttttaggtttcacgtggtgtcagagtttgatgattcaaagaggagttgtaggaggagactagcaggtcacaacgagagaagaagaaagagctcccatgattctgttgcaaggaattcttcacaagctgtatatacactccttggagtatga

SEQ ID NO: 71993 - DNA, 327 bp, Glycine max
  Peptide Sequence Number=SeqID_188771
atggtgagtcctaagcctctctatttgggacacgcgtcacatcgtgctggcagggcccgtgtttcccaacaaccaagagctcaaccaaagccagtaattcctaaattaaatgaagaagtatgtagtgacacaaaagctgttgatgcagacattgaaggagaagatgttgattctattaatccaatggttgatcaaagaactcagaaacaaacacaactacctgttagatttcagcactttgaaatgctgtcaaataatgcagtaaatgtagaaggagatttgatgcactttgctcttttggttgacattgagcctatagattactaa

SEQ ID NO: 71994 - DNA, 1587 bp, Glycine max
  Peptide Sequence Number=SeqID_188772
atgtctgcagatggaagaagtactgtaatttccaagagttttgcaaatggtgcagcacaatatattttgaaacccttttctgcggatgacttcaaagacatttggcgatatgcaaagaaactatctattcaaaataatgaaggggggtcagtaccaggtgataacacttctattcaggatgttaactcagcaacatcatcgaatatgaacaagagaaaaaggaagtattgcccaagaatgagttcccaaatgaataaggaaggccaaagtgaagaaagctctaggcttgtaaagaaaccaaaggttgtttggacaacatatcttcacaaccgctttttgcttgccataaaacaaattggattggagaaggctgtcccaaagacaattgttcgagtcatgaatgtgccaaacttgactagagaaaatgttgctagtcacttacagaaatatcgcatattcctaaaaaaagtagcagataaaggattgcttgagggcttatctaacagagatctaaggtcaaggtttgcctctggcctttcagcatcaatgataaatgacatccaagcaaaacgtgagaaatctcgtgttcctgcacaacaatttataaaaagaatagaacatcaatcaggttatggaggaatagccaatgttgttaaaccttacaacaatgtttcaagtgtgactaacactccacttggaagattacatcaatttccccatccatgtcacaaaggcttgaacttgaatacaatgcttcacaaccaacgtcatggtagttcttcgaatcaagcaagacttggagcacaatattcaagctttggaagcaatgccagggccaataatatccagcaaaatatgttgggaagctatgctaaccaaccatattatgcacaaagctcttacaacaatgctggtgttgtctttccatcagatggagtaatgggacatggcttgatgaattttacaaatggcctaagaggaggtatgaaccatggtgccaaccaatttatgtatccaaactatggttcatttggaaataatcacaacttaagcaatggtcaaggagtgtttgcctctacttctaatgctggggagggctgttcaagggagcttccaaaagaaaatattcaagggaacctaacactgcctcaacaacaactacagggcaatgttgcagaaaatgatattggtacttcaattggtgagaacaatttcaaccagctgaacgaagatgacttttctgatcttttcatgatgctagatgaaatggatctaaatgagactggagagaaccataatgcaaatgattttttgaagtctgacttttcaatctctaatcacgctgtggagtcccttgaaaagtctaacagagtttgtgaggtaattattaacccaaccgaaggcacatcaaatatgccagacgagacctcaacaagctctaacaagagttctaacaagatgggaggtgatgacgaacatgcgaacatggaacccttggacaggttcgtgatgaatgatgtttcctcaggaaataactcggccactgatgaggcgagtcaacatactaaaaaatgttcatgctattga

SEQ ID NO: 71995 - DNA, 294 bp, Glycine max
  Peptide Sequence Number=SeqID_188773
atgaggtttgctgatgagttcatgttcatgttgagtgatggactacttgagactgtggggatcttgttcatgttcaccatttacacaactacgactaccaaaactattgagcaataccatcgtagctcttttactcctcaagacgaacacgttgaatgtgaaactcagagctggtaccaagaggtgtcaaagctaaaggcaaagtatgattctcttcaaaggacccagaggcatttgcttggggaagatgttggaccattgaacataaaggagctgcagaatcttgagaaatag

SEQ ID NO: 71996 - DNA, 168 bp, Glycine max
  Peptide Sequence Number=SeqID_188774
atggggctttgggttggcttttatagagggaaagtgatgttctgcttggctatgataggctacttaggcaagtttggtggaagtgctgattttgagccgctcgctaagctaattttgtggcttagcaagccatccgctaagcgcagcagttcatggctaagcgcgtag

SEQ ID NO: 71997 - DNA, 949 bp, Glycine max
  Peptide Sequence Number=SeqID_188775
atggttagaactagaggtttgggtcgggctttaaacagggttataggaagagtcataggaagagaacaacaaaggccaacaacattcgcacgtagtcaatgggaagctacacctgttgttgaagatgttcaacacgtggatcatgcagttgacaaggaacgtcctgagttaaagttatcctcctatggaaggaaggttgagaaatttggtaggcctgctccagatattgaaggcttagtggctgccacaagattaagtcctctgatcacatgttcgttggacactagtgatcgaggacttatatcggcttttgtggagaggtggcataaggaaactagtagtttccatctttctgtaggagaggtgactatcacccttaatgatgtggcattcttgcttcatcttcccatcacaggtgtcttccataacttcgaggctcttcatatggacgaagtcatgttgttgttagttgaattgcttgaacattttccttcccttacttcgtgtattgctgctgaagattatcatgagaggaaaccgcgtccttatggtgaccaccgaacatttagagaatttgaactaattgctttgcttttcggacataccattcctccacaccctactgcatcaacattatgcatagaagatattaatgatagatggattcagttttctgaataccttgcaccgcttggggatcctcctagacatccacctgtgctgcatgatgacgcatttattgaaccagatattcctcagcaccctgtggcaacaacagctatggacgaagcacctatagatgcacctactcatgtagagcaacctcgacatgcattggatgcttgccaagcaataattgaaaggttggaacggttgctcaacctaaggatagtgatagaaggtacaaaagcatacactgtcatggaagacagcctaaggattgccagag

SEQ ID NO: 71998 - DNA, 1383 bp, Glycine max
  Peptide Sequence Number=SeqID_188776
atgctgtttaaatttcacgacgatccaacggtgaatgagtctgagatcgtcatttttctgagacaggcagttatttgcttggatggtgatggctgcaaggttcgcaatgggttggctactattgaaggagattctgatctcgatacatcaatagcctgtgattcatgtgatatatgtatttgtgataagttcataacaaacactgttagaagcatagttaagtctaataggtgtcttttattgactggtatcatgccttctgtgtgggatttgatactgaaggtacatcagacagtacatggttatgccccagtttctaaaggaacatccaattcagtagagaggacaaccgtggaatgtaatgcagatgatcataatagtaacagtgaatgccatgctaaggattccttttcaggaaaagtgtctgtgtctgttgctgatacaggagagacagttgttgttgtttcaatggttaaccaaacaatatgggttccagcaacaagtgagaaaatcctattgccttttgaagttggtgggtacccaatgactgaatcatgtattttaatgtctgacacaaatggtcagcaaagtggggaagtgaagacagagacaaatacgttacgaatcatggaggaagaagaactggaactgtctttgtcaaacaacatatcctgtagcgtaacttctaaatccttagtgcataatgatttaaagaaaagtgtccgtggagcaagggatgacccaagtggctttgacggaaccaagttattcgacgagtcccttaccaaaactagtccatccaaaattgaatccgaaatgggtcttcaacttggtttgtcagtgggctctttcttatctgacaagaatgaaacaaaagatcaagcaactgatgtcctgtgcttgagttcagaagaatgttttttgaaagcatttataccggtttttaaaccttataatgttgataataaaattatctcaggagatgaaattgaagcaaatgcttgtaaggacaatgccaaagtggctgaaagagaagatgtaaaaatgttgtgggatgaagcacactgtgccttagtcctcactcctcatgcttattatactctgacagatgactccaacatggacactaggcccaacactaacacaaatgctttgacatgtgatgagcaagtttatataaaggctgatgatggagatgtcaagcctgaacttccagaagaagatgacaagtctgaacttccagaagaagatgacaagtctgaacttccgaatgaaattggacaaaagaaaattagagctactggtagtcaaatgaccagtactaatgactctgcagatgctcatctcttagaaaatgctcagaaatgcacaagggaaaattga

SEQ ID NO: 71999 - DNA, 780 bp, Glycine max
  Peptide Sequence Number=SeqID_188777
atggagaggaaaaatagatcccttgaagaaggtgcaagaacccttctaaacgaaacaaggttgcctaagtacttttgggcaaatgttgtacatactgtttgttacaccttgaaaaaagtacttattagacctattttgaagaaaactccttatgaattgtataagggaagagaaccaaacactttacacctgagagtttttggttgttttcaggaaaaggattttgttcttgaagatgacatcaaggctgaagaaattaagcaaagcaaagagatctctacaacaatgcctaaagaacttcctagagagtggagaactcaaaaagatatctcattagacaacataaatggagaaatctctaagggtgtttctatgagctctagacttagaattctatgtaacaacatggcttttgtttctcaggttgaaccaaggaacattgatgaagctttttgtgatgaacattggttaatggcatttcatgaagagctttttgtatgtgatttagttcctaaaccaacctctcacaagtcaactgaaaccaaatgggtgtttcgaaacaaacttgatgaatccggcatcatagcgaggaataaaccaagattggttgcaaaaggatacaaccaagaagaaggagttgactatgataaaacctatgctctagttgccagactttttcaaatagatgtaaaaagcgccttcctcaatggacacattgaagaagtgtatgtagaccaaccaccaggatttgtggatcatgaacatcctgactatgactaa

SEQ ID NO: 72000 - DNA, 270 bp, Glycine max
  Peptide Sequence Number=SeqID_188778
atgggagacaagaccaaatttgactcattgaaagcaaatgagggagaatatgtaacctacgaagacaacaataaaggcaacattcttgatataggtaacacctacatgctcaatattgattgtgttacatcatcacatctaacatgtttcattagtaatgatgatattatatggttgataaacgtcaaatttatgagaaattgggcaattttacaaggtagcctcactcaagcgaggtataggccgctcaagccaggtcaaatagagtag

SEQ ID NO: 72001 - DNA, 273 bp, Glycine max
  Peptide Sequence Number=SeqID_188779
cttgtggagtggatattgcctacacctactccatatggactagttgagctggttcaagtgatagaggtgtcatcctctgaagaggatcttgaagaggacccagaggagttacctcccgagcctgctgcggatgcccctgacttcccagaggatgatgaggacccactccctaatgttgattctccagaggatattatgtcagcatctgaggcagactctacagaggagagcggccctggagggacagcgaatagtgacgactcttcatcgtag

SEQ ID NO: 72002 - DNA, 787 bp, Glycine max
  Peptide Sequence Number=SeqID_188780
tggtcttgtggtaagcaacgatagctcgtggctatcgccagtggtctgggcgatggaggaagaggttgggggtgttgggcgaaaggttgctcgcctaggcgaattctactccaacaaattttattgcttcgggcgttacaataaccaacaaaaaggtatagactttggtgaaacctatgtaccgttagctagagtagaggtcgtaagattgttacttgcttatgcttatgttatggatttcaagtttgaagaagcaaagcttcatggtgaatcaaaggtgattcaaagagggtacatctacttgggtttgactgagaacaagagagggtacatctcttgtggatcagttttagtggagggtacatccactaggttcaaagagaacaagggagagtacatcccttgtggatctttgcttgtaaaaggatttttacaagctaaactacttccttggtctccaagtgaagaaaataaaccatgggacatttctccatcaaacaagtattgcaaggaacttctcaagaagtttgagatggataaaagcaaaaaggttgcaactcctatggctactaattgctaccttagtgctgatgaaaaagaaaagtccattgatcaaacaaaatatacagtaaaaaagatcatgaaataccttagaggagcattagatgttggcttatggtaccctaaaggtgttgagatctctcttgtgggatacttagcttcagactttgttggatgcaaactatgttggacaagtggcctcagttatcttaagaagaggggttga

SEQ ID NO: 72003 - DNA, 353 bp, Glycine max
  Peptide Sequence Number=SeqID_188781
accgcaacatcaaaagcctggtactgagcttctccctccttctcctttccacctcaagatcatggttaggaccagaggattaggtcgtgccttaggtcacgttactggcagaggagatcgtgatgattccgatgatgctccgcagcgtcgacggcctatcgcatccgcacggaggcagcgagtcgctgtgactgtggcgcacgatgagccagtggtccctgcgccagatgttgaggctaatgtattttcggatgacccgatggcaccagctgattctgaggacattgtggcagacattcctgcagacacaggcgcgaaggctgctgaggatgagcatgagggatttctgggtg

SEQ ID NO: 72004 - DNA, 363 bp, Glycine max
  Peptide Sequence Number=SeqID_188782
atgttcattgttttttatgaatcgctattgtatgcagagaaggtggaagaaggcactaaagttatcatttttaactccaaaaagcttcgatttttaactcatttttatctcagacagataacagagaaaaaagatgaaccaggaaagcttgaagtaattgattatggagaaccactagatgaagcaccggcagacctcgatgatgttattgattgttttaactactatgccaagcttgcagaaggattggacgcaaagcaaaatgctcctgtatcccttcctatggaaaccttcaagagctatgttcacaaggagcccattggagttgttgcattaattactccatgggaaaaagatagctaa

SEQ ID NO: 72005 - DNA, 498 bp, Glycine max
  Peptide Sequence Number=SeqID_188783
atggtgaaaagaggccacgaggtaccctctgttaagagaatacagaggggacctgcaaaacaaaaaactctgacactcaaatatacaaagcttaggttttcctcatttaatctgggttggtggcctgggtgtatattaaataaggcagaggtgcaagttttagctgtagcaaaatctttcagtatgccaagtttatttagcggtgacgataccaataccattgctggtggtgttggtggcaatagcagtgttagtaatattagtggtgatggtaataatggtgataaagatgatagtaacagcagtggcaatactaatgtaggtggtgacgataatggtgtgatgttgatgacaaaaagaatagtggtgacagtgacaacgatggtggtagtgtcggtgtcaatgatagtgataacaataatgataatgttgatgttggggacgacaaggatattagtgctaatggtgatgatagtggtgttggtgctagtggtatga

SEQ ID NO: 72006 - DNA, 330 bp, Glycine max
  Peptide Sequence Number=SeqID_188784
atgactcgtggacatccctttgtcgaccacatcatggaggctgacctacccttaggtttgaaaccgcttaacttagagcgatatgatagagctaccgacctagacgaacatttagatgcattcttcaccaaggctaatctctgcaccaacgacgacgcaatcttgtgtcgcgtcttcccaatggccctcaaaggagcatcattgacatggtgtgggggactccctccaatgtccatcgacaaatttgacacctttgtcgagcgtttcaactctcagtatgcaaccagtcatttacaccgcatgaccttcgctcctctggccagtctataa

SEQ ID NO: 72007 - DNA, 675 bp, Glycine max
  Peptide Sequence Number=SeqID_188785
atgaccaccttcggtcaaggtcagcttagctctcatggagcttcaaagttagcatggacgaaaggtcttatccccactctgatcatctacaaaccaagtttgggagatcaagatggtgtattcgatgtggattcgtgtgatgacactgctgataaaggcccaaagcctattgaagaatttgtcaagctgcaactcagacccaaacttgagcaacgaatgcagaccagcctattcaagtggcaaccatttgacatgccaggtatccaccccaacatcatatgccacaaactagccatctactcccaggctaaaccagtgtcacagaaaaagaggaagatgggagaagagcagcataaagcagtcaaaaagaagggtcatgccctttggcctaaaaaatgcaaaagctacatatcaaagactaatggaccagatcttcaaacaacatatcgaacaaaatgtcgaggtctttgtgacaacatggttgttaagtctcgcaacgtaagtcaacacgtggcaggcttgaaagaggtgttcggggaaatctgcaattacgacatgcggcttaacccgaaaaaatgcactttcagggtcgcggaggaaagttcctgggttcatgatcacacatcggggaatagaagccaaccccgaaaaatgcacaaccatactagcgtctag

SEQ ID NO: 72008 - DNA, 1329 bp, Glycine max
  Peptide Sequence Number=SeqID_188786
atggaaagtgaaggtagaacctggctatttataatgttcgacatgagctctgggtccttgattgtcgaggtggtaaccttgacaaatctaaggattgcgggcttgtcgagccccccagcttggacaaacattgttcggattaaaattgacagattgtctagggtgagcgtgcttttcatcccttcaagtagaggcagttgttgtgctcatcatggttctatgcagttccttcttgggattatgggttttctcccctacacttcttccctctccaattgtctcattcacttcaaggaagggcttcccattggcgattcttcatcagaggagtcaccccatggagcttccgatagtgggtcctcctcttttgagaggttggtagacccaggccttgccggcaagggtggctcccgaccctgtgagggctaccaagttaatctttggttcaggtcgcccctcccttgcaattcctacttcttcttccactacactggctacatcaacacccttggtagttcttgttttagctcttccttgttttatggtggtgccattactaagagatggtatgatgcaataggtgtcttggagaactttccttctccttcctcggccttgccaccctcagctttgaccatcttgccttcggtaatgccttcctcctcttcccgtccaggtgtttcattagaccataggagtctggatatttttaaggagaatgggcaaaggcacaatgaggctctaaacaagattacatcttttgaggttgaggtcactaaatggagagccattgcttggactttgtggcgagtggagcatcccaaagtggccaacactattgttgcccttgctaagctagtgagcacaagattggatggtaacgaagtgttcaaacgatgcaaagatttatttaaagaaaggaatgatttggcgaccaaggtggagcgtgcttctaaagagaaggaaaagctcaatgtgacagtggctgaatctgccaaggtgattactgatctccaagcccagttgagagagttggagctcactatgtctagcttccaaactaagatgaaggaattcaagctcaaggagtcaaaggagaaagaggaaaaaaagaagctggaggagaatcttctaatgtgtaaaagggagggtcttgacttaggtctttttggcccgtttaaagatatgaaggacgatcaactattcgaagaggaggagattgctgctgggggaaaggacaatggcaaagaagaagacgatatggcaaatattttgagcttctcacctaaggctacgaggtcgtattcgagtaggaagttaaaccaatag

SEQ ID NO: 72009 - DNA, 2046 bp, Glycine max
  Peptide Sequence Number=SeqID_188787
atgaatagaaatgtgattcagggtgtattgaagaaacatggtgtatcctctgttaggagaacaataggagggacctacaaaacaaaagtctccgacactcaaggagacaaccacgataggtgcgagagttgtaggtttgtcaagcttgttaagaccccagcttggacaagtgttgcccagactgtttctgctaagttgtccaaggaggacatattttttattttacaggtgaagtttgacatgtcagtgcagcacacacacgttactcttgcttacatgtcactcgaggagtggacacatattggagacgcggtgtgtggtgcaaattttcaggatacattccctttcaccatgtctttcatctctgattctgccataggtatgggcagaagtgactctggggcttcgattcagcaactcttgatggaacgagagttcattccaattgcagctcctcctcggaggggacacaccatgaagcttttgatagcgattcctctttctctgagtggttcgtggactcacgccgtgttggagggggtacttctcgtccctggagcgagaatgagtggtggtggggatgctagggttccccccataacaggtgtagccgcattgaggttggccaacctagaagactcctgcaagatggttttccaagcttgtgggagtgatgattttccctttttgaagacggtgtcaggttgtccacccttctttattgtgtaccgttgtctttttgaagttttgggtctacttctccccttgaactcctttgaatgtgctacgttggagcatttgaatgtggcaccctcccagcttcatcccaatagttgggtggtggggagggccttcaaggaccgctttttcaaggtcctagcaactgatgtcgtggctcataggctgccattgatggtcccgcttcccgatctattgaccttagtggaaagggttgacaaggctattttggagaaactgctagccacgttggatgcacgagccattttgtcctttccttcggtgaatgatcctctcgctgccttatatggtaaaatattttaccatgtctcttttttgtttgatgtcggacctgctggtgggatcgtgtcaccatttgttgtcaagcctcctataggagaaaggggtcaacctgctactagggttgaccctaatgatgatgaagttgttgaggctatcgggttgatgtccgatttgggtcacccttctattgctagttcgcagggtccgctttcagctccattggctatgcaggctacttctactactcatgctcctctaacttctccttgtgttcctactcaagaggctgatgtcgccaagtggaaggtcactactcggaatgtttggagagtggagcgtcccaaggtggccaatgccactgtcacctttgttgaggtcatcaggtccaaccatcagccatcgtccgaggttggtgatgttcttgccatgctgttgcgcaccaaactagatagtgatgaggatgagctcgccaaggtggttgttgacctccaggcccagttgaaggaatcagagtccaagccggaggagttcgagctcggggcgtcaaaagagaagaaagccaacaaggagctagaggaggagctggctatttacaaggctgtcaggcaggtcaggttctttaccaagaatcttgacttaggtctttttgacccattcaaagacgtgaagaacggtgaattgcttcatgaagaagagatagctgtcatagagaaggatgccaacggggagataggtcaccttgataagagtgagatcttggaagcgtcttgtcattcatctggtcttgctaaccagtctggtggtatttccttttgccttgaggaacctagaccttttgactatgctcatcatagtttcaaaagagtgagtttaccatgctcaccaagggagaacattaggtttgtcgagcctttggagatgcgagactcacctagggaagaccttggatttgatgagcctttggagaagcgagactcaacaagggtggaccttgtgtttgactag

SEQ ID NO: 72010 - DNA, 498 bp, Glycine max
  Peptide Sequence Number=SeqID_188788
atgagggtggaattagagatgaaggatgaagtccaagagatagccagaatcaagttcacccttggtaagtctcgccaaacccaggatgaacgtgtccctggtcaaatctccaaagactcattaaacccaaggtccacccttggtgagtctcgccaaacccaaaacaaacgtgaccctggtcgaatctccaaaggcttgtcaaacccaatgtctgcccttggtgagtctcacccaacccaggatgaacacgtccttagtcgaatctctaaaggtccgcccttggtgagtctcacccgacccaggatgaatgtgtctctgatcaaatctccaaaggctcatcaaacccaacatttgcccttggtgagtctcgccaaacccaagatgaacgtgtccctagttaaatctccaaaggctcatcaaacccaaggtccacctttggtgagtcttgccaaacccaggacgaatgcgtccctggtcaaatctccaaaggctagttaa

SEQ ID NO: 72011 - DNA, 384 bp, Glycine max
  Peptide Sequence Number=SeqID_188789
atggcggctcgtggcggttaccggttgttgtgggtggtgaagaatgggtttctagggtttgggacttgtgcttggcgtgtttgtctcgctattaaagatgtccagaggtgttatttcacaaatcccaatggtaaaaacatgcagacttgggttgcaaacataaagtccaaatttgaagttatcgaaatttcatggcattatagaggtcaggtactcgacctggctggccaacatcgtcatggtaaagaaggccaatggaaatggcatatgtgcactaagtacactggcatcaacaaggcacaccccaaggatgcatatccctttcccatcatcgaaaagcttatggatggtgcgcccgacttccagaatgtaggagccatataa

SEQ ID NO: 72012 - DNA, 330 bp, Glycine max
  Peptide Sequence Number=SeqID_188790
atgtggaaaacgttccctcttgaaaacgatgtcattgccgccaaatcccccttcgtgccaccggaggccaccgaggaggtcctcctctggatccccggtgtgatcctcaatctcatcgacaaggactacaatgttgacctcgcatgcagcgatttctttgggatcctcttctggctaggtgacaaagttgtctccgtgtacatgcgcgtcgccgacgagattcaatggttgctcgcaaaggacaccactgttgtgaaaggttccggtcctgatgaggaagaagaagatatgcccaactacgacttaactgtgactgcatatgctgtttaa

SEQ ID NO: 72013 - DNA, 681 bp, Glycine max
  Peptide Sequence Number=SeqID_188791
atgactaacaacgacgctttccgccaacttcaagcccacattgcaaagatggaatatcgccatgaggaggagctcagaaaattgaaggcccaccatgacgaattggaggcttgtaccaacaaaaccctagatgaccacaacatcttgcatgcacactgccatgaaggacagacgaatcaacgacaccctttcgtccattgcatcatggaggtcaacctgcccttaggttggaaaccactcaaactggagcgctatgacggaactactaatccagacgaagacttggatgcgttcctcactcaggctaatctctacaccaatgacgacgtgatcctgtgtcaagtcttccctacgtccctaaagggggtggtatttatgtggtacggaggactccctccgaggtcaatagacaacttcaacaccttggtcgaatgcttcagttctcaatatgcgacgagccagtcacaccgcttgacttctgttgccctaactagtttacgtcaagcaggcaatgagtcactccacaagttcatggacaggttcaatagactcactgtccaaatcataaatcttaatcctaaggtggtgttacattccatgctacttgccctacgacctagtaagttcgtcgacagtctgtgcaagaagcctcccaacaacatggacgagttatgggaatga

SEQ ID NO: 72014 - DNA, 1224 bp, Glycine max
  Peptide Sequence Number=SeqID_188792
atgaagagcgaaagcgaattggttggattctgcattgaggcagcatgtgagagcagagaaagcgtggataaatggcggatgcagagccgcagtctcgatcgcttgccttctcatctcgccgactctctcctccgccgcctcatcgcccgccgcctcctttacccctctctcctcgaggttttcaaacatagtgctgaagaggttgatgtgagaggggacaactccgtggacgcagaatggatggcgtatttgggagcatatcgtcacttgcgctacttgaacctctccgattgtcatcgagtctccacttcagctctttggccaattacaggaatgagtagccttcaggagttggatctatctagatgcttcaaggtcaacgatgctggaattaaccatattctttccattcctaatctggagaggctacgtatttcagaaacaagcgtcactgcaaaaggagtcaagcttctcgcctcgcttaaaaacttgtctcttcttgacttgggtggtttgcctgttgatgacgtcgcattaacttcattgcagtttagcactgcctctgatgttgcggctgtaaaggactgctttatgagtctgtacagttctcaggtactgaaaaggctacattatattgatctctggggtagtaaaatatcaaacaaaggtgcttctgttctcaatacattcccaaagttgacctatctcaatcttgcttggaccagtgtcacaaaattgcctaaattatcatttcttgaatacctgaacatgagtaactgtactattgattctatacttgaagatgataaagctcctttggcaaagcttattctctctggggccatgttcatgaatgaagctgaagctttgttatatgcaaatacaaatttcctatcctttttggacgtggccaattccagctttcacagattcttcttcttaagtaaaatgaaagtgatagaacatctcaatctcagctcatgcatgatgggggatgattcagttgagatggttgcgtgcgctggtggaaacttgaaaagtctgaatttgagtggtaccagggttagttctgctggattagggattttagctggacatgttccccatcttgaaattctgtcattatctcagacaccagtggatgacactgccatctcatttatcagtatgatgccttcattaaaggatgttgacctgagcaatacaaatattaaaggtatttga

SEQ ID NO: 72015 - DNA, 408 bp, Glycine max
  Peptide Sequence Number=SeqID_188793
atgtgctctccatgtgactctctggttgtggggaaggtagccagatctctgggcttcaaagaagagaaggctcttgctcagagcttggccatagtcatggccagcgaaggcaaaagtggggaacagaagaagaagaagcaaagggaacatgcgaataagcttttccatgtggtgactgaaacttgggataatcccaccaaattaggagggaatcctttaaggaaagagggaagtttcaagaaaaggaagagagagagggagtacggggattggaaactgaggagctcgaggctctatatattatggaggggtgggaaaaaggaagtggctgcaaattgcaatgcagacgttcctgatgatatgagaatgggacaatggcatgtggccttacagaatggaggtcggtga

SEQ ID NO: 72016 - DNA, 216 bp, Glycine max
  Peptide Sequence Number=SeqID_188794
atgcaagctaatgccgccaataccaatggcgggacatgtgccaacgtggacagtcccaccattggctcctgcgatacacactccatgaagcccatgccgccaatacaaatggcgggacatgccaacgtggacagtcccaccattggctcctgggagaccaaggtggccacgactcaggctagtctagggcattgttcttgcattggaggaggctag

SEQ ID NO: 72017 - DNA, 156 bp, Glycine max
  Peptide Sequence Number=SeqID_188795
atggttttgggtttctatgggaaaagaaaaagctacgatgcaaagggatgtttctactctacagcagttggaggattgagatgctatgagaatccaaagaataagattactgcagttcctgctgaggaagaggacatatggggtgcattcttcaag

SEQ ID NO: 72018 - DNA, 315 bp, Glycine max
  Peptide Sequence Number=SeqID_188796
atgtatacatacattcacacagttctcattggtgatgatcccgtcagagcaaaaatcaaagacttcatagttccttcgtcgcggatctctttttcgacaattgtggcttatcgacactttaagatgaagagaaactttgatgttgtctctgataatgactcaagcatttttgacatgtgtaccgagttcaaaccaaagtggtttgaaatgctagagaacatttaccagaaattggttatccccgtgggtcaactcatcaatagagaattcgagggagacgaggataacaccacatggcagtggatgaataattag

SEQ ID NO: 72019 - DNA, 450 bp, Glycine max
  Peptide Sequence Number=SeqID_188797
atggtgtggaatagtaagccccggttgggcaccatagttgaaggtattgagccacaaggcagttggtggggttttgactcactctggttggacctctgtggtggagaccacggattgaactcaagggtgttggaagtgaagaagatggggtattcaattcctaagaacgaacgagatggatcattcacgagtgatgcggtcgctaacttaataaggttggttatggttgaggaagaaggaaggatttacatggaaaaggttaaaaatgtgaaggatttatgtaaaatcatagggaaaccagttagggtcacgctgttttgtgaaaatgctccaaccatatgggatcaacataggcttaaaggagcacttaaaccgggtatatttacccccaaggcctacactccgaagagtgcgttagggcctctccctcctgattcaggcccaacctag

SEQ ID NO: 72020 - DNA, 387 bp, Glycine max
  Peptide Sequence Number=SeqID_188798
atggcaatggcaaatggcaaaggaggcaaagcactaagccttatttgttgtaatcacatcccaaatcatgatatattaggaaatatggaaactagacaaataaggaaaggaatcaatggtgcagttagagatgaaacactgttacagttaacagttcctacaaagtttgtacagggcagcaaggatgctctctgtccacttgagaagttagaagccactcggaagaagatgaaagtacccaatgagctgcatgtcatcgatggtggtgaccactctttcaagattggtaagaagcacctgcaagcaaacaattccacccaagatgaagctgaggatgttgctgtgcaggctattgctgctttctttttcaggtctcttgaaggatga

SEQ ID NO: 72021 - DNA, 348 bp, Glycine max
  Peptide Sequence Number=SeqID_188799
atggagacatgtggcatagtctataataaaataataagaaatgaggaaaaagcctttttaaaatcaaaaagcaactctctctctcttcactcagccccacattatttcagacagctctctctctccctcacgttgccattctcttcttcttcattctccattgaagctccaagcaaagcttcaacctttggccatcatttctaccccaaatcccaaaaggagggcattttcggggtcgtgaagtgcgtggctacgagtgggacttcgaaaattcagggtttttgtgatgatgtttgtgatgtttatatgctgaaattgcttatggaaactgttagagatgaagggtag

SEQ ID NO: 72022 - DNA, 204 bp, Glycine max
  Peptide Sequence Number=SeqID_188800
atggaaagctcagcttctgcattacataaagtatctgcagaagctagagaagccaaagaaaccagaaaccacactgagaaaaatggagatcttactaatagtagtgagaaggactatgattttgatacaagcttaacaggagttttgccttctttatctgcgacatatgaattacttataaacagtttccaacatttccaatga

SEQ ID NO: 72023 - DNA, 474 bp, Glycine max
  Peptide Sequence Number=SeqID_188801
atgaccgaaaccaaagctgcggaggatgcgaaggagatggtgttgttggaggaagaaaagtgcgcgaagaaaatggtgtgcatgtggggataccttcctagagcctcgctgaagaaatctccaatactgtctctggtaccagtgaacctctctgatccttcactcgttggagattcgtggaaggacgtctgtggcgagaaagggaagctcataacgtggggttctatggacgatgaagggcaaagctacttgatattggggaagcatgggccagaccctcaatctcaccttgcattctgtgtttgtgaagaccccacgtcgtcgtcgctcttagtcccacacccacaccaccgtcgcacgaggcccatcatcacccacatcgttgcatcattgccattgattgagcaccccatcgctgagcccacgccgccattgagccagaccctcagtcacgttgcattctctagtttataa

SEQ ID NO: 72024 - DNA, 423 bp, Glycine max
  Peptide Sequence Number=SeqID_188802
atgatgagagagggtcaacaacatggtatggtgagatcttattggatcctactaaatccacttaatcctagacctaataccagaatcatcaatcggtctaattccccttacacaactagaatatttgttagggtttcttctaagccaactaatcactcaaagtacacaggaaagtgtggcaaaccacgttgccctggttgccacctctacccagcttggaaattgcacttaaagcatgagggcacacatgggaggaaagtgataccgagagaagaggttgtgatgaagattagagtcgtcgtggatgcgagaggagagagtactactataactgagggtttttttagagatagggggagcaacatgaagactaagatttggagcttgaagaagttttgtctttttacatgcccaactccttga

SEQ ID NO: 72025 - DNA, 441 bp, Glycine max
  Peptide Sequence Number=SeqID_188803
atgacaaactccagcgaaaacactgctcctgacacgaccatcataaccacagatgccactaccatccaaactaatgaaaagcccactatgcacattgaacatttatttttgatagaagactccaagaggattgggctagaagtgatgcaatcctaccccccaagggtattggatagaagactccaagaggattgggctagagctgctaaagaaggccctggggttctcatgaacctaaggcatcctctccaagattcttatccaaggcacattcttggtggtgaagctccttcttccatggacttcattgaagctcaaagatccatcctctatagaagctccacaagcaaacttccatctagaaggtatttcaatgatccagaactgagatacccagaactcattgggatgttctggaggaatgctcaactcaaggactag

SEQ ID NO: 72026 - DNA, 774 bp, Glycine max
  Peptide Sequence Number=SeqID_188804
atgattccattgcttcagcaccatcttccttatcacccttctcaaccccttcttatgctcgtgctccttctcctctctcacttcagtttaccatcttacaattttgagttcataactctcaaggacctcttgctggactcaaactacaggggagggggcatttcagtcataaactcacttaggactagcatagacaattgttacatcacacatttcaccaccaatggaattttagtccaaagtggccatgaaacctacatcagaaactctttccttggccggcatataattgctggtgaggacaaaaatgagagggacttctcaggcacaggaataagcctccagggtaatgacaatgctgtcactgatgttgcaattctctcggctgcaataggattaatggtcactgaagacccagttcaactccatatctctagcagtttcttccttggtgatgccaatattgccccaaagtccaagaatggggttgtgaatggtgttgatattgttgatcaagttattgttgataaaaacattgcaagggggatgaagttaacggccacagttgcaaaaatgtctatgcaagggaatggaacctcttggagtgttgattttaacaatgttttgcttttccctaaccttataaagaatgttcagtactctttaagctccaaagggagcagcttccccaatgctctaaggaatgtgtctgagaattgtgttgtgattgaaacaaatgaagcagtagtagtgaatcaaagtgcgttaagttga

SEQ ID NO: 72027 - DNA, 318 bp, Glycine max
  Peptide Sequence Number=SeqID_188805
atggcaaggcaaaaagttacggagcggttgggggagagtgcaataggagaagatagttttataagaaatggtaggtttagagtgaaacatcatggtcatggttgtggaggatccaacaaattaagatggactagccaatgccaacttcaaagtccattggggtcatgtgtcaatgtcaacccttacccaaaggctttggcttcctgcgccccatttcctcttacccttgctggagcttcttcacccagcttcagtagcttccacaatgtaccacaattgcttcattttcctccgtcacacttacttcgtcttccctaa

SEQ ID NO: 72028 - DNA, 423 bp, Glycine max
  Peptide Sequence Number=SeqID_188806
atggagagggagatgataatcatgataatagacacgttaccggtgttctactatgagaagatggtggcttacatgccttcaagctttgtcgatttagtgttcgttggtgaaaggattgaagtgggtctgagaagatgcaaatttgattatcctactttaatgaatagaaagcctggagcaaatggagagaataagaaggaaggaggaacccatgttgtgactgtcgttcctacatggccaaatttcccaccagctcaacaatatcaatacttagccaatatcagcactgggggtgtaaatagcaacctggccccattgaccttccagattcttcctccagaaggcggttgcttctggaggaagcaacctggctcgcctgggcgagctgggtggcaagctcctcccctattttgctataaatag

SEQ ID NO: 72029 - DNA, 267 bp, Glycine max
  Peptide Sequence Number=SeqID_188807
atgtcaagaagccacaatcaagagcttggccgggcacagaataaacacgattctgaaaagaagaaaaaggatgctgctcatgatgatattgatgattgggaacttccacatgtagatgaaaagtattttaagggtattgctgatacaatgggatgtttgcaaagggagggtcgtttgcttcagggagagcataatcttttaggcgaagcatttcttgctgatacaatgggatatttggtgaagtatgttgcaaagatcttacaataa

SEQ ID NO: 72030 - DNA, 567 bp, Glycine max
  Peptide Sequence Number=SeqID_188808
atgcattatattttttgtcgtatcttgcttccccgttcagcaaatcctgctcaagcttctaagaaggatttaattttgttgtgggtccttcaaatcggtcgtcaaattgactgggcctatcttgtctattactgtatgcataaggcattacgggcaaatgcacctcttccatacccccaacttgtcactctctttctccaacattttcatgtccctctagatgatgaaccctttgttaaggttaaacgatctttggctattggagctgctgttattgcctcctttggttatcagaaggatatgaatggtcagtgggttcagaaacaagaccttccacctactgttcctgatgaacgtacaccctcaccaccaccacaaaaggattcctcgtcttcactgctgcatgatgtgctcactgaacttcgggagctttgggcctttgtagatagttgtcatcatcaaaaagggggagaatatgaatgtatgtctataaaggttttgatgatgccaaggtgtaagcaacacaagattacttcatgtcaaaattcaagatcaagagaaagataa

SEQ ID NO: 72031 - DNA, 384 bp, Glycine max
  Peptide Sequence Number=SeqID_188809
atgttggaaagggagagtgcatggtataatatactcttaactgaggaatcgttatcgattccaattgcacgcgcagatgtagatgctgatgctgatgttgtcacgacaaccactcaagagcgctacctccctgtctccttcgaccaggccatcgatgcaacgatgccgttcttcaccacaattttggcattttttatcacatgcaagaaggagactggggaggtttacctcgcgctgttgctggtggtgttcggtatcgttgtggtgagcaacaatgaagcggagaagacatcaccgcctctctctctctctggcgtgatggagacagcggaggccttgggagggacgttagggtttctattggctgcatttgcaaataaataa

SEQ ID NO: 72032 - DNA, 892 bp, Glycine max
  Peptide Sequence Number=SeqID_188810
atgggatttgttacctggtgggagaaatattattcgggccgttcggttggagacacaactatcatgatctccagacttgagagtggttttacacaaccaacggtcgagaatatccgctcaaaccttcaagctcgaggcaaaacaatcatgacaaagaaaattgctgaaacgtctcgagctgatgtgagacccaagaaacccactggggtgaagatccaagaatggaaacaagaagagaagagtcataagaaagatgatagcaccgagactaccacgacctcaaaacgctcgaagcgtgtggtcatcgaattcgacgaagaaaaagatgcaagtcttatttctaatgaagaagaggaaagacctcttgtaagaaaaagaaaatcacctgagacttcgaccaaatctgccgaccaaacagaggcaggcgatttccaggctcaaatgcctaagaagaaaaagaaagtgaagcagatcgagcctgaaccttctgtgacggtcgagggtggtgagccagtcaggaagaaaaagaagaagaccaagtcttcaaaagaacaaggtgagaatcaacctgttgacgtccaaccaccttcgactgatgctggcggcgctgaaacagaaactactccctctattgctgagatgggcaaccttgtcgaacaaccggacttaccacaagaacaccctaccgtcgaggtacaacaaaatgtttctgtagaagaaataccctcatgtgctcgaacctctcctgctcctgagacggatgcagtgaatgttgaggaacagggtgaaggtcaaggtattggacccagcagtcctcaggggtcgagtcaaagaagttcatctgaagaacacttttctgatgaagaggccatacaagaggctgaagctggag

SEQ ID NO: 72033 - DNA, 204 bp, Glycine max
  Peptide Sequence Number=SeqID_188811
atggatattttggtttctgattcgaatcattttgctcaacatgaatctcaatccctctctgtgacagcagatcatgatcccctgcttggactccccttgacgcctacaaagcggcagacatttcaggattgtgatgatgaaccagggatctctcaaatttcacctgcgcagctttcatccaacaaattaaaaaaacatgcctga

SEQ ID NO: 72034 - DNA, 411 bp, Glycine max
  Peptide Sequence Number=SeqID_188812
atgtctgaagcagcaccacagcagcattccctccagcaagaaacagacggcgccgcagagcccgtacttacccactcaacaacatcagttatagaaaacgaggcgatggaagatactggaccccaacagacaaatccctcggaagacattccccatgctcggggtccccggatactaggagtagaagacatgggcttgcaagacggcaagggagtcgagatgacactcgagaacgaagaaggagccaacaacaactccgctgagcaaaacggccagcagggcaatgatgctggccagactgcgaccaaagaaaatgcagacggagacggagatatcacgctagacgacgccaaaaacgcaaatgaagagcccggtacctcggcgaagggggatgagcaacctaaaccctag

SEQ ID NO: 72035 - DNA, 435 bp, Glycine max
  Peptide Sequence Number=SeqID_188813
atgatctcaatcctcacacagtgggagacccgctgcggcgacgtcatcagcgacatcgaagccgagatagctaggatcaagaccgactcggcaaagcggcgcgcgaaggaacaggctcgggcggtgttatttgagaaaacgttgtcaaactggggctcagatgggggtgagtcaaacccccggtttccaggatccaaaaagcaaagttggcacggaggtgcaaagggtggttcctcagggttcgttggcaataagcgcgagttcagcggggatgacttcgatgatggatactgggacaacggtgctgatggagcctatgattcacaattttctacctcgaagatggatattgaccagggcgcaggatcgtccgctacgggatcggcgggtgctggagctagacatgcgaagcgtgttttagggaggaaatcctaa

SEQ ID NO: 72036 - DNA, 225 bp, Glycine max
  Peptide Sequence Number=SeqID_188814
atggaagggaataagcaaaagggtacttcttcttcattcacctctgagctctttgggtccaaagagtctcgtccctcttcttcttctgggatttttggctccattttttctcctccatcgtctaaggtgttagggagagagtctctgcgctctgaattgagtggcaaaattgccaatgaaacctggagctccaaaatttgtattcaagaaacgattatgaaatga

SEQ ID NO: 72037 - DNA, 405 bp, Glycine max
  Peptide Sequence Number=SeqID_188815
atgtacagaatatgcaaaactgccctcttaaaccatgaactactaagagacaataatagcgagaggttgtttgaagcacttacagtgatgatttctgatatattgggtgcatgtctcaccaatttgccccttgttatatccaccaagtgtttgaatagcaccattgaagagagggaggatactgtcagacatgcagtttacattcttggcaagaccaagaagataatagaaatgctagaaaagagagcatttccccgcgtgaatttttgccgagggaccttcattgaagattggcgtttaatgcataaggaaagcaaccttttgcactttgttccatcttcaatggagaatgacactcatacagatcctcccaaatcaagtgatctatacctagacgttgactaa

SEQ ID NO: 72038 - DNA, 336 bp, Glycine max
  Peptide Sequence Number=SeqID_188816
atgtacatcggtggtatatctctagttattgtgctaaattgtctctcgatgtgcttgaaggtgattgtggagaaggcagaaagaagtgatatcccaagtattgacaagaagaagtaccttgtccctgctgatctgacagttggacagttcgtctatgttatccgcaaaaggattaaattaagcgcagaaaaggcaatctttatctttgtggacaacgtccttccaccgacaggagcaattatgtctgccatatatgatgagaagaaggatgaggatgggtttctttatgttacttacagtggagagaacacctttggggatctgacttcccactag

SEQ ID NO: 72039 - DNA, 378 bp, Glycine max
  Peptide Sequence Number=SeqID_188817
atggatcccaaggacgagaagaagacgaaattcatcatcgaatccacaaacttttgttacaaggtcatgtcattcggattgaaaaatgtcagagcaacatatcaatgtttgatggacaaagtgtttcaggttcagcttggaagaaacctacaagtttacgtagatgacatggtggtcaaatttgacaacttgacaacccacttggcaaatttagaagaagttttcggtcaactcagaaagtataacatgaggttgaaccctgaaaagtgtgtctttggggtagaaggggggaactttctaggtttcatgctcacccactggagaatacatgctaacccggacaaatgccaaaccaccctgggaatgaggagtccctag

SEQ ID NO: 72040 - DNA, 432 bp, Glycine max
  Peptide Sequence Number=SeqID_188818
atggagcaaccggctaatcaccataacaaagacattcacgctcaggtccctaaaatgcaaaggcactacgctgaagaagttgtcgcccttcagtgcgagaagcccacaggtcgtgacaacctgaggctaacccgcctgaaggaggagaagctgaggacaagcccttcattggtcacgcggttgcccctcaactctgtggattcattcgacaccctggcgacttgttttggcacacaattcgccactagtcagcctcaccgcctaaccctatgcaagaaaccagcatttgacctcgacgaactacgaacgagagcagctaagtatatgcagatgaaggagttggtcaagtacaggaaccaagtgcgggccgatgtcatcttagccaaaaaagacaatgacaagcccagctctaacaaagctcgcgatgactag

SEQ ID NO: 72041 - DNA, 339 bp, Glycine max
  Peptide Sequence Number=SeqID_188819
atggcagggagattgactaacgcagcatcgaggatcttgggcggaaacggcgtcgtttatcgatccgtagcttcctctcttcggctccgctccggcatgggcctccccgtcggcaaacactacgttcccgacaaaccccttcccatgaatgaagaactcttgtgggacaatggcactgcatttccagaaccgtgcatagatcgtattgctgacactgtcggaaagtatgaagcattggcctggctatgtgggggattgagttttttcgcgtctctgggattgttggctgtgtggaatgacaaagcctccaagataccatttgtgagtcttctactttaa

SEQ ID NO: 72042 - DNA, 306 bp, Glycine max
  Peptide Sequence Number=SeqID_188820
atgaaaggaatgcatatgacacagatgcaatctaggaatgcgggggcccgaggaattgtctccttcttagatacaacgtctaggggtagcaaagtgccccaactggagtcaccaactgtcgcaacctacccttcggcgggagggcgacgcgtgactcgcgggatgcgtgttccacgaaaggaatacgcgcggagtcgccaccgacgtttatttgaggaaaacgtcggaaaaaccggaaaagacgcgatctacgaacttttaagtgaaaggttcgggagttgtatttacgcacggggaaggtattag

SEQ ID NO: 72043 - DNA, 159 bp, Glycine max
  Peptide Sequence Number=SeqID_188821
atggctccactgatcttacaaagtttggaaaatgacaaagtatttcttgactgcatccgcattcacgggacgagggagctcatccccatccatagtcgtaagagtcagtgcaccaccagagaaagctctcttgacgacctatgggccttcgtacattag

SEQ ID NO: 72044 - DNA, 642 bp, Glycine max
  Peptide Sequence Number=SeqID_188822
gtgacatcaagaaaagatcaatggcaatattgggcgcataaagaagaaccttatagctttgtcactgtcaagaattttgctgaagccttccagtcatttcacataggtcaacaacttggagatgagttggccaatccttttgacaagtctaaatgtcatccatatgcattgaccacaaagaactatggtgttaagaagaaggagctgttgaaggcttgtgctagcagagaatttttgcttatgaagcgcaattccttcgtctacatattcaaagccacacaacttacttatttagctatattgacaacaacattatttctacgaaccaagatgagccgcaataccttggcggatgcagaagcttacatgggtgctctattcttcacagtcactgttgctctgttcaatggaatatcagaactgaatatggccgtcatgaaacttcctgtcttttacaagcaaagagaccagcttttttacccttcatgggcatattcttttccaccatggatcctcaaaataccaataacccttgttgaagttttcatctgggagtgtattgcttattatgctattggctttgatccaaatattggaaggcaagaagaaactatgatcattgctcctcaactatgctactaa

SEQ ID NO: 72045 - DNA, 396 bp, Glycine max
  Peptide Sequence Number=SeqID_188823
atgtatgtagctcttgtactcatggtgagcatgcttacaagcaataacaacatgagaacaaggcatgtgaaatttttgcaatttgccacagtcacaccacctttcatccagcctaaccgtgaaatttccagtgggccaaacctttctcgggttaattgtttcttggaccaagaaccatgtgtcgcatcgattgaactcaagaacaatgtgagtcttccatggccttgtttcatacttgcgtataaacttggtcagatgaagaagagtcatgcttctgttgtttcaccatcgacaagggcaaaggctattggaaggattttattgttgtcatcttgtgcaactgccacaatgaaggtccccttgtacttaccatacaatcatgttccatcgacctga

SEQ ID NO: 72046 - DNA, 366 bp, Glycine max
  Peptide Sequence Number=SeqID_188824
aaagctttttttttagtagtgtctccaaaggctcgtcaaacccaaggtccacccttggtgagtttcgcatctccaaaggctcgacaaatccaaggtccatccttggtgagcctcgccaaaacccagaacgaacatgtccctggtccaaagctcgttaaacccaaggaacacaacaaaacccaaggtctacccttggtaagcattcctacaaaaactcaaggcatgcccttggtaagcccactcctttggaactacgacgagcatagtctaaagtccaagctccacaaggcaaaacaaactatcaccagactggtcagcaagaccttcaaccgggtggaaatcatactaagtcgtcactggccttag

SEQ ID NO: 72047 - DNA, 195 bp, Glycine max
  Peptide Sequence Number=SeqID_188825
atggtagaatcatccaagaaacgaaagggatcatcttcaacactattctcatctgatgaacagcgtctccgtcaaggtgcaccttttgagggcaccattattgacgactggaagtttgatttctcaagtcatgatgcccaccgtatggtctgcaatgatcaggcggatatgaccggtagacttcttgccaaatga

SEQ ID NO: 72048 - DNA, 111 bp, Glycine max
  Peptide Sequence Number=SeqID_188826
atggctgaaacttcgaaaaagggaaagggcacttcgagtcggagtcaacgtgtatatatgtatattcctggtagaagtatgtacattgggggggaaagatacgcaggttag

SEQ ID NO: 72049 - DNA, 216 bp, Glycine max
  Peptide Sequence Number=SeqID_188827
atgtcctcatgcttcctcagattcactacttggacttccattagtgatcggtcgagtggaaaatttggaaataagccaaaaactcaaaatgggggtgaattgatcaatttagggggtgctcttcagccctgggcccatctaggccaatcaggaagcttctacataaagcaaccagctggcatgggcgagcatgttacttcaggcttaagccactag

SEQ ID NO: 72050 - DNA, 327 bp, Glycine max
  Peptide Sequence Number=SeqID_188828
atgccaatctccccctgcaaaagtatcagttggtctgtgtcgtcccgacatgggatgcccgtaccccccccccccccgcggcaaggtcacatcatcatagggattgcgcctgcaagacacccagtggacccgaagaagtccaacagggtcttggagttgtcaagctctaattacgggtctctgtcagttctacggagtgtctgtcgcccccagcaaagtcatcagacccccctaccaatcgagctttcatcaagaagtactgcgcccccaggcaggcgcagggcgaaacaccacagcagcattgggatggccggtagtgggcaatag

SEQ ID NO: 72051 - DNA, 603 bp, Glycine max
  Peptide Sequence Number=SeqID_188829
atggctcccgaagacctggagcagctgatgcaacaaattagggaccaactggaggagtcgatcatagaaaaagtgactcgacagctaatgttatccttcagccagatgcagttccagtttcagtcacagatgcaatcacagggactcgcactgcctcctgagcctgaggttggtccttcaactgctcgtgtcagcacaaaggagagttgtgttaatccctcagggaatgatccagacacggatgactcagacaaatgcaggttgtacatcgaagaaaatcctccccgcctggttgtcctaggaaaagtttatgagggatccataaccattcacaacattcctttgttgcatgatcaagtcaaggttggttttaaggaggttagagatgcagatgctcccattcctgtacccactaaagaggttaagttagtggagcagacacttaacaccttccttgcttggtcgacacatcttgtcaagcatttatcagaacagggagctatgggaccggcaaaacctgcagataggccggatcatgatgtcgatgatcccctatatctaatgacattgaccatcccacaactttttctgaagccattgcag

SEQ ID NO: 72052 - DNA, 183 bp, Glycine max
  Peptide Sequence Number=SeqID_188830
tcggtctccttcttggcatcaagagtcgtcagtactgaaaaaggccctggcattaccatcgggaaatctaggaggacagctcgccgagcctatggtggacgtcggttgggttgtcgacgattacgaccattcaaaggcatttttccattagctggagtaggaagggtgaagataggaaaatag

SEQ ID NO: 72053 - DNA, 585 bp, Glycine max
  Peptide Sequence Number=SeqID_188831
atgacattagttgaatacagcgagtcatctgagaacacgctgacttgtttgtctagtctgcaacaggcatgcccggtatcaacccaagctttcattgtcataggttggccatatgtaaagacgccaagcctgttgcccagaggaagagaaagattggtgaagaaaggtgccaagcagtgcaacaagaaaatggccaagctgacgattattgggttcattctactcctcttggcagatctaaaagaagtttttggccagctcataaagtacaacatgaggttgaaatccgagaatcgaggccataaatgtggtgctggtgcaggaggaaggaaaggagtagagtccggtaaactttgtaagttgggtactgcaagatccgaagacaagcttaggggagaatttgaagaagtgcaagtgactcacataagccaagaggtcaacgacaagaccgacgagttggctcagctagctacctcccctgagcctagacagcttaaaaccttcattcttcattcggtgctcaaacccaacgtctcgggaaaagaatgtttactagtgaaagaagctcccatagggtggaagtag

SEQ ID NO: 72054 - DNA, 417 bp, Glycine max
  Peptide Sequence Number=SeqID_188832
gcacccgagacctcagcaaggaacatcaagcagacgaccctttggcacagaagacctttcagcacgttcaagaatcccttcatccctagtgttatggaggcgactcttccctccaattggaagaacttaattattgataagtacgattacactatagactcgaacgagcacttggacgtctacattacccaagtgagcctgtacaccacggggacgaaatcctctgtaggcctatgtaagaagccgacatctgatcttaacaaactatgcacgagactagccaagtacatgcagatgaaggaattggccgaatattggaaccagacatgggtcgatgtcgtgtcggccaagagagatgatgacaaacccagctccagcaaggcccgtgatgaaggaaggagggattggccaccgtag

SEQ ID NO: 72055 - DNA, 417 bp, Glycine max
  Peptide Sequence Number=SeqID_188833
atgggaatgggagacacaaaagaagacgtacaacgtatgttcctcgcagacaagacggcaacaattatgaaaaaagtaacggagaaagagaatgggagtttctttgtggtttcgatgcattgcatgccctttccttttctttttgctgtgatgttcttttctttttggtcattcggggatactgtttctgtcgtttccaatactcagaccgagacagattcatatgatctaattgaccatattatacatcatttcacaaagaatcccaacttctccagagcagcttcaccaccctttgtccattatttgtcatgcacacctccctcaacacttggtgagcctgtcatgcctcctccgacgacaaagcttactaaaggaggcacaacatgcttcataaagtcggaggagacacaatag

SEQ ID NO: 72056 - DNA, 528 bp, Glycine max
  Peptide Sequence Number=SeqID_188834
atggaaatcatgaccattgtgccaccattgtcgaccacatcgtgccaccattgtcgcctgcgtcatcccaccatcgctatcaatcgccactatcgtgtcgtccaaccccttctcctcgtgtcccttagcctctacttgggaagtagaaaagaagacaacattcatagtgcaagtctagcacgaagcaaagccttccattttcccaacgcacaggcactggcacacaagctgcgctcactcttccacgtcataaccctcattcctgaacaggtacgccaactccacaccatgcattcccctcagttattgggccttaacattgctgacagggttggccttctcaaggagattgattttggggatgaaggggagaaagggagaaagggaagaagaggagaaggggagaaggggttggaaggtgcagtggcagcggttgacaatggtggcggcgcgacgtggtcgatggtggtggtggtggtgatttctgttggagaaggggagaaagggaagaaggagaaggagaaaaag

SEQ ID NO: 72057 - DNA, 501 bp, Glycine max
  Peptide Sequence Number=SeqID_188835
atggccgttatcacttcacgtgctccgttctccgttcgtgtcagtacctcaaccacgtcgacgccgctcgccggcgacacaattccggcgctggtaatgtcagaacagcagacacccaatttgcagtcgcgggtcgcggcagctccgtccattgcggtggccagaaatctagggttccggcccacccctgaattggggcttctctctcacttgttcgttctctccatggcttttggggcgtttttctcagtagcagtgttttccattccaaccttaattgcttttggaagattaggagcttcagtgaagaaattgtcaaaggttgtttcagaagaggtacctggaactttacattctctgaaactttctagcatggagctgaacgacttgacccaacaacttagtagtctcaggcataaaattgcgggcatttctaagggaaagcaggacagcagcactgccagatcaagatcctttcgtaaggggaacccagcatcctag

SEQ ID NO: 72058 - DNA, 1048 bp, Glycine max
  Peptide Sequence Number=SeqID_188836
gagaagctaatgcttccgaagcaaagattagggtgtggcagtgggaggtctatggtggtctgtttgtggagatttatgctttggtggatgacatggatgagttacatcaaaggttgtgcaatgagatgttagtggatagtgagcatcgccgactgctagtctcagagttctggaggaaagtgcaagccaaggaaaagccaatggaggggaggcctgtgcttgatgatgttgtgtttaaatatccggggcttgatgggttcaatttcagtttctttcaggttggttgggagttcttgtgggatgacttgatgacttttgtgatggagtttttctctttaggtgttttgccaaaggcagcgacgtcatcgtttgtggcattgatttcgaaaaaggatcacccccacttttttcctggccggtgcattttggatgttgtggttgtggctaatgagttggtggacatagtgaagcagagtaagagagggtgtttcatgttcaagattgattttaagaaggcgtatgatttagtgagttacgattttttggactatatgatgaatcaaatggattttgatgacacttggaggaagaggggggactcgttggccccatttctttttttgatggtggaaaaagggttacatggtttggccgagaaggcaagggagatgggagattttaagagtctcaggttaagcctgatggtggagttttctctgcttcaatatgctgatgattcgattatcataggggagccttattatggtaatttgttggctgttaaagccattctatgtggctttgagttggtgtcgggtttgagggaagggtttatggatattgcctctaatttcttgcattgttcactatccaatgttctatttcagtatcttggtattctaataggtgttagtcctaggagggctttaaaggctctcaacgcgtgttatagccacattggtgagtattcaaaggaggctaaggcggatgaggggttagggatgaagaacttagcaactttcgatgctagtttgctagataagtgggg

SEQ ID NO: 72059 - DNA, 1079 bp, Glycine max
  Peptide Sequence Number=SeqID_188837
atggcttgccctcccggggcggtgtcggctcagattcccagcatgcggtgcagtgatccggcgtccgtgccgctgtcggcaaagtcgtcgaaggcgcgctcggtcacgcggatgatgtggtcgcggatgaaggcggcgccctcgcgtgcgccgtcttccgggtgcttcaggcagcactcccattccagtaccgcccatccggggaagtcgtactgggcgaacttggagaagatcgccttgaagtcgatctggccgtcgccgagcgctggcgcggtactccgcgtccttgacgtggaagatgccgatgcgcgcgtggtagcgatcgatgaaccccagatagtccatctgctgcagcagcaggtggctggggtcgtacaggatcttcgcgcgcgggtggtgatcgaccacgtcgaggaagcgttcgaaggtcgcaccgtcgtgcaggtcctcccccgggtggatctcgaagcacaggtccacgccgcaggcgtcatacgcatcgaggatggggcgccagcggcggccgagttcggcgaaggcttcttccaccaggccgggcgggcgctgcggccagggatagaaatagggccacgccaatgcgccggagaacgtggcatgcgcggtcagccccaggcgctggctggccttggccgccagcagcagctgctccactgcccaggcatggcgcgcggacgggtcgccgcgcttttccggtggtgcgaatccgtcaaacaggctgtcatacgccggatggaccgcgaccagctgcccctgcagatgggtggacagttcagtgatctgcacgccatgcccggccagcatgccggcaaggtcgtctcagtacgcctggctgcgtgcgggctcggccaggtcgaacaggtggggcgcgctggtcggcacttgtacgccaaaatagcccaggcctgcggcccatccggccagcgagtccagccgatcaaaaggagctgtgtcgccgatgaactgcgccaggaacagcgctggacccttgagcgtcttcaacgtgattcgccctcgatgctttcgattgctttatcctatcaggggctcacgcacgatct

SEQ ID NO: 72060 - DNA, 195 bp, Glycine max
  Peptide Sequence Number=SeqID_188838
atgtcgcgcctgggcgcgatgatgtttctacagttcttcatctggggggcgtggttcgtcaccctgggccagcgccagccaggtggcgacggcgttcctcagccagtccatcggcgccatcgtcgcgccgttcctggtcggcctgatcgcggatcgctacttcgccgcgcagcgcatcctggtgggatcctctag

SEQ ID NO: 72061 - DNA, 984 bp, Glycine max
  Peptide Sequence Number=SeqID_188839
atgcgttcgtgggcaacgggttggggcgatccccattgcttcgatcatgctcgaacgccaggacggtgcgctggcgtggagcctgctgctgctcaatgcgctggcttggcccgcgctcgccctcgtgctgacccatcgctcacggcagcccgcggtggtccagttccgctgcatggtgatcgattccttctttggcggtgggctggatcgccttcatggggctcagcgtggtgcccagtgcgttgttcgccgcgctgctggtcgccgacaaagatcgccgccggcggggtgaagctggcggtacgggccacactggcgctggcagtggggttcgcgctcacctggtggggactcgggtttccctatcagccggtgtcatcgcagcgcacgatcgtactcagtgtgccgttcctgttcgtctacggcatcggcctcagcatcctcagctggcagctggcgcggcgggtgaaatcgcagaaccgccagttgaagcggctgagccggatggacccgctggtggagctggccaaccgcggcttcctgatcgtccgcgcgcagcaggccctggacaaggcgcaggggcagggtggtttcgcctgcctgctgatgcttgatgtggatgacttcaagcgcatcaatgactcgcatggtcatcgtgccggggacgaagtgctgcgccatatcgcctccaccttgcgcgccttcgcccggcccggcgatacccctgcgcggctgggaggcgacgagttcgtcgtgctgctgcaggactgtgcgcccatcgatgcgatgcatgtggcagagcgggttcgtctgcaacttctggaagcagcacggcaggcaacgccgggcatcgagttcagcgtcagcatcggcattgctgccaccccgcgcggcggcagcgtcgaggactggctggcattggccgaccgcgcgctctaccacgccaagcgccagggcaagaacaacgccagctatggcgaatga

SEQ ID NO: 72062 - DNA, 459 bp, Glycine max
  Peptide Sequence Number=SeqID_188840
atgatccagagacaggttggtgttgaggaggttaaagatgcagaggctcccgttcctgtacccactgacgaggttaccttagtggggcagatacttaaaacctttcttgcttgggcgacacatctcgtgaagcatttatcagaacaggcagttgtgtctccagcaaaacctccaaaaagcctggatcatgagcctctccaggttatgtgggatgattccttattcgggctgtttaattcagacttccccttgtacataaaacatgaagatctatctaaaatagcacacggtggtcaatgtttcagcatctctgttatacaattgtggattctgcatctgactgagacaagtatgcgagcggggaattccgatgtgtatggattcctcgagccacagtccattcagagatctgggcaatcacaatttgaatcaaaaagttacatcaagagttggatgtaa

SEQ ID NO: 72063 - DNA, 132 bp, Glycine max
  Peptide Sequence Number=SeqID_188841
atggagaggaacctagtgtttgctacccgtgatgacgttttgcattgggctcgctctgttgtgtatgatattggttttgtggcgatgataatgaggttagacacaaacactggaaagagaggaaaaacctaa

SEQ ID NO: 72064 - DNA, 255 bp, Glycine max
  Peptide Sequence Number=SeqID_188842
atggcagatactgtagattcgccattagattatttgcaattgcaaggtagcaccaatccgaattttagctttacttacctattatttaaaaatccaaaaagatataccaaaaaaaaggtgccaagagctactagaaaggagaaggttggggccatggctgttcgagggagatcaccaaaaaagttgcttcatgaaagattagactatggaagctcgatagatgatttaagatgcaccaaaccaacgtttaattag

SEQ ID NO: 72065 - DNA, 816 bp, Glycine max
  Peptide Sequence Number=SeqID_188843
atggaagatatgatcaaaaccaaagcaaaagcattagaagatatggcacgtgccaatcatggatgtaacaagttgagggatgaagagatcaagttgagaaacaaagaaatcgatttgcaaatcatctacaagatattgctgcccccagcatcggcacgtagacaacgggcagctgcagttgttgttgagaatgttgagcatgtggatcatgttgctaacgaggttcatgaaaagcccttggagccaattatggatcatgaacgtactgagttgaagttggcctgtcatgggaggaagacagacaataagggacttttatctacttttgcagagaggtggcacaagaaaactagtgccttccatacctttgatgctattgatgtagaggaaggtagtgacttgttagttgagttgcttaaagtcaatagacaagaagcaaacgacgagactgagcaatgcagaggcacatatggttgcacactctttgctaacaagagtgccacacacatcagtgtggtattcttgaacacattttgtgacctcggccaatatggaggctattcatggggagcagctgtactgatccacatacaccaactagagagggtagtgcgacaatttggttatgttcagaccattcctccactccttactgcttcatcctcatccatagaggaggttgggaagcctcctagacatccactcgtggtgcatgaggatacatttattgtaccaaatccacctatattgctcgttcactcaacagctatgccaggaccacttgcacctgcagctgccaatgcagacattccttga

SEQ ID NO: 72066 - DNA, 2286 bp, Glycine max
  Peptide Sequence Number=SeqID_188844
atgagtctcctctttccaactttgataatctcattggttattcttctcgtcactgttaaccaatgttgcgctctcagtagagacggtgttctgttactctccttcaagtacgctgtgttgaacgacccactctacgttcttgcaaactggaactacagtgatgagactccatgttcctggaacggagtttcttgttccaacgaaaaccgcgtcacgtcgttgttgcttcccaattctcagtttctaggttcggttccttccgatctgggttctattgaacaccttcaaattcttgacctttccaacaactcccttaacgggtctcttccttcgtctctctcccaagcctccgagcttcggttcctgaacctgtctaataaccttatcacaggtgaggttccggagtccttgtctcagcttcggaatcttgagtttcttaacctctccgacaatgccttggcgggaaaattgcctgaaagtttttccaacatgcaaaacctaactgttgcttcgttcaagaacaattacttgttcggctttcttcccagcgggttaagaacgttgcaggttttggatctgtcttcaaacctcttgaacggttctcttcccaaggatttcggcggtgataatatgcgttacttgaacatctcctacaacagattctccggcgaaatcccgacggagttcgcggcggagattccggggaacgccaccgttgatctctccttcaacaacttaaccggcgaggttccagactccactgtgttcacgaatcagaattcgaagtctttcaacggcaactttaatctgtgtggagaaataacaaagaatccttgtcctattccttcttcgccgtcgtcggagccaaaagcttctgctcctatttctcctcctgcaatcgccgcaataccgaagagtttcgatgattctcctttggcgccgacggggcagaaacagaggggtctcaaacaaggaacgatcataggaatcgtggtcggagacataatcggcgtgggaatcttggccatgctgtgtgtctacgtgtaccgtttgaagaaaaagaaggatgcggagagcacaaagaagaagaacgaagcggctataacaagaagcagaagcgagagttcctcgtcaacaacctcagaatccagaggcttcacgaggtggtcgtgtttgaggaagagaacggaagaggaagattcttccgagacaacaagctcttccgaaagtgaagtggagggagccacggcggcgacacatgataataataataataacaacacggggactctagttactgtggacggtgaacgacaactggaggtcgaaacgctgctgaaggcttccgcgtacatattgggtgccacggggtccagcataatgtacaaggcagttctggaagacggcacgtcgttagcggttaggagaatcggcgagagtggcgtggagcggttcaaggacttcgagaaccaagttcggcttattgctaaactggtgcaccctaatctggttcgcgttcgtggattctattggggacacgacgagaagctcatcatctacgacttcgttccaaacggttgcctcgccaatgttcgttacaggaaagtggggtcctcgccgagtcatttaccgtgggaaatccggctcaagatagctaaaggagtggcacgtgggctgacttacctccacgagaagaagcacgtgcatggaaacttgaagcccagcaatattctattgggcaacgacatggagcccaagattggagacttcgggcttgagaggatagtgacgggtgacacaagctataaagctggcgggtccgcgcgtatttttgggagcaagagatccacggcatcacgagatagtttccaagacatgacgtttgggcctagcccgagcccgagcccaagctcaataagtggtgtgtctccttatcatgctcctgagtcgctcaggaacttgaagcctcaccccaagtgggacgtgtactcttttggggtaatgtttcttgagttgctaacgggaaagattgtggttttggatgatatgggccagggtcccgggcttttggtggaggataagaaccgggccttgcgcatggttgatatggttatacgggccgacatggagggtagggaggaggccttgttggcctacttcaagctagggtatagttgtgtctctagcattccccagaaaaggcctccaatgaaagaggcactacaagttcttgaaaagatctcatcctccttctcttcttcttcctcttatcattatagcgtctaa

SEQ ID NO: 72067 - DNA, 276 bp, Glycine max
  Peptide Sequence Number=SeqID_188845
atggatgagtttagagatgaattagtgaaaggtgaagatgatgatgatgatgaatctttatccgattactgtgaaacccaattcagcaccaacaacatgaacaatccagtggttcaattcaacaagtacagtgaagagaaccatgaatcaaccacttcaagtccaaaacaaacttggttcaagagatgcggtgataatagtgatggcaatgaccaacgagagagtggcaacaacggagtgaaggttcaagagaatgagggtttcaaagtgagctag

SEQ ID NO: 72068 - DNA, 702 bp, Glycine max
  Peptide Sequence Number=SeqID_188846
atgggttacatagaatctgatcatgtacaacatgatgtgccttaccaagttgaggaaatgtcacatgtaaacgaagtcattgaagttgaaagtatttgtgcattgcaagatttagtaggaggtgtagaagaagtagaccctactaatttgttgagaaatgaagaagattcaaataatttaaatggagaatcaaagaatattgaacaagacaatgaaggggaattagaagatgaatttgaaatatgtgatcaggtggtgctgaccctccccaaccccattcacatgattcaagtgggaaatgggcagttgcaaagaaaggacgatatgtggcctcccgatgttgcacctacaccatctccacctctgactgaagctagaccatcctcatctcatgttaatgcacgtggaccatctccagtacctacatccaccccatctccatcctccgttgatgcacgtagactgtccccagtacctacacccacaccttccccatccccgcctgtgggcaacatgcctacaaatgaagatgctataaatttggcgatggaagaccctccccttaatgatcgtcctatggttacgctaattaatggagcgtttcatccatctaaggttacggcaaaggctgtcactttgtccattaggcaacaatttggtcagccttggcctacatggggagcgattccaaaagatcattaa

SEQ ID NO: 72069 - DNA, 267 bp, Glycine max
  Peptide Sequence Number=SeqID_188847
atgggagaggatcatccttctccctatgattattatatctacattgtgcaaattttttgtcaacgtggccactggcttaatgttaaacaatgtcgcaaagagtatcttgatgtcgcagaggacgatcatgtataccgatttaagtccctggagaagcttccgttggtgtcattggcatggttcaccaaggacgagagcaaatcctcatttctgaaacgttgcaaggaaagtggcaacgctgagatcgtgtactgcgaagcaatataa

SEQ ID NO: 72070 - DNA, 396 bp, Glycine max
  Peptide Sequence Number=SeqID_188848
atggcctttgttcacatcctgattgggtttcatcgagcacatgacgagtgcccatctttcccgaagctccactttcataaacacccatcggtactacaattgatcacaacggaaattggcatcacgggccacgattcctccacgccccccacgcgcaagcacctagtcatgctcaactccccttcttctcctcaccatcaccaagaggccgtgaggacagtgagggcgggaggagaagtgcatggcggcgatgaggagcttcgagggggcgccgtcgagggtgccgacgaagacagggccaaaattgtcgtggccaaggcgcttggagaaggagttggtggtgtggcggcggaggacggagaaggagaggcggtgcggcagggaggtgatggctag

SEQ ID NO: 72071 - DNA, 1413 bp, Glycine max
  Peptide Sequence Number=SeqID_188849
atgtatccacgatcaaatgcgtcctttaacatgcaaacattgatgcaaataaggcagtggcactttttgaaggtagcacactggttaatcaaccatcaaacaattgaggcatcaaacactcaaagtaacaatgaagaagtgcaaactatgaatgttacatatggaaactcggagaggcaagatgaatcaaacaatgatggatgctccaatgttgaaaaagctcaaaagaaaaggaaacatggagaagcagcaccactggcaccaccatccactaatcccacacccactaatcctattgctggagagccaggtaaaagcaaaccatgtagacctagatcttgggcttgggatcatttttcaaaagatgaaagttgcacaactcaaaaaagagctaaatgtaattggtgtaaaaaatcatatgttgttgatacacataaaaatggtacaagctctattataaaccatttggtgaatttgtgtaaaaagtttcctagagagtctattccttctcaacaaattcttagtttccaacaaatgaaaaaggaagatgggaaaggaactggttctattcttagtagtgtgcattttgatgttgaggcatgtagagcaactctagctaggatgataattgtcgatgagttgccttttaagtttgttgagggagagggatttcttcattttatgagtattgtgcaacctaaactaccaattccggggaggattacaaccgctagggattgttggtctatttacacaaatgaaaaacataaattgaaatctgtctttaagaattcaaatcaaagtgtgagcctcacaactgattgttggacttctgtgcaaaatatgagttatttttgtcttactacgcacttcattgatgaaaactggatgttgcataaaataattcttaatttttttcaagttaagaatcacaaaggagaaacaattggtagaaaaattgagaaatgtttggagagttggataataggtagagttttcactattacagttgataatgctagctcaaatgatgttgcaatatcttacttgaaaaatagaatggaaaattggaacacacacccactaaaaggggaacatatgcatgttaggtgttgtgcacatattttaaaccttgtggtcaatgatggattgaaggagtatcatccttcaataagtagtagaattaggaatgcggttagatatgttcgtgcatctcctagtcgcatggaaaggtttaaaatttgcattagtgaagctaggatacttgacaaatctactatgcaattggatgttccaactaggtggaactctacctatataatgcttgaaagtgcattgaaatttcagaaagcctttaagagattgggtgagaagtgtgctgaatgtgatattgcaaggtggtatcccaactaa

SEQ ID NO: 72072 - DNA, 204 bp, Glycine max
  Peptide Sequence Number=SeqID_188850
atggtacctcctgttgagcctgaggtagctcctttcggtgcctgtgtcagcataaagggaaactgtgttaatcccttaggaatttatgatgggtcaacaatcatgcaccatgtccctttgggtaatgagctggataaacaggtactagagggaccaacgaagcctgttgataagccgaaacctgatgacgataccatttactag

SEQ ID NO: 72073 - DNA, 138 bp, Glycine max
  Peptide Sequence Number=SeqID_188851
atgggttgggccaggcaggaccgtccactagctcgctatcaatttggcgaggcaagagtttattttctcaaagggtgggtagcccgtcagcccaccttcaggtgggatgggtcagcatgttcaactcgtcaagtctaa

SEQ ID NO: 72074 - DNA, 222 bp, Glycine max
  Peptide Sequence Number=SeqID_188852
atgacgaagaagagcccagaaatgagaagaggcgttgacgaagaagggaagcgttgtggtggtggtgtgcgatttaggtataagggatcgccaggccaaggatccactaccaccgtcgtactcgttcgagctagtcaccaagtcgaactatcgactttgataccaattattgtgcaaccgaggggggtaaacatcgagaagatttacaccaatgggtcatga

SEQ ID NO: 72075 - DNA, 204 bp, Glycine max
  Peptide Sequence Number=SeqID_188853
atggagtggttttacatgatatctcatcctttcatgactcccgcacagcttggggatcctcctagacatccacctgtggtgcatgatgacacatttgttgaagtagatgttcctcagcagcctgtggcgacaacgactatggacgaagcacctgcaaatgcacatgctgatgtagggcaccctcaacgtgtagtggaggcttga

SEQ ID NO: 72076 - DNA, 624 bp, Glycine max
  Peptide Sequence Number=SeqID_188854
atgggaaagtggttttcagaaaattggatgaggttctttgttgttcctgttgttctacgttttggggataacacaaagaagggcattaccttgggcacccaacacaagtgttgtgccgctactcctttctttttcttccgttcttctcccactgttggtgccgcttgtcactccattgcggttgtcctcgctttctccttcgttgctattatggttagaaccagaggtttgggtcgagcttcaagcaggattataggaagaacattaggtagagaagtaagtcgtgatgccaatgaaggcccccaacagaaaaggcccacaacatctacacgtaggcaacgagaaggtgcatgtgttgctgaggatgttaagcatgtggatcatgttgttgaagagcttcataaacagcctggagaggcacctgttgatgatgtagttagtgatgctgagggtgttccaggaggtccccacgatacatcagttttgatggactatgttcattatgtggcagtgacaatttggaatgaagaggaacctgagttgaagttatcctcccatggaaataaggtagagaaatttggcaggcctgctccagagattgaagtcttaatggctgccacatga

SEQ ID NO: 72077 - DNA, 201 bp, Glycine max
  Peptide Sequence Number=SeqID_188855
atgaatccattgaccaagttgatttttgggctaactgaggaagaagaggaacaagcacctcttgaacttgatattgatgctcttgaaagtgttttgtatcatgagaatgaaattccaatttgtgaaccatcaaaaaataatgaaggtgatgaaaatcttgacactatggtgtttcaagttgaaagtggtgatggtggttga

SEQ ID NO: 72078 - DNA, 570 bp, Glycine max
  Peptide Sequence Number=SeqID_188856
atggaatcagcataccccattagagcattgaatcgccatttgcttcgaaccgcgccatgctccgttcggatcctagttgagcgtgaaaacttgactaggaacaacccttcaacttctgtgtccttctacagtgttggaattgtgtttatagaagggccagatgaccgtgaagccttggcatatgcaatacacatggcatatcactcgaatgtgaaggtcacaatgcttcgtttaatggagcctcacaagaagagtagacaattgatcaacatagaccctgatggtgacttgattcacaagtttatggttgactacctccaaatcaaacgccatgattacagagaggaagttttgagagatagtgagggaatggtcagtatcataaggtcactcgaaggttgctatgatttgattttggtgggtaggcgccaagaaagagagtcttcattgtttagtcgattaacagagtggaatgagtacccggaacttggttatatagcaaatatgttatgtcttcggattcaacttttgatgggtctgtgttggtggtacaacaacaaaataggttag

SEQ ID NO: 72079 - DNA, 213 bp, Glycine max
  Peptide Sequence Number=SeqID_188857
atgtggcccaaagcaagtgccaaagaccctggaaggtcagtgcacttcgccccccacaaacatacacaacatccaacgtatgaacgtggcccaaagcaagtgccaaagaccctggaagaaaccgcaagccaagtttggatgatttcgcttcgtttgaagggttcctctcggtgtggggtttcaacgagaacaatggcggtttgtggtggctaa

SEQ ID NO: 72080 - DNA, 186 bp, Glycine max
  Peptide Sequence Number=SeqID_188858
atggacgtggaagaagcttctgcacccaaagagggaaagcccgttttggtgatcttggcgggagcacctgggagtgggaagtccaccttctgcgaagaagtaatacgcgtctctactcgcccctgggtccgcatttgccaggtttggttcacttcattctatgtgttcgatgaaatgtctcactag

SEQ ID NO: 72081 - DNA, 966 bp, Glycine max
  Peptide Sequence Number=SeqID_188859
atggcgatttttcagccagtcgctggcgcattttttccgccgtcgcgctttattcgctggaaatttcgcccgaaaagcggtgatgtctgcacctctttcccatcccaaactggcgccggtagtgctgccggttgccgtattactgatcgccatgctgtcgctgcagggcggcgcatcgctggcgaaatcgctatttcccaccgtcggtgcgcctggcattaccgcgctgcgtctgggactgggcacgctcatcctgtgcgcgattttcaaaccctggcgcctgcgcttcagtgcaaagcagcgcaaaccgctgctgatgtatggactggcgctgggctgcatgaattacctgttctatctctcgatccgcaccgtgccgctgggcgtagcggtggggctggagtttctcggcccgctgacgctggcgctggccggcgcacgccgtccgctggattttctctgggtgctgctggcggtcaccggcctgtggttcctgctgccgattggtcatggcctgaaccatatcgatcccaccggcgcgctgctggccgtgggtgccggcgcctgctgggcggtctatattctggcgggccagcgggcaggcgccgaacacggcccggccacggtggcaatgggctcgctgatcgcctcagtgatttttgtgccgctcggtctgacctttgccgcacccggtatctggcagtgggaaattctgccgctggcgttgctcatagccctgctctccagcgccattccttactcgctggaaatgatggcgctgacgcgtctgccggcgcgcattttcggcacgctgatgagtctggaaccggcgatggcggcgctctccggcatgctgttcctcggcgagctgctgacgctgcagcaatggctggcgctgctggcgattatcgccgcatctgctggctcgacgctcaccatgaaacagaaagcggcacatataaatga

SEQ ID NO: 72082 - DNA, 393 bp, Glycine max
  Peptide Sequence Number=SeqID_188860
atgtacatgatgaggttatcgactctcaatgagtatgggagtggagttattgacatcctcattgggagtgtatgccacattgggtggtgtaaagttgggagccaagccatatgcatgatgataaaaatgcaaggatcatgcatgagcggagttattgacatcctcattgggagtgtatgccacattgttttcgttttgcagaggaaaatgcaaggatcatgcatgagcaaacgtgaaaacaaaaggaacgatacgtccattacgatgccatggagagatgcttatgcgatgcatgatatgaatgcatttacggacacgagagcccgaaaaatcctctcctcttacttgcgcatttgggggcgcagtgccccatgtgtgcagttaagaaggtga

SEQ ID NO: 72083 - DNA, 408 bp, Glycine max
  Peptide Sequence Number=SeqID_188861
atgaagaagtattttgagcaatttggtgagatcttggaggctgctgtcatcactgacaaagccactggaagatctaaaggctatggatttgttacttttcatgaaccagaagctgccatgagagcttgtgtggatcctgctcctataatcgacgatgggaaagctaattgcaaccttgcttctttgggtgtccagagatctaagccttcaaccccaaaacatgttttcataagaacaaattacgatgggaacataaacatgcttcaaagagaagtgagcacaaagagcacgtacacagaagcacaaagttacaatgaagacatgaagcttacctcaaactcaacaccgacaatggcagcgagactcagctattcaatggtagcggcaatgggtctcaggtcaccatga

SEQ ID NO: 72084 - DNA, 183 bp, Glycine max
  Peptide Sequence Number=SeqID_188862
atggccaacaactaccttaaaggaatagttaacagtgctttgaaaggacttgatgatactccacagcctatgtccaaggctgctgctaagtggattatcgttaagtattttaatgatgctagaccattggagccaaagagattaaaggcgcttcgcatccagtgggcacaatattatctctga

SEQ ID NO: 72085 - DNA, 420 bp, Glycine max
  Peptide Sequence Number=SeqID_188863
atggtttgggtcacgtggtggtttggtgaaggtcatatgggtaatataagggtgagtggggcgacattgatggtagtttgggtcttggctatgcggagttctaggggtgcgcggggtgaaggttgtttgggtgatggattgatgcaaggagggaaaagagaggagaattgggagatagaggagaaggaggaggtgatggagaattcgcgcatgcgagcagagaaccgaccaaggagggaggaggaggtggggaaggaggaagggaggatggtgccggtggagtcgtggaaggagggggaggttaggaagtcagtggactgtgacgaggagggtggtggaggaggaggaggaggtgttgtcattgccattgccggtgtagttcacgagtttggacgttggcgatgtaattcacgcgtttga

SEQ ID NO: 72086 - DNA, 552 bp, Glycine max
  Peptide Sequence Number=SeqID_188864
atgggtaacagcttaaggtgttgtttggcttgcattcttccgtgtggagccctagacttgatccgcatagtgcacttgaacgggtacgtggaagaaatcacgcgtccaatcacggctggggaggttctgaaggcaaatccaaaccatgtcttgagcaaacctagctcccaaggcgtggttcgccggattctgatcctcgcaccggagaccgagctcaagagaggaggcatatacttcttgatcccggcggcatcgttaccggcggagaaaaagaaaagacacatgaaacatgtgaaacacgtgagtggtaaccacggtggtgatgatagtagtaataagaatgccgttatcaagaagggcgggatcgccggagtggtcgcggcggattgtggcagcctcggttggagagcatctcagaagactagtttttttccggtggccggtgccggaatttggcttgccggtggggactgggaaccgaaggtggttcaacacttgaaattgttaaaatataacatgactttttctctctcaatgtatgcgagtatctaa

SEQ ID NO: 72087 - DNA, 318 bp, Glycine max
  Peptide Sequence Number=SeqID_188865
atgcacgttagccacctatgcccactcaaggaatctattaattggtctagattaaagcgatataagttctactttcaggagatgagtacaggagacgaaccaaagtacagattggagtcccaattaaggttgatgattgtacttctaggctttcattccatcgttaacaattcaggagacaatttaagctcgaaaaagatatatggtagaaacaatagagaggagaaaaaggtgggacttagtagaaacattggcgacctcaccacgctactcaagcaagaaagctggcatatcctccttgacctatttcttatttaa

SEQ ID NO: 72088 - DNA, 225 bp, Glycine max
  Peptide Sequence Number=SeqID_188866
atggtttgtcggcaagtgatggttgtggcggtggttgatttggccattaacggcgtaggtaagatggacaaagatcaacaaatgtatgatagtataatgtctggagaagttgatatgaatgaacaaaatgaagatgaagctggtgtgaatgaagaacatgttgattgttctaatgcattcaatacttctcaggcgtttgctccccgtgatgatgttctgcattag

SEQ ID NO: 72089 - DNA, 216 bp, Glycine max
  Peptide Sequence Number=SeqID_188867
atggtgcgtgtccggtctagagtcaatgtcgcaagcgaagatgacgagtatgtcggtctccacgatcttattatcgtgcgtaaccttggcgtgctccatgggcttaagctcgctggagaagtcgaggtagtcggacccagcggcgatgcaggtgccatgacgggctcctcgtggagacaaaagggtcacacaattgaggagcggaggaagggataa

SEQ ID NO: 72090 - DNA, 1050 bp, Glycine max
  Peptide Sequence Number=SeqID_188868
atggatcagccgaagcgagtggttgtctgcggcggcggagtaatcggagtctgcaccgcctactttctggcggagaagggcgccgctgtcacgctcatcgagaaatccgacgtggcgtgcgccgcgtccggaaaagccggcggattcctcgccctcgattggtgtgacggaggaccgttggaagagctagctcgcgccagcttcaatctccaccgttcgctctccgaagaactcgagggtccgcgatcgtacggttacagagccctcaccactctcagcctcaccgtaacggaatccgaaggctcctcttctgctacctcaacgttgccgtcttgggttgacggaccagctcgtggtgctaaaacgattggaaccaccgaaacgacggctcaggtgcatccgaggctcttcactcgcacgctgattgatagagcggtggagaagcatggagtgaaggtggagattgcgaaattggaacggttggttgtggcagaaggacgagttggatcggtggtgcttgaaggaggacgagttttggaagcggattctgttgtgttagcattgggcccttggtccaagccaagttccataaccccccatgctctctttctcagttactattcttccaaacgtggaaaatctcttgaccctgaagtgtaccctcgtcccacaggggaggtgtatatatgtgggatgtcgaaggaggaagaggtgccggatgatccagaggagataagaggaaaccctgaatcgattgcgatgcttaagaaagtggcgaagacggtgtcgagctatcttggggaaggagtggcacgtatgaaggcagagcaagcgtgtttcttgccgtgcacggatgatggggtacctgtcataggagaggttccaggggtgaaggggtgttatgtggcaacggggcataactgttggggtattctcaatggtcctgccactggtgctgctgttgctgagcttgttattgatggacattctagcattgttgatcttaagcactttagtcctgccagattccttgggcgtagaaaggcttag

SEQ ID NO: 72091 - DNA, 255 bp, Glycine max
  Peptide Sequence Number=SeqID_188869
agtcactcagtccattatgtaatccaccaagggattcaaggagctagaaagaaatttgtgaagaagcatgataaaggcaaatggccattaaagatcaatgacagtcctatacaaatccagaataagacatcaaagagcaataattgtcatttctatgggaaatctggacacttccagaagaattttccaaaatggattccttataatccaaaccataagcccaagagaacttcgtcttcatggggaatagagtga

SEQ ID NO: 72092 - DNA, 393 bp, Glycine max
  Peptide Sequence Number=SeqID_188870
atgtatgtggatggtacttatgtggaaaaagattggagcgtggatgtggatgagctatcgtatattgacatcaagaatatgctggagaagatgggatacaagaaatataaatgcatatgcaatgggtataaacttgttgaaatatatctagagcacctaattgatgttccagttattgatgagggtgaggttcagggtgatggtgaggtgcagggtgagggtgaggtgcagagtgaggttcagggtgaggttcaaggtgaagctgcggttgaatttggggacgaggatggtgaaactgataagctagacaccccaccaggaaatgaagaagaaggggtagaaagggagaaatttcccagatttagaatgcctgaggatgatgcaaatgcttga

SEQ ID NO: 72093 - DNA, 300 bp, Glycine max
  misc_feature (30)..(30): n is a, c, g, or t
  Peptide Sequence Number=SeqID_188871
atgaaaccacacggcctcggtgggacccgnccccacctaaaaattaggtttgtccctaggcaatgcaacaatggccctgaactgctcgagagtaggccacaggtgagggctacggtcctggcgctgctggtgcagtgtatactagtagaatgtagagctccatcctctatatgtgagctgagatggactctagagatgatcactattgtagaggtggcgagggtgcgtctgcggccggttgctactgctggtcttgcctcggctgctgcgcctgccttggcatgcaatacttctcaatga

SEQ ID NO: 72094 - DNA, 146 bp, Glycine max
  Peptide Sequence Number=SeqID_188872
atggttccaaagaagcttcttactaaaagagctaggaaggccaccgcaagggagggatctagtgcagccctgcatgcggagattgagtttgaaggaaaccgtttccaaaccgaggagcatcagcgccgtttcgaagcgatcaaggg

SEQ ID NO: 72095 - DNA, 135 bp, Glycine max
  Peptide Sequence Number=SeqID_188873
atggtggttcctgtgagtcttggggagcctttgagcaaagttagagatactaggttgcctcctaggagcgcttctttaacgtctttagccggaggtggggtggtgatcgaggcttcgccatatcatcctccctaa

SEQ ID NO: 72096 - DNA, 529 bp, Glycine max
  Peptide Sequence Number=SeqID_188874
gctcccctcacctctctctccgaaatccccaaattgcctgtgaatgctagaaaccctaggcacgttcgatttgatgctctcccatttgcaatcaagggcgagcgcattcggttcttgcacgcaaggctggtactaccgctgcatcggcctcgatccctgaattcatcattctttctcgcaccatctttttctattccgattcgatttgttgttgttgttgttgttgttgtgtttttgtttccttccttgacgaatcatcacgatgttgatgagcaagcagaagaagagccagatccagaacgcgaagaggaggagcttgtggcggcggtgatagacaccgccctcaagtcctacgcccgtgaggggaggcttcccgtcctgggaaacaacaccaccggtttcgcgctttactgcccccatcttggatccgatgctctaagtccttgggatagaattggatcgcatggggtacgaaatttcatgctgtgcaagaagccagagggtgtggcggatgtagatggagatgcaa

SEQ ID NO: 72097 - DNA, 516 bp, Glycine max
  Peptide Sequence Number=SeqID_188875
atgactatagtcagatttgtgttatcattggctgcttctcagggttggcatctccatcaacttgatgttaatactgcttttttgcatggtgatttaaatgagaagcaactaaagcactccttggatgcaaaatttagtattaaggaccttggaatactcaaatacttccttggttttgaagtagcccgatccacctcagacactggtctgcttgctgcaaaatcttcttccttacctatggatcctacactaaaatttcgtaaatcttctggtattcctctctctgatcctattgtttacaggaggcttgtggggcgattattgtatcttactcacacaaggcccgatatttgctatgctattggaaaattgagccagtatttaaaatctccaacaaacattcacatgcaagttgcacaccatattttgaaatatctcaaaggcactgctggcagaggcctgttcttctcctcttcatctttcacttctttaactggattcagtgactcagattga

SEQ ID NO: 72098 - DNA, 732 bp, Glycine max
  Peptide Sequence Number=SeqID_188876
atggctgaagcgctccatgtgcaaaactccccctcgaaccaaggtgttatcgaaggtaatttcgatgcttctattgtggatgggaaaggtacaggacttggggttatttttagaaatgagtttggtgaagtcaaggctgctgctacaaagtttttgcccatttgtgttgaggttcatattgctgaagcactggtgtttcgatgggctattgaatctgctgcttacctaatgctaaatccagtggtttttgagtctgattgtcttcgcttagtttctgcttggtcctctagaaactccaattctaacagctactttgcgggtatcatcaaagattgtgcagttctgctttcaaattcttcttttaaggttttaacccatatgaatagatctgctaatagggcagctgacggtgctaagttagcttttttggcttttgaatcctattggattggggatgtccctcctcagatcggtgattttgttcaggatggtgtaaggcctgatggccatttttcgttcttcatatactcatcccaggggcatatatttaagacgttatcaaaaggtgcagggggggatttcaaagatggagcaggagaggccaaacatagagtctccaactacttacaaatcaacagtgcaggaggaagtcaatctggaagtggcaaaacatctttgctagcagcattgggaagccagcttggagagaaactcaagcataacttacaatag

SEQ ID NO: 72099 - DNA, 363 bp, Glycine max
  Peptide Sequence Number=SeqID_188877
atgaaacccaaatacacactcttgtttgtctttctctcggactacatgaacaccctctctctcaagcttgatccaccttcaattcgcttcacctccataccaagctgccggattcaccttcgctggagaatgacttttttctcttcaattcgccaaatgctcgtcactgtagctcccccgcagcaacaacctcgaacccgtttgccatggaggatctccgctgcaatagccttgaacggtgctgttcgtggtgacgaacggatcttccacgctagcaatcccgtggcgcactgcaacggacgatccggaagagttgtgttcaacattgttatgaaccactcaaggatctcccactgcagctag

SEQ ID NO: 72100 - DNA, 225 bp, Glycine max
  Peptide Sequence Number=SeqID_188878
atggactggatgcatgaaattgaggatgatgaaggccattgggctaagcgtgcatccaccgctaagtacagcttcagcgtgcttagcgcgatagaagaatctgacagggcattaatatcaaggacgcacgctaagcgcgagatcagtgcgctaaacgcaacagttatcttcagccaggctcagcgcataattggaactaagctcaaatccacttactcgcgctga

SEQ ID NO: 72101 - DNA, 510 bp, Glycine max
  Peptide Sequence Number=SeqID_188879
atgaatatatttgtacgaagaaaaagtggaacaaaaagtaaccgtaggggaaatccaacagaaggcattgcaacccttggaggggtgcatccaagaacagttagaaacaatgaagatggaaccatggttgttagaccatggcttttttatctgctttcagaacagaacacaaacgccattatggagctttctgtccttttaaaaacaaaaggcattccaaggctaatagcatcttgccaaagaacggtagccactagtagaagaacctctaaaacaaatgataggtgcctttttactagaacaattgatagggaaatgatttttgcacttggtgtaaagaaaaatacatcacagagcaaccacgaacacagagagaacgcgaggaaacacacgatacagaggaaccgtgaaaacatgaaacttaccttaacaccaacagcgacattggcagcaagactgatcgcgagtgggagtgacaatgaagagtcgcgacgtggagagttgcgatga

SEQ ID NO: 72102 - DNA, 501 bp, Glycine max
  Peptide Sequence Number=SeqID_188880
atgaagatcatccccggcagcaaggccgagccggagaaattctccggcacggtcacggaacacgaaaaccgcaaccgggagacggtaaaattggtgtacaaggcattattgcgtgatgccgacacggagaagcttgcgaaggtggtgagggcagagttggaatggtggtaccacgggcctcctcactgccagcacatgatgaaagtgttgaccggcgagtcaacgacggcgcaaaaggccttcaagtttaggcctcggaggatcagggccgtcggtgaccgcgtggtggttgaagggtgggagggggcgggggagtactgggtgcacgtgtggaggttcaagcacgggatcattactcagctgcgtgagtactttaacacgttgatcacggtggtgcatcgggtttcggaggacggcgatgaggctcgcttgtggcggagcaccaaccgagttcgggttcgggttcacgggtcgttgccggatcttgtgctttccatttga

SEQ ID NO: 72103 - DNA, 492 bp, Glycine max
  Peptide Sequence Number=SeqID_188881
atgtttacttgtgttccggagctggctaactcacaatcacaagaatgcttggaggaatatgtggaacgcaacacgagagtggtcacagagttatacaaagccctaacctccaaagaccccgagacgctccatgggcttgtgacccaagacttggagtggtggttccacggcccaccatgccatcggcaccacttggtcccctggctcacgggctcctcaccctcctcaaaggctttggttccacaacacatggtgggctttgggccagtggtaattgctgaagggtttgatgatgaccatttggtgtggtgggtgcacgcgtggaccgtcactgctgatgggctcataactcaggtcaaagagtatgtgaacacttccgtgaccgtgactcttttatcacaacaagtgcttccaaatgcttccaagtgtcaatgcatttggcagagtaggctttgtgatgaatctgtgcctggacttattctgccaatctag

SEQ ID NO: 72104 - DNA, 1304 bp, Glycine max
  Peptide Sequence Number=SeqID_188882
ggctgcatgccctcgcctttagaggactacatgtccttctcttcaaagggctatacacccttgccttcataggactacacgtcctcctcttcagagggctgcacaccctcgccttcagaggactacacgtcctcaccttcaaagggctgcacgccctcgccttcagaaggctgcacgccctctccttaagaggacttcacgccctcaccttgacaagactacacgtcctcgccttcagaggactacatgtcctcgccttcagagctttgcatgtcctcgccttcagaaggctacacgccctcacctatggaggactacatgtcctccacttcaaaggactacacgccctcgaattcagaggactacacgtcctactcttcaaagggctacgcgccctcccctttagaggactacacgtcctcgccttcagatggctacacgccctcgccttcaaaggactacacgtcctcgccttcagagggctgcacgccctcgccttcagaggactacacgtcctcaccttcagaaggctacacgccctcctctacaaaaggctacacgctctcaccttgagaggactacacgtcctcgccttcagaggactagacgtccttgccttcagaggaggactacatgccctcgccttcagagggctgcatgcccacgcctttagtggactacacgtcctcacctttcagagggctgcacggcctctccttcagagggttacatgccctcactacaagaggactacacggctacacgccacctttagaagactacacgtcctcgcctttagaggaatacatgtcctcgcctttagagggctgcattccatcgcctttagagggctacatgccctcgacttcagagggatgcatgcccttgccttttgtggactacgcatcctcaccttcagatggttgcacgccctcgccttcaaagggctacatgccctcaccataagaggagtacacgtcctcgccttgagaggcctgcacgaccttgccttcagaaggctacacgccctcaccttcagaggactacacgttgtcgccttcagagggctgcacaccctcgcctttagtggattacacgtccttaccttcagagggctgcacgcctttgccttcagagggccacatgccctcacctttagaggactacatgtcctcgccttcatagtgctgcatgccctctccgtgagtcggcttcacgccctaacgttaagaggactacacatcctcgccttcagaggactacacgtcctcacattcagagggctgcatgtcctcaccttctga

SEQ ID NO: 72105 - DNA, 495 bp, Glycine max
  Peptide Sequence Number=SeqID_188883
atgaacctcaacacaagtgggcaaagactttgtagcagcagccatgacttcaccaaactcatttctaaaaataaccccaagtctcgtacctttcccatccacgatagaagcatcaaaattacctttgatatcttccaaattgtcctagccaattcagaaacccttgccagcatatctagatctcccaaccttaaacaatccgcaaattttgagaacaaagaatcttcaggaactgaaatgatgtcccctagcacagaagcaaaccagatgtgcttaacttcttcagacaaaagaatcgcatgggagacagtttccacacactttccacaccgagggtacatatcatcaaacatcaatacccttctctttaaattcttgggaacaggaaagacatttttacaagctcgccaaagaaaattcttgcaattaggaatcatctttatctgccaaattttcttccagatatcccccgagagcctgcttgaggaagcataa

SEQ ID NO: 72106 - DNA, 678 bp, Glycine max
  Peptide Sequence Number=SeqID_188884
atgcttttgggtgtaaagttagcggttgctcatggaaagtatttgggtcttccctctttgattgggagggatggatctatggtggagctttttaatgatagacgggtgtcgaactctatgggtggactagcttattggaatcttgatgttagtgttgatccaaatatgataagttcatctggcaattcatttgatggtggccttttctcggtgaaatctggctattatcaagccttagagtctaatgttaatccttatgcttcctcaagcaggctctcgggggatatctggaagaaaatttggcagataaagatgattcctaattgcaagaattttctttggcgagcttgtaaaaatgtctttcctgttcccaagaatttaaagagaagggtattgatgtttgatgatatgtaccctcggtgtggaaagtgtgtggaaactgtctcccatgcgattcttttgtctgaagaagttaagcacatctggtttgcttctgtgctaggggacatcatttcagttcctgaagattctttgttctcaaaatttgcggattgtttaaggttgggagatctagatatgctggcaagggtttctgaattggctaggacaatttggaagatatcaaagtttggtgaagtcatggctgctgctacaaagtctttgcccacttgtgttgag

SEQ ID NO: 72107 - DNA, 303 bp, Glycine max
  Peptide Sequence Number=SeqID_188885
atgattcaatatcattcctatgttctttccgcagcacctgatgtgtggaattacaatacttcttcatcggattcagttttgataaagaaaatcattcaaataagggactttattatctccaaagagctaagtacggaagaggccaacaagaggattcaatcttggagcaccaatgaacaattgcttgttggcaaagcctatgaatacattagaggaaatctctccaagtttgggctcacattcgtgatttggctcttttccgtaggcgtttcacttctttacagtgcattactgactctttaa

SEQ ID NO: 72108 - DNA, 628 bp, Glycine max
  Peptide Sequence Number=SeqID_188886
atgcataatggccaaaagatcaaaagcgttgtagcaattatgaatgatggatgctcagtgagggcaagtgctaagatctatgtttacttgttgcagaacgagaggaacaatgattcgacaacaagaactgctcttacaagaatgagaggaggagcaaatggaggtcacgatgtgaagtcattcaccatactaacactaaatgaagggaaaaatgatatatctatactaagtgttatgggtggcgatgagcggtggctaacaggtggtggtgcaatggcaatgtcgagactaatgttagagagagtgaagggatcaacagaggtgtatttttgtggtaataacaacaatgataatgacaatagtgacaattgtggtggcaatggtggcaccagtaccagagttggtggtgggggaagtgttgatgttggtggcgacgatgttagtgatgctaatggtcatggtagtggtgtggttggtggtagtgatactagtgcgagtagtggtaccaatgttgatggtggttgtggtggtgcaatgttggtggtggtagtggtgtcagtgtcgatggtcttgatgctagtgccagttgttgttgcaatagtggcaatgggaaggatcattgtcaaat

SEQ ID NO: 72109 - DNA, 273 bp, Glycine max
  Peptide Sequence Number=SeqID_188887
atgggttgtgaggaactgaatcaagctcatttgtacatattgaataacacccaagaggttatcccatacaaagaagctcacaaagaatttgtgaagattagtcactcaaaaatgaccaagaaacaggttaatgggaataccagtgtgaaagtcgatgatatgggatttactttgatagatcttaatagggttgcttattctgatgagcctttcatcatggcagaacaagaaaaacaagtgttttatgttcgagatctgtgtagctcaagatag

SEQ ID NO: 72110 - DNA, 678 bp, Glycine max
  Peptide Sequence Number=SeqID_188888
atggagaggcgtaacttgcacaaacgcgtcgccaatctccaagatggaatcatagatgtagctgtggtgaaggagttttatgctaacttgtacagcccggaagaccagagccctaagcaagtgagggtgagaggatatttaatcaagattgatgctaacatcttgaataccttcttggagaccgcaatagttttggaggagggtgagacactgcctacttattccagatttatgaggatgaggattgatcctcaagagtttgctgcccgtctctgcattcctggtaggggttttgttctgaatgtagagggccatccttggaagcttttgaggaaagatctcaccactcttgcacagacatggagtgtcttctcctacaacaacctgactcccacttcccacacctctaatcttaatatggatagagtcaggttggtttacggcttagtcacggacatggacatgaatatcatagccctaatctcaagtcagatttctaccattgcccagatgaacttcagaggggctaggaaggtaactgctcgaccagcagatattccttgttcttccgcaccaccagctccttccacttctaccactcctacaccagctcctcccacttctgccacccttgcaccagctgcccaggactctcaacgctttgaagccatgctttag

SEQ ID NO: 72111 - DNA, 300 bp, Glycine max
  Peptide Sequence Number=SeqID_188889
atgagttcttcgattattgttctggtttatttgaatgaaagaatatttcaaagtgacgatgacatcagatttgaaggtcctaagaaggctattcaaattaaacgtggtaaatatattgcattacaaatttgtgacgatgaaaatgttgaaacaatgattgaaagttttcaacaacaacaagaaatgggtgtcattgaattgtgcattgaagtagatgttgtcagtgcttccgcgttgaatgtagcaaattcactattatcatgtgggaataatatagctggcaatgaatcaaaagtttaa

SEQ ID NO: 72112 - DNA, 525 bp, Glycine max
  Peptide Sequence Number=SeqID_188890
atggtcactttagggacattttccagcccttgggcccacctgggcccattagaaaacttaaaggtgaagcaaccagctcaactgggcgagcaagttacttctaaaggaagcaaccagctcgcctgggcgagctgtcatacaacctcctcccctcatgagaggtgcactatcggaggaaatcatcgcgcttttcatcgcatgagagtggaaagaaaggataaagagcttaagggaagtagcaacgacatcatcagtagctatcacaagttgttgaagtctagaacgcaagggataacttggctcccaaagctaaaaggtctaagtggggaagaggctaaaattgctgaggaaagcgaagaagtgcaagctttgaaagcagagctcaaaaagacaagagtggtgaaagagaagttggaaacgacaatcactagggtcaggaaagattgtgatgagctgaaagacatcaacatgaccacagtcaaagcattagagcgagaaacaaaaagagccagacgggaagaatga

SEQ ID NO: 72113 - DNA, 444 bp, Glycine max
  Peptide Sequence Number=SeqID_188891
atggcattctttgcaatttctcaacacctagcacaccccaacagaatgagaaccacgatattggaagaagctatccatgtgaaattcaatgacaccgtgcctgataaagaaatatcaaagttggatgaatctattgtagatttaagactgaaagatggcattagacccttaatatcaacagaccaaccagtagaagcagacacatccagccaatcactagaacaacctcaacctgaagaagtcaaggaaccaacaagaggaatactcaaaaagagtcatccagaaagcaagatcattggtgaccccagatctaaggtccaaacaataacatctctcataaatcaaggtcacataacactaatctctaaagttaaacctaaacacattgatgatgccatggaggatgagcaccaggtcaaggccatgcatgaagaacttgactag

SEQ ID NO: 72114 - DNA, 609 bp, Glycine max
  Peptide Sequence Number=SeqID_188892
atgaacttaaagataaaggaagaggtgaaaaagcaatttgatgctggcttcttggcagtcgctcgatacccggaatgggtcactaacattgtgccggtccccaagaaagatgggaaagacaacttttgtttaccgcacatcaatgtccttgtagacaacacaaccaattttgctatgttttctttcatggacgggttctcgggctacaaccaaatcaagatggcaatggagggcaaggaaaaaatgacgttcgtcaccttgtggggaacgttctgctacaaggggatgtcttttgggctcaagaacaatagggcaacctaccaacgggctatggtagcattattccatgatatgatgcataaagaaattaaagtgtacgtggacgatatggttgccaagtctaaaaccgaggaggaacatcttgtcaacttgcggaagttgctcgagagactacgtaagtaccgattaagattgaatctctccaagtgtacttttggggtcaagtcgagaaaattgctcggctttatcataagccagaaagggatagaggtggaccccgacaatgtgaaggccatccttgaaatgcccaagccatgcaacgagaaacaa

SEQ ID NO: 72115 - DNA, 342 bp, Glycine max
  Peptide Sequence Number=SeqID_188893
atgaaaactggtgttaagatcattcacgcaagtggtatttcgggttcaatcgcttacaattggtctcgacccaacatgaaaactggtgctaagatcattcacgcaagttcctgttacgggaaagttcctgttactcgcaaagggtgtctgtggctcagtggtacctatctttttacaagtgtaggtatgatggttgctgaagttagaagtactattactgatatccatgaagacttgggttattttcaacaaacagtggaaacattgagcgcaaacacttggatcaaaggtaggtgttgtgttaagcaacatggtgagactcagattctatctgttgtgtaa

SEQ ID NO: 72116 - DNA, 372 bp, Glycine max
  Peptide Sequence Number=SeqID_188894
atgtctgacacatccaaggttctgctggcttggagtacattagactgccatacgatcatggagatgaagattttggtggctgttttgacatacttttccatggtgatgacgatcaatattgattgcaatgcctgctacagaaaagtgaagagagcccttcttaatatgctagatggtgaagctgcaactgaggaggtgaaaaagagtaaccatgttttgagaaaattagaaaagcaaaagcagaaccaagttcttgatcctcacattgaagaaaaattcggaggtggtcgccttttggcctgcatctcatctcgccctggccaatgtggttgtgctgataggtcaaagaataagggatttccctcattctaa

SEQ ID NO: 72117 - DNA, 250 bp, Glycine max
  Peptide Sequence Number=SeqID_188895
gctacagtaacaacggcggctttggcaaagaagttgtcggagaagttaagaggaagatagagagttttacgggacagtctacaaggctttgcctattcaagggttgcaacaatagccaaaacggcatcacgggtcgtcaagcacaagctccgtattgttggtgtctgtggcttagtggtatttcaggttcaatcgcttacaattggtctcgacccaacatgaaaactggtgttaagatcattcacgcaag

SEQ ID NO: 72118 - DNA, 432 bp, Glycine max
  Peptide Sequence Number=SeqID_188896
atgggaaacagcttaaggtgttgtttggcttgtgttcttccatgtggggctctagacttgattcgaatagtccatttaaacggctatgtggaagagattacacgtccaatcacagcaggagaggttctaaaagccaaccctaaccatgttctaagcaaacctagctctcaaggagtcgttcgtcggattttgatcctctcgccggagaccgagctcaagaggggcagcatatacttcttgatcccggaatcttcactgccggagaataaacggcacgccggaaagggaagcattggtggtgatagtgtgatgttgattattcttcactaccacaagggtacctcaaagtcactcacaaaggttctaaagagaagagatcgtcgtgccgggatcgccggaaaggccgcatcggaatatggaggcctcatttag

SEQ ID NO: 72119 - DNA, 2148 bp, Glycine max
  Peptide Sequence Number=SeqID_188897
atggcttattatcttgtgttcctttttcaatggtctcatcaggctggaatcatattgggtcctttatttctaggtcaacacaattcaagttatgagatgatattttcaacaccaagccaaatgacactcacaacatttgcagaatttggcatgataatccatttctttaagatgggggtgcaaatcaatcccaagctaatcttaaagatagaaaaacaagccgtaacaattggtctaataggccacatgtctgctatagcacttggtggtgtaattttcaatattgttaaagtaatgtaccctgaagggattaaagacactgatgttcatgttttagtgatatcatcttcggtcactacatttcctgttattagtggcttcctagctgagatgaacattcttaattcagaaattggacgcatggctatatccacttccatggttagtgattcatgcatgtggatattgtattttgtggtaatcaatagtgctaaagcagtagaacaacaaacatatatacctgttacagaaatagctgtgacaatttgttatttctccatcttattcttttttctaaggccattggttatatggatctccaaccgtaatccacaaggaaagcctatgacagaaagtcatttcttgtcaatcatttgtatattactatttgttgcattttctgcaagtgttgcaggacaacctcctttccttgttgcattttgttttggcttgatcttgccagatggtccccctttaggttctgttttggctgaaagacttgacactattggttctactttaatggttccatcttattgcactattactggcctcaggaccaatgttccttcattagtaaaatccaagacaataaccatacaagttatcttaattgcaacgtatgtaggaaagtttgtgggaaccattttaccatcgcttcactttcagattgaattttgggattcttttgcactagctctaatcatgtgttgcaaaggccttgttgatctctgcatgctcaacatgttattaaattctaaggcaatagaagaactacctttcacccttgctatatttactatggtggtcgtaactggatttgcatctatagtagttcattacatatatgatccttcaaggaggtataaagcctatattagaaagacaattaagggtggtcaacatgaacctgatatcaaaatacttgtctgtgttcacaacgaagaaaatgtatatccaatcatcaaccttcttcaagcctccaaccctacaaaggctacacccatttcagtctttgtcatacatctcatggagctctcaggcagggcaatttccactctcacaaaaagtaaaagtactaacaagtcatctcaacacataaaaaatgtctttgatcaatttcaaatgcataataaagagggtgtcatgttgcaatgtttcactgcaattaccccatatgtaagcatgcacgatgatatatgctacatggcaatggactccaaatctaacattgtgattatgccatttcataagcaatggtccatggatggaaatgttgagtactccaatgcttcaattaggatactaaaccaaaatgttttaaagaaagctccttgctcagttggaatctttatagatcgaagccaaatgagaggcaaactcttaatcatatatgagaagtcactttgtgaaattgccatggtcttcttaggtggaggtgatgaccaagaagccttggcttatagtttacgtatggctcaacatccaaatgtgagactaacagtgttttgggtaacaattaaaatgcaagacaaccaaaggaaaacaaagaacccttacattgacttgatggagcacatacgttatagtagttaccatgaaggcaaagtgaccttcaaggaagagattgtggaagatggagctggaacaacacaagttattcgaatgatagaaggacattatagtttggtcatagtgggtagacatcacatggcagactctccatgtacattgggcttgacagaatggtgtgatattcctgaacttggtccacttgggaacctcttagcgacatcagattttacattttcagttttggttgtacaacaacaacccccctttaattatgaatttcagtatattacgtga

SEQ ID NO: 72120 - DNA, 639 bp, Glycine max
  Peptide Sequence Number=SeqID_188898
atgggtgatgctaagtgcacccaatattattgctggtgcacccaacacttaaagcctgttcttctccttcttgagcccctacgcccttcttcttcagcctcgatcgttgtgcgcgccccgtggtgtcttcttcttcttcagccccgttggttgtgctcaccccatcggcattgtcgagcccttcagaaaatagacgacaggtggatgtactactcagaccatcttgcctcagcaggtgagatatgtcttgtgctaggtcagtatgcgcccaagtacatggactggttcttcatcatttctcatccattcatgatcgcgacacaacaatcagatccgccgcgacatccacctgcgatgcatgatgcctcatttgtgaagccacatatccctcaagtcccaaagccaccagcagcagcaccaacacatccctgttctcatgtggaccagcctagacatgcaatggatgtttgccatgcgatcactgaaaggttggagcgtctgctcaaccttaggatagtcacggcaggcacaaagacacacgaggtcatggaagaatgcatcaggattgccaggggtgtcacagaagaaggcaatgtgtatgtgaggtctcgacgtaggcggcatacggatcaaccatag

SEQ ID NO: 72121 - DNA, 405 bp, Glycine max
  Peptide Sequence Number=SeqID_188899
atggatggtgttgtgcaatacttttgcaggtttggtcacttggcctgctttacttccgatgttgagatgtttgttgaagtcctcactactgataagaaggcagaactcttggagaagttgatgaaaaccagagactctttatcagctccactaaccaagacacttgggctgtctataagctttttcaaaattaaacaattattgctaggggacatgtccaagtcttctgcaagtgatcttgaagtctcttgtgttcaaatgtttgaaatgtattgcaaaaaccttccgctttcaaaagatatggatccacaagagagcatgcatggtgaggagctgctttcaatgatatgtaatattttggtccagggagtgctggagtgggaggagacatacaaagagatatga

SEQ ID NO: 72122 - DNA, 1479 bp, Glycine max
  Peptide Sequence Number=SeqID_188900
atgcttctgccatctgctgccatgccatctgccatatgtatatgcaaatttttgactcgccgccataatctgctgtctgccattgataatactgatggaggcaattctgttagaattctaaattctgaggggaacatggtaattgaatttgtccagttcaaagataggttgcagcactctagtcagtatttagtggctcgagttgaaacatccattttacaactaaagcagaatgcagataacattgaagaagaggagggtgtccttcaaagcttgaaatgtggtattcagttccttgagctgtctaaggaggtagggtcaaagtctttgaccttcaatgaagacttgcagtcacggccctggtggacaccaacttcagagaaaaattaccttttagattataatctggtgttattttctaatgtatctgtgattgatgattgctatattaagcttaatggatggttgccgtctgtttcagggccatttgaagggatttcttattatcctagagaaatattgaccaaagatagggaaacaagtttaaagagagtcattgaaaagaaatccctacttccacggatgatatatctttcgattcaaagtgcttcagcatcaatcaaggagcatgttgaggtcaatggttctgttaccccagacatcatttcagagctgaaattgttgctggagtgctatgcacaattgttgggcttttctctcactgaagcaatagaagtggtcatgggtttctccaatggtgaaagatcttgtgtggtttctgactccaacttgattgactggttgaatttcactgtatttttaaatgcatggagcttgagctcccatgaacttgtgcagccagacggaaatggatgtaggcctcgaatttggaatatcttagattctatgctggagaagtatatcttagagaaggttaggttccaagagcctcagctctgctctccttggagtggcatggaacttctgatgcagttagttacagaacctttggcgtggcatggacttgtaatccaatcttgtctgagatcctgttttccatctggtaaaaagaaaaagaaaagtggattagcttatcagtctagcatgaatctgactaaagcaatcacagattctgtcgtgcatttatctcacgtattagaggatgttttgacatggataactgaatggaacaaaagacctgaagatgagcatttggagaatattcttttacttcttcggaaagacgggcataatgatggaccgggggaggtctttcacattttagaaacattcatttcctctatgaatgatgcagaacttggtgatcgcatctcccaatctctaaagtcttggagtcctgctgacgttttcaggaaaatgatgactgggaagctaaaagtactgacagaattttctgccatctgtgagtcaaaattgaagttatttaattctatgaaacagcagatagctcaactgtga

SEQ ID NO: 72123 - DNA, 732 bp, Glycine max
  Peptide Sequence Number=SeqID_188901
atggttgtcattcgccattgcccgcttcaccaactagatattaaaaatgccttcttgcatggtgagttacaacaagaggtttacatggatctgccccctggttttactgcttttggtggatctcaccttgctgatcattttgtgttttcactccattctccatttggcatgtgcatttctcttgttgtctatgttgacaacatcatcattattggtgatgactttgacgatatcccgccggctcaaatcccatgtacacagccaatttcagaccaagacttgggaccgctcaaatatttcttaggcattgagaatgctttggatatacttacagagaccgacatgcttgattgtcgcccaagtgacactcctatggatcccaatttcaagcttcttccgtatcagaggaaccattggaagacttgggaagatatcgacaacttccattgggatgctgtcatgcacattcttcaatacatcaagaatgcactaggttgcggactactatatgaagacaaaggcaatgccaagatcgttaggctcattgtcagacagaaggacactaagtttatttgtgacaatcaagctgctctttacattgcatctaatctggtattccatgaacggactaagcacatagagatcgattgtcactttgtgagagagaaagtgctctcaggaaaagtcaccaccgattttgtccgctccaatgatcgcggacctattcactaa

SEQ ID NO: 72124 - DNA, 358 bp, Glycine max
  Peptide Sequence Number=SeqID_188902
atgagtgtcacaccactatttggctattggtgtgaaggagcagtaactggaggggttgttggagtgcagatggtcacatgccaaaaaggggcagcacgtggaggcatgtcagaggtcggacagaaagggacaccagagggtggcggttccagtgtcggggttgagctagagaaaaagtggcatggtggcgaccaaaaaggctgcgcagttgcaagagaagattgccagtggacggaagctgtcagaatggaagttgctgatggatggtggtcatcggagttggagtttgaggtcaccagtggacggttactcgtttggaggcagcttcatgagggagactgggagaggaagagaacct

SEQ ID NO: 72125 - DNA, 165 bp, Glycine max
  Peptide Sequence Number=SeqID_188903
gaggcgctaagcgccaatctcttacggtttttgaactcttggaagtacgctaagcgcgcctattgcgctaagcctgaactactctctaaagcgctaagcgcagcttgctgcgctaagccccagatgttcactgtaccttacaacttcaagttgggcttagcgtga

SEQ ID NO: 72126 - DNA, 273 bp, Glycine max
  Peptide Sequence Number=SeqID_188904
atgggaagactatcctccacaatcgaaatccctcacaaacgccatcgacaaaatgatcgtcacacccctgacttttatgtctccgacaactatcgttgtcatcgcaaccctagctatgactcatatgaccgccacacggagcgtcaccattgcctttcagaattgcctgagcacaaaaaccttaggcataccaacagaacttacaacgaaaatgttataccaaagaaattcggtcacggaaacaccacgtatctagaccgcgacctgatatag

SEQ ID NO: 72127 - DNA, 441 bp, Glycine max
  Peptide Sequence Number=SeqID_188905
atgagtcttgaggatcatatcaactttcactgtcgattgcctgcgtctccactgcctccccagaaaggatatcattgtttttgccctacagttaaatggtatctggtttctattgacgtcgccttctttgagtctactcccttcttctctgcatctgttgacaacattgcttctctacatgctccatctattttttcaaatccagctccgattgttgtccctactccatgtgttgttccaaacccggctattgtcgttgctccaccaccacttattatctatcagcaatggttgcagcttcctttggcaattccacctactgatcttgcaaaatcatgtcctactccaaatgtccctccaccaatgtctcctgtacatgagcttcccattgcgctacgcaaaggtattcggtactctcgcaatcctaactcttcatcgtga

SEQ ID NO: 72128 - DNA, 381 bp, Glycine max
  Peptide Sequence Number=SeqID_188906
atgatgaaggtctatgggaaaacatccctacaggctgagtgcgaaagtaatgctttgtttaatgtgatcatggccacagatccgacgtctcctccgcagtccgatggtcaatcagaggcgacttccaagaggagtagaacaacgacacggctgagaacattgacattaagaaccgtggatcagcccagaccggctgtttatgtggatcccgctaccgggagagcatccggaccgatgcgtgaaaagttccacagctacctaggcgtagtggcgcgagaaaaggttcccattatccacaataattggaaagacgtacctgaaacgctaaaggagattgtgtggaatgacattctaagaacagcacaagggcagtttaaatga

SEQ ID NO: 72129 - DNA, 2960 bp, Glycine max
  Peptide Sequence Number=SeqID_188907
atggcggaaggttctggaaggaggctgatggtggaggtttgcaacgcgaaaaacctgatgccgaaggacggtcaaggaaccgcgagtgcttacgcgatcgttgactttgacggccagcgacggcgaacgaagacaaaatcgagagatctcaatcctcaatgggacgagacgctcgagttcatcgtccacgacaaagactccatgacttccgaaacgctggaggtgaatctctacaacgacaagaggacagggaaacgaagcacttttctcggcaaagtcaagatatccggaagcacgtttgtgaaatccggttcagaagcgattgtgtactatccgttagagaagaggagcgtgttctctcagatcaaaggagagctcggtctcaaggtttggtacgtcgaggaggatccaccggaaacagagaacgccggagaggagaaagcagagtcagcaccaccggcaacggaggagaagctgccggagaattcgcaagaaggagagaagaaagaagataaggcagaggaaacgcaagacgaggaaaagaaagaagatgagaataaacctaaagaagaatcaaaagaagaagaaaaaccaaaggaggaggctccggaggcggcggtgccgccgccggaggttgagaacccaccgattgcgcagacagagaagccaaagccgccgaaggaaaagcacgtagaagtgcaaaagcgtgcggatctgaacgttagcgatcacgaactgcgatctctgagaggcgatcggagccggagtgcctacgacctcgttgatcgtatgccgtttctatacgttcgcgttgtgaaggcgaagcgagctaaaccggaaaccggttcgaccgtttactcgaagcttgtgattggaactcacagcgtgaagacaagaagcgagagtgaaggcaaagactgggatcaggttttcgccttcgataaagaaggcctcaattcgacgtcattggagatttccgtttggtcagaggaggtcaaagaaggggatgagaaaagcgagagttctctcggaacggtgtcgtttgatctgcaagaggtgcctaaaagagttcctccggatagtcctttggctccgcagtggtacactctcgaatccgaaacctcgccggcaaatgacgtcatgctcgccgtttggatcgggactcaggccgacgaggcctttcaggaggcttggcagtccgattccggcggcttgataccggagacaagagctaaagtgtatctttctcccaagctctggtatcttagactaacggtcatccaaacccaggacttgcagctaggttcggagggacccgaggctaaggctcggaatccagagctttacgtgaaggctcagctcggcgcgcaggtattcaaaacaggaagagcctcacccggctcggctaacccaacgtggaacgaggacctcgtgttcgtagcagccgagccgtttgagccgtttctggtggtgacagtggaggacgtgtcaaattctaaaaccgttggccacgcgaaagtccacgtgtcatccatcgaacgtagaacagacgatcgaacggactcgaagtcaagatggttcaacctagccagcgaagacgagtacacaggtaggatccacgtcagagtatgcttagaaggtgggtatcacgtgatagacgaagccgctcacgtgacaagcgacgttcgagcctcggcgaagcaactcgcgaagcccccaattggtttgctagaagttgggattcgcggcgcggcaaaccttcttccggtgaagaccaaggacgggacacgtggcaccacggacgcttacgtggtggccaaatacggacccaagtgggtccgaacccgaacaatcatggaccggttcaacccgcggtggaacgaacagtacacgtgggatgtatacgatccttgcacggttctcaccattggagtgtttgataacgggagatacaagcgaggggaagatggaaaacctaacagagattgcagggtggggaaaattcgtgtgcggttgtctacactggacaccaaccgggtgtacgtaaactcgtactcgttaaccgttttgctgccaggtggcgccaagagaatgggagagatagagattgcagtgagattctcatgctcctcgtggttgagtttaatgcaggcctacgcaagcccaatattaccaagaatgcactacgttcgcccattcggcccggcccaacaagacatcttacgccaaacggctatgaggattgtaacggctcgcctcgcccggtctgaaccggcgttgggtcaggaagtggtgcagttcatgctggactccgacacgcacgtgtggagcatgcggcggagcaaggcaaactggttcagagtggtgggatgcctgtcacgtgtggcgacactactgggttgggtcgatgggattcgcacgtgggtgcaccctcccacgacggttctggtgcacgtgctgctttcagcgattgtgttgtgtccatacctagtgctcccaacagtcttcatgtatgctttcttgattttgcttctgaggttccgttaccggcagagggtcccacagaacatggatccgaggatgtcgtacgtggacatggtgagcctggatgagctggacgaggagttcgacgggtttccgaccacgcgtcccgcggaggtggtgcggatcaggtacgacagggtgcgcgcgcttgcggggagggcgcagacgctgctgggtgacatggcggcgcagggggagcggttggaagcgctgtttagctggcgggacccgcgtgccacggggctattcgcggtgctgtgtttggtgatgtcgttactgttctacgcagtgccgtttaggggcgttgtgctggtggctgggttctattacctgcgtcacccgaggttccgcgacgacatgccgtctatccctgcaaacttcttccggcgactcccatccttttctgatcagattat

SEQ ID NO: 72130 - DNA, 664 bp, Glycine max
  Peptide Sequence Number=SeqID_188908
ggttggggttgtagggaaggggaggaagggttggggagagcaagggttgcaagaccaacaagacgtgctggtctgccaggcacttccttccacgctttcccataaaatccctcctcctccttcgttccatttgaactacgaaatcgttgaagtggtttacgctcagccgagtctcactccttgctgttcgtggaaggaagtgtctggtagaccagcacgtctggtcgcgcctagcagaccaacacttcctaaccctgtcccaccttccctaccacctagtcacgtcatgtcatgtgttgctattatgggaaacgcatccaacggagaagcgtattcccgtccattgagtatcattgagacggaaaaatcagtcactggaggggaagtggtggatttctttgattggttatctcttggagcaatgaaggattctgggccaagtccaggtgtgggtcacaagttcaccaatagtgaaacccttggtgggattaaggactctggtcctagttccggggggccaggtcaccaatttactaacagccagacccttggtggaatcaagaattcgggtcctagccccggaggagagggtcacaaatttaccaacagtgagacccttggtgagatgaaggactcaggtccaagccctggccaaggacactaa

SEQ ID NO: 72131 - DNA, 174 bp, Glycine max
  Peptide Sequence Number=SeqID_188909
atgggaaactcatccaaggacaacgactccgccacctccgccgacgcttccgccggcgacattccgccctccaattccggcgtctactccgagggcgagaaagtgcaaaagactgagatcagaaagagtgaatggaaatactttgttcactaccttggctggagtaaaaagtga

SEQ ID NO: 72132 - DNA, 354 bp, Glycine max
  Peptide Sequence Number=SeqID_188910
atgctttttaaaaggttcaagtttctctccgtgagatctttcagttcaaagggtgtaattgtaacaggcatttgttattggctgcaagtctgcacaatagagactaaaggcccggttttcacagcaatgttcacccctctagctcttataatcacagcaatattctcagcacttttgtggaaagaaacactttacttgggaagtgttggtggcactgttttactagtggttggactctacagtgtcctttgggggaagatcaaggagagtgtaaaggagggtgtaaaaggagaaaacctagaagttgaagaaacaaaagaggaacccagattggagtgcattgtacagcattga

SEQ ID NO: 72133 - DNA, 1455 bp, Glycine max
  Peptide Sequence Number=SeqID_188911
atgtcggtggatgaaagagtgaacgttctaatggtgtcaatggccttgcaaggccacatgaaccccatgctaaagttcgccaagcaccttatctcaaagggtgttcatgtcaccatcgccaccaccgaagatggccgccaccgcatgctcaagaaaacaaaaccctcaaacgccaacagcaacaatagcaacaacaaaaacaaccttaaattttccgacaactctggcatcgaactcgtgttcttctccgacggtcttagcctcgggttcgaccgttccgacaccgagtcattagtcaacaccacccgagaaaaaggctccacaaacttctccactctcctcaccggcctcaccaaagttcgtaaatatgcgtgcgttgttgtaaatccttttgtgccttgggctattgatgtggctgctgaacatggcatcccatgtgcaatgctttggatccaagccagtgcaacctattcaatttactaccgttacttaaagaacataaactcttaccctaatttggaggacccaaatgagaaggtgcacttgccaggactaccaccattcgaggttaaggacattccttctttcattctcccttccaccccttatcatttcaggcatctcataaggggtttgttcgaggctttgaacaaggtgaattgggttttaggggcttcattttatgaaattgagaaagagattgttaattccatggcttcactaaccccgatttactctgttggaccattggtgtcaccttttctgttgggagaaaacgaaaaaagtgatgttagtgtggacatgtggagtgctgaggatatttgcttagaatggcttgacaacaagccagattcctcagttatctacgtgtcatttggcagcttgcttgtgctgtcacagaagcaagttgataacatagccgcagcattgaagaacagcaacaaggcttttttgtgggtggttaagcctggagggtccaatgatgatgatgttgttgctgctgaattgccaaattggtttttggatgaaactaattataaggagaagggtttggtggtgaagtggtgccctcaggagaaggtgctgatgcacccttctgtggcttgcttcataagccactgtggttggaactctactcttgagactgtggtcactggtgtccctgtgattgcttggcccttttggacggatcaaccaaccaatgctatgcttatagagaacgtgtttcgaaatggggtgagagtgaaatgtggagaagatggaattgctagcgtggaagagattgaaaggtgcattaggggagttatggaagggaaaagtggtgaagagattaagaagagggctatggagttgaaggagtcagcacagaaagctttgaaggatggtggtagttctaataagaatatcaatcaatttatcactgacttgattgcttggaattcagctagggcttga

SEQ ID NO: 72134 - DNA, 303 bp, Glycine max
  Peptide Sequence Number=SeqID_188912
atggccgacagtgggacaattttttgttcttctcttctcttatgcttcaatataccaaactctcatggcatcagtgggaggcacaaatggaggggaaaggcgatgggaggcgcggcagaggaggaaggtgagaagtggatgtcgatgggaagggcgattaagggatgggtgaagaatcacgtttcttctcatttcagagagagagagagagaggataataaacaaaatggtggaggttgttggagtcgggaaattcacaaatttcatttattgtgttcaagatttactgggccttcgtactaa

SEQ ID NO: 72135 - DNA, 174 bp, Glycine max
  Peptide Sequence Number=SeqID_188913
atggataatggaagccaattattttaccagcccaaccttttatgtggaatcaagcctaatgatgctatgagggataataataatgaaaatgtggatggtgaagacactaatatacaagcgcaacctagttatcttgacttttctagttatttcatagttgataagattttttaa

SEQ ID NO: 72136 - DNA, 315 bp, Glycine max
  Peptide Sequence Number=SeqID_188914
atgacagacttacgagaagtgagcactgcttccaaccatttgagtgctactcatcatggtgcttggtggtgccttgaagaagaagatgaaggggcttcccccaactacagtttggtgtcagaaaagatggagagtagtcagaagtatgatgtggtctacaaggtagtggagttacagctagaggagtcaaggagaaaaagcataatatgcacccatttctttccttcatctctctctattttctctctcactaatgtcatcaatgctctcttgcatgatataaaaacagttctattcttgggttgtgaaaaataa

SEQ ID NO: 72137 - DNA, 360 bp, Glycine max
  Peptide Sequence Number=SeqID_188915
atggccaagtatttctcgctaatgcttcaatctagtgattccgagttgtgttttcgtttgtttggaatggtgacggagctcagaatcctcagagggcaaaactcgagacaattgtcgacctatacttcaattttgtgtttggcctttctacattggcattcgctgttcacgctcgatgaggaagtcattgctttgacaacgataatgttaccgattattgggcactacgagcttggaaattgtccccagacaacgatggctgctctatccaagaagttgatggtcaagagggtttcgctctcgttaggcttgcgcgatggcatgccacaatcaatgattcccccctccagacctggatag

SEQ ID NO: 72138 - DNA, 270 bp, Glycine max
  Peptide Sequence Number=SeqID_188916
attgctctgggagaatcttcaatcagcgaaggaaaagatagcctattgatacctgaacacactgagattattgcctcgtcgttactcagtcgatgccctcatcgttcagaaattcagagtattgctcttgctgaggtggagagctgtggctatgtaatgttgggaagtgtggattcatatggtcatctcattgtgtctaaactagatgcgtctggtgaagctgtagttctgtggtgccaattcagaaataaggacatgtttctcgattag

SEQ ID NO: 72139 - DNA, 465 bp, Glycine max
  Peptide Sequence Number=SeqID_188917
atgacattcaagcgcaggaatggaggtcgcaacaaacacggccgtggccacgtcaaattcatccgatgctccaactgtggcaaatgctgccccaagatttgtgcgaggcatttcaattttcaacaactaaccttttgtgctcgctctgtgaaacaggacaaggccatcaagaggtttcttgtgaggaacattgttgaacaggctgcagtcagagatgtgcaggaagcctgtgtctatgaacagtacacgcttccgaaactctatgtgaagatgcagtactgtgtttcctgtgctatccactctcatgttgtgagggttcgatcccgcactgacaggaggaagcgtgaccctccacagcgattcatcaggcgcagggatagtttggataaaacttgtgtaattgtactgatgcacggcaatggatcctctaaaacaaatggagacgatatagagagtgacatttag

SEQ ID NO: 72140 - DNA, 324 bp, Glycine max
  Peptide Sequence Number=SeqID_188918
atgaagctctctgttttacttctggtgttcctcacggttcttgctgccacaaggcctagccttgtaaactgtagggtcctttctccacaaaaaaacacagagaaggcccctcatgagcctctcaaagtgattcgatttctcatcaatttagtgatggcagagaaggccaacactagtgagggtaatatgagcaacagggttttggctgagaacaaattccaaaccatgtcttcagggccaagcagaagaggttcagaagaagaaaaagtatattggtggaaaaagatcgaatttggcagtgtatggcaatttaaatcaaagtaa

SEQ ID NO: 72141 - DNA, 327 bp, Glycine max
  Peptide Sequence Number=SeqID_188919
atggttttgctaattgtattgaattgttcctttgtccagactgctgttgcccgtagtttttgcaaaaccattgatatttatgatcaagacatccacattcgcacattacgaccgctttggtaccctacttcattaaacttcttgcaagacggagttaatggaaatcaaagttctaccttagctattacagaaggaagccagtggttgaaagcaagccttgactcaatggtaaggttgttgctttgtgacttggaggtcacaagttcaaatcttggaaacaacctctttgtttgtgggggtaagactacatgtatctaccctccctag

SEQ ID NO: 72142 - DNA, 165 bp, Glycine max
  Peptide Sequence Number=SeqID_188920
atggcctctgtagatttttttttcaaaagtgatttcaagaatagtgaatgttccaagcatatgatgggagatgtatccaagtttacaaccatttcccccaagaaaggtggacatgttacatacggcaacaacaatattagtaaaatctcaaaagaggataattga

SEQ ID NO: 72143 - DNA, 2358 bp, Glycine max
  Peptide Sequence Number=SeqID_188921
atgacaagggtatttccagtccagcgtttgctacaagcatccaacaatggattgctgcagaaaggcctcattaatcctgctcatatcctgccacaaaacatggttaacattactatcaataactccacattttcttaccccattttgtgtcattcagttcaagattctcactctgttgctatcttctatggtgacaatccttttgttcactccttctcacttgtaatgttcaatctcatgatcatcactgccatcacgagcattttccgtattcttcttaagcccctcaaacaacctctaatcatatcccaaataatagctggtgtgattgttgggccttcctttttgggaggtattagatggttccaaagtaacatggagactgagtcaaccaaattcctgataaaaaatcttggaaaaatgggattcatgttctttgtcttcgtctatggtgtgaagatggatccaacccttttgaaaaaatcagggaaattgcatttatctacgtcattaattggcataataatacccataacgatagtcgttgctgtggccctaagcatgaaaaagatcacggacaaacaagaggccatgattccttcactaggagcaatagcaggttacttgggggtcacatcattccctgttctctacatcatcctcaaagagtttaaccttctaaattcagatatgggtcgatttgcattgtatacagcattaattggtgacacattgggtatgatttttgtcgtgttcgttgagaaaggagaaacaaagatgttgactaccttatggcccataatgacatggatcaataacaataccccacaagggcacccagtgcaacagtcctttgtggttgctattcttcttggggtttttgtgatgggcttcgtaactgacatgtttggcatcgcaatttgtaatgggccattgtttttgggcctggtaattcctgatgggcctggtgtgggggcaacacttgtaaagaaggccgaaacaattatgagcgatctccttctaccattctcattcattatggtgggatcatacactgatttctatgccatgagcgcttctggttggtcaagtttgtcaccattgtttgtcatggttgttactggctacattatcaaattcatttccatttggattgttctatatttctggcgaatgccactcagaaatggactagccgttagcctcattatgagcttaagaggccatgttgaacttatattgtttgtggcatggatggagaaaaaaatcttgaaggttccagccttcacattactgattattatgacagtagcagtgacagcaacatgctctcctttgatcaacatattatatgatccaacaaagccatacatggtgagccaaaggcggaacattcaacacaaccctccagaccaagagcttagaatagtgttatgtattcttgacactgaagccataaatggtctcatccgtttgcttgatatctcaaatccaacctcaagcagccccttttcaatttctgttgttagactaactgagcttgtagggcgttccagccctttgttcatagaccatgaaaagcaacaagttcctcccatttatcaatggacaaacaccataaacgtccttgaacaccatcaggaactcaagggaatgtccatgcagctccatttcttcacatctgtggccccaaagcagtcaatgttccgagacatatgtgagcttgccctagaacaagaagcttctttgatcatcttacctttcgacagtgctgatgttcacgaccatgcagcgagagcagtgaattcacaggtcttgaacaatgcaccttgctcagttgcaatttttgttgataagggtcttcttgaaatcaacaaaataggtagttccattcgtcgaactccatatcgattcgccgtgttgtttcttgggggtggagatgctagagaggctcttgtttatgcagataggatggttgctaaccaagatgtgttcctcgaagttgtaaggtttctccctgagaactttctaaggtacaatgatattgagaggaagcttgatgatggaattgtgacttggttttgtgttaagaatgagatgactcaaagagtggtgtatagagaggtactggttagaaatggagaggaaacaattgaaagaattcaagatatgaatgatggtgcttttgatcttttcatagtgggaaggaaacatggaataaaccctattcttctcactggattatcagaatggagtgaaagtgaagatttgggactcataggagactatatttcctctgcagatttttttggctcggcttctgttttagttgttcaacaacaaatcttaagaggctaa

SEQ ID NO: 72144 - DNA, 420 bp, Glycine max
  Peptide Sequence Number=SeqID_188922
atggaggacgacggttccaactcgatccgccgcatgtcaagccgaacgcgaaaagcggcacttgcacgcttggatgcattggagaatgacaatgcgggttttgaaatcgcagatgccaataatgatgacgatgacgcttctctagacgaggaggatcaattttatatgcagaaaaagcagtctaaaggcaccaaaaggaaaactaggcaggcaaaagcacttgaagctagaagggccccaagaacattccttgagctcttacatgaggctaacttagaatcattgcctcctcatgtgccctcctattggaaagccgcagttggacccccaagctcaacctcccgtcgccacttctgtaccgtttgtggtttttctgctaattacacttgtgtgagatgtgtgttcactagcactgtgtaa

SEQ ID NO: 72145 - DNA, 246 bp, Glycine max
  Peptide Sequence Number=SeqID_188923
atgtgtttaccggggaaggggacgcgaggcgaacaagtcaccgacgcacaggattttggctggcaatcaaagagagaggaccactttaggtcatggtttcctttcttttcatgttttcttggtgacaaatctgcattgttcagacatcgtttgggcaaggtttatggtgagttgggactttggcttatggcttgtagaacggatggacatgatatatgtcagggtgttggtatggttcaacgataa

SEQ ID NO: 72146 - DNA, 174 bp, Glycine max
  Peptide Sequence Number=SeqID_188924
atgacggggaaagttaatttagggttaaattttagaatgtcaattaggacttgtagtaaggcttgggcagagcaaatgagaaaaatgagtgacaaaggtgaaagcaagagccatttccagggtaaattgggtgttgaggggtcaaatcttgaatcggaggagtttttgccttaa

SEQ ID NO: 72147 - DNA, 477 bp, Glycine max
  Peptide Sequence Number=SeqID_188925
atgaacagtggcaccattgattttgtcgaagaaaacggaaacgggagcgactcggacgcgaattccgatgatgcaccggagtactaccagccgatttccgctgttgacgacgacgggagctcagacgacgagcacgacggagagctccggcacgttccgaatggtttcgcggtgcacgtcatggtgaagaacgggatctcgtctctggatcttaacgacatcgcagagaagagcagcagcgacgaggaggaggaacaagaagaagaagaagaagagaggagagaggatttcgagagagcgctgagagaagaagagaaccggcgaaatgcgccgctgacgatagagaatgcaacgagagttatggatgtgatgcgcagagagtctttcgccggagtggttcccgattgggctgctcgagatcccaatgatcgttgggtcgatcagcttcgccgattgaggcaatcgtcgaacacttga

SEQ ID NO: 72148 - DNA, 1119 bp, Glycine max
  Peptide Sequence Number=SeqID_188926
atggcagtgtgtgaaggagagggagtgctgaggttgaagcgggaaacaatggcaattcccatgttgagggctgcaatgatttctcattctcaatctcaaccactcattcattccatatctgctatttatgaaaccgctaagaggaggaagagagtggtgttctcttcttcttcttcagaacttaaccctgtaattcggtacacaacacatgttctgtttgttaagtggttaagtcccggtcttttctttctaaaggttaacacaggtggggaagatgctttctttgtgagcaactataatgggggagttattgctgttgccgatggtgtctctggttgggctgaagaggacgtggatccttcgttgttccctcgtgaattgcttgctaatgcttccaattttgtaggagatgaggaggtgaactatgatcctcagattcttattaggaaagcacatgccgccactttctccacaggctcagctactgtaagcatcgttgctatgctggagaagaatggaactctgaagattgctaatgttggagattgtggattaagactcatccgtaatggtcatgtagttttttccacttctccacaagagcactactttgactgcccattccaactaagctctgagagggttggccaaacataccttgatgcagcggtatgcaatgtggagttgatacaaggagacacaattgtcatgggatccgacgggcttttcgataatgtttttgatcatgaaattgtgccaaccattgttagatacaaagatgttgcagaggctgcaaaggcattagctaacttggcaagcagtcatgcaatggattcaaattttgattctccctattcgttggaagccaggtctaggggttttgagccacccttatggaagaagattcttggaatgaagcttacaggtggaaagcttgatgatatcactgtaatagttgaagacaaagtcctgattgctgagatcactagagaagggtttgccttaagtatactgcggcaactaaattttggtgatgctctgagaaataaggatctattcattgaagtgagttctcctgctttgcctgttgtgctgcatgcattgagaaaggctgtctga

SEQ ID NO: 72149 - DNA, 366 bp, Glycine max
  Peptide Sequence Number=SeqID_188927
atggacgaaattgccaatgcattgcacgatagcaatgttagattcatgttggtaacgcgtggtgagactccatggttgaaagaaatttatgggcacatggggatggttgtggcatggcgtgggcatagagtgaagaaggatgataagttggacacctcgatgagaagagatgagattgttgtgttgttgaggaagttcatggagttggatagtgacgctggtagagatatgaggaaaagagccaaggagcttcaacatatggctcagcttgcaattacaaaaaatgggtcatctgagatcgaagcctttatgaagaatatggttgagagtggaacgagcataattcaagttcaaaatggtatttag

SEQ ID NO: 72150 - DNA, 540 bp, Glycine max
  Peptide Sequence Number=SeqID_188928
atgctggtggctgacgaagaggctaaggagcgaacgatgcaaaaactggctggcataatgttactgggttgcatgagcgtaagcgctgcacaggcagcggatctcagcttccagaatgcgcagggcaatattgaagtggtgcccggcaaacccacctttgtgcataaattgcactaccgcaaactctatgatgaaaagccgttcccggatgcggtgatttattactacagcaacggggtgtataaaatcctgtcgcagggcgaaaatcattatggcctctacgtgatgcagggcagcgttgaggaccagagttacaccatccgctatatttcagcgccgtcaaaagactggggcaacaaaaccgccttccatcagctcacctttgtgaatggcgcgcaggcaaaggtgtttattcaaaacgcgattacggataccggtgagcagatcgcccagcaaaacggcgagtttttgctgcaggatcaagatcccgcgcacgcggcggcagacagctgggacgatgatttaaaaatcaaacgctga

SEQ ID NO: 72151 - DNA, 644 bp, Glycine max
  Peptide Sequence Number=SeqID_188929
atgacggcgccattaccgcgccagacgcggctattcgtcaccactgcgactggccctgaccttattgttcagggtgcaaaatcctgcagcataatctcgcatcatacttcattcatgctgcgaatcaggatgcggaagaactcctgcactcaggcatcagcaaagtggagctggcgtatgatattggcagcgatgatttcttccgcctggcgagccactgatgaagagcttcgctatcccgccaaatcgctaacccgcagcagccttttcggcttgctctgcccgcggctgactgccgaaacgcccctgccgctgcccgcttgtggtttcatcaccgccgctggccacaccgctgaatcgctgtcgctggcgtggtgccgctttgatcggcaacagtggcacgccgctttacctgcgcagtggcaattgccgctgccgtccgcgctacagcaggcagccagcaaacgcaaaattgaatatctcgccagccgctggctggtgcggcaacagctggcgcagctgggaatcactgattttgtgctgcacaacgcgccggatcgctcaccgtgctggccggcaggcatccgtgcttcactgtcgcacagccatgactgcgtggtgatggccgcgacgcgcgaggcatt

SEQ ID NO: 72152 - DNA, 859 bp, Glycine max
  Peptide Sequence Number=SeqID_188930
atggccctgagaaagcttccatcaaagaggtccaggaaggacaccaccagagaaggctccagcgctgccacacaagctgacacaaacttaacaagcatcaatttcggagcgcagagcataagcagcgctttgaggccatcaagggatggtcattcctcagagagaggcaggcactgggcatcacttgtgacacccatggctaaatttgacccggagatagtcatggagttttatgccaatgcccagcctaccaagaagggagtacgagatatcactcctgggagtgtgagtacaattagaggaggagacatgtctctagctttgatgaggaggccattgcctagctattgtgcataccggggcaagatttcacccataccgctgcagggagacgggaatggtgattacgagacaccctatgcaccaggaaaggtccaacaaggccctagggtttcccgcgctgattacgggcctctgttagttctacggagtggcgaggcaccacaacaacctggagacggccagccgcaggcagccgatgcaccaccatcacccccggagtccacctcggcccacttgcagagtacactctacgccagcagggccgggattccagcccttatacatggtgtcgcaacctacccttttgcgggcgagcgaggcgaggctcacgggaaaccggtcatgaagaatattctagattcgggagttatctttacgtttgaggaaggtattagcacctctcacgtcgacaaacacgaggctcatgctcctacgtaccctccatcgcagaggaaatcaaacctacgtagttctttcaaaaggggcgaatcaagtggttctttttacttgaaagggg

SEQ ID NO: 72153 - DNA, 429 bp, Glycine max
  Peptide Sequence Number=SeqID_188931
atgatttatatgatccttgctattaccgccggcactatccgtcgcgccgacgttaaggcattgcaccagcgtcgtgcatcctgcaccgcttcagcgctggcgcagtgtaacaaagcggccacggggcgcgtggcgctgagagcggtggcgtggcatgaattgtgcagcgttgatggtgggttgaacatcagcgagacccagctcgctcaggcccggatgatcgtccgggcgtctgccagccggccagtgaaccagccgcgcttcagcgctaatcggcaaatcgtggatgcaggcgaagcgctgaatcatcagaccatcggcaccaaagtgccagttttcattgccgtagctgcggaaccagttgccgctgtcatcgcgccactcataggcaaaacgcaccgccagcttatcgtggtgccacgcccataa

SEQ ID NO: 72154 - DNA, 198 bp, Glycine max
  Peptide Sequence Number=SeqID_188932
atgaaggggaggttggtggtagttgaggtgaccgaatctggtgaagcggagagagacaaacaagagacggtggtagtgctggtgggagagaaggagagagacgaacttaccgacgacttacagccgcaacaacagtctttgcctccatcggggaggggtgatggtgagtgtgagagaccaagagatgagttaggataa

SEQ ID NO: 72155 - DNA, 237 bp, Glycine max
  Peptide Sequence Number=SeqID_188933
atgggtgccaagtacctcgaagcggtcaagcaaaggttgcatgccatcaacaatggtccctggacgacattagggtatgacacatggcctactccgaagcagtttgaggctgcgatagcatggcatggggattggcttgactttcaggcagaggcggggtccgcggggacctctagaggtggggacaaagcccaggatgatcaggacatagccgacttgatagatttcctcctctga

SEQ ID NO: 72156 - DNA, 579 bp, Glycine max
  Peptide Sequence Number=SeqID_188934
atgtcacactctgtggacgaacaactctcctttcttcgctccctaatccaagccagaagtttctgcgactctaccctccgatttctcgaatcgctcttggtctccaaggacgtgaaatcgttgatcgaagttcgatccagcttgacgcacctcctcagatctgaatccctgtccgttattcgctccatcgccgcaaaaaccgtccacgacaagcttctcgttctcgattttttcgtccgcgctttctctctcgtcggagatcaacagagttgtttggcgttgagatacgaggctttagttatgagagaacacaaatctgctagttgtcaatggctacaagtttcgcctgcggaatggttaagttttgtggagaacgcggtgcacaacggttttcacgccgttgccgaaaaggcatgtgaaattgcattgtcgtgccttgggaataatgatgatctgaagcacggaagagacccagttccagaaaacttgaaggctgttatcagtgagattacaaggctcaggaactgtgcaatggcatctgttgcttcacgatctggtatctcttcactcatccattaa

SEQ ID NO: 72157 - DNA, 1515 bp, Glycine max
  Peptide Sequence Number=SeqID_188935
atgtctggagcgtacggtcaagacggcggcggttccgcgccaccgtcttatggagccagcggcggatacggttccaccggcggtggtgccggtggaggtggtagttatggtggcggaggctatggaggaggaggaggtggtggcggatatggtggtagtgatggcgggggaggtggaggttacggagccaaaggcagcggaaacggcggcggatatggtggtaacgatggtggaggttatggcggaagaggcggctacagtggaaacgatggcggaggctatggaggaagaggcggcgggggaggtggtggtcaaggtggccggggaggtggaggttatggtggtcgaggaggtggtggtggatttcaaggcggagatcgcggtggtcgaggtggcggtcgcggcggcggccgtggcggcggtagagatggagactggcgttgtcctaaccaaagttgtgggaatttgaactttgcaaaaagggttgaatgcaacaaatgcggtgctccaagtcctaatcccaatagttctaatgaccgtggtggtggttataatagaggaggaggaggaggtgggggctatggtaacaatcgaggaggaagaggtaatgactataacagtggagggggtagatctgggagttatgatggagggagaggcaatgactataacagtggaaggagtggtagtagtgatggtagaggtggttcatacagaggtaatcaaggtagagaagatggtggttatggtcaagttcctgctcctactgcccaatcttatggtggtggtgctggtggaaactacccacccacttacagttcttatggtggtgggaatgcaagttatggaacagaagcagttcctccacctgcaagttatactggtggacccaattcctatcctccatcatatgggggtaatgtgggtggttatgggggagataatcaaggggatggacggagtggcggtagatccgggcctcctactggatatgacagcacttatggtgctggtaatcgaggtggatttggtggatcttctgctgagccccctgctgcagtgagacagtgtgatgagaattgtgatgatacatgtgacaactctagaatctacatctcaaacctaccaccagatgtgactattgaagaattgagggaactttttggaggcattggacaagttggaagaataaagcagaagaggggctataaagatcagtggccttggaacataaagatttacactgatgataatggaaacaataagggtgatgcttgccttgcttatgaagacccttctgcagcacattctgctggcgattatgatttgaggggttacaaaatcagtgttgcaatggcagaaaaatctgcaccaagagctccacctgcatataaccaagggggcaataggggtggctatggtggagatagacgcagagacaattatagagatggaggtggtggttctgggcctgataggcgtgatcattatggaaatcgttctcgtccatactga

SEQ ID NO: 72158 - DNA, 423 bp, Glycine max
  Peptide Sequence Number=SeqID_188936
atgtctcacgctatcaggcttgatcgttccttgaaagcaggagggccttttgcacgccatccacttgattgtccttggatgacaaaaaataaccacttgaggtatttccacctgccacctgacgcatgggtcaggatcaacagatgttgtctttctacggataatcacttgggtatatccgcctgccacctgacgcatgggtatatccgcctgccacctgaggcatgggtcaggatccgcagatgttgtctttgtacggataatcacttgggtatatctgcttgccacctgacgcatgggtcaggatcaacaaatgttgtgagaccaaaagagtctcagccggaaggtgttgacatctctggaaagggcagggacgaccacattggtcttcgcttgtcaatcagacttggggtctctaaatga

SEQ ID NO: 72159 - DNA, 138 bp, Glycine max
  Peptide Sequence Number=SeqID_188937
atggtgaaatcaaggaaccagctaaacttgggaaccacacgggatcacattatgttcgagagaaaaaggagacagctaatggctgagagattcatagcgctttcagctattataccgggcttgaaggtcagtgcttaa

SEQ ID NO: 72160 - DNA, 1418 bp, Glycine max
  Peptide Sequence Number=SeqID_188938
ccttcgacgatttgaaaatagccatgacaaccactcctgtcctctccctcccagacttcacgattccctttgtagtggaaaccgatgcctcagggacaggcatgggtgtcattttgatgcagcgcagccatccaattgcctacttcagtaagcaattctatcccaaattgcttcgttcttctacatacatctgcgagttgcacgccataacctccgccgtgaaacgctggtggcaatacctattgggccatacttttgtgattctcactgatcacaaaagcctgcgcgaactaatggtgcaaccagtacaaactcctgaacaacacgtttatctcgccaagctcctgggatacaattattcaattcaatacaaggtcgaacacagtaacatggtggccgacgcactctcgcgtcagacagatatagaccatacaacaacaatgttctctatcctatccatacctcgcccgaaattcttagatgatttgaaaatagaattagcctcatcggaggaatttaatgacctcacgacacgtgttaccaaggatcccgaacaacatctcatgttcattctcagagatggcctcttactgtacaaagggcgcatttggattaaccgcgacaacaatttcattgctcttctccttgaggaatttcacaagtctccattggacacacaacaattcattaaacgatgtgtggattgcttacagaccaaatatattcctcagaaaccgacggggctcctccaacccattcctccaccgtcgcgagcgtgggaggatttggctctggatttcattaccggccttcccaattctcagggagccattgttatcatgactatagtggatcgtttctccaaaggagcccattttgggtctcttccctcccatttcacaactcacacagtggcccagcttttcattgactcgatttgcaagtttcatgggtttcctcgaagtctgattttttatcgggatcctatcttcatcagcaaattttggaaggaactttttcggctttgcggcacaaaactacgaatgagcaccgcctaccatccacaaatcgatgatcagacgaagggctacaacaccacatgtcactcatcaaccaacctcactccctttgaggtcacatatggcaagccaccgccgacaattacagactatcttcctggatcatcttcaatggaagcagtggattttctcctttcctctcgccaacatttgttcgagacccttcgtcagaaactcgaatgtactcaagtgaagatgaaacaacttgtagatactcatcgtcgtgaagccactttcaatatcgaggattgggtctatgtgaagttgcgaccttaccgccagacctccatagctgataagtatcagaagttgagcaaacgtttctacggcccctattag

SEQ ID NO: 72161 - DNA, 240 bp, Glycine max
  Peptide Sequence Number=SeqID_188939
atgagaggtagcttcttagggtttgggttggaagaggatagtgctattcaggctaggaataagcgtagccagatattgttttgttggttgatggtgaggtctatgttggaggtggtggtagggatcagtgatttgattcgacatgatggtggaataatggagaaacttgctttgcttttctattacagtaaaaaggcacaaagtcttccatgcattgaagaggtttatgtaaaaacttaa

SEQ ID NO: 72162 - DNA, 2157 bp, Glycine max
  Peptide Sequence Number=SeqID_188940
atggcagactccatttgctccaagaccaatatagatcgtatggaggaggcaattgccaaactggcctctaatcagcaccatgtaacctcgaagctcgatgatatcatccaatgccttacaacctgtattacagtcaaggaccgttttccaattcccaccatagacgaattattagatgaacttggagatgtgagcaagacggcctttcgaactcatcatggtcactatgagttccttgtcatgccttttggcttatgcaatgcaccatccttgtttcaagccaccaagaacagtgccttcagtccttacttaaggaagtttatcatcatcttcttcgacaatattctcatctatagttcattcctgccggagcatcttgcacacttggagaaagcttttgctgtgcttcttgccggaggattctttctcaaatactccaattgttccttcgcacaaacccatattgagtatttggggcatatggtttccaataatggtgttcatcttgtgccgacaaaaattgaggcaattcgtaattaccctacaccacgttcgatcagagccctacgtagttttttgggattgtcggggttttatcgtcgtttcattcaggggtatgcttcgattgtggctcctttaaccaagctcttggtgaaggaccaattccagtggattgcggcagctcaacgggcgtttgatgatctcaagcacaccctgtgcagtgctccggtactagaactgccggatttttctcaacccttcgttgttgagactgatgcttcaggggtaggaatggaggcgcaagtatacttagctcatctccccaggtttgattactcaatccaatacaggtcaggaaagtcaaacgcggcagctgatgctctatccaggatacccgaaaattacactggtcaattattcacattgatcgtgccccacttggtgtttatggaggatttgaagaaacatcgaatttggctgcccaaaggattcagcttcatccctctactacttgaggaatttcattccacacccaatggtgggcatatgggcattgctaaaacagtggcgcaggtgactcagaacatcatgtggcaagttctggcatgcccttgggaagatttgtcattagatttcatcggtggcttgccatcttttcgcggatcctctgttatcttggtcgtagtggatcgattttcgaaaagagtccacttgggaatgcttcagtccacttatacggctttcatagtagctcacctctttttggatattgtagttaaaaaccatggcatgcctcatagcttagtctctgatcgggatccattgttcctaagcaaattctggcaggagcttttcaaactttctggcaccaagcttcgaatgagctcggcttatcatccgcaatcggatggccagacggaggtcttgaatagggtcattgaacagtatctacgatcctttgttcaccaacgaccttcctcgtggggcaaatttcttctttgggccgaatggccgtacaatacttccattcacactgctacaggaatgacgccttatgaagttacctttggaaagaagccatcgtccattccgccttatcttcccggtacttccaatattgacgctgttgatgatttcttcacaagtcgtgaggctattttcaccatagctaggaagaagctccttaaagctcaacatactatgaaacactttgctgatactaagaggcgagaggttcagttcaaggtcggggatatggcttctgttattcccattccagttgacagtctaccaagcaactcagtggacaatgagcccgttatcactcctctcgtcatattggctactaagtgggcctcttctagtgatgggcctgaattactggccttggtgcaatggcaaggattgcttcttgaagatacctcgtgggaatcttggactgagctcaaagaggagtaccaccttgaggacaaggtgctttcagatgtggcaggggatgttatgaagcaacagcagaacaaaacagaaatgcaaccaaacaagaagcataccaacacagataagaagcagaccaacactcacctcagggataaaagggaattgtgcaaaccacacaatttggaggatttcgtgacctccttttggaccaaacgctga

SEQ ID NO: 72163 - DNA, 543 bp, Glycine max
  Peptide Sequence Number=SeqID_188941
atgatactaacatggacaattgatattgtaactgatgtggcacccgtatgtgggcttgtgatgtgggttaacgtggaaaaagaatatttacaatttaaaaaatggtataaaaatgatgaaggtctacgtgcaattgaggaggagaatggtgtggaggcactgaagatccaagggttgatattgtgtcaagcattatttggtgataccaagaggactgggtccgagttaaggccagagaataacccatttattccgttgtgtgttacttctactgatttgatgtgggaattggcactgcctattggtgcaaaccgtgaccatgaatattttaatccaagggctgggaatgtggttgagaaattggataagatgagggagcatgggtggagggagcttgcacagttgatgaagaaaagatcaaggatgcaagtggtgaaggactttgaagaagaagggttccgtggaatagaacttcttgagccatccaaagcaaagcatctcattgcgttagtgaaaggcttcatttactcaatctgcgcttaa

SEQ ID NO: 72164 - DNA, 543 bp, Glycine max
  Peptide Sequence Number=SeqID_188942
atgtcgaatcaacccattgacccctatcaatacctccaaatcttccgcaaccccgacggcaccttcactcgcctaaacgacgccgttccatgcaccccaccctcttccgaccccactctctccgttctcaccaaagacataaccatcaaccaacaaaacaacacctggctccgtctattcctaccccgaacagcactatcctcaaattccaatcccaagaagctacctctcatcgttttctttcacggtagcggcttcgtgcgactcagcgcggcttccacaatgttccacgatttttgcgtcgaaatggcgaacaccgcggaggccttcgtggcctccgttgactaccgcctcgcaccggagcaccggcttccggcggcgtacgacgatgccgtggaggcgctgcggtggatcgcgtgcagcgaagaggagtggttgacgcaatatgcggattatagtaagtgttatcttatggggaatagtgctggggccactattgcttaccacacaggagccattcctgattacgaagaaatggagtaa

SEQ ID NO: 72165 - DNA, 960 bp, Glycine max
  Peptide Sequence Number=SeqID_188943
atggcctccatctcctccgccgaactcaattacctcgtttatcgctaccttcaagaatcaggtttcacgcatgctgcttttacttttggttatgaagctggtattaacaaatgctccattgatggaaatttggtgccgtcaggtgctcttgttacatttattcagaagggtctacagtactttgagatggaagccaacttgagtaattgtgatgcagacctggaagaagatttttcattcttacaacctttggatcttatcacgaaagatgtgcatgaacttaggcaaatgataagtgaaagaagaaaaaaactacaaaaggaaagaaagaaggaatttgaaaaggagcatgaaggtgaacgtgtacgggtaagagaaaaggataggcgtgaaagggagaaagaagttgaaaaggatagacgtgaaagggataaagaagttgaaaaggatagacgagaaagggagaaagaagttgaaaaggatagacgagaaagggagaaagaagttgaaaaggatagacgtgaaaaggagaaagaagttgaaaaggaaagacgtgaaagacagaaagaagttgtgaaggatagggagaaggtagaaaatgataaagaacgagaacaacaacacggagaccagactgtcagaaaaatggtcatagatcatgaagatagggttcctgttgtaaagcttgaagagaatggagcagttggagggccagaatcaatggacatctctactacatcaacatctcagctatttgaaattcctagttcagatgtgacaattttggaaggtcatacttcagaggttaagtgtgtgcttgtgcatggagccctacaggatctcttcttgcatcaggaggctgctgtagcagagcagttaagtatagttgctgtagtggaccctaaagcaggcagaatagcagccagccatagtggatgggatagcagtgctatttgttga

SEQ ID NO: 72166 - DNA, 990 bp, Glycine max
  Peptide Sequence Number=SeqID_188944
atggagactttccttctcgattattctgggaaaaagctagaatacccaaacctggttcctcagatctgcctaccccatatacatactcaagctcttggattgccatttttgagtccatatctgcaatcaattggatctaattacaaacatggagctaattttgctacattggcatccactgtgcttctacctaatacttctttgtttgtcactgggatcagccctttctcccttgctattcagctcaaccaattgaagcaattcaaaactaaggttaatcaagtgtatgaacaaggaaccgaacttccttcaccggatatatttggaaaatctctttacacattctacattggccaaaatgattttacttccaacttagcagccattggcattggtggagtgcaacaatacctccctcaagttgtttcacaaattgcttccaccattaaggagatatataatcttggagggcgtacatttttggttcttaatcttgctcctgtgggatgctaccctgcattcttggtggaacttcctcataatagttcagacattgacgaatttggatgcttggtttcatacaacaatgcagtagtggaatacaacaacatgttgaaagagacattgaggcaaactagagaaagtctttctgatgcttctgtcatttatgtggatgtttacgctgttctgttagagctcttccggcatcccacttctcatgggcttaagtatggtataaaagcatgttgtggatatggagggggtgactacaacttcgatcctaaagcttactgtggcaattccaaagtgataaacggcagcagagtgacatcaactgcatgcattgacccctacaactatgtgagttgggatgggattcatgccacagaagctgcaaacaagcttactacctttgccattcttaatggatcctactctgatcccccttttccatttcatgaacgttgtgatcttcaacctataggttga

SEQ ID NO: 72167 - DNA, 507 bp, Glycine max
  Peptide Sequence Number=SeqID_188945
atgtctagttgctatctcatgggaagcagtgtcagggccacaattgcctatttcatgggtctacgcgcgatcgacatggcgcgcgatcttgagccgttgaagatcagagggctgatattgtgccaagtgtttttcggtgggacccagaggtgcgaatctgagattaggctcaaggacgacgaggttgtcccgctgtgtgtgattgatatgttttgggagctggcgctgccggttggcgttaaccgtgatcacgagtattgcaatctgagggttgagaagtgggttgggaaattggggatgatgaaggagctagggtggagggtgttggtgagtgggaatgatggggaccctgtgattgatcgtgagaaggacttggtagtgttgttggaggagaagggtgtggatgtggtgagtgattttgacatagatggttgtcatggggtggagtatgctgatgaatcaaaagcaaaccaactcatcctggtagtcaaacgttttgtttcatga

SEQ ID NO: 72168 - DNA, 813 bp, Glycine max
  Peptide Sequence Number=SeqID_188946
atggtattgtcttgtgttgtgaaccaaaaagtttccatacctcgtcatactgtgaaatttgtgaagtacagaccaaaagggagtttaaacaaaatctctaaggatattcagacccactacccaaacaagggtgaactgaagagtacattaagcaaacacacgggaccaatattcgctctgaagtggaataagaaaggagattatcttctgactggaagtgttgatcaaagtccaacacttgatgttgatcagcgcaacaatgtgtcttttgtcacaagttccacagacaatatgatatatgtttgcaaaattggagaaacccgccctataaaaacttttgctgggcaccagggtgaagttaattgtgtcaaatgggatcccacaggttcattgctggcctcctgttctgatgatatcacagcaaaggatacttatcttcctgacttaagggagcattccaaggagatatataccatccgatggagcccctctggttctggtacaaataaccctaatcataaactggtgttggctagtgcttcatttgactcaactgtaaagctatgggatgtggaacttgggaaactcatgtacagcttggatggacacaggcatcccgtatattctgtttctttcagtcccaacggcaattatctagttagtgggtctcttgacagatacatgcacatatggtcattgagggacggcaagattgtcaaaacatacacaggcaatgggggcatttttgaggtctgctggaataaggagggtgacaagattgctgttgttttgctaataatacagtttgcgtaa

SEQ ID NO: 72169 - DNA, 969 bp, Glycine max
  Peptide Sequence Number=SeqID_188947
atggtaaatactgttggaaatgggtcttttgtctataaggatatgctaatatattcagctccacagattgccataacaaggtatagagctgaaagtgaactgaagagtacattaagcaaacacaagggaccaatattctctctgaagtggaataagaaaggagattatcttctgactggaagttgtgatcaaactgcaattgtgtgggatgtgaaggcagaagaatggaaacaacaatttgaatttcattcaggtccaacacttgatgttgattggcgcaacaatgtgtcttttgccacaagttccacagacaatatgatatatgtttgcaaaattggagaaacccgccctataaaaacttttgctgggcaccagaaagcaaatagtttgagatatttcattggaatgcgatatagttattggacaagtgtttacattacatctgctaaatcacctttctgcatttttcagggtgaggttaattgtgtcaaatgggatccctcaggttcattgctagcctcctgttctgatgatatcacagcaaagatatggagtatgaagcaggatacttatcttcatgacttaagggagcattccaaggagatatataccatcagatggagccccactggtcctggtacaaataaccctaatcataaactggtgttggctagtgcttcatttgactcaactgtaaagctatgggatgtggaacttgggaaactcatgtacagcttggatggacacaggcatcccgtatattctgttgctttcagtcccaacggcgattatctagttagtgggtctcttgacagatccatgcacatatggtcattgagggacggcaagattgtcaaaacatacacaggcaatgggggcatttttgaggtctgctggaataaggagggtgacaagattgctgcatgttttgctaataatacagtttgcgttttggattttagaatgtaa

SEQ ID NO: 72170 - DNA, 792 bp, Glycine max
  Peptide Sequence Number=SeqID_188948
atggtttttcaatctacaggaagcaagttggcactaagtcatatgcatgattggctgattcttctgcttcttgctgctatggatggagccttgaacatgatagaaccattccatcgctacatcgggaaagacatgatgagagaccttatgttcccattcaaagaagataccatacccatgtggggtgtccctgtaggtctcatgttttcaagcttaatcactggagtcatcactgattccattaaagatgctgttggtagaccgcgaccaaacttcttccaccggtgtttccctgacaatatacctgtgtttgataaagacaatggtgatgttctttgtactgggattaaggcagttataaaggaaggatacaaaagctttccaagtgggcatacttcatggtcctttgctggtcttggtttcctttcatggtacttatcagggaaagttagagtgtttgatcgcagggggcatattgggaaactatgcctagtcttgcttcctttacttattgctgctcttgtgggaattactcgagttgatgattactggcatcattggactgatgtgtttgctggaggccttataggacttaccgtgtcttcaatctgctatttgctactctttcctttgcctactcatccacatggttgggctcctcatgctttttttcttatgatgagagagagtgattctccttcccaacgaggaagccaaactccagatacaacaagactagatgagtttcccctgcaaatggcggaaatggaaagtgggacaagatatatgtga

SEQ ID NO: 72171 - DNA, 2170 bp, Glycine max
  Peptide Sequence Number=SeqID_188949
atgcctactaccactttttcttgcttcctcttcacgttcctcatcatcacttccagcattgcctgtgtggctggagctgtgggggtgaattggggcaccatggcttctcacccccttccaccccacaaggtggtgaagctcttgaagtccaacagtatcaccaaagtcaagctctttgatgccaactctgatgttcttcaggccctttctggctccaacattgatgttagtgtgggtgttcccaacactatgctcaggagcttgaactcttctaagaaggctgctgatagctgggtccatgataatgttacccgctacatgcctaatgtgggcagtgtgacacgaatcgaatatgttgcagttggtgatgagccatttcttaaaatctacaatgaacaatttcatcccttcctcattggagctgctatgaacattcaagcagctttaaagaaagcaaaattggacagcaaagtgaaagttgtggttccatgtagctttgacagtttcgagtcaggatttaacctgtcctcgggagtgcatttgaggcctgacatcaacaaaaccatgattgagctcctcacatttcttgataagcatggatcacctttctttgtgaccatttccccattcgtaacccaccttcaaaccaaaaacatttcgctggatttctccctcttcaaagaaactgcacgccctcataattttagccataaaacatacaaaaacagctttgacttaagctatgatacagtggttactgtattatcaacagcgggatatcctaatatggacattgtcgtggcgaagattggttggccaacagatggtgctgtcaatggaagctcataccttgcagaaaccttcattaaaggccttataaaccaccttcatagtaacttggggaccccacttaggccacacaagccaccacttgaaacatacattatgagccttcttgatgaggaccaaaggagcattgcttctggaaactttgaaaggcattggggtttgttcacttttgacggccaagcaaagtaccatatggatcttggccaaggttcaaagagcctcgtgaatgctcaaaatgttgagtatctctcttctaagtggtgtgttgtgaacaacaataaagacttgtcaaatgcaactgccagtgctttagaggcttgtgcaagtgctgattgtactgctctgtctcctggtggatcttgctttaacatcagctggcctagtaacatatcatatgcttttaatagttactatcagcagcatgatcagagagctgaaagctgtgactttggaggtctaggtttgatcactactgttgatccatccatggatcattgcagatttcccattgagattcgcgtctctcactcagaatttcacaggatgtgtaatttcctgcagtgctttctttactctacttcacaaactcagcgtgctaaaagaatctcgttctcgcggtctcaaggaaccctagatcggatcatgtctggagcgtacggtcaagacggcggcggttccgcgccaccgtcttatggagccagcggcggatacggttccaccggcggtggtgccggtggaggtggtagttatggtggcggaggctatggaggaggaggaggtggtggcggatatggtggtagtgatggcgggggaggtggaggttacggagccaaaggcagcggaaacggcggcggatatggtggtaacgatggtggaggttatggcggaagaggcggctacagtggaaacgatggcggaggctatggaggaagaggcggcgggggaggtggtggtcaaggtggccggggaggtggaggttatggtggtcgagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 72172 - DNA, 165 bp, Glycine max
  Peptide Sequence Number=SeqID_188950
atgtgtcatgcgtgtgaacacaatagatttagaccctttcgattattgatgagtgaagttaatgcaagaaagaatcgaaggaaggaaggaaaggaggggcatatactcccaatggaaagcaacaaaagcgagaaacaaaaagcaagacatggtggcactacatga

SEQ ID NO: 72173 - DNA, 474 bp, Glycine max
  Peptide Sequence Number=SeqID_188951
atgctgctgacctctggtcacgccgagcacgcggataaccgtttcgatattctcaccgccgacccgcgggtgaccctgacgacgcgcggtgacagcaccgccatcgacgatggcaccggcatcagccactccaccgccgatccgctgcagctggtgcagcagcagctggacgcgctgggcatccggccggcgtttgatgcaaatctgccgtttcagggcggcgcgctgggtctgtttggttatgacctcggtcgccgtttcgaaacgctgccgcagcgggcgcagcaggatttacacacgccggatatggcggtcggcatttatgactgggcgctgattgccgatcatcatcgccagacgctgacgctgattgcccagcacgacgcggagcagcgctggcagtggctacagggcgctggcggtgccgcagcccaaaccctttgccctgaccagcgactgggcaggccaatatga

SEQ ID NO: 72174 - DNA, 687 bp, Glycine max
  Peptide Sequence Number=SeqID_188952
atgcgtccccccattacaggagtgcatcatgttttcaggtcttccggctttatcgcacgaacaacagcagcaggcagtggaacgtattcaggaactgatggccggcggcatgtccagcgggcaggcgattgcgcaggtggcgcaggaaattcgccagagccatcagggcgaagcgattcgggcgcgcttcgaagaggacgaagacgacgaatagcgcccgcgcggattcatcaggccggcctgcaccgtgcagcgtaccggcgcattacccggcgagacccacgcatcccaggcgcggttcatcgcggcaaagtcctctttgtctaccaggaaaatggtggcgtcgagaattttgcttttatccgaacccacgcgcgtcaggatgcggtcaatcaccgccagcgcgttggcggtctgcgcttccgcatcgtcatccagattctccggcacgctggtgtaatacacggtctggtcatgtacaaccgcttcggacatgcggtgctcggcatcaatacgcgtaatggtcatactgttctcctttatttttgctgcgttagcctgccatatcccatggccggctgtcatctgttgtggtcgcctgcggtgaatcctgacataattacagtagttttaagagcaatcggtgaggatgtgtggcagacgattttgcagcggatggcgcgttag

SEQ ID NO: 72175 - DNA, 726 bp, Glycine max
  Peptide Sequence Number=SeqID_188953
cgcaccgagcagctttatattctgcccgcctcacaaacccgtgataaagatgccctgacccgcgaaggcgtggaaaaagtgctgaacgacctggcggcaatggacttcgattttatcgtctgcgactcgccggccggtatcgaaaccggtgcgctgatggcgctgtacttcgcggatgaagcaatcattaccaccaacccggaagtctcttccgtgcgtgactcagaccgtattctcggcatcatctcgtcgaaatcacgtcgcgctgaaaacagcgaagagccggtaaaagagcacctgttactgacccgctataacccgggacgcgtaacgcgtggcgacatgctgagcatggaagacgtgctggaaatcctgcgcattcctctggtcggcgtgattccggaagatcagtcggtgctgcgcgcgtctaaccagggtgagcccgtgatcctcgatgcaaactctgacgccggtaaagcttacgctgataccaacacagccaacatagccaaggagaggctgcagattatcgtggccgaacgcagaaggggcgacagtgagccccactatctgccgcagctcaagcgcgatatcctggaagtgatctgtaaatacgtgaaaattgacccggacatggtcacggtgcagctggatcagaaaggggatgacatctctatcctcgagctcaacgtgacgctgccggagacggaagacgttcctaaatga

SEQ ID NO: 72176 - DNA, 435 bp, Glycine max
  Peptide Sequence Number=SeqID_188954
atgagtgaaatagaggatgtgcaagagcatatgaatgccgacatagaggtcgtgaaagaccgaatggctgccatgatggaagccatgttgagcatgaagaagataatgaaggtcaacacgactgcagttgccactaccaacgctgccactaaggtagacccaactcacctatcaggcctcaatcaagtaaatcctccagtctcaaatatagtagggcagggaggcgaagcattaggaagtacgggaggcacctattttgtgcaagttcagaacaagcattccttcccaccatatggcttgcctccaactatacaccacttgatgttgtacgcgcttccgatgacaatgtcaataactccactcccatactcattgagagccaacaaccccaatctagtcaggcacaggtccctcaacccatggggagacacatga

SEQ ID NO: 72177 - DNA, 183 bp, Glycine max
  Peptide Sequence Number=SeqID_188955
atgaatgcaaagagaaaagaagatatggatggagaacagggacacaacgacgttcatcaccacacccgaccacatcatttagtcaaccgtgcaaggcatgacttaggccctccgcgccgtcgagcacctcctcagattggtgggtgcagttctacatgtccccctacacccacacctgattga

SEQ ID NO: 72178 - DNA, 156 bp, Glycine max
  Peptide Sequence Number=SeqID_188956
atggttctacccaatgagaaaagcataaaagtcgaagttgcagcaagaaatatgctagttgctcaaggaaaaagtgaagcaaaagatatgagagtcattgttgaagagtttctttctaaagctcattacaagcagcttcacatgttcaacccatga

SEQ ID NO: 72179 - DNA, 282 bp, Glycine max
  Peptide Sequence Number=SeqID_188957
atgaagaagatcctaggcctacaagctccaatggagcttgcatcaggggagggcaatgatatgttgttaagggaaacattaagcccaaatgaggtaatgaacgacaatgctcattatggaccagtcaatgaaactaattcttacccttggagtccttcctacttagaaggagaatctttatcccaattcactatacaattggtgctttcattagtcactgtgcctccctctaaagttaaggacctcttgaaacaatgtctcactcagatgaaggacctttag

SEQ ID NO: 72180 - DNA, 255 bp, Glycine max
  Peptide Sequence Number=SeqID_188958
atggtgcttgctgtttatctcatgcccaatagcctcacttctactctggaaacccacttgtatctagaaccaacagtttctttttctggagcagagttggaagcagaagaaatttatgagacccttggagtggtgagaaggccttgtatgtatttaaagagtggtactaatactacctttgagtggcaaataaggagcaagtgttggagggttgaaagtccaagtttgactaagataagcgagtttttcagctaa

SEQ ID NO: 72181 - DNA, 1283 bp, Glycine max
  Peptide Sequence Number=SeqID_188959
tcggtcacacggatctaggaagcaatggactacttcactttaccccatcttcactgagccagatacagaaccaaccaaaaacagagaaaatgaggatggattatttgaagcaaaagtttcccttcagccacaaaaatttcttcctcaagtcacttctcacaatcttcttcctaggcctcgctttctgcatcctcttctttgactccctgtccccccagatttccccagttttggaatccccatttcctgagaaagtgccattaccagaacctcaaaatccacctcagacttcaactgttctagaacatgttcccgaacagccacctgttccagaacatgctcctgaacccccacctgttctggaacatgttcgcgaaactgaagatcaactgtctcccacagactcaaagaaatgttataactttagtggggattgggtccgggttacactaatgaaagctgtgacctcattgtttttcttcgtaccccattgcccggaggctcttcgctatgcgaacattgtatctcatcaaaattgcttgaagaatgggaggcctgatagagagtttctgtattggaggtgggctccaagagattgtgatttgcctcagcttgatccagaaaggtttctctacatgatgtggagcaaagcctgggcactcgttggtgattccatttcactcaacaatgtgcaatcgctgctctgcattcttgccaaggtggaacaacttgtctcattctaccatgacgaggaatacaagtgcaaaagctggcgttttccctcatacaacttcagtatgtcacttatttggtcaccattccttgtggaagctgctatttttgaagacgaaaatggtgtttcgagttctgaagttgagctacatcttgacaaactggatagtaaatggacggatcagtaccttgactttgattacattagtttttcaatcgggaaatggtttctcaaatctgcaatctactatgagaatgacaccatattgggctgccactcctgtcctaagaagaacctgacagagctggggtttaactttgcttattgcaatgccttgaaattagtaatgaacttcatagtgtcttcgaatcacaaagggatttttttacggacattcacacctgatcattttgaaaatatggagtggcttaatgggggaacttgtaagagaacgacaccaattaaaggtgagatggaaatgaaatatttgagaaagatgctccgtgacgttgagttggatgaggttggaaaggcagctactgaagcttaa

SEQ ID NO: 72182 - DNA, 585 bp, Glycine max
  Peptide Sequence Number=SeqID_188960
atggagaaatcgagagaagaaaagcttaggcaagtttgggattgtggcagcaccctatatgattcctacgagctcaactccttcaaacgccaattaaacacggcaatagcgaattccccgagcaatagaagaactctttccatgtctcatttacccgaacgttgtctctcatcacaaccacaaccacaaccacccatgtccaacaacaagtctttcaggttctctcgaaccttccagaaactccttcgatttgttttcaagtcccgcaacaaactgaggatctctagcacccgtagtactagtaacaatattagtactttccaagtggcagagaaatattccaatgaccgtttctacgttgtttatgataagtccgaaccggttctctccacaattcccgaacttccagagtttgaggtgggtgttctttcgccagatatcacttccttcgtcagaaagtcagcgtcggagcggtttatggccaccgcttctatcgtcaactgggtaggagacgcgtatatgggtggtggtgcatccattttcaggccaatgggcaacggccgaagtggtttatcaactacaaag

SEQ ID NO: 72183 - DNA, 516 bp, Glycine max
  Peptide Sequence Number=SeqID_188961
atggatgtggaaagcaatacctatcaaaaatggattaggcttgtgttggtctacataaaaatgctggtcaacactaggtttgaggacgacaaggataatgcgacatggcagaggatgaaggaatggttagacaatcaagaatgtggcagtgtgttggttcgacatggaccatgggataaagatgtgttacaattaccaaaaaagtttgaggagcgaactaaagggtgtggaatagtgtgcattggttgggcaccacaattaaagatattaagccacgtggaaattggtgggttttttactcactttggttggacctctatgatggaggctattcaaaatgagaaacctatatttctattaatgtttcttgaagaccaaggattgaacacaaaactattgaaagagaagaagatgaggtatttgattcctagggatgaacttgatggatctctcatgagtgatgcggtcatagactcaataaggctggttatggttgaggatgaagaaaggatctaa

SEQ ID NO: 72184 - DNA, 279 bp, Glycine max
  Peptide Sequence Number=SeqID_188962
atgaaaaatcagttgaatgcaggctccctcttgcaaagcccactggtatgtgacaaacctgataacgtgaaccagccaaaaagtattgctttgaaagtttcatataaccatgatcccaaactatggtctgacgatacgactagagttgaagccacacccaatcccttgattggtagctacgatcaagacggtggctatccacttgattgcacatgcagatttttatgttgttgccatgttctccttaaagagatgcaagtgatgctgataatgttgtaa

SEQ ID NO: 72185 - DNA, 1194 bp, Glycine max
  Peptide Sequence Number=SeqID_188963
atggtgggatcaaagaggagtcgtggacggccaccaaaaacggtgtctccggtacctgttaatcctccatcgccggtggctccaccggaaatggaatcagaaatccatgacgaagacgaagatggcgatttggctaatagtaaacaaggacctgctaatggaagtgaaacggtggctcaagaaaccctaatcaaagagcaagatggaattgggcgtaaactctgggttgacgtgattagtggaaacataaatccagctaagggtagagttatgcagtatgtggctcccaaggtggtagatggtgaaatagatgtgaaaattgaggatgaggatgttgccccagaattgaaattttgggaaactactttgatcttgtatatcttaggtggagatatcagtatgtatatgctgaagaatttcatggagaaggcttggaactttgtctccctgccggatatgtactatcacgatgatggatatttcatgcttcgcttcaaatctcatgcggatatggatgctgttttgatgaaagggccttatacaatcaggaatatgcctttgattttgcaggaatggaggccggattttgatctcaagaaagacatgttgagcaccatccctatatgggtgaaattgccaaaacttcctttgcatctatggggagaaactagcctaaacaaaatcgatagtgccattggaattcctctagtgacagatgaatgcactacacataggcttagagtttcatatgccagaatattgctggaagttgatattacccagaagatgcttgatgaaattactattacagataataagggtttaaaaagaaagcaacctattgaatacgagtggaggccaaaattctgtgagaagtgtcagacaattgggcatcaatgtgatggagctgctaagcataagatttggaagcctaagccgaagaaagttgatcctgataaaccgccaaaagcagaaaagaatagcactctggtgaagactctaattagagacaaaggtcccaatatcattgatgttgaagacggtggttgttggacagttgttaacaaatctagagataaaagaaaaggtaaagatgctactgaatcatcctctacattacaatgtctgaatggctttgaggctttaggggctttgaatggtccacaaggctcttatgacagaggcccatgttag

SEQ ID NO: 72186 - DNA, 2454 bp, Glycine max
  Peptide Sequence Number=SeqID_188964
atgcaacaggggccttggtgtgctgttggagattataacaatgtggctaaaagtcaagacagggttggaggtaaactggttactgaggcggaatatgaagatcttcaagctatgatggatgcaaccggtttgagtgaaatggacagctctggggaaatttttacctggactaataaacaggcagacaatcctatctattctaggatagatagaatattggctaacatagactggttccaaactcatagtgatgctaatctgactattctccccccccccatgtatctgatcataacatcctttatttgtctgagcctcttcatgttagaaaaagaaatcagttcagattcaacaactgctgggtggatgcagtgggtttttatagtattgtggaaagatgttggaaccaacctgctagaggcactccaatgcagaggttgtgcaagagaaaagttggaccaggctcaacaggaccttagaaataacatcatggatgcccccagaattgaggaggtgaaaaggttgactgatgaagtgatccactggaatgaaatggaggaaaaaatgttgatgcaaagatccaaaattgactggattcgggctggagatggcaataatgcattctttcatgcatatctgaaatccagacaaaatgctaaaagaattaaagttatccacaaagatgatggcactatcctcactactcataaggaaattactcaggaagtgctagctttttatgggaagctcatgggtcatgatagtataagcctccaacatgttgatatttatgctttaagaagaggagatcatctcaccatggttcaaagagaggatttagtgagacctgtcactgttaaagagattgaagatgctctaaatggaattagtgacttaaaattgcctgaagttgatggctatagctctaagttttttaagtcatgctggaacatagtgaaagaggatgtggttaatgctgctcaggaattttttgctcaagatcagttattcttgccctttaatcaaactgtggtgacattggttccaaagagtgataatgcaagtactgttaaggagtacaaaccaattgcagtttgtacaactttctacaaaatcatgtccaagattctcactgctagattgaataaggtgctccctagtgtggttagcctctctcaggcagtttcttatgaactattaaatggttatgctaaaaaaggaggtacccctaggacaatgatccaacttgatttacaaaaagcatatgatatgatagactggccaaaagaggcattaggcaaggggatcctatttcttccttgcttagtgatgatggaatatcttaacaggctgttggttaaattgcagctggaccctaattttaatcaccatgctaagtgtgagaaattggggatcactcatcttacttttgcagatgatgtactcctgttctgtagaggtgatgttatgtctttggaaatgatgcttcatgtgataaataagttctctaccactacaggccttgtggttaatcctaacaaatgcaggatttattttgggcgggtagatggtactaccaagaataaaatccagcaaatttcttcttatgaggagggccagctgccatttcgttatcttgaggtgccactaactagtaaaaagctcaatataaaatactatctgtcgctaattgataagattatgactcgaattcaacactggacttcaaagctgctcagtatggcagggagagttcagatggtgaattgcaccattactgctatcgttcagttttggatgcagtgtctacctattccaatgagtgtcataaataagattgatagtatgtgcagaagttttgtttggtcaggaagcactgaaattactagaaaaagccatattgcctggaattctgtctgcagacctaaaggccaagggggtctgaatatttttaatctgaagcctgtgtgggatgagttgctgaatagtgaaagatttaaaatgaaaaaggcttatgataaaatgatggaggctgatagagtgcattggagcggtctgatgaggaaaaactgtgctagacctagagcaattcacacaacatggcttgcttgccatggtagattggggaccaaggataggttggtcagatttggtatgatcaccgataagatttgtagcttgtgtaaggaggtagaggaaactcaaaaccatattcttttttcttataaagttgctactgatatttggagtaatgttctaaactggataggaattgatcatgtccctcaggagtggccgttagaacttgactggttgctgaacttgactaataggaaaggttggagagcttatttgctaaaactttcagtcacggagacaatttatggcatacggatccacaaaaatagttggatcattggatcaccttgtactcacttggcttttgagaagtaa

SEQ ID NO: 72187 - DNA, 417 bp, Glycine max
  Peptide Sequence Number=SeqID_188965
atggaggataaaatcatttggggtgcatccggagatggaatgtttactgcatctagcttctgccttcaaatggctcattgcctactggtgtggcacagtctcaacatggatggcgaaccttcattttatgctgctacgtgcgtggattggctagtcaacaacatcaatagcccaccaagagtagaaatgctcttatttttcaagacaagctcagatgtcatcaatgtgattcaacagtcaatgcctctgaaagcaatgaaatctgttcgttgggaagcatcaaatttccctttcatcaagctgaatactgatggatcatcatcaatggacgctttccttcaagcgcatgttctttgggaaggaaattccagtgctatctggcttaacacattggtgattgctgatagattaaaataa

SEQ ID NO: 72188 - DNA, 333 bp, Glycine max
  Peptide Sequence Number=SeqID_188966
atgaatccacatcttacggggttttctggttcaacaaatcaatcttttccaattcttcaaaatcagagatttgataatggacccagatttgaaaatctcttctttgatcaaagtaggaattttgatctacaatgtgatccaaatttaataccagctaacacaccctcatcctccactgtgacccatgaggagcattctcccgaggactgtgatttttctgatgcagttttgagttacatcagccagatcctcatggaggaagacttagaggacaatacatgcatggttcaagattctttagatattcaagcagcggagaaatcattctatgag

SEQ ID NO: 72189 - DNA, 420 bp, Glycine max
  Peptide Sequence Number=SeqID_188967
atggaaaaagcatgtagtatagagttgatccagttatcgagaaagaacccacctcctccacgagcggataagtctaggacaaggattcctcgcatggaaagagtgatgaacacgagcggagtcgagaatgtagtcgaacttgagagcccaaggaggcaaaaccacaagaggaaggtaacccctagggacccagcttcgtggggtaaacgctatgtccataacctcaaattggttatggcaatagaagcagaaaagaaatcaaccagaagcatgcctcatatcactttcactaatgaagactttggagacattgatcgatgccacaatgatccaatggtcatcaatatagagatgccaaacttcctagctacggagttttggatgacgccacttccagtgaaggaagataagtcaggatag

SEQ ID NO: 72190 - DNA, 441 bp, Glycine max
  Peptide Sequence Number=SeqID_188968
atggcacatcagtgtaccagtgaagttttgctaaccattcatgaacagcggtgtctcaatgatgtcatttatgaaagggtggagccaattctccatcctatgaacctattgagtgaccgaaagagttctttccctccacgtcatgtcaacttcatcgggctttggcagatggtttcgatgggtcttccatctcttgggtgtttgtttgcttcatggcattcatctccctttgcagggcgagatcagggaatgattgtcaagcacttgacacaagatgttaaccatggttgttgggctcccattttcagaggaattgtcgtgtttgttataattgatgataatgatgcggtcaaaggaaaagtttttcctagccccatgatgggcaccaaatgttcttatcatatttggcaagaggttgctcacggtggtgctcctttgtga

SEQ ID NO: 72191 - DNA, 1809 bp, Glycine max
  Peptide Sequence Number=SeqID_188969
atgaatgatggggttggaggttatgacttctctggagattatggcaattgtcctgatactaatggagatctcatgagcatttttactaaccagtttttgccaccaaactcaggtagttttcctgctcatagtcttcatggtgatggcatttcacattcttcttacaacccttcgaatagtgtggaagggcttgtaaattcttcaaaaagtataattcaggttcctgatctgaacagtgaaagtgaatccatttggcaatttcagaaaggtgttgaggaggctagtaagtttcttcctagtgcaaatgggctgtttgctaatttgtcagaaccagagccaaaggaaggaaaggatgaattatcatttaaagtggagaaggaggagggggaatatgttaatggtggatccaagggaaggaaacatcctcagatagatgaagcagatgatgaggaaaacagaagcagcaagcaagcagcaatttattctgaaccaacattgcggtcagatatggctgatataatccttcttcacagcaccggggatggtaaggaccactttgtggctcgccgtgaggctttgcagaataaaacacagaagtcagtgttgccaaaaggtcaatcaaaagcatcgagcagtgggaaggggcgcggtaagaagcaaggtgggaggaaggaggttgtcgatttgagaacacttctgtttctatgtgcacaagctgttgcagcagatgaccatagaaatgccaatgaattgctaaagcacatcaggcaacactcaaccccttttggagatggaaatcagagattggctcatatctttgcagatggccttgaggcacgtttggctggtactggcagccaaatttacaaaggacttgttggcaaaagaacatcagctgctaattatctaaaagcttatcatctataccttgctgcatgcccctttaggaaaatttctaagtttacctcaaacatcacaataagggaatcttcagcacagtcaatgaaggtccatgttatagattttggcatcttttatggtttccaatggccaacttttatacagcggctttcatggagagcaggaggaccaccaaagctacggataacaggaatagacttcccacaacctggtttcaggccagcagaaagaattctagaaacgggacgccgcttggcagcgtatgctgaagcctttaatgttccatttgagtacaaagccatagcaaaaaaatgggacacgattcaacttgaggaacttgagattgacagggatgagttccttgttgttacttgtttctatagaggtaagaaccttctggatgaatctgtggtagtggacagtccaagaaataatttccttaccctgattaggagaatcaacccaaagttattcattcatggcatcatgaatggggcattcgatgcccctttctttgttaccagattccgggaggcattgtttcactactcatctttgtttgatatgcttgagactattgtgcctcgtgaggactgggagaggatgctgatagagaaagagatattcgggcgggaagcattgaatgtcatagcttgtgaagggcctgaaagagtggagaggccagagagctacaagcagtggcaagcacgcattctgcgggcaggatttgtgcagcaatctttcgatcgcaggacagtgaagatggcaatggagaaagtgaggggtagctaccacaaggattttgtgattgatgaagatagccagtggttgttgcaaggttggaaggggcgtatcatttatgccctttcttgttggagacctgcatga

SEQ ID NO: 72192 - DNA, 375 bp, Glycine max
  Peptide Sequence Number=SeqID_188970
atgacgaaggagacatccttgttggccaggcttatgaaatctaaatatcatctccatgggcctttatgggaagcacggaaaggatacagacagagcttcacctggactagtatatgggaggcgaaatggatcttggaggaaggttgcgtgtggagcattggcgatggacggtttgctgactgggtggagtttgcgattgacataacggatgaggactctagagcaatggtgtctgcgatcttgtgggcaatttggtacattaggaatcgacttgttttccaaaataggaggatggagattcaacatgtgttgagtaagatggctcctgttctaccatcagggaagacattacaatggctcaagaatcaaacttga

SEQ ID NO: 72193 - DNA, 387 bp, Glycine max
  Peptide Sequence Number=SeqID_188971
atggccgtgaaaatgcatcttagtttcttcatcttagccaccattggctgcatgccattggtatctgtgagttcgacgactcatgttgtcggacacaaattgggttggaatttgcccagttacccagggttctacgacgactgggccaagaaacaaaccttcgttgttggtgacgtgcttcttttccagtatcacccaggacagaacacggtggttcaggtagacaagaacgactacgatcattgcactaccagaaatatcctccacacctacttcagagggaactcttctgctactttggagaagcctggggactatttttacttctcttccgttggcaagcattgcgactttggccaaaagcttcatgttactgtttctcagtga

SEQ ID NO: 72194 - DNA, 2808 bp, Glycine max
  Peptide Sequence Number=SeqID_188972
atgtgtttgtgggttaaaaagcagaaaagaaaagacaggggaagcgttgacgtggaatgtagcatggatgtgaatcacgaagatttgtactgttggaaagcagaacattctggcattgacactcagatggattctaaggcattgccaagctccagtttaaagactgcaaagtctcctcataattctacagggccaggatctggtgggtctgacactgatggtgtgactttgagagaatggttgaaatctaggcactgcaaagggagcaaaacagatcatttaagtatatttagaaaaattgtggatttggttgatggttctcactctgagggagttgcaatgcacaatctgtacccttctcatattaaattgttaccatcaaaccaggttatgtaccttgggttgcctactcagaaaaagatattagatagtattgcaaattctgaagttcttcagctagagaattcttttattaggaaaaggctgtcagagaaggtaatatctgcctctcttaatttgcggtcgaagaaacagaaattcaatgaaaatgctagagttgctggtgattggagtcaatgccctccaaggactgacttgaatcttcaaattgccaatgatattaaagtcaatgcggtgggatcacaagattattgcaatgaatacaaggaagatatccaattttctaaacataatatgcagagcatgtctcgcatccctcacatatttaatgcaggtcaattgcaattgaattctttaaatgaaagattggaagataaatggtatgcaagtcctgagggtggttgcacaacatcatcaaatatctactgtctgggagtccttctttttgagttacttaatgattttgactcagaaagagcacatattgctgcaatgtctgatcttggtcgtaggattcttccttcagttttcctttcagagtatcctatggaggcaggattttgcctttggatgatgcatcctgaaccatcatcacgtccaacaataagggtggctccaatgcttaatgtaactggttggggtggtgttaggttccatcaagagcatcacacaacagggttcaactccacggagatcctacaatctgaagtgattaatggaatgcgggaggtgtactttgaggaattatcattaagtcttaatcaagatgatgcagaatcagaattgctattgcatttcctcatctcactagaagagcagaagcacatggattccaacaaattggcagaagaaataagatgcttggaatcagatgtaaaagaggttgagaggagacatgacttgagaaaatccttgcttccctcaagcttgcagaacgactcctctcttcaaatagagaatgtgtctcttcttaaagaatcttcaagttcagaaacattaccaccagtatccacaatttctaatgcaaatgaactgagattgatgaaaaatatgtgcctacttgaaagtgcttacttttccatgagatcaaaaattaagcttcctgaaacagatactgcaactcacccagataaagatatactgagaaatcatgacaattggtgtgtagctcaaaaagacatggaacaacataagacgacagatactttaggagctttctttgatggtttgtgcaagtccacacgttatagcaaggatgaagactactttgctgctgctgggatatcaaagaaaattaaaatttttgagttcaatgcacttttcaatgactccattgacatccattatcctgtagttgagatgtcaaacagatcaaggctcagttgtgtttgctggaataactacatccagaactatcttgcctcgacagactatgatggtgcagtgaagctatgggatgctaacacaggccaggggttttctggattcaccgaacatgaaaagagggcttggtctgttgatttctctttggtatgccctactaaatttgttagtgggagtgatgattgttctgtgaaactgtggagtatcaatgagaaaaagagtttagccacaatcaggaatgttgctaatgtctgctgtgttcagttctctactcattcctctcatttgctggcctttggatctgctgattactcagcatattgctatgatcttcgcaatcttagaagcccttggtgtgtgttggctggccatcgtaaagctgtaagctacgtcaaattcttggactctgagacacttgtttctgcatcaaccgataatatgttgaagatctgggatctcaataaaacctctcctgtgggtctatcaactagtgcttgcagcttaaccttgtcaggacatactaatgagaagaattttgtgggtttatcagttgctgatggatatatagcatgtggttcagaaacaaatgaggtttttgcctactataaatcacttccaatgccagtcacttcgcacaggtttgggtccattgatcctatttctggtaaagagacagatgttgacaatggtctgtttgtttcaagtgtgtgctggagagagaaatcagacatggttattgctgccaattcaagtggatgtataaaagttctacagatgcgcttctgggatcagataggagacgaagtagtgtacacttgcttggatattctgaatggtgaaggtgatcctacgggtatgaataaaaccttcactgtccttattcccaaagtcaaaaacccagttaaaggctctgaatttagacccataactctatgcaatgtgcttttcaagttgattactgataatgctctcattgcatatgaatgttttcactacacgaggattaaagatagaggaaaaagatga

SEQ ID NO: 72195 - DNA, 2193 bp, Glycine max
  Peptide Sequence Number=SeqID_188973
atgacaaatcaccactcaaaggaatcaatcaagttttttgggagtctaattgatcctgaaaatgttgaagacctccaaagaaccaaaacagatattgaaaataacatctctaagattcttgagcttattaagaacaaaagccatagcaaagaagatgatgagaaccacaaacattctacaagtgggacagaacttgttgggttaatagaggatttatacaagaagcaacaatcactttatgccatatatgattgtgtcattgaagagtttgagaaagtagtttctcgcaaaagaatcaagaaggttgcaatgtcttcctctgactcggactctgaatacttttccccagaggaagtagatggcattaagagaaagtcagaaaaagaatattacagtgtatcttatcttggcacccttaagcaagaatctgatagaggtgattgtacagatgaggttcctaagattgaagcaacaaagtttgaggaacaattaacttcactagcgaaagaggttgagagtttgagccagcaaaaaaagaatctagaacttcaagttgaaagccagacacatgaagttaagcatctaaccttgaagaacattgagttgtatgaccaagtatcagaacttgagttgttgttgaaaagggaaaaaggtgtggtatcagatctacaaacacaactaaataacagcgagagccaagcaaacttagcaaagtccaatgttgcaaatttgatggcaaagatcaatgagctagaactagagaccaaatccctacaaacacaaaaaaatcaaatgggagaaaaaataaaatgtgacaaaaatgaagcattaacccaaagagaggacttgatggagcagctcaatgccatgcaacaaaggctagattacatagaaaatgagaaaagggaactagaagttgagatggaaagccaaagggaacaaatttctcaacaccttattcaaatagaaaatgtgaaggacaaattatctgaaatgagatcggttgagcacaatatggtggaagagaaagaggggtttcttgagaagctaaaggatctagaactaaatttggaaattcaaaacaaccagaaaaatgaattggaagagaagttgagagccacaagttacgaggttaaacaactggcagatgaaaacaaggcccttcaagacagaaatcatgaactgagaacaacaatgacacagaaaggggaagagatctccatttttatgagagaacatgaaaaccataagaatggagcttccatggaggttatggctttaaaagaaaaacttaacggtatgagacttgagctagatactatgcgtgaacagaaaaacaagctggagctacaaaatgaacgaagccaaaaggaatatgctgaaagcctggcaaaggtggagactttgaacaccaacttagcaacccaaatagacgatcaagcgaaaacgattgaacgagtcaacgaggagaacaaacaagccaaaattgtgtatagtaaattgaagttgattcaggtaacagcagaaaggaaaatgaatgaacttgcagaagagtttcgaaggaaaatggaagacaacatcaggttattgcaccaaaggatccacgtggcagaacaactgaacaacgagaacaaatacagttgcaaagtaacaaagcagaggtatgaggaagagaacaagaatttaggactgaaaattgcgagttacaaagaggaaaagacaacgcgtgttccaattgggtttgaattggttgcactaaacagattggatttggtggttgagaaggttgaggagcacatgagtcgcatggctagaatgaggtgtgaggttgagtttgtgaaggattggatgagggaaaggaatggagaagtgaaagagcagagagaaaacgtggattgtcttagggagttgttgaacaaaaaggaagagcaagaattggtgttaagggagaatgtgtggaaattagaggcaaatgtaagcaaggagggaggggagaagttgaacctaaggaaacaagtgagccagcttgagaagaaagtggggaaattggataaaattttgaaagagaaggatgaggagttgattagccttggggaaaagaaaagggaagcaataagacaactttgttttgtggttgagtttcatagagatcgttataactatctaaaggacatggttgccaaaaaagggtaa

SEQ ID NO: 72196 - DNA, 336 bp, Glycine max
  Peptide Sequence Number=SeqID_188974
atgactaggtccaaatcaggtgacttgcatccatatgatcttgagatagataagacatttcataggttgagtagaaataataggagtagaagtgtagttgtgcatgttagtgtagtttttgatagtaatgtagtgcatactaaattcattgttgactctatttctgattttgtttctgagcctgtttttattgcttttgattctaaaaaaaatagtgttgatataacggttgataacaaccaaactcttaaggaattggctacaccagatgttgtgtaccaaccttggtgtattcaatatcctgagactaaggtgaagatccacacaagcatctaa

SEQ ID NO: 72197 - DNA, 523 bp, Glycine max
  Peptide Sequence Number=SeqID_188975
atggcttcatcttccataaaaaacacacaccaccttaaccgcacaaaactcttcatggaagaagatacccttttgaagaagaagcgtcactaccccaaactcatacgaatacgtgtcaccgacgccgacgctactgactcttccagcgacgacgacgagccctcggtgtcctccacgcgccgccgagtcaaatacttcgtcaacgagattaccatccaaggcggcggcggcggtggtggttgcgttaacgttgtttctaggaaaagaaggttcaaggctggtgccggagctccatcgtgtcggcggcggacgggggcgaagaagttccggggagtgaggcagcggccgtgggggaagtgggcggcggagattagggacccgttgcgccgcgtgcggctgtggctgggaacctacgacaccgccgaggaagccgccattgtgtacgacaacgcggccattcagcttcgcggtgccgacgcgctcaccaatttcgtaacgccgccgcgggagaacagaaaaaccg

SEQ ID NO: 72198 - DNA, 1026 bp, Glycine max
  Peptide Sequence Number=SeqID_188976
gatatcaagtgtttcgtccaagagtgcagcatttgccaacaaacaaagccaagcacccaccgccccgcaggacttcttcaacctctaccaacacccactggagtttgggaggatatctccatggattgcatcactcatctaccgcaatctcacggttacatcgtcatcttggtcgtggtagataggtattccaagggtactcatctcggagcgttgcctaccacctactcagcttttaaagttgcatctctattcatggatattgtgtgcaagcatcatgggtttccaaagagcatcatctctgacagagatccagtttttcatagtttcttttggcgcgagcttttctggttgagtggaacacacctgcgcatgagcacggcttatcatccgcaatccgatggccaaaccgaagtcatgaatcgcatgactccatttgaagtgatttacggtaagccaccaccggcactgcctcaataccttcaaggtacatcgacaagcgaggccgttgattctctgatatcatctcaccaggagattcatgaaaagctccaacggcgtttaagcaaggcacatgagaccatgaaaagatttgccgacgccaagcgctgggatgtcaccttcaccaccggccaatggagcgtgtcgaacaagtctggtatcgacttaaattaccagatgaagcacgaattcatcccgtcttttattattctctcaagcgggaacaccatgctcaataactctacattcccaccaacgaggttcgtactaattcaatgggagggccaaccaccagaagacacaacctgggaaaaatggccggacattcgagatacataccaccttgaggacaaggtggtgtttgagggcgagggtattgttagcaacagcctgcaagatgacgaaggtgctgaaagcaatgaaccgcatcaggagcccgttcaagaaccgcatcaggagcccgttcaaggcaggtccaaatgttcagcctcaagacctagttatctacaagactatgagacgtga

SEQ ID NO: 72199 - DNA, 1731 bp, Glycine max
  Peptide Sequence Number=SeqID_188977
atgtgtgattcttggactggagtgacttgcaatgtagacaagtccaaagtaatagcaattaggttgccaggggttggatttcatggcactattccgcctgatactattagccgcctctcagcactgcaaactttgagcctcagatccaatgtcataactggccatttcccttctgatttttccaatctgaagaacttgtcttttctctatcttcagttcaacaatatttctggtcctttgcctgatttctcagcctggaagaacctcactgttgtcaatttgtccaataaccatttcaatggcaccatcccttcctcccttaacaacttgactcagcttgctggtttgaaccttgcaaacaacagtctttctggagaaattcccgacctcaacctgtcaagattgcaggtgctgaatttgtccaacaacagcttgcagggaagtgtgcctaattccctgctaaggtttcctgagtctgcattcattgggaataacatttcctttggaagttttcccacggtttctccagagcctcaaccggctcatgagccatctttcaagtccaggaagcgtggaaggctcagcgaagctgcgctgctgggagttattattgctgctggtgttttaggcctcgtgtgttttgtttctttggtgtttgtgtgctgctcaagaagagttgacgaggatgaggaaaccttcagtgggaagttgcacaagggagaaatgtctcctgagaaagcagtttcaaggaaccaggatgctaacaataaactggttttctttgaggggtgtaattatgcctatgatttggaggatttgttgagggcttctgctgaggtgctgggaaagggaacgtttggaactgcctataaggcaatacttgaggatgcaaccatggttgttgtgaagaggttgaaggaggtagccgctggaaagaaggattttgagcagcacatggagattgtaggaagtcttaagcatgagaatgtggttgagctcaaggcatattattattccaaagatgagaaactcatggtatatgattaccacagtcaggggagcatctcttccatgttgcatgacatctctttacttcagaggagcctcactcaggaggaaagcaaaagaggagaggatagggtgcctttagattgggatactcgactgaaaatagccttaggtgctgcaagaggcattgctcgtattcatgttgagaatggtggcaagcttgtacatggcaacatcaaatcctcaaacatcttcctcaacaccaaacagtatggctgcgtgtctgaccttggcctggcaaccatatcaagctcacttgccttaccaatatcacgagcagccggttaccgtgcaccagaagttacagacaccagaaaggcagcacagccctcagatgtttacagctttggtgtggtgttgctagagcttctgactgggaaatcccctatccacacaactggtggtgatgagattatccaccttgtgaggtgggttcattcagttgtgcgcgaggagtggacagctgaagtgtttgacttagagctgatgagatatcctaacatagaagaagagatggtggaaatgttacagatagccatgtcatgtgtggttaggatgcccgatcagaggcctaagatgtctgaagtagtgaagatgatagaaaatgtgaggcagattgatgcagatactcactcatcatctgggaaccaagtatcaacgtga

SEQ ID NO: 72200 - DNA, 189 bp, Glycine max
  Peptide Sequence Number=SeqID_188978
atgcaaaaattgttaggacggaaatgttcaacccaatattacgcatttgcagaaattgcaaccgataagatgtactcgtcaattatcaagcaaatgttttactccactgccaccagagatggcactgttgtgatgcagccagtggaagggagacacacgatgtcgaagagcatggtcatcgtgaaatag

SEQ ID NO: 72201 - DNA, 903 bp, Glycine max
  Peptide Sequence Number=SeqID_188979
atgtgtgttgattaccgggcactaaactcagtcaccatctgtgaccgtttccctattccgatgatagacgagctacttgatgagttagggcacgcttcttggttttctaagctagacctcaggcagggttttcatcaaatcctgatgcatgagcctgatgttaagaagacagtctttagaatgcaccgagggcactacgaatatagggtgatgccattcgggttgtgcaatgcaccctccacttttcaggcagccatgaatagcttgttaacctcgtttctttggcgatttgctactgtgttctttgacgatatcttggtgtatagtcagttctatcttaagcgtaccaaatgtctttttgcgcaaacccaagtagagtatttagggcacttggtttctaacagaggagtcaaacccgagccatctaaagttcgtaccatggtgcaatggcccttgccaacttcacccaaggagctcggagcgttcctcggacttactggtttttatagaaagtttatcaagaactacatgttgatcgcggctcctctcaattcactactaggcaaagaagcattcaactggtctttaactgcaaactcagcgttcgaacaaatgaaaacagccatgactagtgcccccgtgctagctctgcttgacttcgacaaaccattcatcgtagaaaccgatgcctccgataccggcatgggagttgtcttaatgcagaagggtcatcctctatgctttgacttacgtccgggaacttcatgcaatcgtctcggccgtgcgaaaatggcgtcaatacctgctagggcattcgttcaccatcttaaccgatcacaagagcttctgagaactaatgtcacaggtcgtccaaactctagaatagcattattatctatctaa

SEQ ID NO: 72202 - DNA, 216 bp, Glycine max
  Peptide Sequence Number=SeqID_188980
ggggatggttggacggtgtttggaacaaatgctggaactgggagatcaatgcttcaactacaggtatcgggtgaggaggaaggtgttatcggtcgggttgggcggacggagaaactgagcaatgcggggttgaaggaaattatgggtactactgctgtctatgaggatagtaaggtgggtgtggttaataacactgataaggcaaaaggtctctga

SEQ ID NO: 72203 - DNA, 333 bp, Glycine max
  misc_feature (51)..(51): n is a, c, g, or t
  Peptide Sequence Number=SeqID_188981
aagaaaaaagaagaagtagagacgagagtcgtcatcacggaaagggcaggncggacgaaatcagtgtcctatctttgctttcctcttatctccgatgagagctggattgcttctggaggaagcaacccagctcacctgggcgagctgggcggcaacctcctccccctttttcctataaataggctgaagggggctgttctaaggatcccggatgcccctgaaaatccaagccgaggtgcttccgtaacgcttccgagaggtttccgtaagcaaatccgtgaaggttttcctccgttattcaccgttcttcatccgttcttcgttcttcaacgg

SEQ ID NO: 72204 - DNA, 384 bp, Glycine max
  Peptide Sequence Number=SeqID_188982
atggccatgctgattttcaagcaattctccattcagtgtgatagatttgagaatgttcgtgagtggtggtgtcagaccctaatttcgtccatcgatgatcatttgctaatattttggttcttgttggccgaattgagctgcttgacaccagttgtcgtgcaatccataaggtttttcaatgtttcagtaaataatgcagaaaatacccacaagggaggacaaaagggtcattcgaaggcttttccggacccccgggtcacccaggctagcccctggctcatctgggcccctagaaaactcagggctaaagtaactagcttgcctgggcgagctgagctcacttgggcgagctgctgttcaacctcctcccctcatttcctataa

SEQ ID NO: 72205 - DNA, 408 bp, Glycine max
  Peptide Sequence Number=SeqID_188983
atgttggtggcgactcccgtgcattttcctttcttggaagatacacccttgggttttgcctcaccctcccgccgaaaggtaggttgcgacaggtggcaatggaggttgtcataccctaatttcgtctggggactattgtttgatggcatgcaacctttggttgaccgcttcgagaaactagacccacttgggccttccaggatgttcctccagaaggcggttgcttctggaggaagcaacctggctcgcctgggcgagctgggtggcaagctcctcccctattttccgataaatagagggaggagtgaaggtgaaaggggttcagcccttctggtacttcgtaatcacttaaaattagtgaggaaaattgttttcgtgaagaaaatccaagccgaggcgcttccgtaa

SEQ ID NO: 72206 - DNA, 353 bp, Glycine max
  Peptide Sequence Number=SeqID_188984
gtggggtggtcgacaaaaatggtgcttttgctcctacgtatcctcaatttgacatgaggaactcagacatgaccacattggtctctgcttgtcaatcggacttggggtctccgaatgacgaggtgcggataaccgcaaggtgtctccgcatgccaatggactcacaggtcacaatagcgaaagtgcggggtgagaaagtcgccagcgcacaggattttggttggcaatcaaaggaagaacaccacttcaagtcatggtttcctttccttccttatttggttcacattagccgcttaacagtgaatggctcttctttcttgggagatccctctgctacttcttctgagggctag

SEQ ID NO: 72207 - DNA, 217 bp, Glycine max
  Peptide Sequence Number=SeqID_188985
ttgggcaacccactgcgattctagcaacagttctttgggcatgatgctaatgggtggaccactagatctaccttttgccaagaccatcaaagtctacgaggacgtgggagattttagcaatgatgaggatctcacaccatccatgatcgcattctatcggggtgtttgcggtgaagagatatccaagggaaaggtggtttcatctgacaaggaatga

SEQ ID NO: 72208 - DNA, 310 bp, Glycine max
  Peptide Sequence Number=SeqID_188986
atggcacatctgcagccccgcctgtccaatgcgacaatgatggtgttagaggaaaccactggaaagttgcaggctgacataaggaaaagcatctcgagaaggaagagcaaaggccaaggcccatccgacgatgagtcccacgaaggtactaataccggggacccgaccatcgatatcgagcaagaagcgagttggacggaggatgaagaagatgaagatgtagggcttcccccagagctggaaaagataattgctcgggagaatcaagagatgaggccgcatcaagaagagacagaactcatagacttag

SEQ ID NO: 72209 - DNA, 570 bp, Glycine max
  Peptide Sequence Number=SeqID_188987
atggacttcattgaaggtcttccttcttcttttggtaaacaagtcatttttatagtggtagataggcttagtaaggaagctcatttcatggccttatcacatccttatactgctgcggataaggcccaatgcttccttgatcatgtctttaaattgcatggttttcctgacaccattaccagtgatagggatcctgtttttgttagccacttttggaaggaatttatgtccttgcaagggattcaggccagatccaatgcaaagttgacccctaagtactatggcccatttccagtagaagacaagattggtcctgttgcatacaagcttaaattgcctcttggatcaatgaagtttaatggtactgctactgctgggaactttagtccttcacctttattggatacttctcaaaaggaacctgcagctatcattgacagaatgacagtcaagagaggaaattgtgctgtaaccaaagttttggttcaatggaaacatcaactacctgaagatgcaacttgggaattattttatgactcgaagcagaagtttcctcactttaatccttga

SEQ ID NO: 72210 - DNA, 678 bp, Glycine max
  Peptide Sequence Number=SeqID_188988
atgagatgtcaggcccagcggtggattgtagcagctcgtgcttatctgttgcacctcgtcagttgcactctttttgctaataagagtgcaacatacgttcatgtggtacacctagacgcttttcacgacctgggtcagagtggtggttatgcttggggagttgccacgctggttcatatgtatgatcagttagatgaggcttctaggaccaccacacgacagattgcgagtgctggatctatgagcacttccctagtgcaccagttcgtgacagatgatacataccaggagacctccccacgtgcttcctggtggttgacgtcaaaggcgcacatgaacggaatcacaggagcaccttacagggcacgttgtgatgctttgaccatcacatatgtgtcctggttgccatacactgagcatcggggggttagggcctttgagctgatttcatcattccagggtcagctaagatggggtcctatggtggtcacagctcgaccggagagggtggtatctgcggattacatggagtggtttttccgcatatctcacccatttatgataccgacccaggcaggtgaccagcctagagatgcaccagccgcagaccctgaggagtacatacagtcgcccagcccccaggttccagtggcatttgacccgcctcgacatgtagtg

SEQ ID NO: 72211 - DNA, 1398 bp, Glycine max
  Peptide Sequence Number=SeqID_188989
atggctggagatgaagaaaaacttacaatagtgatgttcccatggctagccttcggtcacatgatcccaaaccttgagttggccaaactcattgctcgaaagggccaccaagtgagtttcgtatccaccccaagaaacatacagcgtctcccaaaaccgtcaccaaatacactcatcaatttcgtgaagcttccactccccaaaatccaaaaccttccagaaaacgcagaagccaccactgacatcccctacgacgtcgttgaacacctcaaagtagcctatgacgccctccaagaacctttaaaacgttttctcgaatcttccaaaccggattggctgttctacgacttcgtgcccttctgggctggttcaattgcttccaagcttggcatcaaaagcgctttttacagcatctgcactccacccttctcggggttcttaggacccccttcgtctctcatgggtaaagattcgttacgccaaaaaccggaagatttcatcgtttcccctccgtgggtcccgtttccgacaaccgtcgcatttcggtacttcgaaattatgagaattgtagacagtttgtcggccgaaaacaacaccggcgtatccgacgcgtaccggtacggtgccagtgctgagaactgtgacatcgtggtgattagaggatgcaccgagttccaaccggagtggtttcaagtgctggagaatatttaccggaaaccggttctccccattgggcaactccctagtactgaccctgttgggggtgaggataccgacacgtggcggtgggtgaaggattggctggacaagcatgcgcgtgggagcgtggtgtacgtggcgtttggaagcgaagcgaaaccaaggcaggacgaagtgacagagatagctttgggtttggagaaatcgaagcttccatttttctgggcgctgaggcttcagcgtgggccgtgggacccagatgtgttgcggttaccagaagggttcgaggagcggaccaaagcgcttggagttgtgtgcaccacttgggcgccgcagttgaagattttggggcacatggcggttggtggcttcttgactcactcgggttggacctctgtggtggaggctattctgaatgagaagccgttggttctgttaacgtttttgtcagaccaaggaataaatgcgagagtattggaggagaagaaaatgggctattctgtgcccagaaatgaaagagatggattgttcacgagtgactcggtagctgagtcactgaggctggttatggttgaagaagaaggaaggatctatagggaaagaattaaagagatgaaggacttatttgtgaatagagaaagacaaaatatgtatattgataatctcctacgcactcttacaagctcattgaaatgttaa

SEQ ID NO: 72212 - DNA, 855 bp, Glycine max
  Peptide Sequence Number=SeqID_188990
atggaagaacatctcaacagcataatggaatcaagatttgtcgagctcactgcttccatgcaacaaacaatacatggaatgtttcagcagaggcaacaagattctccaacagcaagcaatccacctagagatctttgtgaagatcccatggcagatttaatgaaactcaggcagacaggatccatcatagagtatcatgaggagtttgactcaattgtatcaagagtagatctttctgatgagcatcaacttagctgctttttaggaggattaaaacaagaggttcagatgattgttcaaatgtttcagccaaattcagttcaaaaggcttattcccttgcaaagatgtatgaatcttccttctccattacacaacccaaaccatttgtcaagaaccaaaaatcttcctttgtttctaaaccacccttttttccaaaccctcctagatcaaccaatcccttaaccatcaatccctccaccaaaccacaaacacctaagcacctaactcctgcctacatgatccatgtgttggaaattgaagatgaagaggagggctctggacctcaagagcctgatgctaatgtgattcctttaacacaaggagctaaccctgtcaacaagaggccctataagtatgctaaacaacaaaaagacattattgatggattgattcaggactatttgaagtcaggaattataaaaaagagtgatagtccttatgcaagtccaatagtgttggtgggaaagaaagatggggcctggagactttgtgtggattatagggatcttaacaaggcaactgttaagaacaagttccctatatctttagtagaagaccttctagatgagttgtag

SEQ ID NO: 72213 - DNA, 447 bp, Glycine max
  Peptide Sequence Number=SeqID_188991
atgacactgcaaaaaagaagagtaatcacatacaagaaattacacttcgatgatggaaacgatgacgacaacaaacggaggtttgagttcaacagtgacgagaaggcaagtggagcaagagaagccactggagagggagcgtgggggatacgttgttttctaagcgtttgttgtctccgttggtgtacgtgcattgtttacgaatatacggtaaagttcagtgatttttcgttgctagagaagaagagggaacaaagaataacttacctcgaaggagaacgcttcttgcgtgaatggaagcaaggaagaatagggaacgaagaagaagaaacaaacaagaagaaccaaggaagaagtaacaaggagctagcaccaacaaaggaagaagaacaacaacaacaaggaagaagaagtgtgaacgaaggaagaagtgactcgtatggatga

SEQ ID NO: 72214 - DNA, 240 bp, Glycine max
  Peptide Sequence Number=SeqID_188992
atgaagattgagaaacctacaatcactgtgagagagaacgagcagaatgaaagcgtgagagagaacaaaagtgtgaatggaagcagcatgagactgagaacgagagctagggtgcgaaaggatgcgaagaacgcaagatctctagctatcactctaaaagcaagaatgaaatgtctcggtagcgacacaaccacgaatccatatagcactgttagcattgacgacaaccaacaatggtga

SEQ ID NO: 72215 - DNA, 1534 bp, Glycine max
  Peptide Sequence Number=SeqID_188993
tattcatcaaccatctccgctcagcaacagcaatctcttcaccggcgacagcgcgctgtgcgaggcggtagtgcgtgaaggggccggctgggaccgcgaatggctggcgtccgtcggcctgcagctcggtagcgcggagtcactggaattaggtcgcctggccaatgcgcagccgccggagctgctgcgttacgacgcgcgcggtgagcgactcgacgaggtgcgctttcatcctgcctggcatctgctgatgcagggcgtgtgcgccagccggttacataacctgagctggcagcctgacgtgcagggcagcgccatggtggcgcgcgcggcgcgtttcattctgcatgcgcaggtggaagccggttcactttgcccggtaaccatgactcacgccgcgatcccgctgctgcaaacccatctgcccgctccctacgccgactggcacgatcggttgctgagcgatcggtatgatgcgcatcatctgcccggcagccagaagcgcggcctgctgattggcatgggcatgacggagaagcagggcggcaccgatgtgctgagcaacaccacacgcgccgaaccgcctggcacgcgtacgccgggcgaaccctggcgcatcaccggccacaaatggttcttctcggtgccgcaaagcgacgcgcacctgattctggcgcagaccgccgccgggctgagctgcttctttctgccgcgcctgctgccggacggcacgcgcaacgccattcgtcttgaacgcctgaaagacaagctgggcaaccgcgccaatgccagtgccgaagtggagtttcaggatgccttcggctggttgctgggtgaggagggcgatggcgtgcggctgatcctgaaaatgggcggtatgacgcgctttgactgcgcgctcggcagccatggccagatgcgacgcgcgctggcgattgcgctgcatcacgccggtcagcgccaggtgatgggcaaaagccttagcgatcagccgctgatgcgtgcggtgctggcgcagcaggcactgcagctggagggacaaaccgcgctgctgctgcgtctggcgcgcgcctggtcaacgccggccagcgcgcatgaacggttgtatgcacgcctgttcaccccggcggccaagttcgttatctgcaaagctggtatgccgtttgtggctgaagccatggaggtgctgggcggcattggctactgcgaagagagtgaactgccgcgcctgtatcgcgagatgccggtgaacagcatctgggagggctcgggtaacgtgatgtgccttgatgtgctgcgtgtactgggacggcacgcggaggtgcttagtatgctgcaggatgagtttgatgcggtgaagggcagcaatcgccacttcgatcgctgctggcgtcagctgcggctacagctcggcaacctgcgcgaagagcaggcacggcagtgccgcggtgctgctgaaagcggcagaaccgccgctggcagacagctggtgcgcgcgttatctctcatcgcgcccggcacaggcgctgagtga

SEQ ID NO: 72216 - DNA, 537 bp, Glycine max
  Peptide Sequence Number=SeqID_188994
gcggcgcgcgccggtgagcacggcaaaggcttcgcggtcgtcgctgcggaagtgcgtgcgctggcgcagcgcagcgctaatgcggcgaaggagattgacgggctgattgccagttcgatcgacaaagtggccgccggccatgcgctctcggaacaaacacgtgacgccatgagccatattgtcagccatatcgaacaggtgaaaaccctgatgggggaaatcaatatcgctgcccaggagcaggctgcgggcattgtccgagcacacagcgcagcacctgagtcagaaaggccaccatctgacccagctgcacgggcagatggcttacacttgagtcatctgcctgttttccggagccaccatgcgtacgcttattctgctgctgggcctgctgctgagcggctgtgccgcactgcacaccacgccacaacccccgccagcgcccactactcaggcgcaggagatcacccgcgcgcaaagctatggcctgccgaagcttggcaccgtcagcgcccattcacgcggctcgccggatga

SEQ ID NO: 72217 - DNA, 459 bp, Glycine max
  Peptide Sequence Number=SeqID_188995
atgataggtaaaataataggtaatatctacatgttaaatattgaacatgcatcatttcatgaacttagttgtttggttattcaaaatgaaaaaggtcttaacattatttcaattagaagtgatcatggaggtgaatttcaaaatgagtattttgaaaatttttatgaaaagaatggaattcaccataacttttttgccccaagaacacctcaaaaaaatggtgttgtggagaggaaaaatagatcccttgaagaaggagctagaactcatctaaatgaaacaaagttaccgaagtacttctgggctgatgctaagatgaagatgcaggttttcaaaataaggattctactcttgaagatgaaaccaaagttgaagagcttggacaaagcaaagaaatcactgccacacctcctaaagacctccctagagaatgaagaactcaaaaagatctctccttaa

SEQ ID NO: 72218 - DNA, 1071 bp, Glycine max
  Peptide Sequence Number=SeqID_188996
atggcaagcaatccttcaagagctcagaagaaagcaaaatcttccaagaggaagcaagacgaatgctctcaggctactctcaacaggttggacacatggttcactaatgaaagcaagaaaaaagactacaagatgatctacgctatcaaaaacatgaggatccccaagtatttggacttggaatggttctctcagcaaggattcaactttcctaatctgctggaagcacaaggactatcaaagttggtgcagatgaaaggaaccttttatccggagctagtcaaggttttctacacttgcgcacatgttgaccttgaaggtaatctcttctctactggtaatggagtagaaatggtcattgatactgctatatggaaggaagtagccaatctggacatgggtggagtctgcaagtttgatgaaattgttgatgggtacaacaagatgcagacatatagaggaatgcttcttgacccaacgaggaacttgaggaatcacttacgagttggtggactaactacaaaggacataatgttagtttaccttatcacctacattctcactctgaggtcaagtaatcacgctaaggtaatggatgataatctacaggctgtttatggtctgaaatcaggtatcaagatgaattgggtgttgttgattgaagacattatgctgaagagtcgtcgtctggtggattatgaatttccttatgttatacttgccttaagattcattgactataattctataagattgttcctcaattcctgtaataattcatccatggccttactcaatcgatttacctcttccaatttggaaggaatgtcagctcctttaactaacaagggaggttcttgtccatacaaagctttaaaaggagacatcttggcggagatatcgaagttgttagactcctcaaataagcttctaagcatcggttggctacttcagtatgcacatatgtatgaggatgagaggcagtgctcatctttaattgggtctgctttcctaaacaacttcttccaaaaaaggctcataaaaagtttgtctttgtctaatactatttaa

SEQ ID NO: 72219 - DNA, 309 bp, Glycine max
  Peptide Sequence Number=SeqID_188997
atggttgagtggcctaggcttaaagatgctaggggattaagaggattcctagggttaataggggaagaagctattcatgcctttgaagagcttaaggcaacaatcaggaaacttcctattctaacactactagatttttctaaaagttttatcttggaaactaatgcatcaggaactggactggggacatttttattgcaagaagagaaacctttagctttttggagcaagactttatcatatagggctcaactcaaatcagtatatgagagggaattgatggcaatagtgtttgcagtagggcaatag

SEQ ID NO: 72220 - DNA, 289 bp, Glycine max
  Peptide Sequence Number=SeqID_188998
atggggcattcagtgcctagagatgagcaagatggatcgttcacaagtgactcagtggttgactcactaatgttgaagaagccaaagttgatgagctatggtctaggcttttcaactaagatagctagcaatactatgaacgatttgttcaatttcgacaaagttcaaaaagctagtgtgttgatggaaggaggtgtcataaggcttaactacattggcaatgatttggtaatcattagaggcatagatatggacaacgcccaacaacttatgtacttaaatgatgatg

SEQ ID NO: 72221 - DNA, 3064 bp, Glycine max
  Peptide Sequence Number=SeqID_188999
atgcctgtttcaggacatgaagagaccggggtaaagtcctatgctgggaaatttagtggtttaattgcaggtgtgcctatcaagaaaaggaggtttcctacgattcagccttcttctgcacctgtgtctgaggaaccatattctctcactgaagaaaccgagttacaacgtaaagaaaattcaagcacttctcaaggaccaactttaccaaatgctgcaggtgcaccaatcaagaaaagaaagttcccatatcttcagccttctttggaagaggcttcacgttcagaagaaagtgatcccttgcgaaaggaacattcaagcacgtcaccgggttcaactctttctcccagttcttctggtttatctgatgctaatggaatccctgcgcttgaagataagaaagcaagtactgatgttaccaatgctaacatggttcaaagcaactcttgcttccttactcccaaacgtgagcaatcaaatgtcagaactcaatcatgtactttggacgtcatggatagcaaagagaagattctcagtcaaggtagcaataaaaaattggaatcccaaattatcaaagggaatcctgaactcttattggctgcaaaggaaggtcttgctcttagcattggagctgatgtaagcaaacaaaatgtccaagatatttgtaaacaagagactcctttagtttcaggaagtcctggtttatctttaagcttaaaggagcacgtcttaccagctgttgcaagtatggagaatgatgggaatcgtcaaaaaacagagaaagcagaatctgtctcgttggaattatctttaagcaaagaagactgtagtactcacagtttaaatactgatgctaaaactgatagtgacacaacttgtgttcaatctaacagggcaaactgggatctgaatactacaatggatgcatgggaagaatctgggactgaagctggcttggttaaaacaagtattgatgggctgaaaattactgatggttcacttgatgaaaagcagttagtgtgctctacagggatgacgctgccaacaagtgttgtgtctgtaaagccaatgtgtgaagagagtcataaagaagctttcacttttccatctggaccgtgtggacagcagtttaaatttctcgactcaagtattctatctcttacacctattcagaaatatactgaggaaccctcaagattatctgttaagctgaattctggtagtgctattcccaatgtgagcttgtcaagtttggcttcaactgtgggtgatgcaaatacttctagttttaggttggtaaaaccagaaccatttgatgagagctcaaaaaaggatttgaaggaagctaatgcctctcctgtgggttcattagatagtgttgctgttaaacaagaacttgttcagccttccactgccaactcttcaaagttgtcaaatgttagcaatttaatgaaagttgatgctgcctctgttaaactggaaccaaatcacgagggcagtcaggaaggatccaatgctgcattgagtaaaatggatcagttgaataaagatttgcgacaaggatcggataattcttctccttccttggcgatgccagttatgccagagacaacacaaatctctgccgaggcagattgtgctccagtgaaaccattgtatacaaaagagttatcaaccagtgaaaacatagtaagccagattgaaaattctagtcttacggatggagtcgatgttgagaaagtttgtcatggtgtttgtttaaatgccgagcaggttaccatagaaacagttgctatgcctatggttggtaatggttcaaagttgaatgatcctggtctgcaaactttttctgttagaactgaggaagaaaatgctgctgatcgtgatgcttgcagactgaaactcatgaatgagcctccacctgtcccacgaggcaatggtgaaggctgtgtaagtgatgaagaaaagataaccctatctactgatatgttagaggatgattcttacggttctgattgcgagtcagatgagaatcgtgctgtaactattggtgtggataccgaacggtatgttgaagatgatgattatgaagatggtgaggttcgagaaccactggatccttccacagcagaagacaccatatgtgaggtaagagaagtagagcatcctgactgtagtaattttgtaaataaacagatggaaaaaggaatggtgagtggcgattgtcccacttcatatcagttggtggaaaatgacaatattactgcaattcaaagtgaaataaataatgaagttgttgatatggacattgaaatgcatgagaggtctggtaaggtcattgataaaagtgtgtgtgtgcaagagtcattggatgatgagaagtctaacattgctgctcatggtgctaatgttttgcaaatgaaagcattagatcttttagatgggaaaaatgtctgtgaagctctggtggcagaatcaccttccaatcaagccactaatggaagccatggggttgatttccagtgtgctgatgaggttgtcaaaacagctgacatagttaaacaaactgacttagattttgaaactatggaagtgtctgcaaatgctgatgatgcagccaaagatgttaataatggtggtaatccagggagaattatagttctgtctcgagctactagttcttcatctcctggtaaaactaggcccatttcaggcaggtcactgtcgtctcgagctggaagagatgtattgtctgactcacttgatggggataaattacacagaggaagagatgaagttttcattgatggccctcacaaattttctagagaaagacatcaagatatctcccctagaaactctagatttaactttgtgcgaggtagaggaagacttaatagtcgattagactcagttcgtagtgaatgggaatctgaccgtgaattttctggtgagttttacaatggtccaagtcagtttcgtgggcccaggcctaagtatgcacctgcttttgccgataccgatatggagtacaataatgttgcacctgatgggtcatatgttg

SEQ ID NO: 72222 - DNA, 147 bp, Glycine max
  Peptide Sequence Number=SeqID_189000
atggacattggtgagagtgtgattgtcaatgaaatcaggaatgatggtggccggagaaaggtacgaccagataaggccaagatcccaaggatgggtggcacactagggtacatgaattccaagattgttcaacgggcaagtatttga

SEQ ID NO: 72223 - DNA, 2088 bp, Glycine max
  Peptide Sequence Number=SeqID_189001
atgaacgacgcagatgtctcgaagcaaatccagcagatggtgcggttcatccgccaggaagctgaggaaaaggccaacgagatctctgtctccgccgaagaggaattcaatatcgagaagctgcagttggtcgaagccgacaagaagaagatcaggcaagaatacgaacgcaaagagcgccaagtcgaaattcgcaagaagattgagtactcgatgcagctgaatgcttctcggatcaaagttcttcaagctcaagatgacgtgatcagttccatgaaagaagctgcatccaaggaactgttgaatgtgagtcatcatcatcatttgaatctactgagtcatcatcatcatgagtacagaaacctgctgaaagatctcattgttcagtgtttgcttagactgaaagaaccttctgtcttattgagatgtcggaaagatgacctgcatttggtagagcatgagctggattcagctgcccaggagtatgctgagaaagcaaatgttgatcccccagagatcattgttgacaaccaagtctatcttccacctggacccactcatcacaattctcatgatctctactgctctggtggggtggtgttggcttctcgtgatggaaagattgtgtgtgaaaatactcttgatgcacgacttgatgtagtgttccgtaaaaagcttccagaggggttcccgatctccgtgtacaaccgcacggcctccaaagtggaccagaccgtagatcgtgcccgcaacgagggctccctccctctcacgggccaatacacccctcgcgacttcgttctctccctccagcgccccagatccgtcatcatcctcgtcaaggcaggctccccagtcgaccacaccatcgccgccctctccgaccacctcgaccccggcgactgcatcatcgacggcggcaacgagtggtacgagaacaccgagcgccgcatgaacctcgtcgccgacaaaggcctcctctacctcggcatgggcgtctccggcggcgaagacggcgcacgccacggcccctccctcatgcccggtgggtcccaccatgcctactccaacgtccaggacatcctccacaaaatcgccgcccaggtcgaggacggcccctgcgtcacctacatcggcgagggaggctctggaaacttcgtcaaaatggtccacaacggaatcgaatacggcgacatgcaactcatctctgaagcctacgatgttttgaagcacgtcggtggcttgtcgaattccgagcttgcggagattttcgtggagtggaacagaggggaacttgagagtttcttgattgaaattaccgccgatatttttaaagtgaaagatgaagatggtgaagggtttttggtggataagattttggataagactgggatgaaggggaccgggaaatggacggtgcagcaggcggcagagctttcgatagccgcgcccacgattgcggcgtcgttggattgccggtacttgagtgggttgaaggaggagagggagagtgccgcggcggtgctgaaggaagcggggttgagtgatgaattggggagggtaaatgtgagtggggtggataagaagaggttgattgatgatgtgaggcaggctctgtatgcttccaagatttgtagttatgctcaggggatgaatttgttgagggctaagagtaatgagaaaggatggaacttgaatttgggggagttagctaggatttggaagggagggtgcatcataagggccgtgttcttggaccggatcaagaaggcttatcagaggaaccctaatttggcgagtttgattgtggacccggagtttgcaagggaaatggtgcagagacaggctgcgtggaggagggttgtggggttggcggtttcggctgggattagtactcccggaatgtgtgccagtcttgcttactttgatacctatcggagggcaaggctgccggcaaaccttgtccaggctcagagggacttgtttggggcgcatacttacgagagggttgatcgccctggggcttttcataccgagtggacgaaactcgctcgcaatagtggggctggagttggtgcactcaattga

SEQ ID NO: 72224 - DNA, 124 bp, Glycine max
  Peptide Sequence Number=SeqID_189002
atggattgggcttctgaggtaaacttgtataaaaggacagcacagcacagcacaggagatcttggtgcattcggcagacgagaaaacacaaatgggtcatgccgatctcccttgtttgctacag

SEQ ID NO: 72225 - DNA, 816 bp, Glycine max
  Peptide Sequence Number=SeqID_189003
atgaggagtactattgttttacgattgggaagacgtgcgcgtattccattccaacgagcattagcaacgcagagtaacaataataacactctggtgtttatccctctccctcgctgcctcagcgcaacgcggtcgtttcactttcagcgcaattcaccgtttggattctccagcgggcatgggcaacgcaggagcatgttcatccaaacgcagcccacgccaaatccctcgtctctcatgttttatcccggcaagcccgtcatggaagttggaagctccgacttcccaaaccctcgttctgcaatgaactctcccctcgccaaatcgctcttcgcaatcgacggcgttactcgcgttttctttggatctgatttcgttaccgttacgaaatcggaagaggctgcgtgggaattcctcaagcctgaagtcttcgccgccattatggatttctactcctccgctcagcctctctttttagattctcaagccgccgcggccatggatacagctattcaccaagtattaaagatttacattagaagtcagcataggctactaaagggaaaatttaaaccattttttttatcagcaaaagatgattctgaaacagttgcaatgatcaaggaattgttagagactcgaattcgacctgcagtgcaagatgatggcggggacattgaatatagaggttttgacctagatactggaatagtaaaacttagaatgcaaggggcatgcagtggctgcccaagttcatcagtgactctgaaatcaggcattgaaaatatgctgatgcattatgttcctgagaagtag

SEQ ID NO: 72226 - DNA, 2253 bp, Glycine max
  Peptide Sequence Number=SeqID_189004
atgtcatctcgcattgttgcggagaatgctctatcgctcaccaatattgtcacgcctccatatttcgacctaatggaactggacgatctcacgcgccgcccctccgccggagacatgcccacgctcggacagctcctcaagcacgtcggagacgtgcggaaggaagcctccggcgacggaagcgagacgcccgttcaccacgctctcgacatccccgggatcgagcctcgctcgctgcccttcgtcctctccttcagcaacctcacctacagcatcaagagtcgccgcaagatgagcctctcatcaatctttccccgtcgtagcaaccgcctcggcgcggtggcggaggcgccaacggtcggcgagagcatgttcactcggacgaagacgctgctgaacgatatctccggggaggcgcgggacggcgagatcatggcggtcctcggcgccagtggttcaggaaagtcaaccctaatcgacgcgctggcgaacagaatcgccaaaggaagtctaaaaggcacggtagcgctgaacggcgaagctttggagtcgcgtcttctgaaggtgatttccgcgtacgtgatgcaagacgaccttctcttccctatgctcaccgtggaagagactctgatgttcgctgcggagttccgacttcctcgcacgctatccaagtcgaaaaaaagcgcacgcgtgcaggcgctcatagatcagctaggtctccgaaacgcggcgaaaacagtcatcggagacgaaggccaccgcggagtctccggcggagagcggcggagagtgtcgatcggaaccgacataatccacgacccgatccttctattcctggacgagccaacctcgggacttgattcaacgagcgcgtacatggtggtgaaggtgctgcagagaatcgcacagagcggaagcatcgtgatcatgtcgattcaccaaccgagttacagaatcctagggctactcgaccgcatgatcttcttatcacgcggccaaacagtgtacagcggttcaccctcgcagctaccgctatacttctcggagttcggtcatccgattccagaaaccgataacagaaccgagttcgcgttggacctgattcgcgaactggaaggctcaccagggggaacaaagagcttggtggagttcaacaagtcgtggcagagcatgacgaagcaccaccaggaaaaggaagaggaaagaaacggcttgtcgttgaaggaagcaataagcgcgagcatctcgcgagggaaactggtatcaggggctagcaacacgaaccctaacccgtcgtcgatggtgccaacttttgcgaaccagttttgggtggagatggcgacgctgtcgaaacggtcgtttttgaattctcgaagaatgccggagttgattgggattagattgggaacggtgatggtgacggggtttatactggccacgatgttttggcaactggataactcaccaaaaggagtgcaagagaggctaggattcttcgcgtttgccatgtcaactactttttacaccaccgcagacgcgcttccagtgtttctccaagaacgctacatcttcatgagggaaactgcttacaacgcctaccgcagattgtcgtatttggtttcccatgcgctggttgcgttgcccgcattagcatttctctcgctggctttcgcggcagccacgttttgggccgtgggcctggacggtggaatatcgggctttttgttttattttctgataatattcgcttcgttttgggccgggaactcgttcgtgacgtttctttcgggggtggtgcctcacgtgatgctgggttacaccatcgtggttgcgattctggcatacttcttgctcttcagtggcttcttcattaacagggataggattcccagttactggatatggttccactacttgtcgttggtgaagtacccatacgaagcggttctgcagaacgagttcgatgaccccgtcaagtgcttcgtgaggggtgtccagatattcgataacactccgcttggctcggtgccggagcctctgaaggtgaagcttttggagaccatgagcagcacgctgggaacgaagatcaccacctccacttgtttgaccacaggtgccgatatattgcagcaaaacggggtcaccgatttgaccaagtggaactgcttctggatcacggtggcttggggattcttctttaggttcctcttctatttgtcattgttactgggcagcaagaacaagaggagctga

SEQ ID NO: 72227 - DNA, 1464 bp, Glycine max
  Peptide Sequence Number=SeqID_189005
atgtcgttagcccaggattctttattgccaaagtttaaaaaaagtcctagacgatctaaaagtaggtgggagccaatgccagaggagaagccagttgacaatccaatgttaatcagtaatgatactgtaaaatacagtaattgggtacctaatgaaaaggacagaaaggtggcagtggaaaacaaagaaagcaaggatgggttgaggaatactaaattttctccattactgcagagattatctagtaaggctcttcaaaggccatttaagaagcagcgtcttacagatgcttctattgcttctgaaaatggtgatgcatctagtgatagcgacaaggaacaaagtttgacggcatattattctgctgcaatggtttttagtgatacaccagaggaaaggaagagacgtgaaaaccgttccaagcgatttgatttaggacaagggcgtcgaacagaaaataatcactcaaggaaaaaacatgccgggggtggaagcttttacaatagaagggctagtgccttggtgctgagcaaaagctttgacgatggtgccagcaaagctgttgaggatattgactgggatgctctaactgtgaagggtacttgccaggaaattgaaaagcgctaccttcgcctaacttctgcacctgatcctgccactgtaagacctgaagaggttcttgaaaaagcactattgatgattcaaaattcccagaagaattacctctataaatgtgaccagttaaagtctattcgccaagacctaactgttcaacgaatacgcaatcaattaacagtcaaggtgtatgaaacacatgcccgattggcactggaatttggggacctgtttgagtataatcagtgccaatctcagttgcaaactctttatgccgaaggcattgaggggtctgatatggaatttgccgcttacaacttgctttgtgtcataatgcattcaaataataacagagatcttgtatcatcaatggcaaggttatctcacgaagcaaagaaggatgaagctgtaaaacatgcccttgccgttcgtgctgctgtaacttcaggaaattatattgcattctttagactgtacaaagcagctcctaacttaaacacctgccttatggatctctatgttgaaaagatgcgctataaggctgtgaactgcatgtgccggtcatatcgtccaactctacctgtttcatacatttctcaggttcttgggttttcaactggcgtggccacaaatggagtgagcgatgagagagagacagatgcattggaagagtgttcagaatggttgaaagcacatggggccagcataattactgataacaacggagatatgctgctagatacaaaagtttcatcatctaatctgtttgtgccagagccagaggatgctgttgcccacggagatgccaatcttgctgttgatgactttttagcaagagcgcctttatag

SEQ ID NO: 72228 - DNA, 1587 bp, Glycine max
  Peptide Sequence Number=SeqID_189006
atggccaacgaaggaagtaatgccgagaccttagctcctgcggagccacatctgttcgagaatcggcatgttgatgctaaccaacatcatccaacttcctatgttcccactacaactgggtctgaagctgcgccatggactgttcatagctctacaggaaatggagtttattctaatccaacctaccagtatgatcagcatccacagccacctggaagaagcattcaagattgtcaaaatgtatcatcagttgctggtaattcatcaaatttgggaacagctaatgtaacccaagattacaatgcttacgcatcatacccaagttcttctaatccatatggttatggcagcatgggatactcaggctactataacaactatcagcagcaacctaatcatacctattcacagcctgtaggagcatatcaaaacacaggtgctccttatcagcctatttcctcctttcagaataccgggtcttatgctggatccgcaagttattcaagcacttattacaatcctgctgattatcagactaccggaggttaccaaaacagcagcggatatggaaatcaagcaactatgtggaacagtggcagttattcttctcatccatatactaactacaccccagattccggtggttcttatagttctggtactgccactacttcagtgcagtatcagcaacaatacaaacagtgggcagattactacaatcaaacagaagtcagctgtgcaccagggacagagaacttatctgtcacaagttcatctactttggattgtcctattcctgcagttactagtggttatgcgactccaaatagccagcctccacaatcatatccaccattttggaggcaagagtccagttcttcttccataccttcttttcagcctgccacagtaaatagtggtgatcgtgatggttactggaaacatggagcccaaagttctcagatacaacaaactaatcctattcaaccaaactatcaaagtcctttggatttaaaatcttcttatgataaatttcaggatcaacagaagactgtatcttctcaaggaaccaatttgtaccttcctccaccaccgccaccacctctcccctctcaactggtgaatctggcacctgtacaaagtgtttcgtctccagatgcaaaacggcccaaagccgaaaaagatagctctacaaccagttcagcaccaaaacctgtgtatattgctgtttcgttgccaaagccaagtgagaaaatatcatctaatgatgctgctaattctatacttaagcctggtatgtttcccaagtctttacgtggctatgttgaaagagctttggcacgttgtaaagatgataagcaaatggtcgcatgtcaggctgtcatgaaggagataatcactaaggcaacggctgatggtactctcaacacacgaaattgggatatggaaccacttttcccaatgccagatgctgatgtgatcaataaagagtatgctgtgtcctgttttcctcttgtttttgtgtttctggtttttgctaattttcaaggtttgatcaattactatttcttcttccaattttcttaa

SEQ ID NO: 72229 - DNA, 2406 bp, Glycine max
  Peptide Sequence Number=SeqID_189007
atggacgatatagaaaaacccgagaagagaagcagagatcgtcactcggaacgccatcgcgactccgatgagcaccgccaccatcgatctgacaggaatcacaagcgcgaccacaaatccagggacaccgaaggaagcaaggataaggatagggcttacgaaagagaaagtagcaggtcgaaggtgaaacgcgatgaggagagggaatattcgcattctcacaagcggaaggagagggagcacagcgaggacatggacttcctggataataaaattagggtttctgacgagaggagggaacgaaggaagtttggggataaagtaaaaaaggaggaagatgatgcagaagaagaagacggtggtgataatgttagagccgttcacgaggccaaggttaaggaggaagttaccaatttcaaagacactgcgtctctccaaaacggtgcattgggatcacctgccagtgtgccgcccgagacatctttgacccctccttcttccattcctatcaaggtatcttcgaattttaccacaaatgaaaataagggtcttagtattaccaggtctcatgaggttgctggaaaatctagtacagatggaccttcttcaactgctggaaaaactggaagcttctctattgatgcccttgctaaggctaagaaagctttacaaatgcagaaagagttgtcagaaaagctcaagaaaattcctcagttgaataagagttctacccaaactttgcaaggaagctcaaacttgggttcaaagactgaatctacaatgccctcttccaatgctggagtggcattaataacttccacctcagcttctatgggccatgttgcaaatatgtcaatttccgcctcaactgcttctgcaaatcctccagctactgccactagtgctactggtactgcaactctaccaaactttgaagctgtcaggcgtgctcaagagcttgctgccaggctgggatttcgcccggatccacaatttgctcctctaattaatacgtttcctggtcagaatcagatggtaacagatgttgctatcccacagaaacccaccaaggcccctgttcttcgtcttgatgctcagggacgggaaatagatgaacatggaaatgttgttaatgtgactaaacccagcaaccttagtacattaaaggtcaacattaacaaacagaagaaagatgcatttgaaatactaaaacctgtattggatgtcgatcctgaatctaatcctcattttgatgcaacaatgggtatcaacaaaactaagctcctgcgacccaagaggatgaatttccagtttgtggaggaaggaaaatggtcaagagatgctgaaacaatcaaattgaagagtaaatttggagaagctcaagcaaaagagcacaaggccaaacaagcacagttggcaaaggcaaaggctgctcctgatataaatccaaacctaatagaaataacagagagagttgtaatcaaagaaaaacccaaggaccaaattccagaaattgaatggtgggatgtgcctcttctgcattctggaaattatggtgatattgataatggaaccataggtgaagataaactgaaaatggaaaagatcactttttatgtggagcatcctcgtccaattgaaccacctgctgagcctgcccctccaccacctcaaccattgaagctaactaagcaagaacagaagaaactccgaacacaaagacgtatagccaaggagaaagagcgacaggagatgataagacagggtgtaatagaaccaccaaaaccaaaggtcaagattagcaacttaatgaaagtacttggcactgaagcaactcaagatcctactcggcttgaaaaggaaatacgtagtgcagctgctgagcgtgaacaggctcacatagataggaatattgcacgcaaacttactcctgctgagctgcgggagaagaaggaaagaaagctgtttgatgacccaaatacagtggagacacttgtctctctttacaagataaatgatctctcacatccaaaggcccgctttagagttgatgttaatgctcaagagaaccggttaactggatgtgcagtgatttgtgatggcattagtgttgttgtggtggaaggtggaaacaagtcaattaagaggtatgggaaacttatgctcagacgtattaattggactgacgtttcaaaagagacagaagaaaatgaagattcagatgatgataagcctatcaataagtgtgttctggtgtggcaaggaagtgttgccaaaccaagcttcaataggttcagtgttcatgactgcatcaccgaagcagctggccgtaaagtttttgtggatgctggtgttcctcattattgggacctagctgtgaactacgtagaagatgaagctgtttga

SEQ ID NO: 72230 - DNA, 228 bp, Glycine max
  Peptide Sequence Number=SeqID_189008
atggcatgtaaggtctttgacaataataatatttgcattaaaagtgatttatgtgcttgtggtggcgttgctgtgttcttcaagttccgagtactaacttatgggagagagacaagaaatagctcgagcccatactctagtacagtacaaagtctactcctcatctcgggtcgcgctctttctttgtatcaagttcctagacggtcatgtctcccacagcgcaagtga

SEQ ID NO: 72231 - DNA, 804 bp, Glycine max
  Peptide Sequence Number=SeqID_189009
atgatctcaaactcggaccttgtagaacctgccacggcaaccgccaccgccgtcgcaacaaccgcctcttcttccaatgaagatcaggctgcaccgccagcggcaccaaacattgtgatgtccttaggatcacgattctctcttcagcgccgaaatggaaggttcagctatggatattccagtttcaagggtaaaaggtcatcaatggaggatttctttgagaccaaaatatcagaggctgatggtcagacagttgcattttttggtgtttttgatgcagctgctgtttctcctttatggtttgctgtagtctggtttgtctatgatggtggtcatggaggttcccggactgcagaatatctgaaaagtaatctgtttaagaatttgagtagccaccctgactttatcaaagacacaaagactgctatagttgaagcatttaaacagacagatgttgattacctcaatgaggaaaaggggcatcaaagggatgctgggtccactgcatcaacagctgtgttgttgggggaccggattgttgttgcaaatgttggtgtgattccagagtggttgcatgtagagctggctcaggttgatgccatgtcagttatgtgtattgttcctttgtccattgatcacaaacctgatagatccaatgaacgtcaaaggattgaacaggctggtggattcataatttggaccggaacatggagagttggtggtgttcttgctgtttcccgtgcatttggaaacaaacttcttaagccctatgttgttgctgacccagaaattcaggttgcctaa

SEQ ID NO: 72232 - DNA, 1071 bp, Glycine max
  Peptide Sequence Number=SeqID_189010
atggctactacattctttgcatgtgaccctgcagaagatgattacattgacatggaagtcaactcatacaccaacttcttctgccattctcaatctcatccacagcctagagaatttgagttccaaatgtcctccattgttcaagagaaagaaacaacaacctcaccagctgatgagcttttctacaaaggaaagctcctccctcttcaccttcctcctcggttacaaatggttgaaaaactccttcaaaactcccccactccttttgacaaggaaaacgatatctttgaagagttctatagcactcctctagccactacctacacaacacctactgcaggcaccccatttgaatcctgcaacatctctccatctgattcttgtcaagtaagtagggaactaatccctgaagagtattacaactttgactacccaacagatacaagtggatttgttgctgaaaaccagaagaagtcatggactaagaaactgaagcagtcttcactaggttcaaagttgaaggcttcgagggcttatctcaagtcttggtttggaaaatctggttgctcatacgaaacctatgcaacttcaacaaaagttgcggatgaaggatcagtttccaaagccagggaaaatttaaacaagcatgtgcaagtggcaaagaaaaatgcatatggccaaattcatagggacagatatcagccctccaattctgtcatgagaagctacaaagaaaagacaagtgaggatagaagtaaccagcacagaagatcattctcggtcggcatcaaactgctttcggggaacaaatcatcatcaacttcatctatatctggctcaacttcattttcattttcaaacaaatcatatggatgccaagcgcggcagctattgaaaaggtgcagcagtgcaaattcagagatagaaaattcaatccagggagcaattgcacactgcaagaagtctcagcaaatgttctcttcaaagaagactgcaagtgaagtaggaatctactcaatgtttgcatctagaacctcagtttgcgaggatcatgaaagagtagagctttga

SEQ ID NO: 72233 - DNA, 210 bp, Glycine max
  Peptide Sequence Number=SeqID_189011
atgtatcttttcaaaaagttttttctgaattttttcactgttttggagttgttgttccacaacaaatgtccttcccaccccagaaacccgacacgtaaaggaaggagggggaaggtagtggtgcaacatcgtgaggaaggtgtagggcttaatgtcgtggaggatgaggtcgttgccgtcacaggtgaaggaggagccatcatgacgtga

SEQ ID NO: 72234 - DNA, 162 bp, Glycine max
  Peptide Sequence Number=SeqID_189012
atggaaacaatgcaacatcgccaatacttctactctaaaaacaaactggaactgtcccaccactatgcagagacaacaagcaaaaaggacaagtcaaatcccatgaacaccaatgtcttctcacacacggatgaagtggtgccactggcacacacacactaa

SEQ ID NO: 72235 - DNA, 447 bp, Glycine max
  Peptide Sequence Number=SeqID_189013
atgaaggcaagaaaaatgggttcaagatatattataatgaagaaatgcccaacaaatgacaaaaagttgaggattctaaagaggatgggttcatctctaggagtatccaaaagagctgagcaacaagaagtggatgatgctgccaaagttattgaggtccttgttgatctccatatctctggtgcattgaatgaaactgaagaacaagacgtatcctttattgagtccaatgctacagaggctaacaagttagtccaaacaagtcaacttgaacctgcatccaagcagattgacacctcaaatgaagccacttcattgcgaaaggagcttctagatgtaattgttgtcttctctagcaactctgatgttgctcttagttctctaactggcaatcacgtccaagagaagttgaatctagatctgacaaagcaaaaagaagaaacatag

SEQ ID NO: 72236 - DNA, 153 bp, Glycine max
  Peptide Sequence Number=SeqID_189014
atggataaacgactaaacgtgtttcgatctggtgcaaccagaactggttcagttgctgtgagaactggtcgtgggacacattttaaacgttgcaaagtaaaaacgtcacttactgacggtgtaaattgggtgttgaatcattgcaacatctag

SEQ ID NO: 72237 - DNA, 573 bp, Glycine max
  Peptide Sequence Number=SeqID_189015
atggagctcacgacgaggctcgtttcggttatcttgttcttgctagtgatcagggtgggatgttccgcttctccacaccattggagaaaaaaaagggttggcgaaccgtgcaagaagttggtgttttacttccacgacataatttacaacggtcacaacggcaagaatgcgacttcggcaattgtgggcacacccgcatggggcaacaggaccatactagcggggcataaccacttcggtgacgtggttgtgttcgatgaccccatcaccttggacaacaacttgcactcgccaccggttggacgtgcccaagggttctacatttacgataagaaggacattttcaccgcttggcttggcttctcctttgtcttcaactctacccagcttaggggtaccattaacttcgccggtgctgaccctctgatgaataagaccagggacatttcggtaattggagggactggtgacttcttcatgactaggggtgtggccactctctctacggatgcatttgaaggggaagtttatttcaggcttcgtgcggatattaacttgttcgaatgttggtga

SEQ ID NO: 72238 - DNA, 195 bp, Glycine max
  Peptide Sequence Number=SeqID_189016
atggagatggagaaggctcaagctacttcaaatatgaaatcatttgttgttggagatatttctgcaagtagaaggagtgaagctgctaaatttgctcaattatggaatgaagttatttgcagtttccgtgaggaagatatcataagtgataggaaaggcttcgaagccaaactctttagttgttttttctcgtaa

SEQ ID NO: 72239 - DNA, 828 bp, Glycine max
  Peptide Sequence Number=SeqID_189017
atggtgcagggcgccagcgccggtattatcggtgcgctgctcggtacgctgctgggcgtgctgctggccagccagctcaacaatttaatgccggtgatcggcctgttccttgatggcgcggcactgccggtagatatcaatgtctggcagtgtcgtgacctgtgcaaacgctatcaggaaggcagcgtgcagaccgatgtgctgcgcaatgtggcttttagcctgcagccgggcgaactgacggccatcgtcggtagctccggctccggcaaaagtaccttactgcacctgctgggcgggctggatgcaccgacctccggtgacgtggtgtttgacgggaaatcgctcaacgccatgtcgtcggcggccaaagcagagctgcgtaaccgtgaactcggctttatttatcagtttcaccatttgctgccggacttcagcgcgctggagaacgtagcgatgccgctgctgattggcaaaaccggcaaagccgaagcggaagcgcgcgcacgcgagatgctggcggcggttggtctggaaaagcgcgcggcgcaccggccttctgagctgtcgggcggtgaacgtcagcgcgtggcgatcgccagggcgctggtgaaccggccgcggctggtgatggccgatgagcccaccggtaacctcgatgcgcgcaacgctgacgccatttttgaactgctcggcgagctcaacgtgcagcagggcaccgcgtttctggtggtgacgcacgacctcaacctggcgaagcgcctgagccgtcagatggaaatgcgcgacggccagctgagcgatcacctgacgctgggagcgatctga

SEQ ID NO: 72240 - DNA, 351 bp, Glycine max
  Peptide Sequence Number=SeqID_189018
atgactcattctgaaacatggcacgtgcattctaggatccgcataccaaaagattacacacaccgtagattgttagaatataaagtccatagtgcatatctagcggtggactttttctcttgcaatgcgagcacccacagtgtgatagctggcaaaccagaatcagctttcgccggttttgggcgaaaagggtgggcggaggatacgatgagtgcggatgttataaataaggagggtagagaatataatttggaggttgtagatggtgctaaacggatcgccactctttttgcgagggcttatctttggctgactgactgtcacgcacaaaacgcagcagaggacaagtga

SEQ ID NO: 72241 - DNA, 2052 bp, Glycine max
  Peptide Sequence Number=SeqID_189019
atggatgcgaggttcaagaactttttaggatttgctgctaatcattctgcaaatgcattcaagattttgggcagttcaatgcaaattgaaggaaggggagctgattatcatggtacagataccatcttacgacttgattcccctggttcttcaattcccacctctgtgccctcttctaagggaacaaaaaggaagtgggatttaattgatggatgtatgggtcaaagagttgactcttctttgtcacttgggcttgggcgttcaagcagttcctcagacagcaaggggagttcagctgctgcttgcactgctatgtcttcagccaaagatattgatgaggaatcatctatggatattgaactggacttttttcttcatcttggctctgagaaggtacaaagccataagaaacctgttaattcaaatttgaagacattggagctgcaaccaaaatttgatttggagttaagcctttccactgggccctgtgagtcggatattacaagcgtacatctaaatccatcacctcttcaattgaatatggagataccattaacattcagtgggacacaaaatacagatgagggatcaacttcatgtagctggcagccagggattgttttgccatcttctaagatgtcatcaaatacaggtactaattttcttttaagtcagtcatcgaagcagtttgatcatagtcccattgttgtggacctctcgtcaaccggaccaaaaagttcagtcacctgcacttctgggcttacacagcagcaacagccactacatcgccccggtaattctaaaacatgtcaagtggagggatgtgggaagggtgccagaggtgcttctggacgttgtatatctcatggtgggggtaggaggtgtcagaaacctggttgccacaaaggagccgagggtcgtacagtgtactgcaaggcacatggaggtggcaggcgatgtgaattccttggttgcacaaagagtgcagaaggacgtacagatttctgtattgcccatggtggtggccggagatgcagtcatgaaggttgtacccgggctgccagagggaaatctggattatgcatccggcatggtgggggcaagagatgccagagagaaaattgtaccaagagtgcggaaggcctatcaggcctttgcatctcacatggtggagggcgtcgatgccaagttcctggatgtacaaaaggggcacaggggagcacaatgttttgcaaagcacatggtgggggaaaacggtgtactgcaccagggtgcaccaaaggtgctgaggggagcaccccatattgcaagggccatggagggggaaaacgctgtacataccagggtggtggagtatgcactaaaagtgtgcatggaggtaccaacttctgtgtggcacatgggggtggaaagaggtgtgctgtaccaggctgcacaaagagtgctagaggaaggactgatcattgtgtccgccatgggggaggcaagagatgtaagttcgaaggctgtggaaagagtgcacaaggcagcactgacttttgcaaagcacatgggggaggcaagagatgctcttggggccatcctggttcagaatatggcatccaacaggatggtccttgcaattcatttgcaagggggaaaacaggtctgtgtgcacttcatagtgggctagtgcatgacaagagggttcatggaggcatctcactgggatctgttgttcaggatcctcattccagtaaagcagatgaactaaagcaggtactcattgacaaaaacatggatgtaaatatgatgaaaatagggagtagcctaggcgctgctgcaacctgttctgacttcgagcagttggaagctgcaactgctcatgtctcggttaaggaaggtggtcacttgccaatgtcagttgttgttcctgaaggcagggtgcatggtggtagtctgatggcaatgctaacggggagttctagccgtggctcaagcagcgggagaggtctagttagtgatccatctgaaccaatcaaaggttaccccatgccccagagttggatttaa

SEQ ID NO: 72242 - DNA, 245 bp, Glycine max
  Peptide Sequence Number=SeqID_189020
gtgttgagggaataagctcggagtttcaagaacctatggatttgaggtcaaatccttttcaaaggggaggggatgatgcaatcctatccccccaaagggcattggatagaagactccaagaatattgggccagatatgcaggagaagaccttagggttctcatgagccttatggtggatgctactatggtggaaagggtggacgatgactttgtggagagatgggagcatatgatgaagcattag

SEQ ID NO: 72243 - DNA, 267 bp, Glycine max
  Peptide Sequence Number=SeqID_189021
atggagtactcgctcctttgttaccatcttcaagaccaaatgacaagcccaatgttgcctcccccgctctacattgatgctatcgtgatcaagtgggaacatgatgatgtgctcgatgtggatcacttctctgagttccttcattggcgtcgtatgctagatgtggtcattccattcaagtcgctttcactatttcctaatgttgcaacgtcttctgctgattttgactcctcatccaaggatattgatgccactttgtttctttga

SEQ ID NO: 72244 - DNA, 291 bp, Glycine max
  Peptide Sequence Number=SeqID_189022
atgggcccaaaatctaccctaaggatgatgagaatcctaggtccttctcttgtatctctggcccaatcttgttggagtcttctatccaatgaccttggggggatacttgcaatcgagaactacatgaagatcgatacccattacaaggaaaggatagaaaatgagggcatgacccttaactcagttagaatacatcctttaatgtctagtcacaagtaccaacacaaccatcatttacattgctcatcatcaagaatgagtgaggattcattgagggtggatgacacatag

SEQ ID NO: 72245 - DNA, 291 bp, Glycine max
  Peptide Sequence Number=SeqID_189023
atgtactcttgcatacatgtcactcaaggagtgacatgtactggaggcatggtgcgtaaacctatagaactcaccaagggcagaccttgggttttacaagccttttggagaattaaccagagaatttttcaacctggattttgggtgccattctcttgcatacgtgtaactttgtggagtgacacgtactggagatgtagtggagtgttcttacatacgtgtcatccgtggagtggcacgtattggagatgtgatgtcatgctcttgcatacatgtcacttcgtgcaatga

SEQ ID NO: 72246 - DNA, 705 bp, Glycine max
  Peptide Sequence Number=SeqID_189024
atggtgacttctttagcactgtgtctggctgcaaatgaagtatttaaggtaattggttatggatgggttgtgccatggaatgcaatgactatattacaagttatgcttctttggacgacggcattttggtttataggatcttggatgatcccttttgccgcccacataactggctttagcaaggaatctttgacatttagagggcaggcactattcagccttgttactgacgtaacagaaggacttgctggagttgcaattcttcttcgctgtctttctcgatttcgcccccttccacctgactggttcaagtttagcctgaaagggtattggcaattagatgtcatcacgggatgtctcatgtttccacttgtcaatcggctctcacagttcaacctggacctcctaccccttttgccctccacacctgtcaccctttcaagtgttgaacagtcaataatggcgagggatcctgtggcaatgcttttgtatgcaacagtagtgtcagtctgtgctccagtgtgggaggagatagttttccgtggctttctactcccatccctcaccaaatacatgccagtgtggtgtgcaatactgagagtccaatgtgtaggtagaatttcaggcactagcatgcgggtttgtgctttggatcagcaattttcagaagtaaatgcatatgcatatagaacagtacctcgttaa

SEQ ID NO: 72247 - DNA, 1362 bp, Glycine max
  Peptide Sequence Number=SeqID_189025
atggatattctattttggccagtatttgtggtggctgctttggcagtaatagtggcaagtcaggctgtcattgcttcaacgttctcaattgtccaacaatgccatgcatttgaatgtttccctcgggttaaggcagtacattccagaaggtggatccctggtcagacatatataccagagataaactggattcttatgataatcagcttggctgcaacagttggtttaggagacatgagcaatataggatacgcttatgggatggcatatctgattgtggtgtttgtgaccacatgtttgacatcactagttatcaacgttgtatggaatcaaagtcttgtagttgctctggcatttgctttattctttggctcaatagagattctcttcctgtcatcctattgcatgaaaatccctaaaggtagctggattccactcgtgctttctgcagtcttcatggttgttatgtatgtgtggcattatggttctaggaaaaagtatttatttgacatgcttaacaaagtttcaatgaggtcgatccttacattaggtcctagtcttggaattgttagggtgcctggattgggccttatctacactgaattggctactggggtccctgccagttttactcatttcttgacaaatctgccagctttctaccaagtggttgtttttgtttgtgttaagactgtacccgtgccttgtgtgccacatgaagaacgatacctcattggccgaattggacccaaatcttatcgaatgtatcggtgcattgttcgaaatggctacaaagatgtgtatagtcatcaaaatgattttgaaaatgacctggtgatgagcatagcagaatacattcaattggaagcagaaggttgctctggaaatgcagagggttcagtggatggacggatggcagtggttaggacgtcggggaagtttgggactagattgcgaatgtcagaatctgctggttttgaagaaggcagcagtattaatcttcctggagctttgactgttactagcagtaaatctccgacattgaagaagctgcaggccatgtatgaacaggaatcacctgaactcaatactagacgacggattcaatttgagttgctaaatgtaatatataaagatccacgtgtcaaagaagagctcatggaacttgtagaagccaagcgtgctggagcagcctatgtaataggtcattctcacgtaaaggccaagtggaactcaccatttctaaagaggtttgctatcaacctctactcttttctccggaaaaattgccggtcacctgcagtaggactaaacattcctcagattagtctgattaaggtaggaatgaattaccatgtgtag

SEQ ID NO: 72248 - DNA, 222 bp, Glycine max
  Peptide Sequence Number=SeqID_189026
atggagaagaagggaaaacgtaccacggttgatgcacctcgttctctactcgcatctgagctcatagcgaagccagaagaaaacagagcaagcggttatggttttgagagaaagagagcgttgtcgttgcgctcgtttttggaaaggaaaaaaatggaaaaatcgactccaactgttgtatattgggaccgcgaaattgcctcgaatgtagaacgtgtttga

SEQ ID NO: 72249 - DNA, 150 bp, Glycine max
  Peptide Sequence Number=SeqID_189027
atgggtttgaaggtaaaagaagtgatggaagacatcattgcaaatcttgagtgggagacagaagtggttgggatggtgatgaatggtgaaatattagagatgaaagtggaagagttgatggagcacttactagtggttgaagttggacgg

SEQ ID NO: 72250 - DNA, 1689 bp, Glycine max
  Peptide Sequence Number=SeqID_189028
atgttgaagaaactatctggaccgattttgattcttggttctcgagttatagattccggtaatgactatgaagaggtggatgagaaacttaattcgctcttcccatacaacatagaaatcaggcccccagaagatgaatcacatcttgtcagctggaagtctcaattggaagaggatatgaagatgatacaagttcaggataacaagaaccatatcatggaagtgcttgcagccactgatcttgattgtgatgacctggattccatttgtgttgcagacacaatgattctcagtaactatatagaagagattattgtgtcagcaatttcgtatcatttgatgaaaaacaaagacactgaataccgaaatgggaagcttgttatttcttccaatagtttgtcccatgcattgaatatattccacaaggggaaatccagtagaagagatgcatcaaaattagaagatcatgctgtaaaatctgagcaaagagaggaaggaactgctatgaaaccagaagtgaagtctaaaaatgctgctcctgtaaaaaagactgaagcagaaatatcaacttcagtgggaaaggcaggtggtgaaaaatcagttcctgcacccaaagcccctgaagttcctcttgataatgagtttgagaagcaaataaggccagaggtaataccagcaaatgagattgatgtcacattctctgatattggtgccttagatgacaccaaagaatcccttcaagaactagtaatgcttcctcttcgaaggccagaccttttcactggaggccttctaaagccttgtagaggaatattgctgtttggacctcctggcactgggaagactatgctggcaaaggccattgcgaaggaggctggagcaagtttcatcaatgtgtccatgtctaccatcacctctaaatggtttggtgaagacgagaagaatgttcgtgctttattcacacttgcagccaaggtctccccaactataatattcctggacgaggttgatagcatgcttgggcaacggaccagagttggggagcatgaagcaatgaggaaaataaagaatgaatttatgacccattgggatggacttttgacaaagcaaggggagcggatccttgttctcgctgcaaccaataggccatttgacttggatgaagctattattaggcgatttgaaagaagaattatggtagaactaccatctgtggagaacagggaaaagattttgaggactcttttggcaaaagaaaaggtggacaacgaacttgattttaaggaacttgcaactatgacagaaggatatactggaagtgatctaaagaacttgtgcacaactgctgcttatcggcctgttagagagctaattcagcaagagaggctaaagagtctagataaaaagcagaaagctgccaagggacagaataaagatgtccaagaaagtcaaggaggacaatccatattaggaaatactcaagatgctatagatggagaagaggaagttaaacaggaaagagttattacccttgggccattgaatatgcaggatttcaaagaggccaaaaatcaggttgctgcaagctttgcagctgaaggggctggaatgagtgagatgaaacagtggaacgatttgtacggagaaggtggttcaaggaagcagcagcagttgtcttacttcctatga

SEQ ID NO: 72251 - DNA, 1504 bp, Glycine max
  Peptide Sequence Number=SeqID_189029
atggctcgcatgggtttgttgggtttcgttgctttgaccttctttatcttagcttccgtgcctcgtcaagcattggcatcgagccatggcttttatgctagaaagatctttccagttgaaccgtcatcatttaaaggtttatgctcctctgcggtcactattcatggctacgagtgtcaggaacttgaagttactaccaaagatgggtacattcttagccttcaaaggatccctgaaggtcgaaggaaggttagtggccgtgagactaagaaacagccagtgataatacagcacggagtaatggtggatggaatgacatggcttatgaactctccagagcaaaacctgcccttgattctagcagataatggctttgatgtgtggattgttaattccagaggaacaagatatagccgcagacacacctctctggacccctctatcaatgttggtctttcttttttggatgcttattggaattggtcctttgatgaaatggtgacttatgatctgcctgctgtttttgattatgtgtccaaacaaactgggcagaagatagactatgtgggacattctttgggaactttggtagctttggcatccttctcagaagggaaattggtgaatcagctaaaatcagcagccttgttgagtccggttgcctatctgagccacatgaagacagcacttggagttgttgctgctaggtccttgcttggagagcagttctttaccatttctggtatggcagaatttgatcccaaagggttacctgctactgaatttgtgaagtttctctgccttaaccctgaggtggactgcacaaacttgcttactgcaataactggtgataactgctgcctcaattcttcagtttttgatcaattcattacgaatgaacctcagccaacagcaacaaagaacatgatgcacttggctcagattgttagaagtggggttctggcaaaattcaattacggaggaaaatctcctcaaatctataacctttccaatatcccccacgacctccctctcttcataagctatggtggcgaagatgcactcgctgatgtaattgatgttaggaatatgctagctgacttgaagttccacgatgaagacaaactaagtgttcagtacatcaaggaatatgctcatgtagactacattatgggagtcaatgccaaggacttagtgtacaatggagaagaagatgatgatgttgaggatgataatgatggtgatgacagggatcgtgatgacgatgcgggggaagcagcattccctaatctccctatggtaatctttaccttcatcccgactggactggcactctcgctgcctagctcaaccacactatgcaaagaacttgttaggcactggaatgtccatgggttccatgggaggtggtggagtatgatagcagcaagcccagaccaagaagaatctccaaaagaccccagggtgggaggagtttgttcactagaatatgctaggggccaag

SEQ ID NO: 72252 - DNA, 291 bp, Glycine max
  Peptide Sequence Number=SeqID_189030
atggaagcgtctagaaggaataagaaactccccctttttcacagagtgtgttgtgtaataacagaaagaaaacaaaaaccctcggtctcacattttccttctctaaatagcgtgagtgatgatgatcgatgcatatgggccgttcgattagtgactcgagtttcaatggctgctccttcaccggtgcttcaaagtctcacacgcgcttcaacaaacaaaatatcgcctcattgcagcacacagatctgcgacacgttggactttgtgttgtgtggggaccatcattactaa

SEQ ID NO: 72253 - DNA, 447 bp, Glycine max
  Peptide Sequence Number=SeqID_189031
atgggtgaagtaggggaggtgcaagagcagatgaaggccgacatggaggccatgaaagagaaaatggccacaatggtggaggccatgatgagcatgaagaagataatggaagccaatatggttgcaattgccgctaccagcgctattgctaaggtgaacccgatgcccccatctgatctcaaccaaatgaatcatccaacctcagatatggtggacaaagatttgggaagtacagatggccctatgatgtgcaaattcaaaatgagcacgccttcccgccatatggcttgcctcccaactatacaccacccaatgtggcgtacattcccaatgagaatgtcaataactccactcccatactcattgagagccaacaaccccaaactgatcatgcacatgtctcttaaaccgtggggtagacacatgaaattccccaccacaatctag

SEQ ID NO: 72254 - DNA, 246 bp, Glycine max
  Peptide Sequence Number=SeqID_189032
atggataagagcttgaaggtaggagaagatgagtggagggagaaggagagaaggagcacgaattttgtgcctcaaaagagcccactaattcaagatcaagtccaagattctccactaagtgtgcttaggtgtcatgagcccatgagcccgaaatctaccctaaggctcatgagaacgctagggacttctcttgcatctctggctcaatcttcttggagtcttctatctaatgctcttgcggggtag

SEQ ID NO: 72255 - DNA, 1179 bp, Glycine max
  Peptide Sequence Number=SeqID_189033
atggaaggctggaaagctggtgccgatgccacactggcctcccctgacatcgacgccgacacggacgccgacggtcctttcttcgacttagagcttgccgtacccgattccgaagaagacgacactaatgataataacaacagtgactcagcctcagagaaagagttcaagttaacgctttctccttcaacttcaagcaatgatttcatcttcaactcccaacctaataactccaagcctcagttcactgcttcgctgttcaaatccgccaccaagttacgcgtcttcatgttgggcctcaagaagctcaagcccaacgcccctgccgctccaaacctcaagaagaaaaaacttttcaccgtcaaattcaaggcggaagagtatcccattgtgtccttgttctccagagataacagctccagacccaaagcctctcagaatcaccacacagacgaatcacaatcatcactctcagagacactttcttctgcttccgaggagaaacgcttaatgcgaaagtatttgaaaatggtgaagcctctgtacgtgagggtttctagaaggtccgagaaggtcgacgtgagttctcctgagtccgctgaagcttctacggtggcggagaagattccgacggtagcagaagattctgaaagtgccaacttgaagggtccgaagcaggggaatgttgctctgcctgcggctctacgcaagcatttaggaaagggccgttcggcggcggtggcggctccggcaccgccgtcggtgtcttcgaaacggcgtgatgattcacttttgcagcaacatgattggattcagggtgctattttacactgcaaaaactccttcaatgcttctaccggtaatctactattactacactattctgtttttcccttcaatgcgagacttctcagctgccacgatcatatcatagttagtcgagacgacggaaaatgcggtcagagaagtgggaaagatggggacatgagcagtgaaagtgagatcttcttttgggtgaagggaaggaaaggtatcggaatgggtgaagctgtgtctgttttgaataaatgtagttgtgatggagttttcggattgtgtaaaattaaggaattgtggattctggtattcgtaggggaaaaggaacaagcagatggaagtttttatcttgggatcctctag

SEQ ID NO: 72256 - DNA, 384 bp, Glycine max
  Peptide Sequence Number=SeqID_189034
atgcaatcacagggactcacactgcctcctgaacctgaggttggtccttcaattgctcgtgtcagcataaaggagagttgtgttgatcccttagggaaggatccagacacgggtgactcagacaaatgcgggttgtacatcgaagaatatcctccctacatggttgccctaggaagagtttatgagggatccacaactgttcacaacattcctttgctgcatgatcaagtcaaggttggtgttaaggagattagagatgcagatgctcctattcctgtacccactgaagaggttaaggtcataaggcaggcacttaacaccttccttgcttggttgacatatcttgtcatgcgtttatcagaacaagtatttcagtgtcattaa

SEQ ID NO: 72257 - DNA, 375 bp, Glycine max
  Peptide Sequence Number=SeqID_189035
atgccacgccaaaacaactttgtgggttacacgttcaccggaataaatccaaaaaaatttgatattccaaaaggatgtagcatagatcaactgaaggatttgatcaagcaagtagcacctaaagggaatcctcctcatgggattcacgaatcccaagttgtaaggcgtttgttttatcgacaacctagtcatttggagtattctgagaaagttttagaatttgaaattattgagctgaaatgtgacgacgacgtgctaaaggtgctggtagagtccaattactggaaacaatttgtgccaaaagaaattttggctctctttagtaaagtggttatggaaaatgaggatgatgtggttacctccttgcgtgattga

SEQ ID NO: 72258 - DNA, 317 bp, Glycine max
  Peptide Sequence Number=SeqID_189036
atgcagaagacgatgctagtctttgcacgtcaacgggctcatttgcccttggttgacgaaaggatgacaaaaggtgcagaagacgatgttagtctctgcgcgtcaacgggctcgtttgcccctgcgaaagaatgtttatacggatacccacttgggtatttccgcctgtcccctaacttcacggaaattgtctatgcagagaattacttgtgtatctttgcacgtcacctgacttcacgggtcagtatgacagacatcgcggaagacgatgtaaatctctacgtgtcaatgggcacgttggccgcgattgacaaagg

SEQ ID NO: 72259 - DNA, 246 bp, Glycine max
  Peptide Sequence Number=SeqID_189037
atggcgccagaggatatggaaaagaccacattcgtcaccctgtggggaacgttatgctataaggtgatgtccttagggctcaagaatgctggggtgatctatcaacgggctatggtggctttgttccacgacatgatgcaccgagagatcgaagtctacatagacgacatgatcgccaagtccaaaactgaggaagaacacctcttcaacttgcggaggttgttcgaaaggcttaggaagtattaa

SEQ ID NO: 72260 - DNA, 675 bp, Glycine max
  Peptide Sequence Number=SeqID_189038
atggctcagagccctgatcagcagatgaagcccttagctccattcatatcatcaacccagttcagcagacaagaagatcagtttcaagagagaacatccgaacagaaaatcattcgcataagaaagttcgtgctgtgctgcggttgtttcactgcccttgttgtgatactcgtggtcatactgatagtcttgagcttcaccgtttacaatgtcaaagaacccgaggtgaggatgaattcggttacccttctcagtggaacttttgcaaacggtggtgccactaacaacgttacacttgttgctgatatctttgtcaagaacacaaacgcttttaccctgaggtttggaagcaccagcaccattgtttactatgatggtgtgagaataggtgagggtacttctccaccgggtaaggccaaggcaagaaggaccataagggtaaactcgaccttggagattatgtcaaagaagcttttggaaatcccaactttgaatattgacctcagggatcagtttttgaatatcagcagctatacaaggatagatggtaaggtgaaaatactcaacatatttccgaggaaggttgtggttgagatgaattgtaccattggatacaacatcaccactgggtcggtcacaaatggtgataattgtcttggagccgttgatatttag

SEQ ID NO: 72261 - DNA, 125 bp, Glycine max
  Peptide Sequence Number=SeqID_189039
gtgtagatcggcttagtttttacgcaaccttcgcactgagcacgcttgttgtgcttagcgagtatggcggtcatccttgcgctaagcacaactctttcctaaatcagtctgcttgcctcaattag

SEQ ID NO: 72262 - DNA, 4446 bp, Glycine max
  Peptide Sequence Number=SeqID_189040
atgaagtgcagatcggtggcgtgcatatggtccggcacgcccttccctcaccgcgttaccgccgtcgccgctttaaccgaacctccgactcccaccttttacaccgccggatccgatggctctgtcatctggtggaccctctccaattccacttccacttccccaccgcaacttaaggcggtgggcgtgttgtgcggtcacgccgcaccgatcaccgatctcgccgtttgtagtcccgtcgctgacgcagaaaacggttacggtccaagtggaagtaagttcagtgcgttgattagtgcgtgttgcgatggttttttgtgtgtgtggagcaaaaacagtggtcattgccggtgcaggaggaaattgccaccttgggttggcactccccgcataattcgaactttgccttcaacgcctagatatgtgtgtatagcgtgttctttcgaggcaagtgaaggagtaattgatagagaaactaagcctaggaagcctcctaagtgcactattcttatcgtggactcgtattcgctttccattactcagaccgtatttcatggaagtctatccattggcccaattaggtttatggcactagtgttaggtgatgacgagaagaggaattcggttttcgtggctgattctgctgggaggcagcagacggttttgatatcggaggatcaaggggaaagcttggcgagttcccttggagataaaggtcaattggagagttctttttgctatgagggattgagtggcgtggagcaaattgtttcggttttaacgtatgggaatgttgttgcttttatattgagagataggtgtgtgtttaggttgttgaatggtgatagtgtgattggagaggtttcttttttggacagcctattatgtttggatcagggttctgctcaaatgtatgctattggtgggatttttcttgaaagtgattatgtggggaatatatgcaatgccaatgaatatggaaactcgattacagtacaatttgctgtgtggaataatgtaggttatgcagttatatataatgtgttgtaccagaatgatgtttttaaatgtgaacttcattctgatattcctggtactcattatcaacctgatatgagattatctgtctttttcctacaagtaaatcagcatcttgtttgtgtcaagtcagtttgccttaatcatgaggagcctttactatggagaccacttgccacaatctggtcgctgcatgattttgatgatgaacctggtagattgtaccgtcaatgcagaaggatcagtgatggtatatctttcatcgactggtttgataattcatctcagctcaagggactggatgggctagagactatgcctacttttggtgtgagtccaagttctgatgatgtagacaacacacatgtggatagcatgagtaattattatgcttacaaggggaaggttgtttcttcttccatgattatctctgagaacctctttactccgtatgctgttgtatatggttttttaagtggagaaatagaggttgtaagatttgatctgtttcaagggattagcttggacaatgcaagttccaatcctgatgaaaagtcaactgcatgcaaacagtgcttctcaggacatacaggtgctgtactttgtttggcagcgcatcaaaagatgggtagtgccaaaagctggaactttaaacgggttttggtgtctggaagtatggattgcacgattcgtatatgggatcttgacaccggcagtcttatcatggtaatgcatcatcatgtggctcctgtgcgtcaaattattcttcccccatctttgactgtgcatccttggagtgattgcttcctttcagttggagaggatgcatgtgttgctcttgtttctcttgagactctgcgagtggagagaatgtttcctggacacatgaactatccttctaaagttttatgggatggagcaagaggttatatttcctgtctctgtcaaacacattacggaacttctgatgctactgatatattatgcatttgggatgtaaagacaggttcacgcgagcgagtcctgcgtgggacagctgcacattcaatgtttgatcatttttgtaaaagcatcagcatgaattccatatctggcacattgctgaatggaaatacatcagtctcttcattacttcttccaatagttgatgatgcaaggctctctaactcccccttaaatcggtcagacaacttgcttacttcaacaaggtcgtcaccaaatattccaaatatgactgagctgaattcttccaaaacaaatgcaggtaaaggaaatccagtgaagccaaattcatcctctctgattggtcttttgagtagcaagcttcctatcaaatgctctagcccattcccagggattgtgtctctgtgttttgatcttgcatcgttgatgctctcttatccaaagaatgagtccatggaaaatggtggtggcaagccagtgaatatcaatatgaagcagcagggagttcaggagcaaaatcccagctaccataatccagaaactgtagaggggcatgacttggttagcctatttgaagaatacttacttcgatatagcttgtcatttctacatttgtggagtgtagacagggagcttgataatttgctgataagtgaaatgaagctgaggagaccagaaaattttatagtagcttctggtctgcagggggataaagggtcattgacattgacgtttcctgctcagagtgctactcttgagctcttggtggctttttggcaagatgaaagtgaacatgtgcgtatggctgcacgctctatatttcattgtgctgcctctcattgtattcctctacctctatgcaattcaaaacctaccgagtcaaacaatatgagttcccaaactggaagtagagacaaacatctaggaaatatgacagaagaaagtatatctcctaaggaagaaaagcaaggaatttcccaagatgaggaatccaagatacttgcttggttagaatcatttgaagttcaagattggaattcttgtgttggtggaacaagtcaggatgcaatgacatctcacattattgttgctggtgcactggctatctggtatcctagtcttgtaaaaccaagtcttgccatgctagttgttcatccgttaatgaagttggctatggccatgaatgagaaatacagctccactgctgctgagctccttgcagagggcatggaaagtacatggaaagaatgcattgtctctgagattcctcgtctgattggggatatttttttccaagtagagttgagtggtccatctttagtgaaagaaatttcagatgcatctttttctattaagaagactttggtggaggttcttcttccaagtttagctatggctgatataccaggctttctaactgtgattgaaagccaaatttggtctactgcatctgattcaccagttcacatggtgtccttgttgactcttataaggatcatgcgtggttctccaaagaatttggctcaataccttgacaaggtggtcaacttcattttacagactatagatccaagcaactcagtcatgcggaagacatgctttcagagttcaatgacaactttaaaggaagttgtacgtgtatatcccatggtggctgtcactgattcatggaccaaactagcagttggagatgtgattggagaaattaacaatgcaggcattagggtttatgatatgcaaaggttcttatcgattggtatcagagcctttcaccatgtctcttggctgcaaatgagtggcgtgggtggtgacgctgagattgcagtgtttgcctgggactatgtgacaatggtaaaggttttggatgcaagtgggcctcctggacttccaactctgctcccagcagcaacatcaggaacaatgttgactactgcaatttcagcactgagcttttcaccagatggagagaaactaagccggaactttgttcctgtccagtgcaccaaactaatatttgttcctccttgggaaggattttcacctaattcatcaaggtcaagcataatggccaatattttggaaactgacaggcagatgaactttcaggataatgtgagggattcaaaccacggggacagtccgaaacacgcgcttcatagtttggacctctcctatagactagaatgggttgaggggcggaaagcatcaactagtgctgattctttgaagtttttgctgggaattttcattgattccataattttagttgaggctatcatgaaagaactctctagcatctatagcagccagcccaatctagcaacagaagattttttattagctgatactagcatactgtttgaggagcttgatggtaccgggagccaattggacggtcttagtgcgacttcagatgtttggatgaaatactgggaaaaggaagaa

SEQ ID NO: 72263 - DNA, 177 bp, Glycine max
  Peptide Sequence Number=SeqID_189041
atgcaagacctctatattctcaattggagcttatggatcagaaagcagggaatagtagcagcagctgcaacaggaactgcaaaatgttatacatacttaattttgcttcacctcgaagctaaatgcgacgatctggttcttcttcaacacctcattatggcctctaatctcatttag

SEQ ID NO: 72264 - DNA, 534 bp, Glycine max
  Peptide Sequence Number=SeqID_189042
atgggtggaggtgatgatgtcgatagtgatagcaatggtggtgacaattatcgaagtggtgatgacaacgatggtaatagtggtagtagtattgatgacgataatggtggtatgacaaaatgtggtattgttagtagtggtagtgacaatgatggtgacaatgacattgacattgatggtggtggttctagtgtgataataataatggtggtgacatcaagtggtggtggttgtcatgatagtgatggaggtgatgataaggacaataacactgatagtaatgctaatggtgatatcaatgacggtgacattgatgattgtgatggtggtaataataataataatagtgatgtcaatgacaatagtgatgattgtattaatggtggtggtggtaatgtgcgccttactatctatttagtcgagtttgttcacatccttggaaaggacaacttcattgcgaagtttggacctaattcagcattggtatttactgagcttgaggttcccctagcgatttcagtggctgcttactag

SEQ ID NO: 72265 - DNA, 1230 bp, Glycine max
  Peptide Sequence Number=SeqID_189043
atgtcctcttccacatatgactcctctaaccttttccctaacttcccttcgtcttcttaccctatccttccttttctcattgatcctgaaaatgattttgcaagccacacccttcttgatgaccaccctcttgttgttcccgccggcctcatacatgatcctccattactccctgaagaaaccgttgccaattttgcagttgcagctgactgcactgccgccatgcttgaacacgatgcagcaaacactaactatggttcccactatggtagcagcgtttccaattttctcacccagaaacctgctgcagccacagccaaaaaagacaggcacagtaagattcacacatctcagggtttgagggaccggagggtgagattatcaagcgaaatagcccgcaagttctttgatcttcaggacatgttagagtttgacaaaccaagtaacaccttcgattggctcttcacaaagtctgagaatgcaatcaaagaactagcccgaagtaagcatagcggcagtgttagtcggggtgacattaagtattcccgctacccgtctgtggattcaaacaacaacaacaaatcattggtggatggtggtgatgcttcccgagggaggaagttgaaatgggcacagagggatgatgtttgtgttcagaacaaaaaagagtcaagggaaagggcaagggcaagggcaagagaaaggacttgttacaagatgtgtagctgtagtagaagggtgcagcagaaggactctgatgaaaggttccctgcaactacaaacactcaaatgctacaccaattgaggtcttccattcagcctgaacttgaagatcaacctcgtgcaagatgggttcagccttattataataacccttatttcattgataatgaagcaccaagaaatggctttaacgtcatcgaagaatctattatgataaaaaggaacatgaagccttcatctcaccaaaaccttgtgatccctagggatgcaagtttcaacaacaatgagttccccctattaccctattccagtactactccaaactgggatagtactaatggggccgttaactttggtggaataagcacgatgaatctatctacatgtttcatgaacccgtgtgatttctgcgtccagatttgtagagcttcattcaaaatctttggaaaattcttggggcgagtgcatcaatcagagtcgacactaaaatgttctagttttcggtaa

SEQ ID NO: 72266 - DNA, 1083 bp, Glycine max
  Peptide Sequence Number=SeqID_189044
atggacgagaacctgctcgacgatattatccggaggctcgtcgcggcgaagaacggtagaacgacgaagcaggtgcagcttacggaggcagaaattcgacaactctgtgtttcctccaaagagatctttctcagtcaacctaatcttctcgaactcgaggctcctattaagatttgtggagatgttcatggccaatactcagatcttttaaggttgttcgaatatgggggatacccacctgaagcaaattatttatttctcggagattatgttgatcgtggtaagcagagcatagagacaatatgtttactcctcgcctacaagatcaaatacaaggagaatttctttcttctcaggggcaaccatgagtgtgcatccatcaatcgtatatatggtttctatgatgagtgtaagaggaggtttaatgttcgcctctggaagacatttactgattgctttaattgccttcctgtcgctgctctgatagatgagaagatcctttgcatgcatggtggactatcgcctgatcttaaacacttggatcagattcgaagtattgctcgtcctattgatgtgccagatcatggccttctatgtgaccttctatgggctgatcctgataaagatcttgatgggtggggagaaaatgaccgaggtgtatcatttacatttggggctgacaccgttgttgaatttcttgaacatcatgatctcgatctgatttgcagagctcaccaggttgtagaggatggatatgagttttttgccaagcgtcagctggtgacgatattctccgcaccaaattactgcggtgaatttgataatgctggtgctatgatgagtgtggatgacaccttgacatgctctttccaaatacttaaatcttctgaaaagaaagggaaaggtggatttggcatcaacacatcaagaccaggaactccaccccataagatattcaagcctcccggagctttaccgataagcactgttcacaattatcttagacttttaaaccaaatatccaattttctggcttggctacgctcttttgggcatgagcctatagtgggaagtaacctatag

SEQ ID NO: 72267 - DNA, 1959 bp, Glycine max
  Peptide Sequence Number=SeqID_189045
atggacgctgttgaattgccgttaccacttgacgtggcagccacccccaaattgatgggatcggaggatgttgcaagtataaaaactgtgcctgagtttccttcctgcaataaatttgtagaaactcaactctctaagaattctagtctgctgccccatctcgagggtgaagaggtgtccaaaaatacgcctagtggtaatggaagaaatttttctgtaattaattccagattagaaggtgtaccattacaacgaaaagcagcaaaatcaaacaggagtaatagttcttgttcaaagaggccacggatgtcccaaccagaagattctttgagccctaatggaattgaagagtcaaaggatatttctgacaaacttggattgcataatttaaactgtacttctccagagaaaaatcaattaccaaagcaaaagagcaattctagcaagcgtggtgataagaggaattttaaagtgccttctgtgaaggctaaatttgagtcatcctctatgaagatgggtgcatcaatcttcagttttacatctggggggaacaacttttttgggctatatggtctgaaacatgattttcatgatgtcacaaagcttatggaggaaccaccgttagaggagcttcttaggggcacttttgacttccccattttaagcaaagataaagggaagaaaacatcaagtatgagtgatagttttttaaattcagttagaaaggcatgctctatccttcagcacccgaaacccattcggtcccaaaatatggccgagatggattactcctccaacatgaaaatgtcaacttgccaattgagctcagtttgtgcaatagaaagtgttggtaatggggataaagagcagtcttgcacattagacatgtcttcatgtcagaaggatcattgtagtgaagtagaaagtacaactagtccacttgacttcccgttacatcaacctaaggatgttttggaacgaattgcactccatccattccaggatttggagtctttgctgcttgatgtgtccaagcctgctgttaccacaaagaatggtaatgaccaacggtcaggcaagcaagtgtctcgtcggccaagcctgccaacctttccatggtcacatgcttttggtcattctagaactaattctgacgcaggtaagttatcaacaagtagaagtatgtgccaaggtaaatggtcaaggataggtgtcattgctagctctacagatgctgatcgcagttccttctcaaaccttgattcattcagttatgatcagagccttgttccttcatctggtagttcagacaaaaggaatttctcatctttatttgctaaccttcctttccatcaattggattcttcatcttctgtaccatgttcagaaatttctcaggctaaagcagaatttggaggccaagttgatactaaagaaaatgatgaacgttgtccaataatattaactgctgcacaaactctctgtgaaattgcaactcacttaatgaggcagagttcagatggaattttaaaatggcaaaggaaaacttcactgaaggccatgaaatcttgccactataaatcagatgagaaacttgaggagacgtcttcaagaccaatttcaatgatcggatctgacatggtggccagaagtgtggagcagataatgccctcaaagaagccaagactttccatagtcgagaataagaacagtggtcactccaatattgctaagaaagggcacattgtgtggcctatttcaaaatcaagtagatcatttcccagtaaacaaattagagactcttttgtggaaaacaaacgtacaaatgccagcatcttgaagcaacattatatgatgcccccacctgcaagggatttagataaggctcatgatggtcagaagcaggttggaaaagtagtagcgatggactggaaaaggggaagagacaacacagattga

SEQ ID NO: 72268 - DNA, 396 bp, Glycine max
  Peptide Sequence Number=SeqID_189046
atgaatgcattttcgatatttgatatcggagcatcagtgtttgaacgagtgaattggaattggaattggaattggaattggaaaatgctagaggcaatggaaagtttagtcaatgttgggttcacccatttgcaaagctgtggagatagcagcgaagaagagtcatcggtgcttcctcgtcacaccaaagtggttgtaacaggaaataacaacaccaaatcggtgctcgttggtcttgaaggtgttgttaagaaagtcgatggattagatgctggttcttacaaatgggtgattgagcaccgaccagtaatgaggaagatgatgaccttgaattttaaaatatgtcgtggaatggatcagatatggattctttcagtttgcctaaaagatgtttga

SEQ ID NO: 72269 - DNA, 867 bp, Glycine max
  Peptide Sequence Number=SeqID_189047
atggatgaatttgcgtgcttgagagattgggatttggaagctattgtgagaggaaacaccggtgaagccaccaccatggatgacccaaatcctgatttttcttatttcttctctgaacaagatgagctgcttgatagctttcccgaattctcagaaaccacgagagtccttgatgatttggaagacctttacaaacctttctacccagtttttcaccctctttcaccgcacaccatcgttacaacttccccacctatccccatagagcctgaacaagtgatcaaagcatcagaagagaaagtagctctacaaggattgaaagtcaccgcagcacctaaatgtaaaaaaagcaagaagagccagaacaagagtgtggtgaagcaggtgacaacagcagaaggtcttgatgatgcatgggcatggcgaaaatatggacagaaaccaataaagggttcaccctatcctcgaagctattatagatgcagcagttccaaagggtgtttggcgaggaaacaggttgaaaggagccacttagatcctgcggtttttctggtaacctacactgctgaacacagccatccccacccaactcgaagaaactctcttgctgggaccactaggaagaacaattcccttgttcctcctccaacaaccactcgtcaccaaaagaagactacttgttcctcaagcgttcaacaaagcatggacttgaagaaagaggaagattttcttgactggttggaggatgatagtgctcaatttggtgatggttggattccaagctcggatctagagaaactgataggacttgagtgccaacattttgcattagataccggtttcacggatgattttccacacccttaa

SEQ ID NO: 72270 - DNA, 162 bp, Glycine max
  Peptide Sequence Number=SeqID_189048
atgcctaggaattactggcctcttactaggactattaggcaaaatggaaagaacaaacttgatccatcctttttcgtgttagccctttcacccaaaatgacatgtcttaatagcacgttgcaactgccatcaagaaagagactagagctagcacttgcctag

SEQ ID NO: 72271 - DNA, 144 bp, Glycine max
  Peptide Sequence Number=SeqID_189049
gttataaagttgattaagtcaatcctgagtctggtcacttgcggcttcagttctctcgatttcctagtcccagatctagacctggacctcgtggcaagagtgattgagagggagtggtatgctggaaaaaaaaacactttctaa

SEQ ID NO: 72272 - DNA, 459 bp, Glycine max
  Peptide Sequence Number=SeqID_189050
atggcggcgcctgaaacccctctctgttacgtaggtgtcgccaggcaatccgctgcttttcgcctcatgaagcaaatggggtgggaagaaggtgaaggtctgggaaaagagaagcaggggattaaaggacacgttcgagtaaaaagcaaacatgacactattggtattggcctggagaagccaaacaactgggccttcgacaccactcaatttgataatatccttaagagattgaaagttcaagctccgcaatcccatgacacagacatagaggaaaaagtggaaaccaagcctagtgttcctgttggtaatgagcattctgtctccaaaactacaagaccacaaggaagatacacgagaagagagagggggaagcttgtctcgcaatattccttgaaggatcttgaaggaattcttgtaagttccgccccgggatacgccattcactgcacatcttaa

SEQ ID NO: 72273 - DNA, 534 bp, Glycine max
  Peptide Sequence Number=SeqID_189051
atgaaacacaaagaactgattcctctcgtcgccgccagcgatggcgaagaggtaaaatattacagtgtcttcaacgtcacggtggcactttttctattagcgtatgggttcatccctggccccagcatgttggtgtcaagagtattggtggcggttttgttggttatgttgatgtactcgtacttgaagaactggttcgaacaggggaatgacgtggagaggcagaaggagaacgaaactgtgttggcggcagagaaggcagaggcgaagatagtgaagaggacgccggtggtgggtgatgtggagcacacaaaaatggaggcattgagaagcatggatttttggaccttgttcgtgtcgtttctgtgcggagttggaacgaatttggtcgtggtgaacaatatggttcaagggacttttaatttggaggaaaagatgttgttggatttgttcaacgatgatctatctcgatgcatgatggcggtggtgtcagaacaaattatggttttgagaggaaagaaaaatattttttaa

SEQ ID NO: 72274 - DNA, 1272 bp, Glycine max
  Peptide Sequence Number=SeqID_189052
atggccgcaatatccaactccttatcacttaagcatagtttctctctccttcttccacttccatcaaattcacaagatgtacgtgatgctgcgcgcactttcgttgagcatggaatggccgatggtcgtctctgtattgtaaccaaagagccttatgcaccttacgagcgtcccgctctgacgagagcgtatttgttcccgccggataagaaaccagcacgccttcccgtttgcattaaaggtcaacacaggactactgagggttttcacacttgtgttggatccggtggagagaggcagactccggagtggtataaagagaatgtgatagagatgttgtatgaagatccagtaaaagatattgatattgaaaagcatacattgacaacaagttctggaaaacttctgaagtatggttcgcttattattgctacaggatgcacggcatcaaggtttccagagaagattgggggaaacctacctggtgttcactatattcggcatgttgcagatgctgatacactaattttatcattggaaaaagcaaaaaaggttgtagttgtcagaggtggttatataggaatggaggttgctgctgcagctgttggttggaaacttgatgcaacaatcatatttccagaagatgaccttttgcaaagactgtttactccttctcttgctcggagatatgaagaactctatcaaaagaatggagtcaaagtcttgaaggtaattataggcattggagcaagacctgctgtaagcccctttgagagggtgggccagaatacagatgttggtggtatacaggttgatggtcagttccggacaagcactcctggaatctttgctgttggtgatgtagcagcttttcctttgaagatctataaccgtatctctcgagttgagcatgtagatcatgcccgtcgctctgcacagcactgtatgactatcttccatacttctattcaaggatttttgaatatgaaggaagccctagaaaagtgtggtggcagttctttagagacaagggcaattggagaaacagttgaaattggaaattttgatcctaaaatagctaccttctggattgaatctggtaagctgaaaggagttcttcttgaaagtgggagccctgaggaatttcaactcctgcctaaacttgccagaagtcagcctctgattgataaagcaaaacttcaaaatgcaacttcagtagaggaggccctagagattgctcgaggatccttgcaaggcgaagctgttgtctag

SEQ ID NO: 72275 - DNA, 1080 bp, Glycine max
  Peptide Sequence Number=SeqID_189053
atgcctgcaacaacagagaacaaccaaggctcattcctcggccgaataagcatccgcagaaatcaagtaatgtccatggacggaagccacgaccaagaggtggaagacctggagctttttcagaagcacgtgggagaccgcttctcggagctcttatcctcgaccaacacctcctccggcgacgcgcttctctccatcgcgtggctccgcaggatcctcgacgagttcctctgctgcgaggccgaattcaaagccgttgtcctaatgggccgcgacccttcccagatcgcgaagccaccgctggacaaggtcctcccggagctcctcgaccgcgtcgtgaagtccctcgacgtctgcaatgccgtcaccctcggactcgacgccgtcaagaacctccagcgcctcgccgagatcgccgtcgccgccctcgaccagacacccctgggcgacggccaggtccgccgcgccaagaaggcgctctccgccctcgtcgccgccatgctgcacgacgacagcaatgccgccgccaagggaaccgaacgcacccggtccttcgggcggcgcgccggaaacaacaccaacagcggcaagtacaagtcgctgtcgtggagcatggcgaagaactggtccgcggcgaagcaaatccacgcgatgatatcgaatctggcggcgccacgtggcgcggagtcctcgggattggcgcaaccgatctacatgatgagcagcgtgttggtgttggtgatgtggactctggttgcggcggagaagatcgcggaggagtggaagaagaaggagaagaaggggaacgtggggttgttggaggagatgcagaggatggacaagctgggacagtccctggtggagttcgcagactcctttcagttcccagccgaagcggagcgtttggatgaggtcaagaagcacgtcgaggaattgggggacatttgtaaaaaaatggatgaaggcttggaacctttgcagcagcagattagagaagtctttcacaggctcgtaaggagcaggactgagtttctcctcgtcttggaccaagctggcatgttgtctacacccgctctttaa

SEQ ID NO: 72276 - DNA, 384 bp, Glycine max
  Peptide Sequence Number=SeqID_189054
atgaggatgttgcggtggatgtgtggtaagactcgacaggataaaattagaaacaaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcgaaattaatggtttggatagaagtatgctcagttgtttagagtgttgtattaataacatgaaagtcacaagttcgaatcttacatgggtcattaaatttgtcagggaggtgaacacagtgaggcgggaatga

SEQ ID NO: 72277 - DNA, 1503 bp, Glycine max
  Peptide Sequence Number=SeqID_189055
atgaatcttgaccatcctcgaattatagatgtgcagaattatagcattttcgtagctacatggaatgtagctggaagatccccaccaagtaccttgaatttagatgattggcttcattcttcaccaccggctgatatttatgttcttggatttcaagagatagttcccttgaatgctggtaatatcttgggagcagaagacaacggccctgccaaaaaatggttggctctcatcagaaagactttaaacaatcttcctggcaccagtggaagtagtggatgctatacaccgtctcccataccacaaccagttgtagagctaaatgcagattttgagggatcagccaggcagaagaactcatctttcttccataggcgatcgttccagacaacttctagtggttggggaatggacaatgatccttcagttgtgcagccacgactagatcgaagatacagtgtctgtgatagagtaatttttggtcacaggccaagtgacttcgatcccagttttagatggggttataggcctagtgactattccagggcaagtgactactcaagatggggttcatctgatgatgacaatggccttggggattcaccaagtacagtcttattttcaccaatgtcttgtggtggtgctggacctgcctttaatgaagatggatatgccataccaggacactcaaggtactgccttgttgcaagtaagcaaatggtggggatatatcttaccatatgggtgagaagtgaactgaaggatcaggttcaaaatatgaaagtgtcttgtgttggcagaggattgatgggttatcttggaaataagggatccatctcaattagtatgtctgtgcatgaaactagcttttgctttatctgtagccatttaacctcaggacagaaagaaggtgatgaactaagaagaaattctgatgtgatggagattcttaaaaagacaaggtttcctcgtgttcaaggtgtggacaatgagaattctccacagacaatcctcgagcatgatcgaattatatggcttggagatttgaattatcggattgcactctcctaccgatctgctaaggcactcgttgagatgcaaaactggagagcattgttagagaatgaccaattgagaatagagcagaaaagaggccgtgcgtttgtgggatggaatgaagggaagatatattttcctccaacttacaagtattcaactaattcagatagatatgctggagatgatatgcaccccaaagagaaaaggagaactccagcttggtgtgaccgaattttgtggtacggagaaggtctccatcagttatcatatgtccgcggagaatcaaagttttcagaccacagacctgtttatggcatattttgtgctgaggttgagtcaactcatggcagattgaagaaaactatgagttgttctcgttccagaattgaggtggaggaacttctgccatattctggtggatacactgagctgagttttttctaa

SEQ ID NO: 72278 - DNA, 900 bp, Glycine max
  Peptide Sequence Number=SeqID_189056
atgacaaactcatcagatacattactactcatggatatgagcagttggcgtgaagttccagaaaaagctgggcttctaaggtgtggcaagagttgtcgcctgagatggattaattatttaagacccgatattagaagaggcaggtttacacctgaggaggagaagttaattataactcttcacggggtcgtgggaaacagatgggctcacattgcaagccacttgcctggtcgaactgacaatgaaataaagaactattggaactcatggataaaaaagaagataagaaagacttcggtgtcttcaaccaccattgcacaaagtatcgatcacaattcttcccaccagttcaattacaattccaatctagtactagaccactttcccaaccaagataacaatctacaaacaaaacctccagttcaagaagccttgttttcctcaacatgccctctgttcatatttgacactactgattcactagaacctggcacagcaacagactgcaagagtagtactgtgcgagcagaacattttcatcaagatgctgtgggtttgagcagtgaaacatggaactcgagccaccatcaggttcatgcacttccacctctcacagtgagtgtaggtttggacaccagcaattatttgccaccattgattgagcacgtggacaacatggtcccaattgaggtacaatcatgtactatcgatgagcaaggagatatagcactagagtgcttgcagaggcaagggttaaatgaatgggtggaaacgcagcaacaatgtcctaattttcttttttgggacagtgttgaaggacaacttggtggggaagaactagcaccaaattcatcaaatgtggaagcaaatacgctttctccttttccttgttctttgtga

SEQ ID NO: 72279 - DNA, 204 bp, Glycine max
  Peptide Sequence Number=SeqID_189057
atggtgtgtgtttgttattcgtggttcctccctagtttctcctctagcaattccttgccatctttcgcgagttttctctccttcaccatcgtgagtagcgttatgtcattggcgacagtgctactcatgacagtggaggaggagatgaaactcgcagaagatgataagggaactgcaagaggagaaactagggtggagccatga

SEQ ID NO: 72280 - DNA, 387 bp, Glycine max
  Peptide Sequence Number=SeqID_189058
atgaagcttgacaggttcaagtgcaggtgctgttactggtggagggacttcaatttgcttgccagacttcaatttgctcttttggaaggctccccaatccctaaagccctagtaatatgtttcactaggaatgtgaccggccccaggtccgagtaccccccgatagtgcccaagccgacgccattttcccatcaaagcaataaggccatcccatggaaatatacccttcccgcttttggagaaggggctgcaaccgaggttgactccttgtcagccaaggtgaccaacattaccggccttagtggcgtaacccgcagtggccaggtgttcgctccccctcactcagcggaattgccctccaaggggaaagtacccatgacccaatag

SEQ ID NO: 72281 - DNA, 300 bp, Glycine max
  Peptide Sequence Number=SeqID_189059
atgaagcttgcttctacaaaaggcagcaagtgcatcagcaaaatccttggtgccttgaaagtgacaaaaatagataactgtgatgtctccgcatgctatcagactcgcttgtctcaggatagcaggggaaacttcagtagccttgatcgacagacgttgagtcttttgacaagggaaacaaatgactatgtttttctctgcatgctatcggactcactgactcgcttgtctctagaaggcaaaggtgtggataaccatggggtgtctctgcgtgtcatcggacttgccgtctctggatga

SEQ ID NO: 72282 - DNA, 228 bp, Glycine max
  Peptide Sequence Number=SeqID_189060
atgggttattgggtgggaaatagcattcttttgttgggagaggagggcccacatggtcacggaactttgtcggaacatgtctgcattaccttccattgccaatcacatttgatgcaagaagcaattagggaaatgcaggaagtaattatcttattgttgttgtttcataaatcagaagcttcactagagttaaagattgtggatgacatgttattgggcttggcctaa

SEQ ID NO: 72283 - DNA, 1194 bp, Glycine max
  Peptide Sequence Number=SeqID_189061
atgaccacaaaagggtcaagctcttctgccgcttcttcagcttcgggggatgctaaaatcaaaagggttctcacccatggtggtaaatacgcacattacaatgtgtatggaaacttgttcgaggtgtcttccaagtatgtgcctcctattcgccctattggtagaggcgttaatggcatagtctgtgctgcttttaattccgaaacacacgaacaagttgcaatcaagaagatcggtaacgcatttgacaatataattgatgctaagagaacattgagagaaatcaagctccttcgtcacatggaccatggaaatattattgccatcaaggatatcatacgaccccccaaaaaggaaaccttcaatgatgtgtacattgtttatgaattgatggacactgatcttcaccatataattcattctgaccaacctcttagcgaagaacattgtcagaaacttgtgcagtacttcttataccagctgttacgggggttgaaatatgtgcactcggctaatgttttacaccgtgaccttaagcccagtaacttactaatgaatgcaaactgcgaccttaaaattggggactttggtttggcaaggactacatctgaaacggatttcatgacagagtatgttgtcacacgatggtaccgtgccccagaattgctccttaattgttctgagtatacctctgcaattgatgtttggtctgttgggtgcatacttggtgaaattatgaccagagaacccttgtttcctggcaaagactatgttcaccagctcaggcttataacggagttattaggttcacctgatgatgcaagccttgaatttctccgaagtgataatgccagaagatatattagacagcttccacagtaccggaagcaaaaattctcggccagattccctaacatgttgcctgaggcattggacctgttagaaaagatgctgatctttgatccaaacaaacgcattactggtatgcatccttgtagaattttgagtttcaatgcagttgatgaggcactatgtcacccatatctttcatcactccacaacatcaatgatgagccagtctgtcccaggccattcagttttgattttgatcagccaacgtgtgctgaagagcacgtgaaggagctcatttggaaggaatcagtgaagttcaatccagatccaccatgccagtaa

SEQ ID NO: 72284 - DNA, 303 bp, Glycine max
  Peptide Sequence Number=SeqID_189062
atgaagcatgataaattgttatgttgggattatgaaattgtgattgagattgtgtggcgacaagttaatgcacgacgggtattaggatgggatccattgtgggaacccgatgaattgaattactttgaggcgtccaatgaggtttttcaccgacatgctccattggagcttgtaagcctaggatcttcttcatcaatggattcctttgcttcttggaagaatggcagcggaatggagaaggaagagagagaggagacgccacttcaaggagaagatgagtctataagaagctcaccaccatag

SEQ ID NO: 72285 - DNA, 2274 bp, Glycine max
  Peptide Sequence Number=SeqID_189063
atgagttttgggggatttcttgagaccaaacaaagtggtggaggtggaggtaggatcgtagcagatattccttacagcaacaacagcaacaatataatgccctctagtgctatctcgcagcctcgtttagccactcctactttggtcaaatccatgttcaactcccctggtctttctcttgcacttcaaagtgatatagatggaaaaagggatgtgaacagattaatgcccgagaatttcgagcagaatggtttgagaaggaaccgggaagaggagcatgaaagcagatctggcagtgacaacatggatggtggttctggtgatgattttgatgctgccgacaacccaccgaggaaaaaacgctatcaccgacacactcctcagcaaattcaagagcttgaatcgctcttcaaggagtgtcctcacccggatgagaaacaaaggcttgaactcagcagaaggcttaatttggaaacgaggcaagtaaagttttggttccaaaatcgaagaacacaaatgaagacacaattggaacggcacgagaactcactcctaaggcaagagaatgacaagcttagagcagaaaacatgtctatgagggaagccatgaggaatccaatatgcacaaactgtggaggtcctgcaatgattggtgaaatttcactcgaagaacagcatcttagaattgagaatgctagattgaaggacgaactagaccgtgtttgtgcactcgctggcaagtttttaggtcgacccatttcatctctaacaggctcaattgggcctccattgccaaactcaagcttggagcttggtgttgggagcaatggttttggaggattaagcactgtgccttcaacaatgcctgattttggggttggaatatcaagccctttagctatggtgtcaccttcaagtactagaccaaccacaacagcaacaacaacattggtgactcctccttctggctttgacaacagatcaattgagaggtctattgttcttgaacttgctttggctgcaatggatgagttggtgaagatggctcagactgatgagcctctttggatcagaagcttggaaggtggaagagaaattctcaaccatgacgagtacacaaggactatcactccttgcattggcttgagacccaatggctttgtcactgaggcctctagacaaactggcatggtcatcataaacagcttggcccttgttgaaacattaatggactcaaatcgttggtcagagatgttcccttgtatgattgctagaacctcaaccgctgaagttatatctaatggaataaatggaactagaaatggtgcccttcagctaatgcatgctgagcttcaagttctttctcccttggttcctgttcgtgaggtcaattttctacgcttttgcaagcagcacgcagaggggttatgggcagtggtagatgtgtccatagataccatccgagacacttctggtgcacccacttttgtgaactgtaggaggcttccttctggttgcgtggtgcaagatatgccaaatggttactctaaggtgacatgggtggaacatgcagaatacgacgaaagccaaattcaccagctctatagacccttgttgagctcaggcatggggtttggtgcacaacgttgggttgccactcttcaacgccaatgcgagtgcctagctattctaatatcctcagcagttccctctagagaacattcagcaataagttcaggtggaaggagaagcatgttgaagctggcacagcgcatgacgaacaacttctgtgctggtgtgtgtgcctcaacagtgcacaagtggaacaagctgaacgcgggaaacgtgggggaggacgtgagggtgatgacgaggaagagcgtggatgaccccggtgaaccgccggggatcgtcctcagtgccgccacctcggtgtggcttcccgtctcgccacagaggctcttcgacttcctccgtgacgagcggctccggagtgagtgggacatcctctccaacggtggaccaatgcaagagatggctcacattgccaagggacaagaccatgctaactgtgtctccctccttagagccagtgtatgctataaatgcgaaccagagcagcatgttgattctgcaagagacgtgcacagacgcgtcggggtcgcttgtggtgtacgcgccggtggacattccggcaatgcacgtcgtgatgaacggcggcgactctgcttacgtggcgcttcttccgtcggggttcgccatcgtgcccgacgg

SEQ ID NO: 72286 - DNA, 414 bp, Glycine max
  Peptide Sequence Number=SeqID_189064
atggatgttagatggatgcagttcagtgactatattgcacctatagggcaaatttgtgtagtatatggtcagtgtttgccagattacatgaagtggttctacatgatttcacacccgcttatgactccggcacagccaggggatcctcctagagttctgccggttcagcactatgacacatttgttaaaccagatgtgtctcagcaactggtggtggtagcggcacctaatgaaccagacgttgatgtgcatcatcctcgacatgtagtgaggctactaaacctgaggatcttgatcgaaggaacaaaagtctatattgttactgaagaatgtctgagcatcgttagaagctacattggccaaccaactagaggtcacaaatcaaggcataggcggcatatggacgatcattga

SEQ ID NO: 72287 - DNA, 1059 bp, Glycine max
  Peptide Sequence Number=SeqID_189065
atgcaacctagggctagggttaaattgtgggtcaatggcacacccattgcctcatccaatgtttgcaacaaagtttcatcagatgcaattcatcccatcttagttcaaagtggctcactgataggaggactttcaaacaatcctaaacacaacaagtcacgaacctcaagaaatggtgctgaagagttagatctagaggatcaagaagatacttgtggaaagggtgttgcccatgataaagctcaagtgaatccagaagctgaaaaagtagtttctgagtcctgtcgattgtttgtccataatctgccctacacagcaactactagtgaggaagaactgcaacaacatgtcggtaaggttcatgtggttgtcaataaaagtacaaaactatccaaaggaatagcatatattcttttctcaggtccagaaattgcaagaagggatgctccattatacttggagtgggctccattatacttggagtgggctccttccaatattcttagtcaaagctcaacatttaaaaaaatgaaaatgaatagtggaattggtgaaaatgatgtcaaacagctgaaattggagcaaaatgtattaagaatatcatatgtggatattggtccagacagagtacaggctcggaccctgtttgtcaagaacctaaatttcaatacaacagatgagagtctgaggaaacattttagtgaaaacatgaaagagggagcaattttgagtgtcaaggtgaagaaacatttgaaaaatgggaaaaatgtttccatggggtatggatttgttgagatttacaggttgccgaagaagtttggatgtcatagtcatagaggctttgcttttgtagaatatgttactccgaaggaggcagaaaatgctctttcaacacttcaacatacccacatattgggctggcatttgaaaatagagagaacgaatgttgatccgagtttggatgaacagcgggctcaaacagctgctcaatttagtagacatatgaatttcaaaatgctactatgttatccaagaaaagaaagaacatcagtatcttag

SEQ ID NO: 72288 - DNA, 231 bp, Glycine max
  Peptide Sequence Number=SeqID_189066
atggcatggcatccctttgatgccatagagaagatatctttgacaccaccctcacagaaaggaaaagggaattcacctaaattacacagtggcgtccgtggaatgggaattagagcttccagagagtcttggttgcaactagaatcttttctctgccgtgcttccacctcactgcaccagcaatgtgagctactctgtcaattacttcaggagcatcccttaccaccatag

SEQ ID NO: 72289 - DNA, 342 bp, Glycine max
  Peptide Sequence Number=SeqID_189067
atggtgctgtctctttctctgtctatttctgataccaagagaaccaagaaggccggtattgttggaaaatacggcacccgatatggtgctagtttaaggaagcaaatcaagaagatggaagttagtcagcacagtaaattcttttgtgagttctgtggaaagtacgctgttaagaggaaggccgtgggtatttggggctgcaaagattgtggaaaagtgaaggctggaggtgcttacacattgaaatatgatttgtttgtgcattttcttcttgacagtactgcgagtgctgtcactgtccggagcaccattcggaggctgagagagcagactgagagttga

SEQ ID NO: 72290 - DNA, 666 bp, Glycine max
  Peptide Sequence Number=SeqID_189068
atgccgtacaacaagattgctgacaggaaaggtcaccagggatggatgaaactagaaggtcaacactttatattccctggtggtggtacaatgtttcctgatggagcagaacaatatatagaaaaacttggtcaatacattcccataagtgaaggtgttctgaggactgcacttgacatggggtgtggggttgctagttttggaggatatatgctgtctaagaatattttaaccatgtcttttgcaccaagagattcacataaagctcaaatacaatttgccttggaaagaggagtaccagcttttgttgctatgcttggcacccgcagacaaccttttcctgcgtttggatttgacttggttcattgctctaggtgtttgatcccgtttacagcctacaatgcctcttatttcattgaagtggacagattacttcgtcctggtggatattttgtcatctctggtccccctgttcagtggcctaaacaagataaagaatggtctgatctccaagctgtggcaagagccttgtgttatgaactgattgctgtagatggtaacactgtgatctggaagaagccagccggagaatcgtgtcttcccaatgaaaatgaatttggtcttgagttatgtgatgattcagatgacccaagtcaagcttggtaa

SEQ ID NO: 72291 - DNA, 222 bp, Glycine max
  Peptide Sequence Number=SeqID_189069
atggcatgtgatggaggtgatcaaacattctttgccttcgggggcaacggcactcaaaagagatttatggttcaaaatgaagaggaggatccatgtgccatatgcatcaatgctttcaactctggtgataatgcagcaagaagagtatgtgccctttgtgctgtttcacttgtagtgatcgcgtcttttgatactgttatgattagcatttatgtactgtga

SEQ ID NO: 72292 - DNA, 1155 bp, Glycine max
  Peptide Sequence Number=SeqID_189070
atggccattcaaaactgcttttccaagaaaccaaaccaccaactcacaagactctaccttctctccttcacaacttttctttgcaccattacttacctcctcggcctctggcaccacgcgccgccctcactcccctccctcgtctccaccaccgcccactccaattgcccaaattccatccccacactcaatttctccgccacccacttctcccccgacccccaagctcctgcgcgtgacttctacgcgcctccgtgcgatccctccctctccgagtacaccccatgcgaggacgtgcagcgctcgttaaagttcccgcgcgagaacctcatctaccgggagcggcactgcccgccggccgaggagttgctccgctgccgggtcccggcgcctttcgggtaccgcgtgccgctgcggtggccggagagccgcgacgccgcgtggttcgcgaacgtgccgcacaaggagctgaccgtggagaagaagaaccagaactgggtccggttcgagggggaccagttcaggttccccggtggtgggaccatgtttccacgtggcgccggcgcgtacatcgacgatatcggaaaactcatcaaccttgaagatgggtccatcagaaccgccctagacactggctgtggggtagcaagttggggggcatatcttctgtcacgtgacattatagcagtgtcatttgcaccaagagatacccatgaagctcaagttcaatttgctcttgaacgaggagttcctggattgattggagttcttgcctcaattaggcttccttacccttcaagatcctttgacatggcccattgctctcgttgtctcattccctggggccagaatgaggggatttatttgaatgaagttgatcgagtgctacgtcccggcgggtattggattctatcagggccaccaataaattgggagaaccactggaaaggttgggagaggactcgtgagaatctgaaagaggaacaggatggaattgagaaagtggcaaaaagcctatgctggaagaaattggtgcaaaaaggtgaccttgcaatatggcagaagcccaccaatcatattcattgcaaaatcacgcgaaaggtctacaagaatagacccttttgtgaggcaaaggatccagacacagcatggtaa

SEQ ID NO: 72293 - DNA, 165 bp, Glycine max
  Peptide Sequence Number=SeqID_189071
atgaaagagaaggaagaagaagccatgacagaactccaaaggtcctttgcagctttttcagagaattgtacttggagaatggaatccatcatgcagtattcattattatacagtcacaatgacagtagtgaacgttgggaattcttcttcccgtatggtaattaa

SEQ ID NO: 72294 - DNA, 792 bp, Glycine max
  Peptide Sequence Number=SeqID_189072
atggggaagaagagaaagcacagtgagggaaatgatgctggaagaaaatttttgcttgatggagaggtcactattgacacaatggcagatgatatggaattcacagagaatgctgtcaatgggctaatgggcaagcagattatcaggaagaatggaagaataaagtttctggttgatatcttgcttgggcttaagttctccatgagtggaaattttgtggaccaacctctttgtagacaaatagtggagaacctttggataattaaggggatagatctagaatatgtgaacaaagaggtaggggggtcttcggccttggagaaggatattaaagcccaagggcacgcgtctatcacctccagagagtacatagggcactctattggaacctttgacaagtgtacaaagactggtggacccttcggaaccatcaagcaccctgccgaactcgctcacagcgctaacaacggtcttgacatctctgacattggaggatgtgatatacaaaaacaggatatccacgaggctgtggagctaccccctacacatcatgaactatacaaacaaattggtattgatcctccccatggtgttttactgtatggaccccctggcactggtaaaacaatgcttgccaaagctgttgtgaatcataccactgctgccttcatcagggttgtgggatctgagtttgtgcagaagtatgttggtgagttcaggaagcataagcttgcatggggctttggctggtgtgagagggccattcactccgtcacagtggatggagcttga

SEQ ID NO: 72295 - DNA, 147 bp, Glycine max
  Peptide Sequence Number=SeqID_189073
atggagatcttcctgcttgttacagctattcggtttcacttgaaaatggtgattcaaagtgatcctaacccacatatatactttgtgagaacttttatcatcaggaaaagagaggctaaattccttgcctggccacatagagaatga

SEQ ID NO: 72296 - DNA, 192 bp, Glycine max
  Peptide Sequence Number=SeqID_189074
atggtgaagatatctgcaagatggtttttggtagtaatggtggagaaagaggaagagtttggtttaaagcttctcacaaacaatgtgaaaatcaatgtcaatgtgtttggtaagctcatggaaggtaggattggctgcggtgtaggtgacagaagccaatatgcaatattcaacttcagtggaggaccatga

SEQ ID NO: 72297 - DNA, 756 bp, Glycine max
  Peptide Sequence Number=SeqID_189075
atgggtctttctgtctgctcatattttcttctatgtttacaacttaaggctgtggctacctctccaattggaggagaatttcttacagactgcttgatgaaaagcttggaaagcaagggtattacgataaaaccaaggtattcctttaggagaaaggaaatacgtcctggagagtttcagacagtagatcttgagtttccaaatacaactgaaagctacaaactctattgccagagggtgattgctagtgatatcaaggaatgtgtgtgtcgtgctccagatactccatatgatgagagtgcatattctaacatcccaatgacctcatatgagcttcctgatggccagacaattgaaattggagctgacagatttaagattccagatgttcttttcaatccgtccctggttcagtcaattcctggcacagagagctttgcagaaattgctccttcagttcgtggcctgcctcaaatggtgattgaaagcattaataagtgtgatgtagacattcgaagagagttgtttagtagtatactggttatgaagcatttcatatcaatgcatcatttcctgcttgctggtggcacagcttcaatgcaacagctaaaggaacgccttgagaaagacttgctagagcagtgctacagagttttcttaaatcccatgactccgaattttcactatctaattttggagggatgggagtttgggagattgagtgtaagaatttacagcaaggacttgtgcatataa

SEQ ID NO: 72298 - DNA, 162 bp, Glycine max
  Peptide Sequence Number=SeqID_189076
atggaacaaagaaagaagtatcactttacactgccactgcctagatgcagaggtgcagaggtggtgaataaaaaaagtgctcaatggctgtcaagaggtgaggtgaaagcaggattgatgctctctgatggagcactttttgttgggacacacggattttga

SEQ ID NO: 72299 - DNA, 548 bp, Glycine max
  Peptide Sequence Number=SeqID_189077
ggacacgttcaataatggtagtgcacaatattcagagaaaccagccactactaaagtcactggtcaactacctttcccaaaacctctaggctttcttcctcctaaaggagggattccaataccacaatccactccaacaacaattccactcacttcatcgtccactcaaacacttgatctatctagtattggcttctcttttcccactagagcaacactccaagagctagagtatggatcagtagcatcaatagatgaggaactacttatagatgatggagatgaactacacaaacttggaaaagcacaaggggtgtgtgttgctagctcagaggatggaagcagccatatggtggctatcacagcaaactttttgaagggtgagtttgaggatggactgaggctttttggaatgcacaagactgatgtttttgagtcacatgttgcagttattggaggcactggaaagtactatggtgctaatggatatgctgcagttaaggttgtggacaaagtaggatctagtgaaaaagaagggaaagtgacaa

SEQ ID NO: 72300 - DNA, 216 bp, Glycine max
  Peptide Sequence Number=SeqID_189078
atgtatgagttttcactcttagtaagaactagcagcacgaaaccacaattccacgaggacattgacaatagtaactacgatcatgatggtggtaacgacgataataataattatgctaatgatatcggtgacgacaataatcgtaacgttaatcgtaacagtgacattaactttcacagtgatgagttgattgagatgttcagaaatgataattga

SEQ ID NO: 72301 - DNA, 828 bp, Glycine max
  Peptide Sequence Number=SeqID_189079
atggccgatcactcagattcttctcctctcgttcctccccttcccctcaccgacccttctgagatcgacctcgaagctgtccctccgaacaaatccagtgccgaatttgtctcgaaactgacgttttcgttttcaggtagagatttcatagccccttgtaagtgcaaaggtacatcaaaatatgtgcatcgagaatgtttggatcattggcgagcaattaaggaagggtttgcctttgctcactgcactacatgcaaggctccttatcatttgcgtgtccatgttgctgctgataggaaatggcgtaccctgaaatttcgattttttgtcaccagagacatgttgtttatttttctgtctgtccagcttgtcattgcttcactgtcatatttggtttatctaatagatggttaccagcagtattggcttcgtcttctctggggttttgatagtgaaatgagcttttactacatatgtggagctctattgttttttgccttgcttggcctctctgggtgcttcattacctgttatgatcgaagagttcgcaatgatttagctcagccttgtagagaattatgtctttgttgctgtcaacctggagtttgtgcagactgtcatttgccaggcactctttgtatgtggactgattgcaccacatgctttgagagttgtggaaccatggcaactgaatgtggtggttgtttggggggtgctggggaagctgggctaccactattattcattatggctttgattgttctgggactttttactgtcaacggatatggcaacgtcattatcacatacttgcaaaaaggatgttaa

SEQ ID NO: 72302 - DNA, 186 bp, Glycine max
  Peptide Sequence Number=SeqID_189080
atgggaaagcatggattaagctttgcttccttggaagccaagttgagcaagagtcttggagcatcatgggaaggttacaataatcacccaacccctctcgatcgatctattgagaaagtggtgaagcatatcattgttttgtcccctgtgggaactatactaacacgaacatactgtgaaatgtaa

SEQ ID NO: 72303 - DNA, 319 bp, Glycine max
  Peptide Sequence Number=SeqID_189081
gtgccatgagaatgattcggcttgttgttccccatatggcaacttggaaacagggaaagattctcaacattggtggtgttagtgccttggcctctggactttggtcaggcacttacaatgcttctaaagctgctcttcatgctttcacagatacattaagggggttttcttcttcttcttcttcttcttctaacttaccctacaaagttgatgaaatgctaagattagggatgaaaacagagcatgttggggaaggtttggccctcctagtcctcgcaaaagacagagcaaaatccattttcatacccatcgagtttag

SEQ ID NO: 72304 - DNA, 750 bp, Glycine max
  Peptide Sequence Number=SeqID_189082
atggagaaggcttttgcttggactgagggattgaatggaatcaatagtagtgattcttgcatgatcaaatctgatggaatttcaagttctgctaacttgctggcaaattcatctgaggaaacacctgttttgtcacctttagtcccagtttcattattgggtagttcaaaaggtgaagaccagaagcagaaagttgttactaagcaagaaaaagttcaagcggtattaaaggcaataaaacagagtccaaagaaggtcaacttggttgctgctctggttcgtggtatgcttgttaaagatgcattgatgcagttggaattgacaataaaacgagcagcaaaaactgtatatcagggtaaagcaaaattgaacgcatttgttttaaaaccctacacgttgcaggttattcattcagcccgagcaaatgcctctcacaatcatgggttagatccagaacgactcattgttgcggaagcatttgtaggaaaggggttttacaaaaagagactttggccccatgctaaaggaaaatcgtcgcttagagtaagaccagaatgcaggctaacagttgtagtaagagagataactgctgaagaagaggcagagattgctaggctgagggtccacaacttcaagaaacgcaccaagcgtcagcaacgacttgtgcctcatcagctcattgtgtccaatcctatttggggccgcaaaaacaaatctagtggtaaaaacttgagtgctacacctgcataa

SEQ ID NO: 72305 - DNA, 444 bp, Glycine max
  Peptide Sequence Number=SeqID_189083
atgtcttttcaaagcttttctgaaatctcttcgctgacaattgattacaagattctgttcaaaatttcaaaatgccatcttcatggtctctctggttttcatgatagcaaggagaaaaaatcaaagacagaatttactacttcctatggatcaattgccactggtagtgatagtggtagtggtagtgacagtgctagtggtggttacaacattgttcagtcgtcaccacttactactaattggttcaacaatcatcacaaccacaatcacagactaaagaaaaccgaaaagtttctcttacagtgcagaaggaggaagatacacacaattcataaagcttcgagagtaaaacaactagaagttattgctgccacagagagaccaacaacgagagtgagactgagagtgacagtgccgacagtggtttcagtgctgcgagagtga

SEQ ID NO: 72306 - DNA, 378 bp, Glycine max
  Peptide Sequence Number=SeqID_189084
atggttgctgccttggcttctggaccttggtcaggaacttatacagcttctaaagctgctcttcatgctttgacagatacattaagaccagaacttggacattttggaattgatgttgtcaatgttgtccccggagctatcaaatcaaacatcggagattcagccatagccagttacaaccgcatgccagaatggaaattattcaagccttttgaagcagcaatcagagatagagcttatttttctcagaagtccaaaacaacccctacagatgagtttgctctaaacactgtagctgctgtccttagggagaaaccacctgcatgggcattactctactgtcatggctatcatgtaccatttaccaatctctgttag

SEQ ID NO: 72307 - DNA, 567 bp, Glycine max
  Peptide Sequence Number=SeqID_189085
atgttgggttcaggcaccaatttggtgacaacggtcattgggtttgggatgagtgccactttcattgtgtttgtgtgcaccagaatcatttgtggaaggctaagagggggtgttgaatctcggatgatgtatgagattgaatcaagaattgatttagaacagccagaacatcatgttaatgaccctgactccgatcctgttctgctcgatgcaatccctactttgaagttcaaccaagaggctttcagttcccttgaacacacacagttaaattacaaagaaagagaagtattgcggatcatgcccaaatgtggccacacttttcatctttcttgcattgatatatggctgagaaagcaatctacctgtccagtatgccgtctgccgttgaaaaactcttccgaaacaaaacatgtgagacctgtgacatttaccatgagccaatcccttgacgagtctcacacatcagaaagaaacgatgaaatcgagagacatgttgaacctacatctactgcagccagcaactctttacaaccaacttcaggggaacaagaagcaaggcaatga

SEQ ID NO: 72308 - DNA, 500 bp, Glycine max
  Peptide Sequence Number=SeqID_189086
atgatgcagtggaggcgcttatttttcgatgctgaaatagatatggccgccaagtttatggaggacatagaaggcctcacaattcatcctcgcaggcatgacaagtgggtctggaagggagacccaagcccaagtgggatttattcagtggaaatgccatatgagaatcaggatagagtctttaatgatttatgggaactccaaattccaactaaagcctctttctttgcttggagattaattcggaacaaattgcctacaaagaccaatttacgtcggagaaatgtggaaatcaatggcagtatgtgtccattctgcagaaattttgaagaggatgcagcacatttattcttttcctgtgatagggtcatgccactatggtggaaatcgatgtcttggataaatatggtgggagctttcccacaaactccgaggcaccgtttcctccaacattccttttgcaggctttcgggtatcaggatgcagcgctggcagagtag

SEQ ID NO: 72309 - DNA, 1500 bp, Glycine max
  Peptide Sequence Number=SeqID_189087
atgattcaaaggatccctcttttgtatcttgcaaatgatattctgcagaacagtaagcataaagggaatgaatttgtgacagagttttggaaggttcttcctgcagcacttaaagatgttatcaagaaaggtgatgatcatggaacgcgtgtggtatctagattgattgaaatatgggagcaaaggagagtatttggatcccgggctaggaaccttaaagatttgatgcttggagaagatgcacctccaccattggaatttggcaaaaagcgatcacgttctgtaagaattgtgaaaagggattctcactccatcaaatcgaaactgtccataggaggtacagcggaaaaaatagtgtctgcatttcatttggtgctcagtgagcaatccgttgaagatgcagagataagtaaatgcaagtcttctgttcagcgtgtgaggaagatggaaaaagatgttgatactgcatgctctgttgccaaagatcccaagagaaaaactttggcaaaggaactagaggaggaggaaaatattttgaaacgatgcgtagaaaaacttaaattagttgaagcaagtagagtagcccttgtgtctcagttaaaagaagctttgcatgagcaggaatctgaactagagaatgttcgtacacagatgcaggttgcccaagcacaaatagaagaggcttgcaacatgcggaggatacttgataatgaagatttttctcagaaagtgtccgttgccaagtcggctgcagcaattgctgctgaggttgcagataagcttgcagcttcttcgtcatcgcagttgatcatgacttctgttctgtcaacatttgcagcagaagaggcaaaaaatgctggtctaacttctgagtccacatcaaaacacgagattccaatgactagctcagatccccatatgtttaggtccccacaacagttgattgccgcaccaaaccattcatatccttcagttttggtagcccaaccaccacccttgcaaaatgctgctccttcatcacaaggtcaatttcacatgcttagtaatccgccatcccagcagttcgtgcagtcaactggagggatcatcactccatatggttatggtagcatcccaccattaccgcccgcaccccaactgccaactcatgttggggctatggtgcctttgacacatcagaccctgcaaataactccacatcaacaaataccaataacacagcaagcccccgcacctcctactttccgaccacttcaaccaccaggaatggtgtactatactaatcatcagcattcgatacatgctaccctgggacgggagctggcaaatgttggaagcaagactatcacatccctgggacgtgaaactctcttgcccaatattttaactgagttactgattcagtcgaccgaccctaatgcgaacggggatctcatgaaccaggcactgataccatcaccccccaaaaaagcaaaaaacaaaagcaatagaagaacatga

SEQ ID NO: 72310 - DNA, 1200 bp, Glycine max
  Peptide Sequence Number=SeqID_189088
atgcagtggcatgacagtgcggtgcccatcaagatgaagagtatggtcaagatcgagagaatgaagaagatgagcatgaagacgggagagaagtggttgagggttaatctccttgcagcagaagaaactgacgtgaagacacaagaggataactgggaagccgagaaagcacctgaagtggaccaaccatcaaattcctttctgcttctcttgaatggaattggagtattttcttccggtgtgttgggtgctctctataaacttgctcagaaagaaaagtccactgttgttgcaacaatagaaacagttttaagagaaaaagaagaggagcttcatcagctaaaggatcagtttgaacttgccctaggtgaagcaagcaaaagccagatcgtcattgctgatttatcccaagaaagagatgatttgaaggaggctctagataatgaatctagcaaggtgaatcatttgaagcatgaactccaagttacccaggagaatcttgcaaaatcaagaaatgagtctgctgaattggaaaaccttctaactttgtcaaataaactgtgcaaagagctcgagctcgaggtctctaagctctcgtctgagctcactgaggaacacttgagggaagcacaagcagagctgcaagatttacgagcattagagcagcaagtctcaaaagacaaggagtcccgaaaatctcttgagggggacctggaggaggcgaccaaatcattagatgaaatgaaccgaaatgcggtgatcctttctggggaactacagagagctaattctcttgtttctagccttgaaaaagagaaagatgtgcttattaagttcctaaacgaccaaagaaatgcatgcaaagaggcccaagacaacattgaagatgctcataaccttatcatgaaacttggcaaagaaagagagaatttagagaaaaaaggtaagaaatttgaggaggaattggcttctgccaagggtgagatattgtgcttgaagagtcgaatcaattcttcaaaagttgctgttaacaatgaccaagtgcagaaagatggagtgcagaaagatggaggtgaaaaaaaggtcaattcttcaaaagttgcggttaacagtgagcaagcacagaaagatgaaggtgaaaacaaggttactgtaagcgcacggaagactgtcagaagaagaaaggctaatccacaataa

SEQ ID NO: 72311 - DNA, 2118 bp, Glycine max
  Peptide Sequence Number=SeqID_189089
atgtcgccaaaatatcagattctccacaatcgccccatcaatcagtggaaggttacagagctgaaagatgagctgaagaggaggaagataagtaccaagggtttgaaggatgatttggtcaaacgtttggacgaagtccttcgtctggaaagggaggttgatgaggcttctgagaaggatgaggccaatggtttcgatggtcatgcagatgggaaaaaagttccggaagcagttactgtggatgctgaaatggttgattcaactgacagggccagtgccaaaacatttgatactgctgaaaagggcaagggtggttttgttgatccaattgaaacgggaaatgtggaaaagattcaggagattgtggatcatgacagcgataagaatgacaagcaggacagtgtttccaaccaagttaacattaataatagtgtgtcagctatggatcaagaggttgaacctaagggcttgccagctggtggagattatgcaaatgtgggacatgaggcaattgcccatgcttctactgtggagactatcattacggtcactgagagtgtagtaacagaagtagtggccagtggtgaggatacttatcgtgccgaaaagaataatgaggattcagcagcacagctggagaatgaggtgtcaaaggcgcagctggatggtgaggactcaaagccccaactggattatgacaccaagcccttgcatgaggatcctgttcccgactctgctgttccagaaaaccaggtatctgaggtcaaccctagtttagggtctcaagtaaaatctgattctatttctactgattctctgtcaattaatcaaaagaatgaactaaaggatactataattactgataatgtcaaattagaacaagatattgttaagccggagatggtggaagaaccatcatccagaaatgatgttcctgtttcttatgatgaatcacattcaatggatgttggagggctgcatgagaaaaaggcatctgttgaagaaaatatcaataatgtttcaagtccagacttgaacaagaccaatagcagtgatgatgtagggtattcagaaaagttgaacttggacagaagttctggtgatgattctatggaagaggatttgcctgagactaagcaaattgattctaagtttaatgttgatgaacttaaagacaaagtagagattgaaaagcctattgtgaaggaggaaagtagtactatagctgttggagatagtctatctgcaggaaaagatgatacccaccaagatattgacattagtcctgctgccctgactgagaaacggaaatttaatgaagttgggaacagtgagcctgccaaaaggcaacgcaggtggaacactgaaacagttaaaggtccagatgcacaaagcactactcccaggcctgctactacacctagagatgagccaattactttgaaacgcagcttctctaggtctgattcctctgcaactgatgatacacctaaagaacacattgttccaccatcacaaaggtccccaactaattccctcagaattgaccgtttcctccgtccatttaccctaaaagcagtgcaagaacttcttggtaagactgggaatgtcagcagcttctggatggaccaaataaagacccattgctatgttacttactcatctgtggaagaagctattgagacacggaatgctgtatataatttgcaatggccaccaaatggtgggcgtctcttagttgcagagtatgttgatcctgaagaagtgaaaatgaagttagaacctcctcctactcaggctgcatcggacagcactgatcgagcagttcctcctgctccccccttctcacagccagagccttccccccatctgcacagggagcagcatccagttccagtcattctcccacctccaccaccattgtcaaaacccccaccagtagcaagagaacggcttccatctccaccacccctccctgagaaagttgacccacctattgtcactctggatgatctcttccgcaaaaccacagcaactcctcggatctactatctacctttgtctgaagagcaagttgccgcaaaactttcaacacagggtaaaagcgggaggcagtag

SEQ ID NO: 72312 - DNA, 534 bp, Glycine max
  Peptide Sequence Number=SeqID_189090
atggcagcaacccccccaagaaaaagaaaaaatcctcaacttccgctacaaacagcagtgcaactcttcattttcaacacaaccacaagacccgtttcgtacttgttttcccacaatcacccaaaaccaatggaagaatccaagacctcattctctctcttcaagaagccactttcatggcaaaacacttgttaccttcttcgtccaccaacaacaacccttaccccacccatctccaccaaatccactccttcctccgccacggacggcgacccgatgcaggtcgagatcgtcgccgatgatgaagagaccacttcaaagtgcacaattgacaaggttgaggagaaaatgaggcactgcttcatcaagaacaagcgccccaaacggccccttttgccctccgccgcagcggtggcggaggagaagcgggttgtttccgatgatgggtttgtggggagggtcagtgacagtgactatgatccatatgctatgaggttgagggcattggaccttatctaccagtttcattgctag

SEQ ID NO: 72313 - DNA, 213 bp, Glycine max
  Peptide Sequence Number=SeqID_189091
atggcaagttcttggggtggagaggctgtaacattagcacgtagattgaaccttttaaaactacgcactacgaagctctatggcaaaagattccttcacttgctgaggttttttgcttataatcatgttaatgaccctgaatccgaacctgttcggcttgatgcaatccctactttgaagttcaaccaagaggctagctttcagttccattga

SEQ ID NO: 72314 - DNA, 1233 bp, Glycine max
  Peptide Sequence Number=SeqID_189092
atgcaaaacagtggggttagtctaagggttgattctcaacactttgctactgtacatcatgacaacccctgtctagcttccatgccttactttggagtcattgaagaaatatgggagcttaattatgtaaaattcattatttgtcttttcaagtgtaagtgggttggtagcaatattggtgtgcaaaccgatgatttcagatttactttgatagatctgaagaagcttgcatatgggaatgagcctttcatcctggcaaaacaagctaaacaagtgttttatgttcaagatccttttgatgaaaggtggtcagtggttctacatggaaaaacaattggtgttaatgttgaagatgatgattcgaccattgatacttatctcagtcctttctccacacaaatgttgcctaacgtcaacggagaagaagaggctctggaagacagcaaggaaagcgaggatgatgaagtatgtgaaaagtacgacataagcaatgataagtggaaccaattttgtcaaagccgtaaagacccttcatgggaggccattcagaagcaaaagattgcccctcgcgtattgtctcgtgggaattatgattttctagaacaaaatttgaaggaggacaagaaaaagaaacgtttggaggaagcagctcaatttgggagcactgacacaatcattgatcctccatctcccattagaaggaacatgaagtggaagatgagccacacgaaaaaatctagtcaaatgatgtatgaggcagaaaaagaaattgcagataggattataagtgactctcatttttcagtggatgtactgactgtcgtcattgggcgaccaggtcaccctagtcgtgcccgtgctgctggagccaatgtaatgatcaaacaatattttggaccaacttcaaggagctcccgcacgtctatgtccatgcctcctgaagacctgaagcagctgacacaaaaaattagggaccagcaagaggagtcgatcatagaaaaaggactcacactacctcctaagcctaaggttggtccttctgctgcttgtgtcaacactgtagaagcaagtttcatgatgatgaaccaagcaattttgatgatgccaaaagcccaagtgattaattcaagattgattcaagacttcaagatcaagcatcaaaaatccaatccaagattcaagattcaagagaagaaattaagaagcaacaagtcaagacttcatataggataa

SEQ ID NO: 72315 - DNA, 681 bp, Glycine max
  Peptide Sequence Number=SeqID_189093
atgtctccttcatcgctatgctctcttcaagcgtccccgccaatatctcacgcattgcttaaccgccaccacaaaccggcgcacgatagcaccgccggcgtacggaatagaacgccatacgtagtttcctctgaaagaagcagcactgcttcgacgcgaagcgcagatgattaccacgccactctcaaagctctcaactccaaaggcagattccccagaaaatcacttggccagcattatatgttgaatgctgacataaatgaccaacttgctggtgcggctggtgttgaacaaggtgatgtggtgttggaaattgggcctggaactggttccttgactaatgttcttttaaactcgggcgcatttgttcttgcagttgagaaggataaacacatggctgcccttgtgagtgaaagattttcaagtacaggaaagttaaaggttttgactgaggatattgtcaaatgtcatgtgcgctctcatatgtcatcattggttggaagcataaatccagaatctagaaaagcaaaagcccactttgagccatgcaaaatttgggctggaccagatttgatgtggactaactatttggggccccagacagccctatacaggccagctcactggtccagtgcattaactaagaacaaaaaaaataaatccttagcaaagtctttctag

SEQ ID NO: 72316 - DNA, 1530 bp, Glycine max
  Peptide Sequence Number=SeqID_189094
atgggggttggtggtaatttctgggacctgctgaagccctatgcgcgcaaggagggttttgatttcttgaggaacaagcgagttgcagtggacctttcgttctggattgttcagcccgagaatgccatcaaggccatgcatgtcagaaaaccccatctcaggcttaccttcttccgcaccatcagtctcttctgcaagtttggagcacttccggtgttcattgttgatgggagtccatcgctgttgaaatcacgtgccaggattgcgagatatttccggtgttctggcattgaattggctaacttgccggtgcctgaagaaggtgtttcagctgagaggaaccgcttgttttcaagtcatgttcaagaatgtgcggaactggttgaactacttggaatgcctgtgctaaaggctaaaggagaggctgaagcactctgtgctcaattaaatagtgaaggtcatgtagatgcttgcatcacagctgacagtgatgcattcctctttggggccaaatgcattataaaatgtttctgtcccaactccaaagaaccatttgaatgctacaatatgtcagatattgaagccgggcttggattgaagaggaaacacttaatagctatctctcttttggttggagatgatcatgatataaatggtgttcgagggattgggcttgatactgcacttcattttgttaaagcttttagtgaagatgatatattgaatagattacatgagatcggcaaagggaatacttcacaaattcccatctgcattaaagttgaggacaatgtggatgggaactccccaaatagaaaactatctcattgttcattctgtgggcatccaggcagcaaaaaagatcatatgaaatttccctgtgaatattgtgtcacaaaggatgatgaagaggagccaaactttcccaaggatgaaatcattgatatgtatttatgcaatgacaatggttatttttcagcaagtgatagcccacacattgtatggggaaaccccaatattgagatgctgattaattttttaaacttccatcagcattgggaaccagcctacgttcgacgaatgatgtttcctatgatttccaccatctttttgagagatatgacaacaactacagtagagactacgttgtttgggcaatatgagtttgattccgtagaacgtgtcaaaatgagatatggatatcaattttttgtggtcaaatggaaacgtgcaggggttaacatttcctgtaaagttccattgaaggaatcaagtgtgcaacaggatgatgctatagagcttgatgaaatggtggatctactggatgactttgatgctccagagattcatggagacgatggatgcagttttctgcttacagatgaaaatatggaccttgtaggtgctgcttttccagcagaagtcaaaaggttttggcaagagcagaatttgaaactcaatctgagaagtatgcaagaggattttagtataataattgtagcagttggtagaagagattcaaatatgtga

SEQ ID NO: 72317 - DNA, 546 bp, Glycine max
  Peptide Sequence Number=SeqID_189095
atggtgccaaatagaactattcaaggcaatccaccaaccacccctaatatcctgatttacaggatccccaaagccttcacagaattgagtaaagtggcactttggatgactttacagtataagtctctgtctatacccaactctatcccagtcaatacccaccctatgcaaacaaggtctaaatatggtattcacaaccctagacttcacccttcactttttctcactcattctgagcctaaaactgtgaaacaagctctagcaaacaaagattggctcattgctatgcaacaggagtatgatgccttactgaaaaatcatacttgggacttagtatctttacctcctaacagacaggccattggctgtaaatgggtttacaggttgaaggaaaatgttgatggatcaattaataggttcaaagcaagattggtagctaaggggtttcatcaagttcatggttttgattttcatgaaactttctctcctgcgatcaagtctgttactattcgaattattcttactcttgccctgtcctatgggtga

SEQ ID NO: 72318 - DNA, 375 bp, Glycine max
  Peptide Sequence Number=SeqID_189096
attcaagggactaaccacctaagaattctttgtcttaacacattggagcgtgcatcctttgtggtacaagtagagcgtacatctacttgggttgtgatattgagaacaagagagggtacttctcttgtggatcagttcaggattttacaaggttattggaaatctcaagaaccggtggttgcttggggactagatgtagtgaagatcgatgctaaggaagttcaagatgctgatgctcacgttcttgtacctactcaagaggataaacagggagctgagggaccaatgaaacctgtagataggttggatcctaatgtcgatcccctatacctgatggcattgactatcccacagcttttcctcaagctgttgtag

SEQ ID NO: 72319 - DNA, 297 bp, Glycine max
  Peptide Sequence Number=SeqID_189097
atgttttcaactgctgaacatgttcgggtgggagagccgggggagaccaatccgatccagtcagctctccatcagcgtcttcaaccacatactcctatgatgagaagcaataacaatttcataatcaacaatcaagaccatttagcacatgggattattggtactcaactaatctcaaactgtttgtgttccatgtcaaatgtaatccagaaagaggcccaaaagccagccttaaggcatcaaaataccagattcaagtctaagcccaattactatcacacccggaaaagcaaatga

SEQ ID NO: 72320 - DNA, 384 bp, Glycine max
  Peptide Sequence Number=SeqID_189098
atgcaatcagagacagaacaacaatcatggagacttcacgtcactgccaaagccaacaaattcaacttcagactcagattcgccgccgcaactcacagatacagacccacttggaacctctccttcttccgcatttccattctcctcaagcttcctaaattcgccttaataatcaattcacaccccacaaacccaacacgcggacgaggattctttgcaaccaaattcaccaaaattctccacagacttcgacctcggttgcccaaaaagaaggaatcaaatgctccatgtctgaaggttaatgaaattgaagatagcaaagcttgtgaatttagtaacattcttcttagtggtggtgggaacaatattttattacctgtttga

SEQ ID NO: 72321 - DNA, 480 bp, Glycine max
  Peptide Sequence Number=SeqID_189099
atggtggcgggaactgcaaccttgaagcttaatctctccgatttttcttctccaatgtcaagtttcagcgcttcttcctcttcttcttcattcccctttcttctttcaatgcgaaccccttcttcttcttctaaaccccgatttctcagtcagtcacttccttccttaatttcctccctttctccaacagcttttctctcttcgctaacttgcgcctttctttcagggatttacgccttgaccagcaacgacatcaaggtcggcaccaacctcgaagtcgatggtgctccttggcgcgtgttagttttgaattgtgaagcctcttttaacttggcttgcgttgcactgcacggttcagagtttcttcacgttaagccgggaaaaggcgcggcgtttgtgaggaccaagatgaagaattatattacagggaacacggtggagaaaacgtttagagctggaagctcggtaaatgcacactaa

SEQ ID NO: 72322 - DNA, 1650 bp, Glycine max
  Peptide Sequence Number=SeqID_189100
atggggtgcttcactgtattgaagagcaaaaagaaaaggtctgatccaattacatatgtaaaacgtgtaagccataatgagaacgtacctacagtactgcctgaacctcaaactcatactcgctcactccagtctgctcctcctagttttaggaccagagtgaaacccattcaacccattaataaagtcagtaacaatagagcgcgaacattatctgctccatcaactcttgatgcagcagaacaagatgctttggcttcaattgagtatgaggaacaagaagagtcaagacaccgagctggatcaatgaaggagcatcgttcatctagtccacaacctttaccacttccatcccctcagggaggttgtgcattgaaggctattggcagctttaagtctgtgacatcaggtggctcctcttactatgcttctggacctttgccactcccacctactgggtcacttcggaattttctgtacgaggaaattgctgctgcttgccaccatttctcttctgatagatgcatgtcagaatgtctttcatccaccatatataaggcttccttcggtgacgatgtttcaagttcgaagaagtttgaagctactgtcacacggcttcacccatcttctcagggcttgaaggaattcataaatgaagttaatactcttgcatctttgcaacatccaaacctctgtaaattgctaggatttcatgcccgagagggttcagaacatagaatgctggtttatgagaggctataccatggaagcttggatcgcttattgtatggaagatctgatgggccatcaattgattggaatacaagaatgaaaattgctatatgtgctgcacaaggtctaactttcttgcatgaagaagggccttttcaggcaatgtataatgagttctcaacagccaacatacagattgacaaagatttcagtgcaaagctttcaggatatggttgtgttggacatattcccgaggaagagatttcaagcagttcatctgctgttggaaacctatcaatggaaacactggagaaaggaatgctcacaccaaagagcaacgtatggagttttggaatttttcttctggagctactcacaggaagaaagaatctcgatagccgtcaccccaaggaagagaggaatttagtcaagtggagccggcctttcctagctgacaactaccgtctgtcgttgatcatggatcctcaactcaaaggtcgctttccttctaaagccgcaagaacaatagctgacattgcacaaagatgtctccaaaaggagccatcagacagacctaccatgagaactgttgttgagcatctcaagatgatacaggatttgaaatactcgtgtcgattcccactgcaagagccagcatcaaactctgggaaacatatgtcaagatcaccaagtctcaatggcatcatctgccctgcaccgcggttgagtttctcaccatcaccgccatcaggaattccagtatctgtttcgcctccaagatggtcaggtggagggcccattctcctcctgccaccgcgtgcttgtgcttcaagtctctctttggaggagcttgataggcaggaaagccgcaagtcatcatcctcagcctctagaagggctagtgttgaaggattttga

SEQ ID NO: 72323 - DNA, 1518 bp, Glycine max
  Peptide Sequence Number=SeqID_189101
atgccttctccaattcccacgtgccaccatattcttcaacctcgtaccccttttctcaccaacattgccaccaaaatcaacaatgacaccatcaccatcagaccaggtaagaccacactctctttctctgccatcaaatccacagcaacaacaacaacaaatgaccttaatttcgaggacacagtcactaggtttcgaatcaaaggtcttgtccacaggatcacagccttatcctcctccaacaccaaaccccagatgctacaaatcctagaaaaagtccccgaactctaccaaaccatatcagatttcaaccaccttctcatggctctagtaattacacgaaaacctgatatttgtctcagaatcttcacaaagttaccatctttccagctcgagccagattgttgcactcactccattataattaggtgccactgtgaagaaaacaacatggatgaagccaagagagcattggacactgctctggaaaaagggtttctaccagatgctgcaaccttcactgttctcataaattccctttgtaaaagggggagagtgaataaggcaagggaggtttttgaggtaatgggtggaaagggttacaaggctagtgttcatgcacataattgcttgcttaagggtttgtcctatgtggggaaggtggatgaagcacttgagatgttgaatgatatgaatgcaacctcattggagcctgatgtttactcttacacagctgtgatggatggtctgtgcaaagtgggtaggtcagatgaggcaatggagttgctcaatgaagctgttggaatgggggtggtgccaaatgttgtcactttcaacaccttgcttcaagggtattctagggaggggaggccaatggagggtgttgctgttttggagatgatgaagaaggagcatgattgtgttcctgattgtgttagttatagcactgtgttacatggattgttgaagtggaatcaagttgtggcagcccttggggtgtacaaggaaatggttggggttgggttggaggtggatttgaggatgatggggactctggtgaggaggttgtgtaagaggtcatggaaggatagagatagaggtctgcttcagggtgcaggtgaggtgtttgagaaaatgaaagagaggggtttggtggttgaccaggggacatttgaggtcatagtccaggcactgtgtgaggggaagaggtttgatcaggcattggcaaatttgtatgagatggttagattgggatattctcctgaggtaattgcctttgacaaggtgattcaagggctttgtgatgaaggaagagtggatgatgcagtgtcagctttggtccttttgcatgcgaatgggggagttcccaatagagtttcttatgatgtgctgatcaaagaactaattgaggagggtagattgttttgtgcttctaatttgttttgtgctgcagtgaagttgggtgttgttcccaacagggaacctgatctaaatgttataaagagggagtgggaatga

SEQ ID NO: 72324 - DNA, 498 bp, Glycine max
  Peptide Sequence Number=SeqID_189102
atgagaacacacgcgttactgacacttttgttgttttctcgggttatgtttgatgtttccgacgctttctctgttcgggaattccgaaagttgattgcctctgatccaaaagataatcaaccaaaggatccaaaccatgctggtgaaacaaacaaggccacagggggttcaccttccaccaatgtgagtggtcctatttcatccccagttccacaaccacaacctctgcccaaagtgatgaagaatacaaatgatgataaaaaaaaggacaataattcagctcctcctgtgagtgtacctcctccaccaaaaaatgatgatggtggtgacaagggtctggataaagagaatgacaaaattgagggcatgaagttttcacataatagcaccactgagacttgtgacgggttcaacaagtgcacagatgatgggggcatggttgcttgcatttcgaaaattggtactcactgttcatcattgcttttgattattcgttaa

SEQ ID NO: 72325 - DNA, 525 bp, Glycine max
  Peptide Sequence Number=SeqID_189103
attgagcaagcagatgtattcaaagaaacaaagcagtttacatataaagatggtgttcaatttgtcttcatggacttgaatacatatgaggagtttcgtctgggtgaaaaggaaattggagacagaacaaaatggctaaaagaaggaatggactgtaatttgctgttatggaatggaaaagtaatcatctcatctcataatatattatgtctttcactattgttgcaagtctcacatcgggtggttaacgagcatgataaaccgttgcttgatcacttcggtgacaaactcacactagaggagcatttcctgattggcagtatggttattgatgttgaactccctatcacaatcaagcttactgtagttgatgtggatccaggacttaagggtgacacggcccaaggcggaacaaaaccagccaccctcgacaccagcgctgttgtcaatgtcccactctttgtaaatgtcggtgatgaaatattggttgattcaagaactgggcagtacatgagccgtgcttaa

SEQ ID NO: 72326 - DNA, 477 bp, Glycine max
  Peptide Sequence Number=SeqID_189104
atggctcggaagaacagggtgatctttcatgtcaacatcacacaaagtagcagcaaaagtacccaactgactttaaatgctggaaaaggggattgtgtgcttcacatggtttcaaatatacctgatgagaatttcattctgcgtcttccttcttatgacaaaattttaacaccagtaaatggtgcctatttcctcatattgatggtcctagtctttggagggacatgggcttgctgcgcatgcaggaagaaacatcatgatgaggttccgtatcaagagcttgaaatggcactgcctgagtctgcattagctaccaatgtagaatctgccgaaggttgggatcaggattgggatgatgattgggacgacaatgtggcggtgaagtcaccggcagcgcatgcgggaagcatctcggggaatggccttacttccagatcctcaaacaaagatggatgggagaataactgggatgattag

SEQ ID NO: 72327 - DNA, 204 bp, Glycine max
  Peptide Sequence Number=SeqID_189105
atgtcttccattggggcacgttcagctgaaatttatgttatggagaagaggcagaaagagaagttgaagagaatggaagaggaaagagtacgaagaggtgaggtgagtactgaagagagaaaggagattagttctagtgtgggaaagaacaaggtgcatccagctcccctaagctcaccgaaaaagaaaaccttgttaatttag

SEQ ID NO: 72328 - DNA, 2869 bp, Glycine max
  Peptide Sequence Number=SeqID_189106
catgtgtgtgttgtttctgatcctccttgcaccggttatgttggtgttttctgtggacactggtttcaatgatgatgtgttggggttgattgtgttcaaggctggcttggatgaccccaaaaggaaactctcttcttggaatgaggatgataacagcccttgcaactgggaaggtgtgaagtgtgatccttcatcaaatagggtcacagctcttgtccttgatggtttctctctttctgggcatgttgataggggcttgttgaggttgcaatcccttcaaattctctcactttcaaggaacaacttcactgggtcaataaaccctgatcttcctctccttgggagtttgcaagttgtggacttgagtgacaacaacctctctggggagatcccagaagggtttttccaacaatgtggctctctaagaacagtttcatttgccaagaacaacctcacaggaaagattcctgagtccttgagctcatgctccaatttggcaagtgttaacttctcctctaatcagctccatggggaattgcctaatggagtgtggttcttgagggggctgcagtcgcttgatctgtcagataactttcttgagggagagattcctgaagggattcagaatctgtatgatatgagggagttgagtcttcagaggaacaggttcagtggaaggcttcctggggacattggaggctgcatacttctgaaatcacttgacttgagtggtaactttctctcagaactccctcagtcaatgcaaagactcacttcatgcacatcaattagtctgcagggaaattcattcacaggaggcattcccgaatggattggagaattgaagaatctagaggtgttggatctttctgccaatggattctctggttggattccaaagtcattagggaatcttgactctttgcatagattgaatttgtctaggaatcggttgacaggaaacatgcctgattctatgatgaactgcaccaagcttttggctcttgacataagccacaatcacttggcaggccatgttccttcatggatttttaagatgggtgtgcaaagtatctctctttctggggatggcttcagcaagggcaattatccttcactgaagcccacacctgcatcttatcatggtcttgaggttttggatttgtcatccaatgcattttctggtgtgcttccatctggcattgggggacttggtagcctccaagtcttgaatttttccaccaacaatatctctggttctattcctgtgggtataggagacctcaagtctttgtacattgttgacctgagtgacaacaagcttaatggaagcattccttctgaaatagaaggggcaacttcactcagtgagctaagactgcaaaagaacttccttggtgggagaattccagcccaaattgacaagattctttctcacaacaagcttactggttcaatccctgcagccattgcaaacctcaccaatcttcagtatgtagatttgtcatggaatgaactctctggaagtttacccaaggagttaacaaatctttcccatcttttctcatttaatgtatcctacaaccaccttgaaggtgaactacctgtgggaggcttcttcaacaccatctccttctcatccgtctccggtaacccattgttgtgtggttccgttgtcaaccactcctgtccttctgttcatcccaaacctattgttctaaaccccaactcttctggttccaactccagcatttccttgcagaaccatcggcataagatcatactaagtatctctgctcttattgctattggagcagctgcttttattgccgttggtgttgtggctgttactgtcctaaatatccatgtgcgttcctcaatggaacatacagctgctccattttcattttctggtggtgaggactacagtggttcgccggcaaatgatccaaactatggcaagcttgtcatgttttctggtgatgcagactttgctgatggagcacataatattctcaataaagaaagtgaaataggccgtgggggatttggagttgtgtatcgcactttccttcgtgacgggcgtgctgttgcaatcaagaagctcacagtctccagtttgatcaagtcccaagaagagtttgagagagaaattaaaaagcttgggaaagtgaggcacccgaatctcgtggcacttgaaggttattattggacttcatccttgcagctccttatctatgattacctttccagtgggagtttgcataaacttctacatgatgataacagcaaaaatgtattctcatggccacaaaggttcaaggttattcttggcatggcaaaagggttggctcatttgcaccaaatgaacataatccactacaatctcaaatcaaccaatgtgctgattgattgttctggcgagccgaaggtcggagactttggcttggtgaaactcttgccgatgctagaccattgtgttttgagcagcaaaatccaaagtgcgctcggatacatggcacccgagtttgcttgccgcacagtcaagataaccaagaaatgcgacgtgtatggttttgggatcctggtgctggagatcgtgacaggaaaaagacctgtggagtacatggaggatgatgtggtggttctttgtgacatggtgaggggtgcattggaagaaggcaaggtggagcaatgtgttgatgggaggctccttggtaactttgctgcagaggaagcaattcctgtgataaaattggggttgatttgtgcatcgcaagtgccatcaaatcgtccagacatggctgaggtagtcaacatattagagttaatccaatgcccttcagaaggacaagaggaattagaatga

SEQ ID NO: 72329 - DNA, 516 bp, Glycine max
  Peptide Sequence Number=SeqID_189107
atggaagaccacaacatcacaggggcgtgtcgcatgtcggcgatcacaaagatgataatggaaagcatgcgtttgaagacaatgacaagtagccttgtggagatcaaaggcacgaacccacctgagtcacgccaaggaagtaactacactcgcctttttgattctgctgagtacgcttcgcttgtttcctgtgtcttaggtgaggaattggagaatgttgtgtctcctcctcgctgcatgtctcacttgggacctgaagttgaagaggaagtgaaacatgtgagtgaaagacaagagtggtggaatattgtcatggctgatgaaaaggaagcagaagaagctgaggcctctgcaaaagatgaaggaaatggaaaaaaatatggagtcatagactatattgagtctaggagtgagacgagatcatgtatgatcgaggtcttggattctcacatttgtgttcttgaattatgtaatgatttgtctttaataagagaggggacaaaacagatgtcttaa

SEQ ID NO: 72330 - DNA, 1263 bp, Glycine max
  Peptide Sequence Number=SeqID_189108
atgatgagtttctccttggattcagtttcggtgttaaaccctaaactctcccactcccatttctctctcccattcaacaggttcccccattccctcaacttccaccccttactcaaaccccgcgcagttaacgccgccgtcccccctaacggcctcgccgcctgctacctcaccctccaccgacggaaaccgttaaccgtcgctttcacagcttctccccaagactccgaacacggagagattgaagtggagaaggagcgtgacgtccacgcgggctctgaagaatctcaggaagcatggaagcaggctctggacacgttcagggaacaggcggagaagtttcagggcgtttctcaggaggcttatgaggtgtactctaagaagactgcagagcagttgaaggtgctggcagataagacgaagaatgagttgagtgtggcagcgaaggaaatcactgacgaagggaaagagtatttgtccgcagtggcggatagttcaccagaggtgaaggagattgtggaaacgtttacctcgccacctgaggatatccagaaattgtctggagtgagggacttctatgttggtgtaccttatgatgttgtttgttggaaaggtaccttaattgcagtcatccttggccctgccttaattacagctatcaaactgttgagacattggctcataggggttgagatctcacatgaggctcaaataatgcttgtaaagctggacagtcctcactgtataagctggttttgtgggattgagttgggccctaaacccaaattatgttggaatggtgtaaaggggcaggcttatgggcctcaatatcagttccctatagacgtcatcccattatacaatgatatgacttctattatgttgactgggaatattttattgtcctgtttctcctcccatgtacctggtttgttgctttctcttggtggtttcctttcctttatggtaacaggcaacactgcagcgataaggtttgggatgattttaggtggtgccctcctggctttaagcattttaagtctgaaatcatacaaaaaaggacgcacctctcctctcgctttgaagggccaagctgctatagcaagtatattgtttctgcgggagataagctcaataggcaaaggatcatcttatttcactgccttgatcagtggtgcagtggtggcattctatatctttagaatagtactggaacgtaatcaacagaaggcctcaaacttggaaactgaaccaggaaactag

SEQ ID NO: 72331 - DNA, 165 bp, Glycine max
  Peptide Sequence Number=SeqID_189109
atgcagagacctaaaggaagcaggcaggttcatagacaaaggaaatttcagagttgtccttctaattcgggttcttgcgatgatggagttgcagatgaagagttcgtggaggggcagtggggttggagaagctgcggcggcggcggaaacggccagagaaagtga

SEQ ID NO: 72332 - DNA, 3881 bp, Glycine max
  Peptide Sequence Number=SeqID_189110
gatggctatgaggattggcggaggcacaggtcagatcgcaatgagaacaaccgggagtctctggtgcttcagtccggtgatttccgatcaaagaaatggaagaaaatacaagctggtgaggttgttaagatctttgccgatgagacaattccagctgacatggtcttgttggggacgagtgatcaaagtgggcttgcctatattcagacaatgaatttggatggagaatcaaatttgaagacaaggtatgctaggcaggaaacagcttcagcggttgcatcagaagcttgtgatgtttttggtgtaattagatgtgagcaaccgaaccggaatatttatgagttcacggccaacatggagttcaatgggctaaagttttcccttagccagtcaaacattgttctgcgtggttgccaattgaagaacacagattggataattggtgttgtagtctatgcaggacaggaaacaaaagcaatgttgaacagtgcagcttctccttccaagagaagcagactggaaacttacatgaacagagaaaccctttggttgtcaatttttctttttatcatgtgtttggttgtggccattgggatgtgtctttggttggtacgccacaagaaccagcttgataccttgccttactacagaaaaagatacttcaccaatggaccggataatggaaagaaatataagtattatgggataccaatggaagcatttttttcctttttgagttctgttatagtgtttcagataatgataccaatatctctttacatcacaatggagttagttcgattgggtcagtcatacttcatgattgaagacagggatatgtatgatgcctgctctgggtcaaggtttcagtgtagatcattaaatataaatgaagatttgggtcaaatacgctatgtattttcagacaagacaggaacactaacagaaaacaaaatggaattccagagggctagtgtacatgggaagaattacgggagctccttgcctatggttgataatacagcagcagcagcagatgttattcctaaacggagttggaagctcaaatctgcaattgcagttgattctgaactgatgacaatgttgcagaaagactcaaatagagaagaaaaaattgctgctcatgagttttttcttacattggctgcttgtaacactgtaatccctatacttggtgatgatgaattttctagtattggaactaatgaagtaaatgaagatattagacgcattgattaccagggagaatctcctgatgaacaagctctagtttctgcggcctctgcatatggatatactctttttgaacgcacatctggacatattgttattgatgtcaacggtgagaaactcagattggatgtattgggtctgcatgagtttgatagtgtgcgaaaaagaatgtctgttgttattcggtttcctgacaacgcggtaaaggtgttagtcaaaggtgctgatacttcaatgtttagcattttggaaaatggcagtgagagtaacaataacatatggcatgcaactcagagccatttgaatgaatattcttcacaaggtttgcgcactcttgtagtagcctccagggatctttctggtgctgaacatgaggagtggcaaagcaggtatgaagaggcaagcacttcgttgactgacagagctactaaactacggcaaacagcagctcttatagaaagcaatttaaagttacttggagcaactggaattgaggacaagctacaagagggtgtaccagaagcaattgaggctctacggcaagctggaatcaaggtctgggttcttactggtgataagcaagagacggcaatttcaattggtctttcctgcaaacttcttagtggagacatgcagcagattattataaatggcacttcagaggttgaatgtagaaatcttttggctgatgctaaagccaaatatggtgtgaaatcatcaagtggagggtgtcggaatcaaaagcacaaaaccaatgctggacatggtgatcttgatattcccaatggttcaaagtctttgagctttcccaaatgtaatcctggaaacgaagaaggaactgatgctccattggcactcataattgatggaaacagtttggtttatattttggagaaggaactggagtcagagcttttcgaccttgcaacttcctgtagggttgtgctgtgttgtcgagttgcacccttgcaaaaggcaggaattgttgatttgataaagagccgcacagatgatatgacactggccataggtgatggggccaatgatgtgtcaatgatccaaatggcagatgttggtgtaggaatatgtgggcaggaagggcgccaagcagtgatggcatcagattttgctatgggacagtttcagttcttgaaaaaattacttctggttcatgggcactggaattatcagcgtgttggttatttagttctgtacaacttctaccgcaatgctgtctttgtaatgatgtatatattatgcacggctttttctacaacttctgcgctgacggattggagtagtgttttctattctgtgatatacacatctatacctaccattattgttggtattcaggacaaggacttgagccataggacactcttgcagtatccgaaactgtatggtgcaggtcacaggcaagaagcttacaatatgcaattattttggatcacaatgatggacacagtatggcagagccttgttcttttctacatcccattgttcacctataaggacagttcaattgacatatggagcatgggcagtttgtggacgattgcagttgttatccttgtaaatgtacaccttgctatggacatcaaccgttggaaagggtatacccgtcttttcaaccatattctgtcagagactgatcttttggtagccaataaaatgatgccacctgtcaccatgacatctatggcaacgggttggaattttcgtggcaaggttcctttaaacttcggagcatgtgcgcattgcaacaaggattggaacatggaaaatcttggtggttctagtcgtaggaaagcaattgaggagcttcttagagggcgtgattctgcccaacaacttaagagtgtcatcaatgggacttatgatgatggatcagccaccccatttgctcaacaacttgtgaaagaggtgctcatgtccttcacaaactccctcttgttcttgcacaacaaccccacttctgaatcacatcatgtcttcaatgttcaagtatgggactctcccaagtctgaggactctcaagagagcaattgcaaaagctccaccattaaggaaccaagagggtgctacaagagaagaagaactgaacaaacatgggagaaggaatctgaagctccaattgatgacggccatcactggagaaagtatggccaaaaggagatcctgaatgccaaattccctaggaactactataggtgcactcacaaatttgaccaaggttgccaagcaacaaaacaggtgcaaagagttcaagaggaaccaatcctattcaaaaccacctactatgggcaccatacttgcaagaactcggcaaaccctgatatcatacttgaccccatgtccccttcatcctcttccaagttccttagctttgacaactccttttcaaccccatccaagcaagagtgcccctttctctcatcttccaataatttcccatcatcatcatcagtgaaaagggagtgcaaggaggaggtccctccctcaatttcctccaatgattacctcatctcttctgacctcacttttgatagctcaccaaggcatcatgtcactctatcatcaacacttgactctgagtacaagagtgtggacatttcggatgtctt

SEQ ID NO: 72333 - DNA, 330 bp, Glycine max
  Peptide Sequence Number=SeqID_189111
atgactggactcatgcgcggccttcgaagaaccaacaccataaccatccacaactgcaacatatccatcgacgcggctttgtttcaacaacaaaactgtcatggaatgggtgcttgtatctgggaccatcatggcagatttatcacatgcagcaatgacaaggtatatattcaactggaatctcgagtcctagggaagctgaagctgaagactttgtactcaacagaaaaaggcagctctaaatttcattttcttatctccaaatgcaagaatcttataagtttcattccaaacttaaagatatcggaaaacatttttcacttcaaatga

SEQ ID NO: 72334 - DNA, 480 bp, Glycine max
  Peptide Sequence Number=SeqID_189112
atggcttctgttctggcattaattttgattgtgaatctattcttcacatctttcatttattttaatcatctagctcagaaatcttgcgaccgtgtcattggagaacccacaattgattcgaagcatcagttttcacctgacttgcatttgcatggggtcgttgttcatcgtggtgcaccatggaaagcagagattggtcaatggcttgcgagttgtgatgttgttaccaaggaagtcaacattactgagatattaggtggcaatagctgcaaaaatgagtgcagtggccagggcgtttgcaatcgagaattgggacagtgtcgctgtttccatggctatgctgtgattgttgttattcttgagcttactgtctttcttaatttggtgactgattcaaagtttttacaaactgttttggaagctgaacacttaagtcaaatatatgtccctccagcaatgattctacccccgaatggctga

SEQ ID NO: 72335 - DNA, 1998 bp, Glycine max
  Peptide Sequence Number=SeqID_189113
atggatgcactgagcaattacaattggaatgcaactatcaaggttccccagaagctccatttgggaaatgggttccctccatatgccctgccacttgtgacaaaacaagagccatgtgcttctgtggagaaggcacaaaatatccaaatcgaccattgccaatgtcatgtggctttcaacttaagtaatgcatcttctgagcctgatggtcccatggaggtggattggacaaaattagaccaagatgtgttcacaaccaatggtaacaaatcaggttggtgcaatgtggaccctgatgaagcatatactggcaaggtgcaattcaaaggcgtatgtgaatgccagtatgatggtctagggggttggttttgtgaagtgtctgtgcaatctacttgcattaatcagtgctctggacatggccattgtcgtggtggattttgtcagtgtgacaatggctggtatggagtagattgtagcactccttctgtcatgtcttctgtatgggaatggcctaattggcttcgccctgctcagattgatgttgctgacaatcagcattttgatgaaaaagttattaatgctaaggctgtggtggctaagaaaaggcctcttatatatgtttatgatttgcctccagtgtttaacagcctgctccttgaggggcgccattttaagcaaaactgtgtaaatagattatatgatgtctataatgcaacaatatggacagatgaactttatggtgcccagatagcactttatgagagtatcttagctagtcctcatcgaactctgaatggtgacgaggcagattttttctttgttccagttcttgattcatgtctcatagatcgtgctgatcatgctcctcatttgagtacgcaggttgtaaagtacataatggtaatcctagatgagaaatctaccatttgttatagagtctacactttaaagaataataatcctactgaatgtggcataatgcttataatcacatcgttgagcaatatccttattggaactgctcatcaggaagggaccacatctgggcagtttttttcatgggatgaaggtgcttgctatgcccctaaggagatatggagcagcatgatgttagttcactggggaaacacaaacacaaagcattaccattcaactacagcctattgtcctgacaactgggatggtattccttctgatagaagaggttttcatccatgttttgaccctgaaaaagatcttgtgattcctgcttggaaagtgactcatgttcatgtgttatcgtcaaaactttgggcttggccccttgagaagcggaagacgctgttctacttcaatgggaatttaggaccagcttacccttatggaagaaatgaatggtatagcatgggtatcagacagaagcttgcagaagagtttggatcaaagccaaacaaggaaggaaaacttgggaaacagcgtgccaaagacgtcgttgtgaccgcagagcgttctgaaaactatgaagtggaactagcaagttctgttttctgcggagttttgcctggagatggttggagtggacgcatggaagacagtgttttgcaaggatgcattcctgtgatcattcaggatgggattttcctaccatacgaaaatgtactcaactatgacagctttgctgttagaatacctgaagatgaaattccaaacttgataaagattcttcggggaatcaatgatacagaaatcaaattcaagctcgcaaatgttcagaaaatctggcaaagatttttgtatcgtgattcagttttgcttgaagctgaaagacaaaaaactgcttttggacatgttaacgattgggctgttgaattcttaaaattgattgaggatgatgtcttcaccacttttatacaggttttgcattacaagttgcataatgacccttggaggaggcaccaagttggccttaagaaaaagtttggattacctgatcagtgtctgctaagtagttccaaatga

SEQ ID NO: 72336 - DNA, 1104 bp, Glycine max
  Peptide Sequence Number=SeqID_189114
atgaacaccatctcatcactgacccttgattctcacgcaatatgcaaccctcagcgcagcatctccctccgccaagttcgccccaccactcgaaacgtcgtcgtgtgctccgcgaagcccgtcgcgcctccccccaccaagctcgccgccgccgacacctccggctgccgcatcggcgaactgagccaggtctccggcgtgcttggctgccagtggggcgacgagggcaaagggaagctcgttgacatattggcccaacacttcgaaatcgttgctcgctgccagggtggagctaatgctgggcatactatttacaacgcagaagggaaaaagtttgctcttcatcttgttccttctggtattctcaatgaggatactctgtgtgttattgggaatggagttgtagtgcacctgccggggttgtttaaggagattgacggtcttgaatcgaacggggtctcttgcaagggaaggatattgatatctgatcgtgctcacctgttgtttgatttccaccaagtggtggatgggctaagagaagcggagcttgctaaatccttcattggcaccacaaagagaggcattggaccctgctactccagcaaggttaaccgtaatggcctccgagtgggtgatttgaggcacatggatactttccctcagaagcttgatcttatattgtcagatgcagcattgaggttcaaagattttaactatggcccatatatgctcagggaagaagttgaaaaatacaagaggtatgccgagaggttggagccctttattgctgatactgtgcttgtcatgaatgacgccatagaacaaaagaagaagattttggttgaaggaggacaagctaccatgttggacattgattttggaacttatccctttgttacttcttctagcccatcagctggtgggatatgcactggtcttggtattgctccaagggtacttggtgatttaataggagtgctaacatacacctttcccccatctatcaatactccccttcaagatggaccttgtcctcaaggtcaagttgaggaaaatagcctgcatttcataagcaagggtctccttcatcctcttcttccataa

SEQ ID NO: 72337 - DNA, 2337 bp, Glycine max
  Peptide Sequence Number=SeqID_189115
atggagagaggagccaataataagaaattatcacctctctcttcggagcaattcatttctcttaccaccccgcttgttgatttggaaaaggaagctgaggcatcaagcacaggagtgtctcaagagagggtcatagaggatgctgagaaagatgaatttcaagttgatgactgtcccatagagcaagtgaggctaacagttccaatcactgatgatcctactcagccagcactgacattccggacatgggttctggggttggcatcatgtgtatttcttgcctttgtaaaccaattctttggctacagaaccaaccctttaaaaatctcttcggtctcagcgcagattattaccctcccacttgggaaactcatggctgcaactctttccactaaaccaatccgagtgccattcacaaaatggtctttttcattgaatccgggcccattctctttgaaggaacatgtgctgatcaccatctttgctacatctggatctagtggtgtttatgcaattagcatcatcacaattgttaaggctttctatcataggaacatccatccagtagcggcttatttattagcactatcaacccaaatgcttgggtatggatgggctgggatttttagaagatttcttgttaactccccttatatgtggtggcctgcaaaccttgtgcaggtgtctctattcagggcatttcatgaaaaagaaaaaaggcctaaaggaggaaacactaggctccaattcttttttctagtttttgtagtgagctttgcctattacactataccagggtacttattccaagcaatatcaactatctcctttgtttgcttgatttggaaagattctatcactgctcaacagattggttcaggcatgaatggccttggcatcggctcgtttggcctcgattggaacaccgttgcaggctttttaggcagccctttagctatacctggctttgccatcatcaacatgttgattggatttgtgctggatatctatgttttgattccccttgcttattggagcaatttatatgatgctaaaaagtttcccctcattagttctcacacatttgactcaacaggtgcaacatataatgttagtaggattctaaatcccaaaacttttgacattgatttgaatagttataacaattacagcaagatctatcttagtatcacttttgcatttgagtatggatttagctttgcaactctgactgccactatttcacacgttgccctcttccatggagagatgattcttcagatgtggaggaagacaactagagcactaaaagaacaacttggagatgtccatacaagaattatgaagagaaactatgaacaagtccctgaatggtggtttgtcaccattttgattctcatggttgttattgccttggttgcttgtgaaggctttggcaaacaactccaacttccatggtggggaattttactttctttaacaattgcattagtcttcaccttgccaattggggttattcaagccacaacaaacatacagacaggactcaacgtgattgcggagttgataattggattcatttacccaggaaagccacttgctaacgtggccttcaagacttatggacatgtcagcatggtacaggcacttgggtttcttggtgacttcaaattaggccactatatgaaaattcctcctaaatctatgttcatagtgcagctggtaggcacagttgttgcttcatctgtctactttgccacagcttggtggcttctcacatctattgagaacatttgtgatgaagaattgttgccgaagggtagtccatggacatgccctggtgatgatgtgttctataatgcttcaataatatggggagtagtaggaccaaagagaatgtttaccaaggatggtgtttatccagggatgaattggtttttcctcattggtctacttgcaccccttcctgtgtggttgctttctaaaaaattccccaaccacaagtggattcaactcatcaactttcccatcatcattgcaggtgcatccaatatcccaccattcagatctgttaattatattacatggggaattgttggaatcttctttaatttctatgtttatagaaagttcaaggcatggtgggctaggcatacttatatcctttcagctgctttagatgccggagttgctttcatgggtgtagccctctattttgctctccaatccaatggtatttttggtccaacctggtggggtcttgatgctgatcactgccatttggccaaatgccccacagctccagatgtacatgccaaaggatgccctcttctctga

SEQ ID NO: 72338 - DNA, 1305 bp, Glycine max
  Peptide Sequence Number=SeqID_189116
atggcaacgggaacgggaagtaagaagaaggcatcgcctctctctttggagcaattcatctccattaccgctcctcttcttgacttggaaaaggaagctgagatttcaagctcgatcgccactggtgcgtccaggaatttggatactgctcaaaagaggggttctacaatcctcaacttgaagtgcgtcgatgtccagacagggcttatggggaagtctctgatcgagttccagtcaacaaaaggagatgttcttcctgcacacaagtttggtactcatgatgttgttgttttaaaactcaacaaggctgatttaggttctcctgctcttggacaaggtgttgtttacaggttaaaggactcatcaataaccattgcttttgatgatataccggaagacggtttaaacagtcccctaagactggaaaaagtagcaaatgagatttgcatacaacatccctcccccataccttcgcatagcgaagagcctctgggcaatggggtgacttatcgcaggatgaaagacgcgttgatacagttgagtaaaggagtgcacaagggtcctgcctctgatctgattcctgtcttgtttggggagaggccaccaacagtgtccaagaaggatgtatcttccactccctttaataaaaatcttgatcactcccagaaagaagcagtttcaaaagctctatcatcgaagaatgtgttcttgttgcatggaccacctggaacgggaaaaactacaacagttgtagaaattatattacaagaagtgaaacgtggatctaagattcttgcttgtgctgcctcaaatattgctgtggacaacattgttgagcggctagttccacataggtgtgtaaaatcatttgttgatactttatactcattcatgatgacgttttctgctagagttaagctggtgagagtgggtcatcctgcacgtttattgcctcaagtattggacagtgcgctggatgctcaggtactacgaggagataatagtggtcttgcaaatgacattcggaaagaaatgaaggcattgaatggaaagctgctgaaaaccaaagacagaaatactagaaaggacatacaaagggaacttaggactctatccaaagaagaacgtaaaaggcagcagcttgctgtaacagatgtacttaaaagtgcagatgtaatattaactactttgattggggctttctctaaaaaactagacagcacttcatttgatttggtgattattgatgaagctgctcaagcacttgagatagcatgctggatacctatactgaaggtagtgtga

SEQ ID NO: 72339 - DNA, 627 bp, Glycine max
  Peptide Sequence Number=SeqID_189117
atgctaactccgacgaccggagtaccgaagctccggccgcgatccggccggacgccgcttcagcttaagaactctccggccgatcccatccagccttccgcgaagctcaagtcgaagccatattttgagatttcgttgatcgataaagagaacaatccgatcgccgccgttgcggttccgccggctgtgccgccggagacgtcgctggcggaggagctcagcgcggtcaagaagaagctggagaggatgagggcggacaaggagagaacggagaaaatactgaacgagaaacacgcgctgctggacgcgtggatgaaggagatggaagagcgaggggagaatcagaagaacttcgagatagaggttgaccggttgttccggttgaaggaactcaagtatcgctgcatgagagtttctccgatgagaacgcttagggagaaggaacaaggaaagatcgtgaacgaagcgccatcgcaatcatcggaggtgaaaacagaggaaacaatggcatcggaatcggaatcggaatcggaatctgaatctgttggaggtgaatgccaagttctgcagagtcctggttcagcttgttcacaaactcatactacacacacaaaatccgatagttga

SEQ ID NO: 72340 - DNA, 228 bp, Glycine max
  Peptide Sequence Number=SeqID_189118
atggagttgaagatgcgagaaatagctagtctcatgcgaagaaaggcgcgaaaggagaagatagaggaatcttgtagaaagatctgtagcgtgtggacgaagaggttgaaactgcgtatgggaggaatgtataaagtgagaggcaaagctgagaaggccacggcaaacgccagttgcagcattattggtgagagagagagagagagagagagagagtgcgaggaataa

SEQ ID NO: 72341 - DNA, 771 bp, Glycine max
  Peptide Sequence Number=SeqID_189119
atgcctgactttcttgccacaaacccacttaccttttcagctgcagaatctccaagattccccttcctcaattcacgcccaactcttacaccaagaacccaactcaacccaaattcccgtgtcctcttttctcccaaaccatccaaaaccagttgcaataacaagagtgtctctttggcactgagctccaggtcgaatgaagggccatcaaggggttatggcttttacaacgagcttgagtttgaggacagaaatgaggaaactttggggttggagataaaccctgttgttgctgaggattcccagagtgaaactgagtctctcccatttgatggggtggaaggtgatgataattataagggagaggatgatttggttcgggttcagggggatgcagatggagatggggatggtttgaagaaagattatgatgatgacgatgatcaaggtgagaatgagaaatttggaggtaaacttagagtcagaagaggtaaacagtggatggtgttgtttgtggaggttagaccaaacttgctctctggggattcagagaaattccttctggaggacattagtcagattggagatgttgtccttgtccaggatgaaagtgtgatagacaatgaatttaaaatggttggattggagacactgctaacattagtggtggatttaggtgaagattacaaggctaacacatttagcatacatcttaagcctatccaagtacatatcggactagttacaggagtaatttgcaaacctgattag

SEQ ID NO: 72342 - DNA, 1278 bp, Glycine max
  Peptide Sequence Number=SeqID_189120
atggagagaagggttggctatgaggtgctggtggctttggtgacccttttggttttctcattgacttgtgtcactgcttcaccatcagggccaacaaaacttcaagaccatgtgaagcaattcagggggaatcttcttgctaatggccttggtagaactcctccaatgggatggaacagttggaatcatttcagctgtcaaattaacgaaaaaatgatcagagaaactgctgatgcccttgtttctactggtctttccaagcttggatacacctatgttaatatagatgattgttgggctgaattaaatcgggatgctaagggtaatctggtagcaaaaaaatcaacatttccttctggaatcaaagctcttgcagattatgttcacagcaagggtcttaagcttggaatttattcagatgctgggtattttacttgtagcaaacagatgcctggttctcttggtcatgagtttcaagatgccaagacttttgcatcatggggtattgattatttgaagtatgataactgtaacaatgatggatcgaaaccaactgatagataccctattatgactcgagctttaatgatggctggtcgtccaatcttcttctcactatgtgaatggggagacttgcacccagctttatggggtgctaaagtgggaaatagctggagaactaccaatgacattaatgattcatgggaaagcatgatttcaagggcagacatgaatgaagtttatgcagagtatgcaagacctggtggttggaatgatcctgatatgcttgaggtgggaaatggagggatgacaaaaaatgaatatactgttcacttcagtttatgggccctttccaaggcacctcttcttcttggctgtgatgttagaaatataactaaagagaccatggagatagtagctaacaaggaagttattgcagttaaccaagatccacttggtgtacaaggtaaaaaggttaggatggaaggtgatgaagagatgaaacaatacattatcacagtcataggtgacccttttggacagatttgggcaggtcctctttcagggtacagggtagctgttgtcttgcttaatcgtggcccttggaaaatatcaattacagccaactgggatgacattggtattccaccaaaaagtgctgttgaagctagagacctttgggagcacaagacattgatgagacccttcgtggataaattgactgccacagttgatccacatgggtgtaaaatgtacgtgctgaagccactggcttga

SEQ ID NO: 72343 - DNA, 624 bp, Glycine max
  Peptide Sequence Number=SeqID_189121
atggcttcaaagcgcatcctcaaggagctcaaggacttgcagaaagacccaccaacttcttgcagcgctggtccagtagctgaggacatgttccattggcaagcaacgattatgggtcctgctgatagtccttatgctggaggtgtattcctagtcactattcactttcctccggattatcctttcaaacctcccaaggttgcctttaggactaaggtgtttcatccgaacatcaacagcaatggtagcatttgtcttgatatccttaaggagcagtggagccctgcactcaccatctctaagccggtttccactcccaagggttgcgttgtgtcgcaccttactgttttgctggttgtgcctttgtggccaaaattgtgcagtatagcagaggttcacagtgtttgcagttgcgatgctgagtttagggttgggaggaagaagatgacgctaagcgtcaccattttggggtcaggtgtggtactgctttctatctgctcattgctgactgatccaaatcctgatgatccacttgttccggaaatcgctcacatgtacaaaactgaccgggccaagtatgaggccactgcacgcagctggacccagaagtatgccatgggctga

SEQ ID NO: 72344 - DNA, 2001 bp, Glycine max
  Peptide Sequence Number=SeqID_189122
atgtcaatgttgttggcgttgcataacaagattctcctgcaccaatcaccaatgcaagctaaactagaagtagaagtgaatagtaaaatggttaaggaagggagcacgagaagtccacaaaagcagcacaacacaagggacaagggaacctcgatcccatgccattattatggagaaggagaagaaggaagaaggagggaaagtggggcagagaaagaagccatgtggatcttgttgagaatgatgagtggtaggaatgcgagggagtatctattgggatccctcaaccatcaccgtagagggcatagctttaatggggtggccaacaacaacaactaccgcgatgacaaccttgatcttttctccaacaaccgtcgctccctctctcttgctgcttcttctgatgactcttcagatgtttcggtgaaactggggaggctctcaattggaacagcaaaaccggttaaaagtggaattgatgatctgttatcatctacagaaggagggaagcatgattatgactggcttctcactcccccggggacccctgtttttccatcagaaggagaatcccaaacaaccttagctcctccaaggagaagtttgactagatcaacatctacctctaagacctcaaggcttgcagtctcacaatcagagaacaacaatcccgcctctagaccagcaagaagcagttcagtaactcgctcttccatctcaacttcacactcacagtacagctcctattcttcaaacaggcactcatcttcaatcctcaacacaagttcagcctcagtttcatcttacattagaccatcttcccccataactcgctcttcatcttcagcaaggccttccactccctcctctcgccccacagcatcacggtcctcaacaccctccaaaccgcgtccagtttccaccagctccactgctgaaaggaatagaccatcatcacaaggctcaagaccatcgactcctagttctaggcctcacattcctgcaaacttgcattctccatctgcttcatcaactcgatcactgtctcggccttctactcccacacgtaggagctcaatgccatctttatctccgtcaccttcccctacaataggttctttaacttcagcaggtcgtgtttcatcaaatggacgcaattcagcacctgcatcaaggccaagctcaccaagcccgcgagttaggcctccacctcagccaattgttccacctgatttccccctagaaacaccaccaaaccttagaacaacattgcctgataggccagtttctgcaggccggtcgcgtcctggcggtgtcactatgaagacaaatagttctgaaactcaagcctccccagttactatgccaaggagacattcatctcctattgttagtagggggagagtgacagaacctgcagcaaaaacccgtggctattccaatggccatcatgttgatgctcctgagcctagaaaagtctcacatgctcctgaggttgctgcaaggaaatctgttaggtcctcatctactgcccctgacaacactggatttgggaggactatctcaaagaaatccttggatatggctattaagcacatggatataaggaacagctcaggaaatattcgttcactaacaagcaccacactctttcctcagagtattagaacttccactaccaagtctcatcgagtttcaagtgctccagcatctgttgacatgaatggaagcatgataagcagtaaaaatggagccaattttgatgtgggaaatggtattgataggaatatgatgatgaaaggaagagatgcagatgaaagacattattctgcaaaactgagtgaagtggacatctatgagagttctcgttacgatgcactgttgtttaaagaagatttgaagaacacaaactggctgcatggtgctgatgataagtgtgatcaaggccccatatttgataatggatttgagcaccttcctgaaccttttggcctcttataa

SEQ ID NO: 72345 - DNA, 1857 bp, Glycine max
  Peptide Sequence Number=SeqID_189123
atgggaaacgggaaggaaactcattccttccatcgagatcggcattcctactttaccacaataccaattttcctactcctgcttgtgtttcctcacactaaagctaatctacattcagaaaagcaagccctccttgattttgctgctgcacttcatcatggtccaaaagtcaattggaactctagtacctcaatctgcacttcatgggtgggagttacatgcagtcatgatggttcccatgttctttctgtgaggcttccaggtgtcggattgcgcggttctctcccaccaaacacacttggtaagcttaatggcctcattagtctcagtcttaggtccaacagcttgagggggaaccttccaactgacctactttcccttccttctctgcgctttgtatatctccaacacaacaacttctcaggtgaaattcctgattctctgccaccgcggcttatctttcttgatttgtcccataactctttcacaggacaaattccagcctcaatccaaaacttgacacatttgataggacttaacctccgaaaaaactctctcacaggacctattcctgatgttaaccttcctagccttaaggatttggatttgagcttcaactacttgaatggctctattccttcaggtctccataagttccatgcctcctcatttagaggtaatttgatgttatgtggagcacctttgaaacaatgttcttcagtttcccctaataccacattgtctccactaacagtctcagagagaccaagtgatctatcaaacaggaaaatgagcgagggagcaaaaatagcaattgttttggggggtgtcacattgctgtttcttccaggtcttttggtagtgttcttctgtttcaagaaaaaagttggtgaacaaaatgtagcacctgcagagaaaggtcagaagcttaagcaggactttgggagtggtgtgcaagaatctgagcaaaacaagcttgtattctttgagggttgttcttataattttgatctggaggacatgttaagagcttcagctgaagttcttgggaagggaagttgtggaacaacatacaaagccatcttggaggatggaacaacagtggttgtgaagaggttaagagaagtggcaatggggaaaaaagagtttgaacagcaaatggagattgtccagagacttgatcatcatcaaaatgtgattccccttcgtgcttactactattccaaagatgaaaaactaatggtttatgactactcaacagccggcagtttttccaagctattgcatggaacaacggaaactggacgagctccactagattgggatacaaggttgaagatcatggtcggagctgctaggggcattgctcatatccactcagccaatggaaggaaacttgtccatggcaatataaaatcatctaatgtgattctctcaatagatctccaaggctgcatatcagattttggcctaactcccctaacaaatttctgtgcctcctccagaagtccaggctatggagcacctgaagttatcgaatcacgaaagtccactaaaaaatctgatgtgtacagctttggtgttctcctccttgagatgctgactggcaaaacaccagttcagtattcagggcatgatgaagtggttgatcttccaaagtgggtccaatctgttgttagagaggaatggactgctgaagtgtttgatcttgagctaatgaggtatccaaacattgaagatgaacttgtgcagatgctgcaactggcaatggcatgcgtggcagcgatgccggacacgaggccttccatggaggaagttgtcaagacaattgaagaaattagagcatccatttattaa

SEQ ID NO: 72346 - DNA, 744 bp, Glycine max
  Peptide Sequence Number=SeqID_189124
atgagttctgcaaagttcgatatcgagaagttcacaggcaagaacgatttcagcatatggaggataaagatgagggctttgctggttcatcaggggctggatgttgctcttgatgggaagaacctcccaacgcatgtgtcagaaagtgagaagaaggggttgcttgacaaggcgcacagtgctttgattctttccctgggtgacaaggttctaagggaaatatcaaaggagaaatctattgtggcggtgtggttcaagctggaaagcctatatatgaccaaatccttggccaataggttgctcttgaaccagatgttgtacacgttcaagatgccattgggtaaatccttggaggatcacatggatgatttcaataagatcattcttgatctggagaatattgaaatcaaggtggacgatgaggatcaagcgttgttgttgctcagatcattaccaagtgagtatgatagcctatcagacatgctcatatatggcagggactcgctgtcattggatgaggtgaaggctgccttgttttcgaaggagttgaagaagaaatcagagggaggtggctatcaggacactgaaggattgtacacgaggggcagaacggagaagaaggatcccaagaacaagaagggatcaagatcgaagtctcatgatgaaagaaaaagaaggtgctttgtgtgtgggagtgaggagcatctcaagaaagatttcccatacacaaggaaaaagaagtag

SEQ ID NO: 72347 - DNA, 420 bp, Glycine max
  Peptide Sequence Number=SeqID_189125
atggcaacggctttgacctcccgtgcttcccataggtttctcaaaccttcttcttcttcttcttcttcttccgtatcactttaccctgtcatcttcaatcctctgatcaccactcaacaattcgcaaaccaaaaccccactctaaatcccccattcaagccaccccagctccaaagtttcaattttgagttccgtaaaactactgggtctctctcaagtttccaccttgttgcacacttgtccacatggcattccaaggagaacaagaatcaaagtggtgataatgtgagtagcagtggtggaggagacacctcttgggttgaattgtacttgcctaggaaggttcagccctatgctcgacttgctcgccttgataagccaattgggacatggttgcttctatggccttgtatgtggtaa

SEQ ID NO: 72348 - DNA, 213 bp, Glycine max
  Peptide Sequence Number=SeqID_189126
atgaaagagaaaacgagagtaaagagacaacaagtaattctcagcagaagagggactcatgcattaatcaatcataaagctataacagaaattaaccaactaactgagtataatttccccctcgtctgccccggtcatccagaccatgatcgtccagctacacacaacaattctccaccttggctagacgtcatgctccttcaaccttcatga

SEQ ID NO: 72349 - DNA, 276 bp, Glycine max
  Peptide Sequence Number=SeqID_189127
atggttttgtattacctcccaattcatttgtctgcagcaggctggctgtattatgcatctctggcagttgtgtctggacacttaggctggcaaacatgggcagtcgacctttcttcacgcactgactgcaataggaagtatgttagggaggttcattgcataaactcaccatctaattatccacaagcatctttgaaaggatctcaaatcttgatttattggctaggccatactgttggagcttcaaaatttcttttaatgctcaatactcaataa

SEQ ID NO: 72350 - DNA, 336 bp, Glycine max
  Peptide Sequence Number=SeqID_189128
atgtcgcttaatgcattcctcaacaaactttgggttgagattttgagggataagtatatgcctcatggcaatattttcctggccaagcagaccaagggatctaaggtgtgggtgtctattatctcggctttgaaggagttggaggatggtttggcctttagcttctggtttgccccgtgggcctctaaggagcctctttgtggcaaagttccttttgtgcatatctgtgattctatgctaaagcttaaagatgtctggattgggatcttcacaagctttattctacccttcctcaatctgctgctgatgttgtcgttaaatccatgctggtgctaa

SEQ ID NO: 72351 - DNA, 216 bp, Glycine max
  Peptide Sequence Number=SeqID_189129
atgctaaccttcaatctcaatgctatctcttcttcgttctcagttgttccatttcatgccaattatccactgtctactcaaacccaattgttagttccttccaatcttagttactcctttgctacaacaggaaccagaaagttcaagtctttccagctcaaggctggattttgggaatcaattaaatctgggtactttcaattttcagctcactag

SEQ ID NO: 72352 - DNA, 1618 bp, Glycine max
  Peptide Sequence Number=SeqID_189130
atggtttctgaaacctcactctcttcttctaaacgctctcctgctactcctaagttctgcaactctttcactactagaatatttgctgatgttgctggcgacattacaattgttgttgatggggagtcttttctgctgcataagtttcccttggtgactctaagtgggaagatcaggaagatggttgctgaagccaagggttccaatgtttcaaacttggagctcctcaactttccaggggggcaccagacatttgaacttgccatgaagttctgctatgggatgaattttgagattacaacattcaatgttgcccggcttctttgtgcagcagagtacctagaaatgacagaagaataccgggagcaaaacctcatctctagagcagagatttatctgaatgagattgtctttcagagtcttcagaaatcagtggaagtgctatccacctgtgagatgttacctccagatatagtggatgaaattgaaatatcaaatggatgcgtggaagccattgcaatgaatgcttgcaaggagcaactagtttctggtttatctaaattagactgcgatggtgaatctagagagctaaaggaggattgtgttgcatggtgggttgaagatctctcggttttgagtatagattacttccaaagagttatttgtgccatgggaagaatgggggtaagatcagacagcattattgcatcactaatgcattatgctcaatcatctttgaagggtattggaaagtgtcaattttggaatccatcaaggacaaactcaagtccaacaagtgtggaaaaggaccagaagataattgtggaaactcttgtaagtctcatgccaacagacaaaagctcttccattcctttgacatttttgtttggcatgttaaagatggctatcatgttgggtgccatcattccctgtaggcttgagcttgaaaggaggatcgcgttacggttggaaatggtctcactagatgatctgcttataccatctctacagagtggggactccttgtttgatgttgatacagttcacaggctactggtgaatttcttgcaacgggttgaagaggaagaaaccgaagattatgggtatgaatctgatggattttgttcttctggccatggttctctgctaaaagtggggcagcttattgatgcttatttagcagaaattgctcctgatccctacttaagtctacagaaattcattgctttgattgagatacttcctgattatgctcgtgttatcgatgatggcttttatagagctgtggacatttacttgaaggcacatccagcactaacagaacaagaatgcaagaagctttgcaagttgatagactgccagaagctgtctcaagaagcaagcaaccatgcagcccaaaatgacaggcttccactgcagatggtggtgcaagtcctgtacttcgagcagctgcgtttgaagaatgcaatgtctggcagtttgggagatgggctgctgtcgcagagaataagcagtggtgttccaagtgcagccatgtcccctagggacaactacgcttctctgcggagagagaaccgggaactgaagctggagatttcaagaatgagggtgaggctga

SEQ ID NO: 72353 - DNA, 2175 bp, Glycine max
  Peptide Sequence Number=SeqID_189131
atgaccgttagtctgttcatctttcttctccttttcttctttttccatcccgccgtttctctctcctccgacggcatcgcgcttctcactctgaagtctgccgtggatgcctccggcgcctccgcgttctccgactggaacgacgccgacgccacgccgtgccagtggtccggcgtcacgtgcgcggacatctccggcctccccgaaccgcgagtcgtcggggtcgcgctctccggcaagggcctccgcggctacctcccgtcggagctcggcacgctcctctacctccgccgcctcaacctccacaccaacgccctccgcggcgccatcccggcgcagctcttcaacgccaccgcgctccacagcgtcttcctccacggtaacaatctctccggcaacctccctacctccgtctgcaccctcccccgcctcgaaaacctcgacctctccgacaacgccctctccggcgccattcccgacgcgctccgaaaatgctccaacctccagcgcttgatcctcgcccggaacaaattctccggcgagattccggcgagtccgtggccggagctggaaaacctagttcagctcgacctttcatcgaaccttctagaaggttcgatcccggacaagctcggtgagcttaaaatcctaaccggaaccctaaacctctcattcaaccacttgtctggtaaaatccctaaatctctcggaaacttgcctgttgtcgtgagcttcgatcttcgaaacaatgatttgagcggtgagattccccaaacggggtcgttttcgaaccagggccccactgcgttcctcaacaacccgaacctgtgcggatttcctttgcagaagccctgcgcaggttcggcgccgagcgaaccggggctcagccctggttctcgtggggcgcaccggcccacaaagaggctgagccccagttcgattatcttgatctcggtggcggatgccgccggggtggccttgattggacttgtggtggtttatgtttattggaagaggaagggcaagtccaatgggtgtagttgcactttgaagaggaagtttggtggggagagtgaggagttgagtttgtgttgttggtgtaatggggtgaagagtgatgactctgaggtggaggagggggagaagggagagggggagagtgggagaggggaaggggatttggtggccattgacaaaggtttcaactttgagcttgatgagttgttgagggcttctgcttatgtgttggggaagagtggattggggattgtgtataaggtggtgcttgggaatggggtgcctgttgctgtgaggagattgggggagggtggagaacagaggtataaggagtttgctgctgaggttcaagccattgggaaagtgaagcatcccaacattgtgaggttaagagcatattattgggctcctgatgagaagctcttgatcagtgatttcatctccaatggcaatttggccactgcccttagagggataatgaggtttgaatttaaaacttcatgcaaactatttaaatgtctcaccaggagaaatggtcaaccatctccaaatctttcatggtcaaccaggctaaaaatcatcaaaagaacagccaggggtttggcctatctccatgaatgcagtccaagaaaatttgttcatggtgacgtcaaaccctccaacatcctcctcagcacggacttccaaccccacatttctgattttggtcttaacagactgatcagcatcactggcaacaacccctcctctggtggccttatgggaggagctcttccttacttgaagccatcgcaaacagagcgaactaacaactacaaagcccccgaggctcgagtcctgggttgcatacccactcagaagtgggatgtgtattcatttggagttgtattacttgaattgcttactggcaaggccccggattcttctccagccgcatcaacttccatggatgtccctgacttggtgagatgggttaggaaagggtttgaacaagaaagtccattatctgaaattgttgatccgtcgatgctccatgaagtgcatgccaagaaagaggtactggctgtgtttcatgtagcactacaatgcactgagggagaccctgaagtcaggcctagaatgaaaactgtctccgaaaatcttgaaaggattggataa

SEQ ID NO: 72354 - DNA, 321 bp, Glycine max
  Peptide Sequence Number=SeqID_189132
atgacttggccactcagacccaattctgcacaggctaatactttcaaacaaaaggatttcagtttggagttggtactcatgacttggccactcagacccacttctgcacaggctaatactttcaaacaaaaggatttcagtttggagttggtactcatgacttggccactcagacccacttctgcacaggctaatactttcaaacaaaaggatttcagtttggagttggtactcataacttggccactcagacccacttctgcacaggctgagtgtctgactcttaaagtcaatccaagtcaactagggagtggcatataa

SEQ ID NO: 72355 - DNA, 888 bp, Glycine max
  Peptide Sequence Number=SeqID_189133
atggcaacaactttgaaaaatgttaagtctgaagtaccaggagaaagtgaagaaatggagagagaattggaggaggttgtgaaaaactctggcataggtggagaggttaatcacttgcggaaggagcctatggatatagccatgaatgcaagaggtaactattgtagctctcctggctcttctgatgctgctactgaacatgagattttgctcaagagtgaagaaacaagaggagaatcagttgaaactttgaactcttgtgagttgagctgcagcaaccattgccttggatttatgcataataatatgctgccagataccaatctaagaccaaatcctgaggcatctattgcaaagaaacatactgaggaagtaatttctgaaatcctaggactatgtcaaggcaagtgcttgaagattagccatggtcagtcaccaaatgagcaatttagaagaagtgaacattttgatgagatgaaaactaggcttaagggtttggaatgcaagctgagagcacattctattcattacaagaatcaagcaccaatagtaggggactccaatcatccttctatgcagggaattcatctgtttggtggtggcactgttggaccaattgaaagtatgtcccaagttgaggctttgaacaacatcaacacaaacagaaattcactacctggatttagttctggccatggtaggaagttgtgtgatctttctcaacagctgcacaaacttggtggataccttcctgagcattggaatagtgtgcagtttccagacttggaagttggtcatgattatagtttcttaaatcctgattatgattttggtttatatgaagagcagaagttacttgatatatgctttccacatgtaggatcttag

SEQ ID NO: 72356 - DNA, 405 bp, Glycine max
  Peptide Sequence Number=SeqID_189134
atggagatagtgctcattgctctgcctgctgcgttggctttggcggctgatcctattgcctcattgattgacacagcgttcgttggccacataggggcagttgaattggctgcagttggggtttcagcttctggctttaatctagtgtcaaaagcgttcaatgttcctttacttaatgttactgcatcctttgttgcggaggagcaggcactgattaggaaggaggaagagtccattccaagtgataaaaatgtatcaacttctttagcacttgctgcaactcttggaatggctgaaactgtggtgcttacgcttggctctggcattcttatgaatatcatgggtatacctgctgtatgtcatacttggctaattattgatccgtacatcatttcatataagtga

SEQ ID NO: 72357 - DNA, 354 bp, Glycine max
  Peptide Sequence Number=SeqID_189135
atgcgtggacctgctgagcagtttcttacattgagggcctttggcactccagcaattgtgctcgcattagctgcgcaaggcacctttcgtggatttttagatacgaagacacctctatatgctgttggcaagagtacatgtctaggtttgcttgatgtaaataatgaagggttgccttggaatgtcaggactttggctgtgtttataactgtgatgctgtcaacatctgtggcagctcagcagggccctataccacctatggcagaattgaagcaggcgatgtgggaccttgcaacacccctcccttcacaaatgcctgtcagaacaaacaagcctaccagaacaggcgattga

SEQ ID NO: 72358 - DNA, 2136 bp, Glycine max
  Peptide Sequence Number=SeqID_189136
atgccggttctgagaattcatggatatgccttggctgtttcgttttgtcttatcatcttcatagcagcctcacaacgaacggacccttcagaagttaatgcgctgatagagatcaagaaaagtttgattgatactgacaacaatcttaagaactggaataaaggagatccatgtgcagcaaactggactggggtttggtgttttgataagaagttggatgatgggaacttccatgttcgtgagatctacttaatgacaatgaatctctcgggaagtctatcacctcagcttggtcagctatcccatcttgagatactggatttcatgtggaacaatctgacaggcacaataccaaaggagattggaaatattagatcactgaaactcttgctcctgaatggtaataaattatctggtagtttaccagatgagcttggccaactttctaatttgaatagattccaagtggacgaaaaccaattgtcaggtcctataccagagtcatttgccaacatgaccaatgttaaacaccttcacttgaacaacaactcatttagtggtgaacttccatccacactttcaaagctatcaaatcttatgcacttgcttgtggacaacaataatttatctggccatcttccaccagaatactccatgttagatggattggcaatactccagcttgataacaacaatttcagtgggagtgaaattccttctgcctatgcaaacctaaccaggctagtgaaattaagtctacgaaactgtagtctgcaaggagctattcctgatttcagttcaatacccaagcttacctatttagatcttagctggaatcagatcactggacccataccatcaaataaagtggcagacagtatgacaacttttgatctgtccaataatcgtctcagcggatctattcctcacttcttgtatcctcatcttcaaaaattgtcacttgcaaacaatttactgtctgggtctatctctgctaacatatggctgaacatgtccttcagtgcgaaagataaacttacaattgatctccagaacaactcattttcggatgttttgggaaatctgaaccccccagaaaatgttaccttgaggctttctggtaatcctgtctgcaataattctaacatacaaagtattggtcaatattgtggacctgaagcagataaggcagcccaagactcaacaaattcaactgtctgtccagttcaatcttgtccagtggatttcttttacgaatatgccccctcttccccagttccttgcttttgtgcagcacctctgagaattggatacaggctgaaaagtccaagtttttcttactttgctccctatagaactagttttgaagactatataactaggtccttagacttagatctctatcaactatcaatagattcagttgcttgggaagagggacctcgtcttagaatgtatttgaaactcttcccttcctataatgattcccgttctaatatgttcaatgaaagtgaggtccgtcgcattaaaggcatatattcatcatggcactttcctcgcactgatttttttggaccatgtgaactgctgaacttcactcttcttggaccttatgcaaatttaaatattgattcggagaagaaaaataatagtttgggcataaaaattgctgctgggatagcagcagctgcttctgctttagcaatatctgcaataatcattttcctgatttctagaagaaatatgaaataccagaagattttcaggaaacgaatgtctactaatgtatctatcaaaatagatggcatgaaaacatttacttacaaagaactggctattgctaccaacaaatttaatatctcaactaaagttggccaaggaggatatgggaatgtctataaaggcattttatctgatgaaacttttgtggctgttaagcgagcagaaaaaggttccttacaaggacaaaaggagtttctgactgagattgagcttttgtcaaggttacaccatcgaaatcttgtctcgctgattggatactgtaatgaaggagagcagatgctggtttatgaattcatgcccaatggcaccctaagggactggatttctggtatgaaattgttggaatttttttaa

SEQ ID NO: 72359 - DNA, 324 bp, Glycine max
  Peptide Sequence Number=SeqID_189137
atgttaaattcaaaactgaactttggtttcaagagctcacttttcaacgaggaattgaaggctggtgctggttttggtttctgtggtggttttcattctggttttccggtggagattttcattgtcggtgtgattttgtggtggttttcgttttggttcccggtgttgctttgtggtggttgcagtggaggtgtcaccaccgtagggtggttaccgtggaggtgtcagcggcagcagtatcattgtggcagcagcgacgatattagttacgcttacgcatctggagtgagagaagggaacaagtacaaattaggaaagacatag

SEQ ID NO: 72360 - DNA, 1029 bp, Glycine max
  Peptide Sequence Number=SeqID_189138
atgaagcttcaaaaaggaggaagagatggtgcagcgggaagaggaacgatggaagaagccaaaataaaaatggcaaagacataccaaatagtgctagcagggagttcttggggagttagaaacacctttcattctcttgtagccatcttaaccactcttgtagttatcactaccatttatctaagacaggatggaggacatgtatctccaaaaataaatgcctctagtagtaattcgtcatcatcatcaaagtgtgacttgttctctggtaagtgggtttttgataacgaatcttatccattatacaaagagaaggagtgcacgttcatgtcagatcaattggcttgtgagaagtttggaaggaaggacctgagttaccagaactggaggtggcagcctcaccactgtaatcttcccaggttcaatgccacagcgttgcttgaaaggctaaggaacaggaggcttgtgttcgtgggggattcactcaacagaggccaatgggcttccatggtttgcctagttgactctatactgcccaaaaccctcaaatccatgcattccactgccaatggttctctaaacattttcaaggccaaagactacaatgcaactattgagcactattggtctccattgctagtagaatcaaactcagatgacccagtgaaccatagggtaccagaacgaacagtgagagtgaaggctattgaaaagcatgccaggtactggactgatgcagactttctggttttcaacacttatctctggtggagaaggcctgtaatgaatgttctgtggggatcatttggagacccagatggagtctacaaaggggttgaaatgttgagagtctatgaaatggccctgagaacctggtccgattggttggaagtacatgtcaatcggaacaagacccatttgtttttcgttagcatgtcacccactcatgaaaggtatccgcaaaacaactctatcaagcatgtttgctcattgatacatatgaaaataggtgatacatttgaagtgtaa

SEQ ID NO: 72361 - DNA, 208 bp, Glycine max
  Peptide Sequence Number=SeqID_189139
atgacattccacaaaggcatttgtagcacaagttgcaatgcaaaggatcaatctgcactgctaatcttcaaacgcggtgtggtagaccgttccaacatgctctcctcttggtccaatgaagaagattgttgtgcatggaaaggagtccaatgtgataacatgacaggcagagttacaaggcttgatctgaaccaagaaaacctggaag

SEQ ID NO: 72362 - DNA, 1797 bp, Glycine max
  Peptide Sequence Number=SeqID_189140
atggctccaaatctgaggctaagattgtgtgttcccttgttgtttttgttgttgagttttctcttgaattctaatgcggaattggatcatcgagtttcacataaggtcatagctgctcctcataaagatgtggggacaaatgtaattgatggcaccggtgtagagaatgcttttaattttgagaatggcaatagcgtggtgggtagtaggaagggtggaagcaataaggtttcggtttcaactgttgcgttgtttacgctggcaatggcagctgccactggtttaggtgccgtgccattcttctttgtggagcttgatccgcagtgggctggattatgtaatggaatggctgctggtgtcatgttggcagcgagctttgatctgatccaggaagggcaggagtttggtgctggaaattgggttgtcactgggattcttgctggtggaatctttatttggctatgtaagaagtttcttgagcagtatggggaagtaagcatgttggatttaaaaggtgctgatgctaccaaagttgttcttgttattggaataatgactctccattcttttggggagggatctggtgttggggtctcatttgctgggtcaaagggtttcactcaaggcctattggtaactttggctattgcggtacacaacattcctgagggcttagctgtgagcatggtacttgcatcaaggggtgtctctccacagaatgctatgttatggagcataattacatctttaccccagccaattgtagccgttccttcatttatttgtgctgatgcattcagcaagtttcttcctttttgtacgggatttgctgctgggtgcatgatttggatggttattgcagaagtgcttcctgatgctttcaaggaagcctcagcttcacaggttgcatcagctgcaaccctttctgtagcatttatggaagctctgagcacattctttcagaatttcagtcatgactacaactctgaggatgcttctggcttttttgtttcattactttttggtctcggccctttacttggaggaattattcttgttgtatttgctcttgccttacgtcttcagcatgctctcctcatgagcaccgcatgtggtattgcctttgttcttggtgcctggcgaccagtgcagcttattttgtcttcaaaattgggattttttcctgttttgttactccttggaatgggggctgctttcatccatgtttcatcatctggtgtattaaaggtggcagcatccaaaaaagcctcagtcaatgacttacctacactcaccggtttcccactcagtgttcacacccttcaatcattcatatcatgcggtgcagttgcatttcacgctttggctgaaggacttgcattgggagtggctgcaccaaaagcatacggacttggtcgtcatatggtccttccagtctctctacacgggcttccccgaggtgcagccgtggctagctgcatatttggagccactgatagctggctcggttctcttgctacagctgccataattggattcatgggaccaatatcagcaataggagctattcttactggtattgactacagtggtcttgatcacataatggttcttgcctgtggtggattgatccctagctttggaaatgtagtaaagagagctctaagtttggacaagaggaaaagcacctgtggcctcatcatgggtattggatttgctactttatgtctaacattcactaggttggtttgtttacatacaccttactgcaattctgcaccagaagctgtcagataa

SEQ ID NO: 72363 - DNA, 477 bp, Glycine max
  Peptide Sequence Number=SeqID_189141
atgccaggaggttatggcaatatctatgaaagcattttatctgatgaaacttttgaggccattaaacgaacagtcgaagcttccttagaaggacaagacgagattttgactaaggttaatacggctcgtcaatctggcacaatatattccatcatagacagcagaatggggttatatccatccgattgcttggacaagtttttaactctggccctcagatgttgccaagacaatccagaggagaggccatcaatgctagatgtcgtgagggaactggaagatatcattgcaatgttgcctgaacctgaaactcttttatcagatattgttagcttagacagttctggtaacatagcacccccatcatttgcatcaacatcagcatcaaatgtgacaagggaggagcaacacatgtcctcatatgtttcaggaagtgatcttgtcagtgatgtcattcccaccattgttcctcgctga

SEQ ID NO: 72364 - DNA, 2136 bp, Glycine max
  Peptide Sequence Number=SeqID_189142
atgggtcactctggtcgcgcaattctgcgtcgttgcatgatgctgcaagtgagactacagtgcaccactagtagcagttacgccatcgcatgttacgcgcgcaacggtcaactcgaccatgctcggaaggtgttcgacgaaacgcctctccctcacagaaccgtctcttcgtggaacgccatggtcgccgcgtacttcgaagcccgccaacctcgcgaggccctcctcctgttcgagaaaatgccccaaagaaacaccgtttcatggaacggcctcatttcgggccacatcaagaacggaatgctcagcgaggcgcgcagggtgttcgacacaatgcccgatcgcaatgttgtttcgtggacctccatggtccgcggctacgtgaggaacggtgatgtcgcggaagcggaacggctattctggcacatgcctcacaagaacgtggtgtcgtggaccgtcatgctcggtgggctgctgcaagagggtcgtgttgacgatgcgcgcaagctgtttgatatgatgcctgagaaggatgtggtggcggttaccaacatgattggagggtattgcgaggagggccgcttggacgaggcgcgtgcgctgtttgatgaaatgccgaagaggaatgtggttacttggaccgctatggtttctggttatgcaaggaatgggaaggtggatgttgcaaggaagctttttgaagtgatgccggagaggaatgaggtgtcttggacggctatgcttctggggtatactcatagtgggaggatgagagaggcttcctcgctttttgatgcgatgccggtgaagccagttgttgtttgcaatgagatgatcatggggtttgggcttaatggagaggtggataaagcaaggcgagtgtttaagggaatgaaggagagggacaatgggacttggagtgcgatgattaaggtgtatgagcggaaagggtatgagttggaagcattgggtttgtttcggaggatgcagagagaagggcttgcgttgaatttcccttcgctgattagtgttctttctgtgtgtgtcagcctggccagtcttgaccatggcaagcaggtgcatgcccagttggtgagatctgaatttgatcaggatttatatgttgcctcggtcttgattacaatgtatgttaagtgtggcaatcttgtaagagcaaaacaggtttttaacaggtttcctttgaaggatgttgttatgtggaactctatgatcacgggttattcccagcatggcttgggagaggaggctttgaatgttttccatgacatgtgctcttctggagttccaccagatgatgttaccttcatcggagttctttcagcatgtagctatagtggtaaggtgaaagaagggcttgaattgtttgaaacaatgaaatgtaaatatcaagtggaacctggaattgaacactatgcttgcctagttgatttgctaggccgagcagaccaggtaaatgaagcaatgaaactagtagaaaagatgcctatggaacctgatgctattgtttggggtgcattgttgggagcatgcagaacccatatgaagctggatttggctgaagttgcagttgagaaacttgcacagctagaacccaaaaatgctggaccgtatgtcttgctctcaaatatgtatgcttataaaggaagatggcgagatgttgaagtccttagggaaaaaataaaagctaggagtgttaccaaattgcctggctgtagttggattgaggtggagaaaaaggtacatatgttcactgggggagacagcaagggccatcctgagcagcctattatcatgaaaatgttggagaagttaggtggattgttaagggaagctgggtactgtcctgatggtagctttgtccttcacgatgtggatgaggaagagaagacacatagcttgggttatcatagtgaaaagctagccgtagcatacggactcctaaaagtgccagaagggatgccaattagagttatgaaaaatttgcgggtttgtggtgattgccattctgcaattaaattgattgcaaaagtcactggaagggagatcattttgagggatgctaatagatttcatcattttaaggatggtcactgttcttgcaaggactattggtga

SEQ ID NO: 72365 - DNA, 2553 bp, Glycine max
  Peptide Sequence Number=SeqID_189143
atgacattccacaaaggcatttgtagcacaagttgcaatgcaaaggatcaatctgcactgctaatcttcaaacgcggtgtggtagaccgttccaacatgctctcctcttggtccaatgaagaagattgttgtgcatggaaaggagtccaatgtgataacatgacaggcagagttacaaggcttgatctgaaccaagaaaacctggaaggtgaaatcaacctatctctgcttcaaattgaatttttaacttacttggacttgagcttgaatgcctttacaggtctaagtcttccaagcaccctcaaccaatcactagtcacaccctccgatacacatgctaacttctctagcctcaagtatctagacttgtcctttaatgaagatcttcatttggataatcttcaatggctttctcaactttcttcattgaaatacctcaatctcagtttaattagtcttgaaaatgaaacaaactggcttcaaactatggccatgcatccttctcttttggagttgagattggcaagttgtcatctaaaaaatatcagcccttctgtcaagtttgtgaattttacttcacttgtgactcttgacctgtctgggaactattttgactctgaattaccttattggatttttaatcttagcaatgacatctcccatattgaccttagcttcaatactattcagggtcaaatacccaagagtttgttaaatcttcaaaatcttaaatatttaggattggataacaatgaatttactggacctattccagattggttgggggaacatcaacatctgcagcatcttggtctgattgagaacatgttttccggttccattccttcaagtctaggaaatctcacatccttgaaccaattaactgttagctccgatttgttgagtggtaatcttccaaacaccattggccaactctttaacttgaggagactatacattggaggttccttgtctggtgttctatctgaaaagcatttttccaaactcttcaatttagaatcacttgccttgaattcaaattttgcatttgatttggatcccaactggattcctccttttcagcttcatgaaattagcttgagaaatacaactctaggtcctacaattccagaatggctatacacacagaggacactagatattctagatatttcttactccggaatttcatccataaatgcagacaggttttggagctttgtatccaatattggagcaattctcttgtcccacaatgcaattagtgctgacttaacaaatgtcactctaaattctggttacatatttatgtctcacaataatttcacaggagggatcccacgtatatcaacaaatgtctccatctttgatatatctagcaattccttgtctggaccaatttccccttcattgtgtcctaaattgggtagggaaaaaagtttgttgagttacatggatttatcatataatcttttgactggagtagttcctgattgttgggagaattggagaggtttacttttccttttcctaaacagcaataagctaggtggtgaaatccccccatcaatgggtttgttagatggactcattgaaatggatctgcagaagaacaacttgtttggtaagttttcactagacatgtcaaactttacatcattggtattcatcaatcttggagagaataatttttctggagttctaccaacaaagatgccaaagagcatgcaagtgatgatattgaggtccaaccaatttgctggcaagattccaccagaaacatgcagtctcccttctctatcacaacttgatctttcgcaaaacaaactttctggatctattcctccttgtgtctacaacattactcggatggatggtgcaagagctgcgagtcattttcagttcagcctcgatttgttttggaaaggtcgagagttgcggtatgaagacactggactgttgaaaaatcttgacttttcaacaaacaacctgtccggagaaatcccgcctgaactttttagcctcactgaagtgttgttcttgaacttgtctagaaataatttaatgggaaagataccaagcaagattggtggcatgaaaaatttggagtcccttgatctctccaacaatcatctttcaggggaaattcctgcagccatctctaatctttctttcctaagttttctcaacctgtcatacaatgatttcactggacaaataccattagggactcagcttcagagttttgaggcatggagctatgctgggaatcccaaactttgtggacttcccttaacaaagaattgctctaaggaagaaaattatgacaaggcaaagcaaggaggagcaaacgagtctcaaaatacgtcactctatcttggaatgggagttggctttgttgtcggcttatggggactttggggttctttggtcctcaatagagcatggagacacaagtattttcggttgctggatcgtattctagactggatttatgtgtttgtagctctcaagataaataagtttggtgaattaagggcaagttctagatga

SEQ ID NO: 72366 - DNA, 2067 bp, Glycine max
  Peptide Sequence Number=SeqID_189144
atggccatgcatccttctcttttggagttgagattggcaagttgtcatctaaaaaatatcagcccttctgtcaagtttgtgaattttacttcacttgtgactcttgacctgtctgggaactattttgactctgaattaccttattggatttttaatcttagcaatgacatctcccatattgaccttagcttcaatactattcagggtcaaatacccaagagtttgttaaatcttcaaaatcttaaatatttaggattggataacaatgaatttactggacctattccagattggttgggggaacatcaacatctgcagcatcttggtctgattgagaacatgttttccggttccattccttcaagtctaggaaatctcacatccttgaaccaattaactgttagctccgatttgttgagtggtaatcttccaaacaccattggccaactctttaacttgaggagactacacattggaggttccttgtctggtgttctatctgaaaagcatttttccaaactcttcaatttagaatcacttaccttgaattcagattttgcatttgatttggatcccaactggattcctccttttcagcttcatgaaattagcttgagaaatacaattctaggtcctacaattccagaatggctatacacacagaggacactagatattctagatatttcttactccggaatttcatccataaatgcagacaggttttggagctttgtatccaatattggaacaattctcttgtcccacaatgcaattagtgctgacttaacaaatgtcactctaaattctgattacatattaatgtctcacaataatttcacaggagggatcccacgtatatcaacaaatgtctccatctttgatgtatctagcaattccttgtctggaccaatttccccttcattgtgtcctaaattgggtagggaaaaaagtttgttgagttacttggatttatcatataatcttttgactggagtagttcctgattgttgggagaattggagaggtttacttttccttttcctaaacagcaataagctaagtggtgaaatccccccatcaatgggtttgttagatggactcattgaaatgaatctgcagaagaacaacttgtttggtaagttttcactagacatgtcaaactttacatcattggtattcatcaatcttggagagaataatttttctggagttgtaccaacaaagatgccaaagagcatgcaagtgatgatattgaggtccaaccaatttgctggcaagattccaccagaaacatgcagtctcccttctctatcacaacttgatctttcgcaaaacaaactttctggatctattcctccttgtgtctacaacattactcggatggatggtgaaagaagagcgagtcattttcagttcagcctcgatttgttttggaaaggtcgagagttgcagtataaagacactggactgttgaaaaatcttgacctttcaacaaacaacctgtccggagaaatcccgcctgaactttttagcctcactgaactgttgttcttgaacttgtctagaaataatttaatgggaaagatacctagcaagattggtggcatgaaaaatttggagtcccttgatctctccaacaatcatctttcaggggaaattcctgcagccatctctaatctttctttcctgagttatctcaacctgtcatacaatgatttcactggacaaataccattagggactcagcttcagagttttgatgcacggagctatgctgggaatcccaaactttgtggacttcccttaacaaagaattgctctaaggaagaaaattatgacaaggcaaagcaaggaggagcaaacgagtctcaaaataagtcactctatcttggaatgggagtaggctttgttgttggcttatggggactttggggttctttgttcctcaatagagcatggagacacaagtattttcggttgctggatcgtattctagactggatttatgtgtttgtagctctcaagataaataagtttggtgaattaagggcaagttctagatga

SEQ ID NO: 72367 - DNA, 1254 bp, Glycine max
  Peptide Sequence Number=SeqID_189145
atggaagtcgttagatttataaggaaggtggggtgggatacaaagctagtgaatgagtcatatccttgggttgagaagcagattgttcaccggccaaagttttcagattggcagagagcagttagggacgggcttctagctgctggtgtgtctcctttcaacggcttcacctatgatcacaagtatggaaccaaagttggaggaaccatttttgacagatttggccgtcgccacacagctgctgaattgcttgcttctgccaaccctcacaaacttactgttttgatccatgccactgtccaaaagattgtttttgatacaaaaggaaaaagaccaaaagctacaggggttattttcaaggatgaaaatgggaagcagcatgaggcatatctaggaaatgacaggcagagtgaggtgattgtgtccagtggggcacttgggactcctcaattgctattgctgagtggaattggcccaaaagcagagcttcagaaattgaacatccctgttgtgcttgataatcaatttgttgggaaaggcatggctgataaccccatgaacacaatttttgttccttccaagagaccagttcagcagtcactcatagaaactgttggtattaccaatttgggtgtctacattgagaccagcagtgggtttggccagtccaaagacagcattcactgccaccatggtatcttgtcagctgagattgggcagttgtccacaattccaccaaagcaaagatcacgagaagctgtaaaagcttatgtgaagagcaagagagacataccagttgaagcattcaggggagggtcatattgtcaaaagttgcgaacccttggtcaacaggacaaccctgctgttaccttcaactacttcagtcacccttatgatcttaagcgctgtgtggagggtatccgcttggcaataaaggttgtccagacagaacacgtcacaaactacactttgtgtgagagagaaaatgcagagaaaatgcttaacctcagtgtgaaggccaatatcaacctcattcccaagcatcccaatgacacaaagtcagtagagcagttttgtagagactctgtgatcactatttggcactaccatggtgggtgccatgtggggaaggttgttaactctgagcataaggttcttggtgttgatagacttcgtgtggttgatggctcaacattttctgagtcgccaggaaccaaccctcaagccactgtgatgatgatgggcagagtataa

SEQ ID NO: 72368 - DNA, 321 bp, Glycine max
  Peptide Sequence Number=SeqID_189146
atgacattgaagaacaagattggattgaggaaaaggcaaagcagctgctacattgtgtcaaaggaagaactaagtggaagtagaaaccaatacaagaatgaagaggggtttgagttggagacattgagaataactgaggattggataaatgggtcatttgcttttgatgcagggcatgctcacaaacatgcttacataaaggacatggagaggagagatcagtggagtaggtttgaggaggatcaagaagaattggcctttgaaattgagacagctatattgcatagtttgattgctgatcttcaggacctggatgcttaa

SEQ ID NO: 72369 - DNA, 348 bp, Glycine max
  Peptide Sequence Number=SeqID_189147
atggggcccctgtttgccaatgtggtgatagaaccatgcttactacatggagacctctggagtggaaacatcagttctgacataaatggagagcctatcatattggaccctgcatgttatttgaagcagaatttggtatgtcttggtgtgctggctttggaggatcattctataattcttactttgaggatattggtgattcttgtgatgcctaaacagccaggctttgagaggagagacctttatatgctgtatcactatttaaatcattataatctctttggttccggataccggtcttcagccatgcctataattgatgattatcttgcgtttttaaaagcttag

SEQ ID NO: 72370 - DNA, 615 bp, Glycine max
  Peptide Sequence Number=SeqID_189148
atgcagaaaaaaattatgcataagcagccgtgtgtgattggttgtagtgttactgttggtaaagggaaggagaagaggaaggaagtggatgacgagtgcacacgtgggagccatgtcgtcttctacatgtttctcttcactttctcgacctcttcgaccttctttcaccaaaaccaaatcatcaccaattctttattagagttcagcatgagcatgagcatgagcaaagatccggttcgtgagtggattctttctgaagggaaagctacggagataaccaaaattagccctgttggtggggttgtatcaatcttgcttgtcgcttcgataccaatgctgcatattggaccatccatgtttgaagcagaggctcttggtttaggagctatgtatgaaaccgggactatccgtgtacctaagccctataaggttggattgctacctactggtggttctttcatcattatggaattcatacaatttggtgcctccagaggctatcagtctgatttagggaggaagcttgctgaaatgcataaagctggaaaatctagtaaagggtttggtttcgatgttgataacaccattgggaggtttaatgcgccttcctcatga

SEQ ID NO: 72371 - DNA, 711 bp, Glycine max
  Peptide Sequence Number=SeqID_189149
atgcagacctcccgctggggcccactataccaaaagcaagagaaaccccatccctctctttccactttcaccccatccatgtcgcccccgtgtgacgacatagatgggggtgaaaaaagtagacaaccatgcaccacctgtgtccacgttcccgaaggcacccctctctttcaagaggattcacggcatgtcaagccctattcaccagtttgtctcttgcctacccgaggattcaacagcaattcgaaaggtttacctatatcgggaatccccgaatctacgcttattttcaactccccaaagcatttcgtcgcttactacgcccttcctcatctctgggtgcctaggctgctcccatttcgctcgccgctactacgggaatcacttttgctttcttttcctctagctactaagatgtttcagttcaccgggttgtctcttgcctgcccgtggattcagcaccagttcgaaaggttgacctatatcgggaatctccggatctacgcttctggggtatctaatctcattcgctcccctagctttcgtctctcggtgtcagtgtcggcccagcaaagtgctttcgccgttggtgttctttccaatctctacgcatttcaccgttccaccagaaattccctcactgaaaagacttgttgggcatgtgacatctcaagcaccgatcgtgtagcaaaagaaatgaggcgtggataa

SEQ ID NO: 72372 - DNA, 219 bp, Glycine max
  Peptide Sequence Number=SeqID_189150
atggtagttagtatcgtacgattcacgataagtatcgcacgattcgataggattccagctgctaccgatgcgaatcggagtatcaaggatcacgacgacatcgtaaccgtgacaaatggtctggaaagtacctttgccctgcctgatgctgtagcagcttatactgatgcgttgtatccttactcgactccggctcttttgattgattccaaagcctag

SEQ ID NO: 72373 - DNA, 195 bp, Glycine max
  Peptide Sequence Number=SeqID_189151
atggtcaagatttgttcttcttctggtcaaagtttgagtctaagagtacaccttgactttggtgctttagatgtgcaggaactgaaggatttttggaaacaagaaaaaattcaacctttctgcccttataagaaaaatggaaaatcagcatcaacaaactcaagaagtagctggatgaatgtgaaaagattctag

SEQ ID NO: 72374 - DNA, 204 bp, Glycine max
  Peptide Sequence Number=SeqID_189152
atgacttgtcagacagcagagctaaacatctttgcgcttggggcaatgacgcagctagtgagatttgctttaactgtttgtaaatctgagaaagtgctgttattcaattcgatggcagcggcagaaccaagagaggcaagaaccgaggaactgaaccgaaaacacaagggcaatcaacccagagcgacaggagggcatccatga

SEQ ID NO: 72375 - DNA, 411 bp, Glycine max
  Peptide Sequence Number=SeqID_189153
atggtagaaccaaagtatatgctggtggtggagtctttttcttcttcaatgatgaacctgaagtggtgtggtagagctgttgttgatggtgcaggtgctggtgctgctgcatttaaattccagctcataggtgaagaggatggatgttgtgatttgaagactggagaacctacattttcaagagaagtatacagaagagattccatagaactgtgcgtccatttcattttggggaatgatttggaaggtgagagtgcaatacttctgggaatgctagaagatgccttggaaggtggaagtgcaatactatcgggaactccagaaggtgattctgatggtgggaatgcaatacttgaatggctgctgattctcgaatggtgcagatacgtggctacagaatttgaaatttaa

SEQ ID NO: 72376 - DNA, 237 bp, Glycine max
  Peptide Sequence Number=SeqID_189154
atggttgaaggatacggttcttgtgctatgttcacgtcgatcatcgctctcccagtggtggtggtggtggttgtcgttcttcgtcaccctttgccaaatgtagagagcctgggtgtgattgagaatttttttgcagagtatggtgtccaaattgctttgagaaagatatttagagcaatgaaagaagctaaggaattggttgaggggagtgagaaggagcaatatggcagagtctga

SEQ ID NO: 72377 - DNA, 1203 bp, Glycine max
  Peptide Sequence Number=SeqID_189155
atggaggcaccagggaaactcttgagaaaggaaccattcgtggggataccatcttttcagggagggttctccaagtacttgggtgcttatcaattggggtgtctgctcatcttatgcgcggctgttgactttggtactggtgaagatccttggcctatattcaagttacaaaaggagttcaatgccccaggaaaatcaccacctttgtcagctgaattttacaccgggtggcttacacactggggagagaaaaatgctcagactgatgctgattttacagcagctgctcttgaaaaaattttgcaaaaaaatggttctgcagttctctatatggcccatggtgggacaaactttggattttataatggagcaaatactggtgtagatgaggctgactacaaacctgatctcacttcatacgattatgatgcaccaattagggaatctggtgacgttgacaattcaaaattcaatgctattcgaagggttatagccagatatagctcagtacctcttccatctattccctctaataatgaaaaggcaagatacggaccaattcacttacaaagagaggctttcgtatttgacatgtttgatttcaccaattccaccaatgtgtttaaatctgaaaccccaatgtcaatggagtatgtgggccaggttgaaaacatgggtcgtgtaaattacgggtctttcatctttgataggaagggcattctgtcttctgtttatctggacaaggaacaagtaaaagggtggaaaatgttccctattcctttgcacaacctgaatgaaatgtcaacctacaatcccatcacgcaagttgcatattctgcattcagtggcatatcatcattcagaaaaaagttgatttataagaatgggaatacttcaaaagaacctgctttttattcgggccacttcttaattgataaatcaagtcaggtcaaggatacatttatatcattcaacaattggggaaaaggcattgtgtttgttaatgacttcaatataggaagatattggccgttgagaggaccacagtgcaacctctacgttcctgctccactccttaaacaaggagataactttttggtaatactagagttggaatctccagaccccgaacttgtggtgcacacagtggatgagccagacttcacatgtggctctagtgggacgagtctccatcagctgtaa

SEQ ID NO: 72378 - DNA, 327 bp, Glycine max
  Peptide Sequence Number=SeqID_189156
atggcctccttaaccaatattggccttctctacaaacatgacaaagcaccacaagcccatcaatgtcatccacattttagagcagacaaggattcgcaacatttgtattctataactagtattttaagagattgcaaattcttgatgacggaacattctgtgaatcttttgctggttgtaaataggaatgctaatagggtggccgattatttggctagattagcttttaagtttgtggataaattttggcttcatgattttcctgcaccagttttgcaattagctgatattgatgtaatgcctgatggcaactctgtttctgagtaa

SEQ ID NO: 72379 - DNA, 408 bp, Glycine max
  Peptide Sequence Number=SeqID_189157
atgagaaggaaggaagaatccatgaagcataagaaattgaggcgacaggtccatgacaacatagaggtggctcacattccagaaattaatgatagtccaattccacgaagcaaaagaagggtggttgaattcaatgtggagaataggatgaaaaccttgcaagttactattgataacgagggatggagtaaatccaggattattaaaccttctgccaataataaggtaggacaacggtgcttgaatcaaaaggcggttcaagacaaagcaaatacacaattttggggattaactcgtactcataagaagaggttgcaaaggagtaaggctatgaataaaatgaagcaaagcttggctgtgattgcaaatttgaaagcgaggaggcaaggagaaaattcattgagttaa

SEQ ID NO: 72380 - DNA, 356 bp, Glycine max
  Peptide Sequence Number=SeqID_189158
aagctttgattagtgataatggtgatcttgtcatagatcaagaggagattgttcgtgttgctcaaaatcattttcgacaattgtttctagatgatggagagtggcggccatgggacatgccaaatatgtttccagttcttgaaggtactgataatgtggttatagctcaagaggtttttcacgccatgaaaagtaaaaagggcagacaatggttcatggctattaaggaagatctggagaaggtctacgataggttgaactggcaatttctcatggatacgttgcgagatgtaggttttgaggagcacttttgcaaatggattttggcttgtggttcatcacttggtcactactaa

SEQ ID NO: 72381 - DNA, 612 bp, Glycine max
  Peptide Sequence Number=SeqID_189159
atggatccccttgccgatttggaagctaaagcagtacaatcggcaaattggggtagcatcctattagctagggatttgttttgtggagtcaagcctacatccaaggctaacaaaatttatgtcgagcctcatgacccacagttcgtggctcgtcaatttggtcttactcaacatcttcatatggcctttctgacaatgacttcacctaagtctcgtcttttattgtcgactaaaaaaaaatttgaccaagccaaacaaaccctttttgcacctcctattccttctacttcggctgccccatctacaactattccccaagtggaaatcatggattatatcgtggaggtttcagccggaatttctagtgctcaagttgttgttgttgccccgaatattgctattgtgtcataccctagttttgtccggggactattgtttgatggcatgcaacctttggttcaccgcttcgaggatgttcctccagaaggcggttgcttctggaggaagcaacctggctcgcctaggcgagctgagctcgtctgggcgagctggattttcaaccgttcttcgtcgttcgttattcgttcttcgtcgttcttcggtcttcaaccg

SEQ ID NO: 72382 - DNA, 348 bp, Glycine max
  Peptide Sequence Number=SeqID_189160
atgaaaggaaggattgagggatttttctccaccgaatccttaaggtggattctgaggatttcactccgattaaaacgttcctcttggtgtggtggttcggcggtaaccaacgatggctcgtggtggccaccggtggtcgtggaagaagctcatctcgctaagtgggagtccacttttggcgctaagcgcaacaattctcattcaatgcaattccctctcgggttggaatttgcactgagtgcgacaattcgcattgagcgcaatttatcttgcgctaagcgcaacaattctcgctcagcgcaattccctctcaggttggaattgtgcttagtgcgcttctcatgctaa

SEQ ID NO: 72383 - DNA, 1716 bp, Glycine max
  Peptide Sequence Number=SeqID_189161
atggccatatctccaattttgttgttggctatcttatctctcatttatggcaatggtgttcttcccattgaagctacccatcatgtttacagaaatcttcagactctatcttctgattcctctgatcaaccttatagaactgcttaccatttccaacctcgcaaaaattggataaatggaccaatgaggtacaaaggactttaccatctgttctatcaatacaatccaaaaggtgccgtatggggcaatattgtctgggcccactcaatatcaaatgatcttgtgaattggactccactggatcatgccatctacccttctcaaccgtctgatataaacggttgttggtcaggctcagccacaatactccctcggggcaagccagccattttatacacaggaattaaccctaataagcaccaagttcaaaacttagccatacccaaaaacatgtctgacccattacttagggaatgggttaagtcacccaaaaatccactaatggcaccaactatttctaacaatatcaattcaagctcatttagggaccctaccactgcttggctaggaaaagatggatactggagggtgctgattggaagcaaaatacacactaggggtatggcaattttgtacaagagcaaaaactttgttaattgggttcaagccaaacaacccctacattcagctgaaggcactggaatgtgggagtgccctgatttctatccagtgctggataataagggcccatcaactattggtcttgacacatctgtgaatggtgataatgttaggcatgtgcttaaggttagtttggatgatacaaaacatgatcattatttgattgggacttatgacattgccaaggatatcttcactccggataacggatttgaggatagccaaactgtcttaagatatgactatggaaaatattatgcctcaaaaacgatttttgaagatggaaaaaacagaagggtcttattgggttgggttaacgaatcctcaagtgttccggatgatatcaagaaaggatgggctggaatccataccattccaagggccatctggcttcataaatctgggaaacagttggtgcaatggccggtggtggaacttgaaagcttgcgtgtgaaccctgtccactggcccaccaaagtggtcaaaggtggtgaaatgcttcaagttactggtgtcactgcggcacaggctgacgttgaaatttcatttgaagtgaatgagtttggaaaggccgaagtattggacaaatgggtggatccccaaattctgtgtagtagaaagggggcagccgtaaagggtggtttgggaccctttggcttgctagtttttgcttctcgtggcttacaagagtacacggcagtgttctttagaatattcagataccaaaataaaaatttggttctcatgtgtagcgaccaaagcagatcctctttgaataaagataacgatatgaccacctatgggacttttgtggacatggaccctcttcatgagaagctgtcgctaagaactttgattgatcgctcagtagtggagagttttggaggagagggaatggcttgcatcacagccagagtatatcccacaatagcaattaataaaaaggcacaactatatgttttcaataatggaactgccgctgtcaagatcacaagattgagtgcttggagcatgaagaaggcaaaaatcaactga

SEQ ID NO: 72384 - DNA, 300 bp, Glycine max
  Peptide Sequence Number=SeqID_189162
atggggaaaacatctgacgaagaagatgtagttgacgcgataatccttcttatgcaaatgatgaaacaaagtctattgagtgaagtgaacttatcttaccactatcaatatatgaaccgcaataagcacaaactcaacgaccgccttggaatgatgcgtcatgtaacaactcctgattttaaacttcggactgcacttccatcagcttcccattgttcctcagttctcacctcccacaaccttaaacagtcaccatggcggcggtggcaccatgccccgccacccaaacttgagatctga

SEQ ID NO: 72385 - DNA, 711 bp, Glycine max
  Peptide Sequence Number=SeqID_189163
atgaagactaatgaaacactggcggaagaggtagtggaatttattactgaacgcgatgaaggggccctcaaatatcttaaagatatcaagtggtgtagaattgacgatcctaagggcttcaagctggatttttattttgattctaatccttatttcaagaattccgtgctgacaaaaacatatcacatgattgacgatgatgaccctatattagagaaagcaatagggacggagattgagtggcatccaggaaagtgcttgacacaaaaggttcttaagaagaagccaaggaaaggatcaaaaaatgctaaacccatcacaaaaacagaaaaatgtgaaagtttcttcaactttttcaatcctcccgaggtccctgaggatgatgatgatattgatgaggatgctgttgaagaactccagaatttgatggaacgtgattatgacattggttctacaatccgggacaaaattattcctcatgctgtgtcatggttcacgggggaggctgcacagagtgattttgaggatatagatgaagttgattatgatgatgaagaaggtgatgaggatgaggatgaggatgaggatgaggaggaggaggaggaggaagaggaggaaaagaaagggaagagcaggagtaagagtggtggcagggtcaaacctggtaaggatcagccgactgagcgccctcctgaatgcaagcagcagtag

SEQ ID NO: 72386 - DNA, 252 bp, Glycine max
  Peptide Sequence Number=SeqID_189164
atgactgtcattgttattgctgttgacaccactgtcatcacaaccatcattgtcattgtcactcctgtcgttgccatcagcagtggttacgacagtaacaacaatcatgttggtaattgcaatggtggtcatggtagtgacaccgatgacgataaaggttatgacaccagaggtggtggtggtggttgcattaatagtcatggtggtgacacctacaatcatgatggtgatgagttaattgatatattgtag

SEQ ID NO: 72387 - DNA, 2052 bp, Glycine max
  Peptide Sequence Number=SeqID_189165
atggatagcatgtacctcattttggttgtaagggtagaaggagataaaagtgaagtgcaatctgtgttgatgcgttccacgttttgctgtcacttgaacctttcacccgtcatgattatgaagggcttctctgctcccatttcatcatatgtttcgcctcgagctcaagccgtcactgagccaccggcgcggattggctttttgggcctcggaatcatgggctccccaatggcccacaatctccttaaagctggtgttgatctcactgtttggaataggaccaagagcaagtgtgaccctctaatcagcctcggagcaaaatataaaccatctcctgaggaagtagcagcatcttgtgatgtcacctttgccatgctcgctgatcctcaaagtgcagtggatgtcgcttgcgggaagcatggggctgcaaatggaatgggtccagggaaaggatatgtggatgtttcaactgttgatggggacacttctaaattgattaatgggcacatgaaatccactggagccttatttttggaggctccagtttccggatcaaaaaagccagcagaagatggacaattgatatttcttacagcaggggacaaaaatctttatgaagcagttggttctctcttggacatcatggggaaatctaaattttatcttggtgatgttggaaatggagctgcaatgaaacttgttgtcaatatgatcatgggcagtatgatggcatccttttctgaaggcttacttctcagcgagaaagttgggcttgatccagatgtgctagtgcagggtgccattagtgctccaatgtactcaaccaaaggtccttccatgatacagtcgctttatccaactgcgttccctctaaagcatcagcagaaggatctaagactagccttggggttagcagagtctgtttcccaacctactccgattgcatcagctgctaatgagttatataaagttgcaaaatccaatggccttagtgatcaggatttttcagcttctttggaaacattgaagttggaagaatgccgtaacttgtttgaaattccagacaacatcaacctcctatcatcattgcgtgagttgttactaaaaggaacagatattgagagtgtctctgcaagcatcaagcatctttcaaagctggaaaagcttgacttgagtgattgcagaaggctttattctctgccagagcttccacagtccataaaagagctatatgccattaactgttcatccttggagactgtaatgttcactttgagtgctgttgaaatgctacatgcatacaagttacacacgacattccaaaattgtgtaaaattggatcaacattcactcagtgctattggagtaaatgcttatgtgaacataaagaaagtggcatatgatcaattttcaacaattggaaccaactcaatcaagtttcttggtggtccagttgattttatctaccctggaagtgaggttccagagtggttcgtgtataggactacacaggcttcagtaactgttgatctctcttcttctgttccatgttccaagatcatgggtttcatcttttgtgttattgttgatcagttcacttcaaacgacaactatattggatgtgactgttacatggaaaccggtgttggtgaaagggtcacacgtgggcacatggataattggtctagcatacatgcctgtgaatttttctccgaccatgtgtgtctgtggtatgatgaaaaatgctgtctgaaaaaccaagaatgtgaaagtgaaagcattgaagaacttatggcaagttataatccaaagatttcatttgaattctttgctaaaactggaagtatttgggaaaagcggatcgatattatggttaatgggtgcggagtgtgtccagtatatgacacagaatgtgacaatttctttaaacagatggaattggagttggaaatgacattgcaatctatggcaactaaaatgtcaagtaaggaagcaacactcgctccaaaacaggtaaacctaccatttcttgatatgtattctattggatag

SEQ ID NO: 72388 - DNA, 144 bp, Glycine max
  Peptide Sequence Number=SeqID_189166
atggatggctctaggcctatctttgattctattgaaatgcctccaaagaagcttctcactaaaagggcaaggaaggacgccataggggagggatccaacgcagccccacaagcagaaattgaatttgacggacaccgtttctga

SEQ ID NO: 72389 - DNA, 1137 bp, Glycine max
  Peptide Sequence Number=SeqID_189167
atgttggcaccgcagaggtttctctacactttctcacacgttctccccctctattcctctctctccaccttcaaatctagagccttcattttccttcccttagtccactcttactacaccctaacaccctcgatcttgctctcgccaatgcctcactggtttttattcaattgcagcagcaggatacctgccagtgccagatttgcaagttccgttgccacacaacaatcctcttctggtttgggtggtttatttggatggctcactggagaccgatccagttctttaccatctctggatttcccgcttctgggcgttacacttcccccttcattgcctaattttgttgcgcccggaaaaactattattactacactcccaaatggactcaaagtggcctctgaaacatcaccagttaacgagcagcttctgaaagtgaaggctgagattggtgaagcttccaaaaatctccaagacttacttttggaagcaattcattctgctggtttttctggtgccttggcaaatcctcttttagcttcagaatcagctctaaatagactaaatggtacaattttggaggagtttgttactgagaactatacagcacctcggatagtacttgcaacatctggtgttgaacatgaggaattgttatttgctgcagaacctctcttgtctgatctacccagtgttccacgtctagaggagccaaaatcagtgtatactggtggtgattatagatgtcaaagtgaatcagggaggacccattttgctctagcagttgaacttcctggtgactggcataagttgaaggatgttatggttttgactattcttggttttgataatgtcttacattttcttgcttttctgcacttgaaatcacctttccttcttttaaggtggcttaaaatatatcagagtatggactgtatgtctagttggtttcttaaaatgctattgggaggtggtggatcattctcagctggtggacctagtaaagggatgtattcacgactatgtaggccttcttccattgaaatggacgaggtcgacttcatcgctccaacttctcagggaagaagcgtgcatgtcagcgatgagttgttggtgaagaagctaatgcgtttttga

SEQ ID NO: 72390 - DNA, 738 bp, Glycine max
  Peptide Sequence Number=SeqID_189168
gttgaagtgaagaggacagtcccaagggaggacgtggatgttactggagtattcaaaacaaagaagatatttgttgggggaatagcccagtttttcactgatgatgagttgagggaatacttttcaccttatggcaatgttattgagtgccaaatcatgctagatcacaacactgggcgatctagaggctttggatttgtcacttttgatgatgaagattcagttgaaaaggttttttcagtgggaaaaatacatgaaattggaggcaagcaggttgagattaaaagggctgagcccaaaagatctggagttgattactgcaacacctcacgaaagtcatacggtggttttggcaatgaaatggatggacatggtggaaatagttctagaaatcgtaatcatggaaaaagaggtggacagtatacaggttctggaatgaacggagcatatggtcattttgatgggagttttgggggaagtgctgccactgtttatggtggctattgtggatatggctatgaatttggatatggtgggccaatgtattgctttggtggttatggactcaattcctatggtaatcctgggggttatggtagcggcattacttcctatggagatgttaatgcatatggaagagctggtagtttcaatggcagtggtggctatgacagcagcaaagtggctgagaagggtgatggtcctacaaccggaaggtaccatccttactggaagtga

SEQ ID NO: 72391 - DNA, 546 bp, Glycine max
  Peptide Sequence Number=SeqID_189169
atggcgtcttatggctcatgtccgtcgataaagaatattcttcttctagactcagagggaaagcgtgtggcagtcaagtatttttcagacgactggccaaccaacaactcaaagatcgcttttgagaagtttgtgtttagtaagactgttaagacaaatgctcgaacagaagctgagatcacattactcgacaacaatatcattatttacaaatttgtacaagatctccatttctttgtcactggtggcgatgatgcaaatgagatcattttagcttcagttcttcagggtttctttgatgcaatcacgcttctcttgaggaacaatgttgacaaaagagaggcgctggaaaacttggacctcattcttttatgccttgatgagattgttgatggagggatgatacttgaaacaaatggaccacttattgctgaaaaagttacctcccatagcatggatggtgctgaatcccccctgtctgagcagacactaactcaagcctgggctacagctagagaacatttgacaagaacccttctaaaataa

SEQ ID NO: 72392 - DNA, 1527 bp, Glycine max
  Peptide Sequence Number=SeqID_189170
atgggaatgtttacggtaagcaaggaaggagaggtcacagtgaacttcaagaacaacataaacttgaatgatttctacaagcctgaacaatctacaaacttgaagagaaggaaggtgggaaatctgaagctccaaaccacattctcgttcaaacatctgctttcagagaattgtggttcacaagaggaagttgaggaggacttgtttaacaaacgaagccccacagttatgtcacaaaaacaagaactaatgttttctccaacttcctctgcccagcttgatttagctgcattaatggttcagaaagtttacaagagttacaggattagaagaattctggctgattgtgtagttgtttgtgaggagctacggtggaaggattcagtgattaccgcttttaacaggcgctccatatccaattttgactctgataaatcagaaacagctatttcaaaatgggcacgagctaggatgatggttgctaaggtggggaaaggtttgtccaaagatgataaggcacaaaaattggcactaagacactggcttgaagctattgatcctcgtcatcgttatggccacaatcttcatttctactacttggtttggtttcatagccagagttatcagccttttttctactggttggatgtgggaggtggcaaagaagtaaatcttgaagaatgtcctagaagccaattgcagaggcagtgcataaagtaccttggacccgaagaaagggaagcatacgaagtgattgtggagggaggtaggcttgtttatagacaaagcaaggatcttgtacatacgaccgaggattccaagtggatttttgttctgagcacgtctagaattttatacgttggccagaagaagaaaggtcattttcagcactccagttttctagctggtggtgctaccattgcatccggaagattggttgctcaaaatggagttcttcatgctatatggccctacagtggccactaccgtccaacagagaagaattttatggaattcactagcttcttggaggaacacaaagtgaatatgacaaatgtaaagagagatccaattgatgaagatgtcccaccttctaatcctgtgaatgaggagctgccatttgagcacatggaaggcaatgtgggtgccagagccactgccaataattgtggtaaagaaaatgtgtgtcagtttggtaccaatgtggaagagaacaagccaatgtcaagcatatggagtaccggagtaggtcctagaattggttgcatgagagagtatccagcaaacttccaagttctggcacttgaactactcaatctttcacctagagtcaacgatgaaacatttgcaggcaaagcacctattccctctccgaggcctagtacaaaacatatgtcgcttgtcagcatgggacttcctagcccaatggtgcatgtttctcctcttcagggtctttggacattcaagtgcataggcattgctttagttttagcatttaaaaatttggacaattggtacataatatag

SEQ ID NO: 72393 - DNA, 387 bp, Glycine max
  Peptide Sequence Number=SeqID_189171
atgaaagcaacattctgtttttttctgctagctctactaatagtgagttgggaatctgcagtagtagtagcaaggaggcccttcccttcaaccgatggaatgtgccatccaggccccaaagcggcaccaggaccagggcccgtgtcttcaccatctaatactgtagagtcagaaaagggtttaatggaagaagcatactcatatagagtgagcaaaatagggtcaagtccaccaagttgtgagcacaagtgttatggttgcactccatgtgaagcgattcaagtgccgagcaccagcagctggcgcagtcatttggggttgcagtacacaaattatgagcccgagagttggaaatgcaagtgtggtccttccctctatagcccgtga

SEQ ID NO: 72394 - DNA, 209 bp, Glycine max
  Peptide Sequence Number=SeqID_189172
atggataattgtgatggggttgtgtctagtgaagttgtggtggctttttgtggtgttgttttgatatattcaaatggcaagttcataaaggtcttctttaggagatttggtttctgtagtgtgcttgaagctgagctttgggcatccgctaagcgcaacactcatgggctaagcgcgaggaagaatccagaagaagatgagctgtacag

SEQ ID NO: 72395 - DNA, 891 bp, Glycine max
  Peptide Sequence Number=SeqID_189173
atggaaggactaagcatgaaggagccatacttttgtgacagaccaagttcaacacgcatcttctcttcttctgatcctccagaggctcccccaagcccaagtaccccacttcagcattcgcatgaaaagaagaaacagctatgtgttgaggaagaagaggaattagaaaaggagccaaagcaacatgttagtgttacccttttggatctgaatattatctcaggtgaagatgataattcatgcactccagaaggaccagaactcaacctcatcacttgtttggatgtggggtcatcatccaataatgctaattcttcatcagaaacaacaacacctcttggtggttcttctgatcatactgagcctagagtgttctcttgcaactactgccacagaaagttctacagttcacaagcactaggtggccaccaaaatgcacacaagagggagagatcaattgcaaagagagggcacaggtttggatcacagataatggccttcggccttccccttttgcaccataacaacaacatccgttttgcaagcatggcttctctacccctttatcatagcaatagaggaactcttggaattcaggcacactccatgatccagaagccttcttcttctcatcttcatgtgaatggctttggaggctcttatgcacatcatcatggttggtcaagaccaatcattgatcaacaacccggaatagcaaagcttgctgcgccagattttcatcacagaacaaaatcagcattatcatcatcacaaagcagcgttgccactaataacgaaatcggtggatgtgtggctattggtggaactcgtttgaagagtactactaatcaagaagaaatgaagcaccttgatttgtccctaaagctctga

SEQ ID NO: 72396 - DNA, 1239 bp, Glycine max
  Peptide Sequence Number=SeqID_189174
atgggtgcttcgggaaggtggtttaagtcacttcttccttttagaaagacctcaactgatcaagagaagggtggtgacaacaagagtaagaagaagcggaagctatggagggcatcttcagaagggtccatgaagaatgttggtggtggtggtgctgctgctgcatctgattcttcccttacttatgcggtggctgtgatggttcccaaagatttcaagctcatcaagcaggaatgggctgccatccgcattcaggcggtgtttcgagccttcttggctagacgagctttgagggccttgagggcagtagtaaggctacaagctatttttagaggccggctagtcaggaagcaagcagctgttactctgaggtgcatgcaggctcttgttcgagttcaagcacgtgtgagggcaaggaatgtgaggaattctcctgaagggaaagctgtgcagaaattactggatgagcatcacaaccacgctgatccttttaatctaattgagcaaggatggtgtgacattcctggaactatggatgaagttaaagcaaagctacgaatgaggcaagaaggagccatcaagagggatagagcaatggcatactctctctccactcagtcaagactgtgtgctagtccaaacccaaaagccactaaggcattgactcctgtcaagcataacaacccaagcaacaagagcttaggatatagcttgttggaacgctggatggaggccaagccatgggagagtccaatctctaggaagagtgaagaccttgttcctgcttttcaatcaagaaggaatggtatgacaactaggatttcagttaagcctattataaccagtcaatcgacttcaccatcttcggccatgagctctgagtacatgtgtgatgataatagccctgtgtcaacatcttatacctctggatctctatccttgccatccaccaacactgttttggtggaagcaacagaggaaagagatgttcatcagccaagctacatgaatttgacagaatcaactaaggctaaacttaaagcctgcaggagttcttcacagaattcaaagagacttgtaatggaggacacagtgtctcacaatcacagcacaacaacaggccttatgaatggagatactagaagcagttttgattctgatccttcagttaacttgtggaaggattcttgtgcgacacctctaagggcaagttatcaaaaacgacaaattaggatatga

SEQ ID NO: 72397 - DNA, 198 bp, Glycine max
  Peptide Sequence Number=SeqID_189175
atgttgatcagcacaagtatagttctacatgtccccttacgcctacacccgatcgatgctccacgagcttggacggtgtttcttgaaaaagagaatcatcgacgcgagggaagagtcacgagttcgagaacgggatttcgggaacttttaggtgaaagagatgatgaatgttataaagaaaatacgcggaggttttaa

SEQ ID NO: 72398 - DNA, 189 bp, Glycine max
  Peptide Sequence Number=SeqID_189176
atgctgagagtgagaggactgaacaacagaaaatggatgagtgagtacactgaggtggtgaatttaatgtggggagctgtataccattgtggcccagttaggggtcgtggggcccaccctgttaacagatgcacttcgatatacgcagatgaagaaagtttttcaacggggttggttggtgacacttga

SEQ ID NO: 72399 - DNA, 201 bp, Glycine max
  Peptide Sequence Number=SeqID_189177
atgaggaaagggtggttatggtggcgccttccggaagaaggtgttccagaagatttccggaagaagggttcttccagaagtactgaaaggtcttccggaagaactggtcttccggaaatcttctggaacacctctttcggaaactttctggaagaagtagttcttctggaaagttttcggaagaagggtttttccggatga

SEQ ID NO: 72400 - DNA, 186 bp, Glycine max
  Peptide Sequence Number=SeqID_189178
atggcgtccaagcgaaaacaagcagccggactcgtagagaagaagacgcaggaggctcgcggaagagggaagagaagcagcagcaaagaagaagtcagtgaatgttcatcaatcccaacacttagtacttgggatgctccttgccctcaactaagctctctccttctcaaggactgcttgggttga

SEQ ID NO: 72401 - DNA, 414 bp, Glycine max
  Peptide Sequence Number=SeqID_189179
atgggatttgtaggtagaggggatatggaggttgaggttgatgtatggagattgaagagtttgcgaggtggaggagtcggaagtgatgtgggggatggggatgatatgatagttggtaatgatgggtttggaggtgatgttatggatggggctgatgctgtggttgggtggagcactataggaataggatggaaggaaggggatgagaggatagcaaagacatccaaagacacgaagtggccatgtgtagtgcatgatgccacattgatggaggtaaagaggcatgggcaagaaggagaacttaagatagtagctcctggatgtcctaaacggttgtgccataattccgtggataacgcggcaaaggtggatggtggcaaggttgtattaggtggtcttgtggcaatgggatag

SEQ ID NO: 72402 - DNA, 2946 bp, Glycine max
  Peptide Sequence Number=SeqID_189180
atggacaccggagcaacctcgcatatgacggctaacggaggtaatctcacgtcctacttcaatttgagtaataatattactgtcggtagtggtcaaaatattcctgtaattggttgtggacatgcatcattaccaaattcccttcatcctctaaaattacctaatgttttacatgcaccaaaactcataaaaaatcttatctctgttcgtaaatttaccatagataatgatgtgtcagttgaatttgatccttttggtttttctgtgaagaattttcagacaggaatactgttaatgagatgtaacagttctggtgacctctatcccattgccacaagaccacctaatacaaccttgccaccatccacctttgccgcgttatccacggaattatggcacaaccgtttaggacatccaggagctactatcttaagttctctgcaccgagacaactttctccaattgacctctggacttcaccaattctcagttcagagggtcatcgttactatgtgttgtttcttgacgattacacaaatttcttatggacttttccaattcatacaaaatctcagattttcgtgtcctcacacctcctcacaaaatggaaaagccgaaagaaaaattcgtaccataaacaacatcatccgtacccttcttgcccatgcctctttacctccatcaatgtggcatcatgcactacacatggccacttacctacataatatccttccaaataaaaagttttccctccaatcacccactaaaatactctaccaaaaagatccggcctatactcaccttcgtgtctttggatgtctttgctatcctctcatcccttcatcatctaggaataagttacaagctcggtccacaccttgtgtcttcttaggatatccctcaaatcatagaggatacaaatgctatgatttatctagccgtaaaatatttatttcccggcatgtcatttttgatgaaactaagcttccattttctaatctaaatgtccctacaacggttggctataattttctggatgacgacacacccttccttccatcctattcctatagtgctccaccctctaaccatcaaactacaccagttcaaacaaacatttatcaaccatcaccatcttcttttaattcgcctctgtcaccctcccacaatcacacctcaccaaccacagcatcagccccatccataacatcacctccaaacccatcattaccaactatcatatcatccccatcccccacatcacttccgactcctccaccttcacaacaaaaaccgcccctctcccctcaaatgacaaccagagcccaacacggtattgtcaaacctcgcaaactcttcaatctccatacatcaacctcaacctccatatcccctctacctacaaatcccattgatgcattaaatgatcaaaattggaaaatggccatgaaagacgaatatgatgctcttattgaaaataagacgtgggacttagttcctcgtccgtctaatgctaatgttattcggagtttgtggattttcaggcataaaaagaaatctgacggatcctttgaaagatacaaagctcgccttgtaggtaatggtgcaaatcaacaaacgggtgttgattgtggtgacacattcagcccggtggtcaaaccggctaccattcgaacggttctaagtgttgccttatcaaaatcatggtgtcttcatcaattagatgttaaaaatgctttcttgcatgggaaccttcatgaaacagtatacatgcatcaacctcctggatttcgtaattctcaatttcctgatcatgtctgtttattgaagaaatctctatatggtctcaaacaagcacctcgcgcctggtaccagcgctttactgattatgtagctacaatgggtttctctcacagtatttcagaccactctctttttatatatcatcatggcaatgacatagcttatattcttctgtatgtggatgacattattcttgctgcatcatctgacactcttagagaatctattatggcacaactgagttctgaattctccatgaaggatctggggcctctaagttattttctgggtatttctgtcacccgacatcccgaaggcctttttctttctcaaaagaaatatgcagaatacattatcgaacgagcaggtatgtcttcctgcaaaccatcctccacaccagtagacacaaaggcgaaacttagtggttcatccggtaacccttaccatgatccaactgaatatcgtagccttgccggagcattgcaatacttgacgttcactcgaccggacatctcatatgcagttcagcaggtgtgtttatttatgcatgatccaaaaactcaacacatgtctgccttgaaacgcattattcgatacattaatggtaccatagatttcggcctccatctgtacccttcatccatcgacaagctcatttcttacacagacgcagattgggccggttgtccagacacaagaagatctacctccggctactgcgtttatctcggtgacaacttgatctcatggtccgcaaaacgccaacataccttgtctcgttcaagtgctgaagccgaatacagaggtgtcgctaatgttgtgtctgaatcatgttggttacgcaacttactcttggaactatgttgtcctgtcacaaaagctactctagtatattgtgacaacatcagcgcagtttatctttccgacaatcctgttcaacatcaacgcaccaaacatattgaaatggatatacatttcgtgcgtgagaaggttgcttgcggtcaagtacgcgttcttcacattccctcgcgttttcagattgctgacatcttcacaaagggacttccgttgcaactctttgatgactttcgtgatagtctcaacattcgttcacctccagtttcgactacgggggtgtattag

SEQ ID NO: 72403 - DNA, 690 bp, Glycine max
  Peptide Sequence Number=SeqID_189181
atgcctgtcattgtacaagatggattgcatctgattatcagatcacatgaaggaccagacgcaagggctggtagagatgatgattttggggacatgctaagtggatacagcatagatcatgatggagaatcgggaagactgtatactctttttagtgctccagactatccacagtttggtaaaaggagatataacaataagggggcatatgcagtgttgaagtcgcctgattttgccagcccttcgtttcactcattcaaagcagcagaaagaccaatggtggatccttactttgattttgatgccaattatatggaatcgagtaaactagactcttctcaaagtgcctcaacctctaccctttctgctcctcaaagattttattcagatgggatgagacctgagtttgactttggggcattaggcatatacaatgccccaggttggagggttgagcttcctgatggttcaggaggtactcaagctgttgaggttccaagggcaccattggcggaaggattgcctctgcctccaaacatacaggagccacacaaggctgcttatgagtatttgtttgagctagttgctggcctgaaacatatgattgtaacaagggagactgagaacagggcccctgtgtctgctttgagaagtagaactaggaaacgagaaggtaagggtaactcatag

SEQ ID NO: 72404 - DNA, 1074 bp, Glycine max
  Peptide Sequence Number=SeqID_189182
atggacccccgcaaagagagaataaagaatgggtgcctgaagattttggaaggaataaattcaatgtctttggtaaatttagatgaccagcaagtccattccttagtgatgatgagagaaatagcacgtggggttgttgatgatcgagatagaaaggttactaaaagtgatgtgatcactgcattgcgccacagcattgagaaaatggtgtgtgcatccagggatatcattcaaatattaagtaggatgtcctttgaaggcttggatgaccagagcatgcatttagtcatgaggatgaaagaaattgcaaatggggttattgataagcaacctagagttgcaataactaggcctgacttacttgctgaacaagttggatttgtggatgaagggatgagagatagtcccgtggttgagtcaaccaagatcagcaatgggtatgttccgattggcggggcacagagcatgactaatgaagatgagatgttggatgtggaacatgttttaagatttgaaaatgggatagatgaagttcacgagtctttgttaccttgttttcagcagtttcttctgtggccacctgatgattgtgtcaccttagagtgggttcaggacatgatggtcatccttgagcaggcttcacagaagatgttgccatctgaattctgtcatatcgtgccggccattttggtggacaaattggcagatgctgcttgcagtattttatgtaaagaaccaaactgtgtggagattaattgtcaaggagaagattcaagagtaattgtattaggcgatatacatgggcagtttcacgatttaatgtttattttcaagcatgaaggagttccttctgagaaccagatttatgtttttaatggaaattgtgtacataagggagcgtggggaattgaagtatttttggtcttgctggcttggaaggtcttgatggctcacagagtatatctacttcgtggaaatcatgaatcaagatattgcacagcaagatatggttttaagaaggaagtgtgggccaaatctggtgatcaaggtgaagatgtctacaatgaattccta

SEQ ID NO: 72405 - DNA, 222 bp, Glycine max
  Peptide Sequence Number=SeqID_189183
atgtgtaagcgtttgattatcaaaatcaataagctcccattattgaagtccattgttgtcgttggtgtcgaactctctcatagcggcaataaaaagctcttagacaaatcagtggtgacacttggagagcttccacgtgttccaacaaaaccaatgatgaacaacaacgttgtcgattttggaattcgaactaaagcatttcattttgttgatcctcgatga

SEQ ID NO: 72406 - DNA, 177 bp, Glycine max
  Peptide Sequence Number=SeqID_189184
atgggcatttatgcaaatagtgctctaaaggctttcgttgagatggttcataatggaataagaggttcgattttaggttcaacattgagtttgaagttgaaggaaaataatgagtcacatgcaatctgctacaatgtactacttgttgtagaagtcaagtatggaacggttctataa

SEQ ID NO: 72407 - DNA, 1293 bp, Glycine max
  Peptide Sequence Number=SeqID_189185
atggaacctcgggttgcgaacaagttccgtcttggccgcaagattggtagcggatccttcggcgagatctatctcggtacgaatactcagacaaatgaagaggttgcagttaagctcgaaaatgtcaaaactaagcatcctcaattgttgtacgaatcaaagttgtataaaatactgcaaggaggaactgggatcccaaatgtgagatggtttggagttgaaggagattacaatgtccttgtgatggatttactgggacctagtcttgaggatttattcaatttctgtacccgtaaattgtccctcaaaactgttctcatgcttgctgatcagatgataaatcgagttgaatttattcattccaaatcatttttacatagggacatcaagccagacaacttcctaatgggtttggggaggcgtgcaaatcaagtttatgccattgactttggtcttgctaagaagcacagagacacctctacccatcaacatattccttacagtctcccatggcagggattgaaagcaggtactaagaagcagaagtatgagagaatcagtgagaagaaagtttctacttctattgagtctctgtgccgtagctacccctcagagttcgcttcatactttcattactgtcggtcactgcaatttgatgataaaccagattatgcttatctgaaaaggcttttccgtgaccttttcattcgtgaaggattccagtttgattatgtctttgattggaccattttgaaatatcagcaatctcaaattgccacacctcctgctcgtgctattggtcctgctgctggaccaagttctgggctgccaccagctgttgtaaatgctgatagacagacaggtggggaaaacagtaggcatactggttggtcttcatctgatcctgctcgaagaagaaactctggacctattgcaaatgatggaatgttgtcaagacaaaaagccccatttccaagtgattcaactcgatctaaagatgttatgttgtctagttctaatttccgttcaagtggatctacaaggcgaggtgttgtatcaagcagtcgtgatgcaactgttggcaatgagactgagccttctcatcctctcaccgtggatgctagtcaaggagcacttcgtaaaatctccggtgctcaaagaagttcacctattatgccatttgagcacaaccgaacatcctctggaagaaatacatcaaacatgaagaattacgagtcaactatccggggtattgagaccctaaatttcaatgacgagaggttacagtattag

SEQ ID NO: 72408 - DNA, 2820 bp, Glycine max
  Peptide Sequence Number=SeqID_189186
atggcacgggggaggatccgggcaaggctccgaaggagccatctttacacatttggtggttgcctgaggccaactaccactgaggaggtgcctcatccacttcaaggtcctggttactcacgaacagtatactgcaaccagcctcaactccttgaaaagaattctctattttactgcaagaatgatgtatcaaccaccaaatataatgtcatcacgtttttccctaaggcattgtttgaacaatttcgaagggttgctaatatatacttccttttggctgcttgcctttcggcgtctccaatttcacctttcagccctcttagcatgattgctcctttggcgtttgttgtggggcttagtatggcaaaggaggcattggaggattcgcgcaggttccttcaggatgtcaaagttaatcaccggaaagctagtctccataaaggcaatggtgattttggtctcaggtcgtggcagaagattatggttggggatgtggtaaaagtagaaaaggaccaattttttccagctgacttgcttctcttggcgtcgagttatgaagatgggatatgctatgtggagacaatgaatttagatggggagaccaacttgaaggtgaagagatctttggaggctaccttgtctctggataatgatggggcttttaaggatttctctggaacaatacgttgtgaagatcccaatcccgatctttacacttttgttgggaactttgagtatgaacatcaggtttatcctcttgatcctggtcaaattcttctccgagattcaaagcttaggaacactgatcatgtctatggagtggtcattttcactggacatgacagcaaagtcatgcagaattctaccaaatccccttcaaaaagaagcacaatagaaaaaaagatggattatatcatatacactcttttcactgtccttatattgatatcttttattagttcgataggatttgttttcaagaccaaataccaaaccccaaagtggtggtatttacgacctggcaatattgaataccagtttgaccctggaaaacttggattggctgggatgagccatctgattactgcactcattctatatggatatttgatacccatctcgctttatgtttcaattgagtttgtgaaggtattacaggcaaccttcattaaccaagacattcaaatgtatgatgatgaatctggtactccagctgaagcacggacttcaaatttgaatgaagagttgggtcaggtagacactatcctatctgataaaactggcactttaacctgcaaccagatggactttttgaagtgctccattgctggtactgcgtatggtgttcgttccagtgaagttgaacttgctgcagcaaagcagatggcttctgatcttgaggagcaggaattgaatctctctaatttccccatgcgtaaagagagtaacgtgccatgggaaaatatcacagaagatgaagaaactgaattggggactgctgttacttccaaggatgatggagctcgaaggcctgccataaagggatttgggtttgaagatgatcgccttatgaatggtaattggttgaaagaacccaatgccgatgtccttttgctgtttttccggatattagcagtttgccatacagccattcctgaactgaacgaggagactgagagttgtacatatgaagccgaatcacctgatgaaggagcttttctagtagcagccagagaatttggttttgaattttataggagaactcaatcaagtgttgccatttgtgaaagattttctgcttcaggtcaagtggttcaaagagaatataaaattttgaatctgctggactttactagcaaaagaaagcgcatgtcagtcattgtgcgtgatgaagagggaagcatcattcttttctgcaaaggagctgacagtatcatatttgatcgactgtctaagaatggaaaaatgtatttggaggctactactagacatttgaatgaatatggagaagctggtttgagaacgctagctctggcttacagaaagcttgatgaccaagagtactctgattggaataatgagtttcagaaggccaagacagctgttgggtctgagagagacacaatgcttgagcaggtttcagatgttatggaaagagagttgattcttgttggggctactgcagtggaagataaactacagaaaggggtgcctcaatgcattgataaacttgctcaagctggtctaaagatctgggtattgactggggataagatggaaactgcaatcaacattggatttgcttgtagtttacttagacagggcatgaagcaaatctgtatcacaatgaattcagattctgtaactaatgatgggaaagaggttatcaaaggcaacatcttgaatcaaatcaccaatgcctcacaaatgataaagctggaaaaggatccacatgctgcgtttgcattaattattgacggaaaaactctaacatatgctttagaagatgatgtcaagcaccaatttttgggattggctgttggttgcgcatctgtcatttgctgtcgtgtgtctccaaagcaaaaagcattggtaacaaggttagtgaaagaaggaactgggaagaccactttagccataggtgatggtgcaaatgatgttggaatgattcaagaagctgacattggtgttggaatcagtggggttgaaggtatgcagttggattctggagcagatttcttgtcaggcctttttggtgagtttattgttgtcagtgctgaccaagggcaaagcttcttgcttttattggaacttatctaa

SEQ ID NO: 72409 - DNA, 219 bp, Glycine max
  Peptide Sequence Number=SeqID_189187
atgatcaccttccaagtaaaaagaatcgttgattcacccttaagaaagaactacgtaggtctgatttcctcttcgatggaggtccaaactggtatggagggacttggactcactgttgctcaacaactttggtattgtattgccactattggtggtcagtatatatgggctctcttacaatttttctttgctttatgtagatggggtgatactgagtag

SEQ ID NO: 72410 - DNA, 312 bp, Glycine max
  Peptide Sequence Number=SeqID_189188
atggaaataacgccaacaatagaaccaaagactaacataacaaagagggaaacaatgcaaaagcaacgtaagataagcatcaaaatgaactttaccccaaccccattggaccaacatattccatgccacgagggaatgactataggaaaggtgcaatcatctttgtgcattggtctttcggctgcggtggctttggttctggagcctgatgtagctccatgtggagcttgtaggccttggatcttcttcatcaatggagtcctttgcttcttaaagatcaatgatagcggaatggagaaggaggaaaggtga

SEQ ID NO: 72411 - DNA, 231 bp, Glycine max
  Peptide Sequence Number=SeqID_189189
atgaagttgttcgtgttgattaaggaattgttcgtgttgggttttcagcagcagactcttccaatttctatattaagagttaaccaatatgaagttgagcttgatgctttccttgagtttcttatttggaggttctcaatttgggtggataagccaaccccaggcattgctctcttgaacctgaggtacagagatgagcatgtagtagaaccaagagataaagacaggaag

SEQ ID NO: 72412 - DNA, 159 bp, Glycine max
  Peptide Sequence Number=SeqID_189190
atgtcgagcgacaacaatgaagacgagctactccagagtggcaatgagatgtcaactatggtggcaaatcctcctccaattaccgaaagccagtggcaaactacatctagctgccaaagaaactcgcatctccatagtgtagggagggcaccctactaa

SEQ ID NO: 72413 - DNA, 1254 bp, Glycine max
  Peptide Sequence Number=SeqID_189191
atgatgtccaatgctcctggcacaattccttatcagacaaaaataaatcccaagaaggaagatgtaagtgtggtgactaccaagagcaaaaaggctaaggaggaactatggaagaaggatgagatagtttcgagtggagaagaggttcttacaaagcagaacccagctgttgagaaggagaaggaaaatgaggtactaacacctcctaagggcatagtagaggacgtgcttgctaaggtggaaaagttcatatttttgatagactttgttgtgcttgatacggaagaggatggtgacgtccttatcatactgaggcatccatttttgaatacatgtaatatgattatagaagttagacaaggaaaactcaccctcgggttgggtgaggaaaacgttatgtttaatttgaatggttttgtgaataagcctgacttggactgggagtggagtaacgatgaagaggaaatactaatgttcctccaatctcaacaagatgccagattggccagaaatcaacaatttgaagagttggataggggcaatggttcaaagccaaatccctcaattgaggaaccttttaccttggagttgaatcctccttcgtccaacttaaaatatgtttttcttaaccctcacgcttctttgctagttgtgattgctacaggagacaaacttggtcttgaattgggaaaaatgttagttcatggagaaaaagtgcatgttcttggacacaaggtgtcctctaaaggtattgaggttgatcctgccaaggtggaggtgattgcgaaattgccaccaccaaactatgtcaaggcagaatttgatctagaaataaaagataaaaaagggttagaaaatttggtagtggaccacttatctcgccttgacccctttgtgaggcaatttgctgatgatggagtgatacaaaagacctttcttgatgagcgtctcttcattgttgctactttgattggaacaccttggtatgctgacattgtcaattacctagcttgcaaggtctatggggacaacttggtaaggcgatgtgtgctttacgaggaggtgagttttatcttgaagcattgtcattgtattgaggctggcagtcacttgggttttgccaggactttccataaagtgttgcaaagtggttattactggccaacccttcatagggatgctcatgcttttgtaaggtcatgtgataactgccaatgcactggtgccttgtcagggcgccttgaaatgccttag

SEQ ID NO: 72414 - DNA, 381 bp, Glycine max
  Peptide Sequence Number=SeqID_189192
atggaaaaaattgttagtgcctttaggaaagattggtttgtgaaactagatggttcactttgggcttataggacaaccttcaagacacccattgggatgcggccttataggttggcttttggaaagaatttccactctcttgttgaacttgaacacagagccatgttgcaatatttgaatgaggtggatgaattacgattcaatgcttatgagaatgctaagttgtacaaggaaagaaccaagaaatggcatgaccaacacatccagaagcgtgaattccatgagggacaaaagggcgacttatccctcatgatctgttgggctcgggacgttaaacaagcgctacccaggaggcaacctatggacattctaagttcctag

SEQ ID NO: 72415 - DNA, 465 bp, Glycine max
  Peptide Sequence Number=SeqID_189193
gtcaatgcaattgaatctccgctggttgaagtcacctcccaacctcaacctctctttgaagatacattgacaactataagcacttccagtactccttgtgagataacccccttgaccgtcattggtccaactagtgtgtttgaggaacgccttcaagagctattgcatctacaacaagccaacctggaagaaactatggagagaaggttccttgttgaatgcctggaaaccaatttgatgataaagaatactctggagtcatcccttaagtctttcaatgactttgtgcttttcaatatgaacttattaatgcaacaaaggatgcctccctccgtccaaccacctccactgccacaacccactattcctccatctacaaccactacatatcttgtgcctacgccttcaccttcaccaccaaagtcaccacctactatccctcaacctccgttcactaagggttga

SEQ ID NO: 72416 - DNA, 276 bp, Glycine max
  Peptide Sequence Number=SeqID_189194
atgtctttgtctttcatttaccttcatcgtgatcgcatcttgcagtgccacgcgataaagatgtttggaatcatcggaggaaacaagggtcacaagataaaggggaacttggtgattatgcgaaagaatgtgttggatatcaacagcatcaccagtgttaagggtgtcattggaaccggcattaacatcattggaggtgtcgtcgacaccgttactgctttggcgtcccacatctccatccagctcatcagtgccaccaaggctgatgagacttga

SEQ ID NO: 72417 - DNA, 1278 bp, Glycine max
  Peptide Sequence Number=SeqID_189195
atggcttcccgtaagagaaaagccacaactacattgtcccaggccagttatgactcatccagatttgtttcaagggatgcttgggaccgttatgcagataacatcctcggccggaacattctttcggagaggaatgtgaagctatacattaatgagtttgatgacttcagaagagaagtcgagaggaggaattggcacagggagctcactattttttctgaaggaagcattgatgtggtaattgttaaagaattctatgcaaacctatatgtccctgaggacaaagaaccaaaccaagttagggttcgagggtacctaattaagttcaatgcgaactccctcaacaccttcttgaagactccagtggtcttagagcaaggggatagcttaccttcttactctaggttttgcaggttgaggccagatcctcaagagctggtagcctggctgtgtatccttggaagggaatttgttcttaacaccgagggcttgccgtggaagctcttgaggaaggatctttcaactttggtgcagacctggagtgttttatcttattctaacctagccccgacttcacatacctctgatcttaatcttgacagggctaggttagtttgtgggctagtaatgaagatggacatgatcataggagcacttatattcagacagatctcgctcattgctcagtccaactcctcgaggcttggatttctagccctcatcactgccttgtgcaaggcccgaggattcaccttagattctctcacttatgagtcactcagtccagccattaatttggcttatattaagaagaattcctggaacctggatgacccttcaatcacttttccaaggacccaaaaatccagggctagaagatctgaggccccatttccttcagttgcccctgctccctctacttttgttctcccttcagctccagtagccccaattcttccaggttcctccgctcagagatcagagcctttcatgtctatgtggcagagcctacaccagggccagctcttgattatgcagagcttgcaggatgtggtccaacagcgaccagttatgagtgtggaggagtttctgcagaaggttgcctggtcaggagtccagccttctcctttgggaggggccactcctactccacctgagccatttatttttgaggatgatccagtgaccgtagagggtactcaacaggcatctccagtaggcactcctgcactggacttgaacgaggaggccatggatcagggcccaccaccaccatag

SEQ ID NO: 72418 - DNA, 477 bp, Glycine max
  Peptide Sequence Number=SeqID_189196
atgagtcatcattcatctagtgttaatggcgagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaaataagagaggaagaaagaagaaaaataatgaaagaaatgaaaagagaaaaacatgcctcctatagtagtcataactcttgcaaaagcctaagtgaagaacttcgtgactattacgaaggaaggcataggtcacatcttagacctcactcccatagaagagaaaaggaaagaaagcctcaagaggctaacattaaaatctcatacttccatgggagttttcttaagagaaatggaagttttctcaaagaagtttctcaaggaagttttcttaagaaagcttctcaaggaagctacctagtctataaatag

SEQ ID NO: 72419 - DNA, 549 bp, Glycine max
  Peptide Sequence Number=SeqID_189197
atgagtgaaaacctcgaagcctttcagcataatcagccgattccgcacatctttacccagcagttttacgatttatggattgcgcccggcggcaccggcgcgctgcttgggctggtgatctttatgctgatccgcgcacgcagccgccagatgaaacagctggggaaaatcgctgcgccggcggcgctgttcaacatcagcgagccgctggtgttcggcattccgctggtgatgaacccgtacctgttcctgccgtttatcctgacgccagtgctgctggtgattgtttcgtgggcggcaatgagcagcggtctggtggcgccgccagccggcatcgccctgccctttaccacgccgatcttcgtcagcggctatctcgccaccggcggccatatctccggcacggtgttgcaggtggtcaacctgacgatttcgctggtggtctactatccatttttccgcgtgtgggatcgcctgaagctgcgcgaagagcagcagaatgaacagcaggcgaaggccgccagcagtagtgccgtcgtgccttcctga

SEQ ID NO: 72420 - DNA, 612 bp, Glycine max
  Peptide Sequence Number=SeqID_189198
atgaaactgtacaatttagcgctctccggccacgctcaccgcgcactgctggcgctgtcactgctcggcatagcgcatgaaacggtcgaagtcgacctgcctggcggcgaacataaaaccccggcgtttctcgccatcaacccgttcggtcaggtgccggtgctggaagacgaaggcgtttacatcgcggattccaacgccattctggtgtacctggcgaagaaatttaaccgcagtgactggctgccggaagatgcgctgggtgccgcccaggtgcagcgctggctgtcggtagcggccggtgaactggcttacggccccgcggcggcgcgcctgattaccgtatttggcgccaaatttaatgctgaagaggtgctggcgcgcgcgcatctgattctttcacggctggaaagccatctcagccagcgtgagtggctggtgggcgaccatcccaccattgctgacatcgctttatatagctacctggccggtgccccggaaggcaatgtcgagatgtccggttaccctgcggtgaaccagctgctgcgtcggattgaagcgctgcccggctttgtgccttttccgcagaccgccgccggcctgcgcgcctga

SEQ ID NO: 72421 - DNA, 315 bp, Glycine max
  Peptide Sequence Number=SeqID_189199
atggctgcggagttagggcaacagacggtggagctatccaccctcgtcacacgcggcgctaacgataagtcctctgattcgttagcggcgctgggaactgcactaggaccagaaggaagactcatattcatggaaattggtgcagcatgtgcaatggcaggtgatgggttcaatggagctgcagatgtagacaatttcttatatgggattcccccataccaaacaaaaacaatcagtggtcagctctatgacagctctcaacaacccaacacacagagcgatagcaatagcaagcccaagaggtgctccaagtga

SEQ ID NO: 72422 - DNA, 1518 bp, Glycine max
  Peptide Sequence Number=SeqID_189200
atgaagtcgtatcgaccttccgccaacgccaggaccgaggttcgtcggaacaactacaaggtcgtcgtggacgccgatgaaggtcgtcgacgcggagaggataccatggtggagattcgaaagaaccgtagggaagagagtttgcagaagaagagatgcgagggtctccaattccagcagattccttcgtcacttctctctactgtaattgagaagaaggttggactcatgaacactcatgatgaggacactcgccagtttttcaagaactcttcagaagctggaacaatctatacccatcatcagaagacagtcattgtggatgctgatgcaggtcagaataaaagaaaaattaaagctttcatcggaggtcttgatttatgtgtgggccgatatgataccccaaaccattccatctttaggactttgcagacaacacacaaagatgactatcataatcctaactttgaggggccagttactggttgtccaagacaaccatggcatgatttgcattcccaagttgatggtccagcaacatatgacattctcaccaattttgaggagcgttggttaagggcattaaaaatgcatagatatcaaaagatgagaagttcacatgatgattcattactgaaaattgatagaatccctgacattgttggcattgatgaagttccttgccagaatgaaaataaccgggagacttggcatgtccaggtcttccgttcaattgattataattctgtgaaaggatttccaaaggaaccacaagatgctataagaagggaaaatgctaattccgtttacttcattgaacagaacttggtttgtggaaagaatgtactgatagacatgagcatacattcagcaatgacattgcttttgggccctccatgttccggaaaaaccaccctcttgttggtcttgggtgcaaaacttgatccaaaattaaagttttctggaaaggtgacttataatggtcgtgggatggatgagtttgtaccccaaaaaactgctgcttatgccaatcaaaatgatcttcatgttgcagagttgacagtcagagaaaccttggccttctcagcaagagtccaaggagttggaactcgttatgatttgcttgcagaattgtccagaagagaaaaagagacaaatatcaagcctaatcaagatattgatgtctacatgaaggtctgtgctgatactattgtacgaaatgcaatgttaagggggatatctggtggacaaaggaaacgtgttacaacaggggagatgctggttggaccaactaatgctttattcatggatgaaatatctattgggcttcttgtgtcattaccccaagttgggagtcttgtgttttacttccctcagggacatagtgagcaggtggcagcttctactagaagaacaacaacatcacagattccaaactaccccaatcttccatatcagttgctgtgtcaagttcaaaatgtcacacttcatgtgagtgttgggtgctggttgacttga

SEQ ID NO: 72423 - DNA, 249 bp, Glycine max
  Peptide Sequence Number=SeqID_189201
atggcatgcccccatgggacccatcctcgttcacagaactcatcagcattttctctgacgacaccattttctcattcacgtaggtcaagtgaaagggaagacattgtggaggccgctttaagagcctgggacatagcccaagatgtttccgacaaccatgaagaaggagaagaaggcattggcattttcacgttttgcggtggccggtggcgcagaggtacaatttttttctacacctacagttcttaa

SEQ ID NO: 72424 - DNA, 108 bp, Glycine max
  Peptide Sequence Number=SeqID_189202
atgacaagaaacttccttctgctgttgtggttggcactgttttttgtgatacatgttctcaacaggaattcaccattggaagccatttcatttcaggtgactcagtag

SEQ ID NO: 72425 - DNA, 442 bp, Glycine max
  Peptide Sequence Number=SeqID_189203
atgacgttgatgcgtgctgaacgacttagaaaccacctgtttctacgacgttgccgggacactgaaatgatgttgatgaacgacttagaaaccacctgtttctacgacgttgccggcgtaaacaacgacgtcaactttaaagacgtgcttccaccgtctttgaagtgcttcttccaccgtcgtggagggaatagaggtgggaatagtggagggaaaggagggaaaattggttttgttggtggaggtggtggtggtgatggagtcaaacctggtattactaatggtggaaaaggaggaaacaaagagggtggtgggcttggagggggctggaatgggttagggaagagagttggtgggcttggagggggctggaatgggttagggatgagtggtggtgggcttggtggctggaatgggtttggaatgagtggtgggcttggtg

SEQ ID NO: 72426 - DNA, 258 bp, Glycine max
  Peptide Sequence Number=SeqID_189204
atgagtttcttcaacagatgggaatacttaaagaagaaagatagtcagaaagaactgatagctcaagaagttcaacacatttcaatctgtcggcaacactgtaagagtaagaaagtagctagaatagaagactactatgacaatagtagtgacaatgaaaaagagagaacacccactgaaacagagacaatggcagtgaaaatgagtaaactatacttcaaatcaacaatagaccaagcttacctcgaacccaaatag

SEQ ID NO: 72427 - DNA, 624 bp, Glycine max
  Peptide Sequence Number=SeqID_189205
atggatgaggactccaagcacaatattattgtcaaaggctatgtcattgcaaatagtagcagtttaatacggaaagctaatattcaaaagcaatcatctcttgctcctaagaaggccaaaataaccaaagcaacattttctgccaaggtacaagccattccttcttatgtacctaagagattaaaaactagcgcaactaaggaaaatccaaaatacccaaaaagcaatggactccaccatctcctccttcatcttcaagttgtgacggaacatcatcaaatgcaccaatcactcctcagtgccttcgaccatcctccccacctcatcatcatccacttccatcaaccatcaatttggagaagttcaaaaactaatcataagatgaaggcacccatggcaggtgaaccaagatttcctttggctttcacttcagcaaatccacagaacatatgcaggaagtgtgaagtcattgaagaggtgttcaaagagcctgtccttagagaatccacttctacatctacacctgaatgggtgaggtatgactatcagcatacatcatcagaagcctataaggctctacctatagatgttatagtctctcttgagaatccttcatggacatga

SEQ ID NO: 72428 - DNA, 363 bp, Glycine max
  Peptide Sequence Number=SeqID_189206
atggtgtgtggtaggtcaaatggaatattctctattaggtggaatagcatgaacttgtggatgtcagaaatagagatatttgagccaattttgtgcaagatgatattgtttatgatattgacccaaatcctagacctttcgcacataagatgtcttggtggtaacggttgccttcatgaatgcaccatgtggctttggcaatggtatccattgacagagtccttattttccaagaaccttggacacaatggtattgctatccacgaatgcaaagtgtttgatgagagtccttgttttccaagaaccttggacacaatggttttggagatgaaagttctttatgagggaatgcaaagtgtttga

SEQ ID NO: 72429 - DNA, 415 bp, Glycine max
  Peptide Sequence Number=SeqID_189207
atgagtcttcattcttcatctagtgttaatggtgagggttctactcctaaggaccccttgtataagatattagatgagttgagatcccttaagttgtggaaagaaaaacaagagagaaaagaaaaaggaaggcataggtcacatcttagacctcactcccataggatagaaaatgaaagaaagcctcaagaggttaacattaaactcccatacttccatgggaaggacaatgtagaggctaatttagattgggaaataagggtagagaaacaacttaaaaggaagtctacttcaaaatcttatggctctcactcttatccaaagaaagaccaaggtcaaggaatcttaggggtgagaccttctaagcccaaagatgataaggggaagacaatagaaaagcaaccccttaaggcta

SEQ ID NO: 72430 - DNA, 285 bp, Glycine max
  Peptide Sequence Number=SeqID_189208
atgatatacacgacaggtggatgcactactcagatcatatggttcaagcaggtgaggtgtgcgccgtgccaggccccacagacagatatccttcacgtgtcgaagccaggagcaccgtcgacatttgcgaggcccactgtggaagagcctaaacatgcagtggaagtttgccatgggattgctgagaggttggagtgccatctgagcctaggggtggtcacaccaggctcatcgacacatgaggtgattgaagaatgcctcaggatggccaggagtgtcacatag

SEQ ID NO: 72431 - DNA, 321 bp, Glycine max
  Peptide Sequence Number=SeqID_189209
atgggggagacacatgaaattccccaccacaatctagctgacttcgagccttggctcggatatgccactgaagggcaagcagttggtggtataccctttgaaaacactttggagagccctcagtttcgcccacaaccacaaccattgcattttgcggtgggaagagcccctcctgctatggctgaaaagggaaaggtggatcatctaaaggaaaggctcagggccattgaaggaggtgaagattatgcctttgctaacctagaaaagttgttcctaatacccaaacatggtcattcccaagttcaaggtgctggactttga

SEQ ID NO: 72432 - DNA, 246 bp, Glycine max
  Peptide Sequence Number=SeqID_189210
atgtcgcggaacttcacggattgcttaacgatgggtgtctcgaagcggtcaagcgaagttgcccctctttacataccttttatcggagataggaggaaagcaatcaattcgtgggacttcggactcgatgatggaggatgcacgaacaacgctaggaaatcaattcgtggggctccagactcagatttgatggtggaggatgcacgaacagcgctaggcaatcaattcgtagggctccggacttga

SEQ ID NO: 72433 - DNA, 135 bp, Glycine max
  Peptide Sequence Number=SeqID_189211
atgtgggacaatgtgggtgtcgagggagcggtttccggcagatttcaagcgggaggaaaaagagaagagcgatttcaggaaggaggggggcaagttaacatcggttttggcaaaactgatgttaacatcaaatag

SEQ ID NO: 72434 - DNA, 300 bp, Glycine max
  Peptide Sequence Number=SeqID_189212
atgctagaagagaagcccccgggggctattacacagactaggagacaacaggaaattcctttgtggctacttacttcgggcaaatctactacggctgcggctttctcttctattgcttatttcgctactccatccttgagtcttgggtctcgtgtgagtcttctctccccagttgttgcttctttctgggcatcgctttctgttttacaagcaaaatggagaacatggaaaacggatcctaacaaacaacaagagttcagtaggatcgagaataacgacggcacctggaacatcgcctga

SEQ ID NO: 72435 - DNA, 255 bp, Glycine max
  Peptide Sequence Number=SeqID_189213
atgaccaccactctgatctcccctactgaagtgtcagctgatttatgccatcatgacatagggatcgtgcccgtaagacacccaatggacccgaagaagtccaatagggtcctggggtttccagctctgattacgagcctctgtcagttctacggagtgcccatcgcccccagcaagttcatcaggccccctactaaccgagctttcatcaagaagtactgcgcccccaggcaggcacagggcgagacaccatag

SEQ ID NO: 72436 - DNA, 459 bp, Glycine max
  Peptide Sequence Number=SeqID_189214
atggtagccataaccctagccaaggttcatcaacctccatttctccgagaatacgactcgaacgcaacgtgtgcttgtcacggagaagccccggggcgttccattgagcattgtagggctctgaagcgtaaggtgcaaggtctaattgatacgggctggctgaaatttgaggagaatcgcttgttgaatcctaacattaacaagcaacaccatacatggggcaattctggaagctgttgttatgactcatcaggattttcaaagagaagtgagttatcaagaataggatgttggacaaatggcctcagttattttaagaaagggggggttgaattaagatgcaaagactattccccaattgaactatcactctctcttttcggattaacaatgcacacagggataacccttcccttgtgttcaggaatcctctacaacaagagacccgcggtctcttaa

SEQ ID NO: 72437 - DNA, 222 bp, Glycine max
  Peptide Sequence Number=SeqID_189215
atggagaaactcttaattgattttcaagtgtttgcccaagagtttcttttgagaaagcatattgcaatgaagttctcttggaatatctttgatgaccattcaaaaatctcttggacagatgtgactctcaggagttattttctgaagagttgtgactcttgggaggaaaagagactagagaagaaggttctagaagttggaaccttgttggatccaggataa

SEQ ID NO: 72438 - DNA, 213 bp, Glycine max
  Peptide Sequence Number=SeqID_189216
atggagggcacattgaacatggccagccaaggggtaatccatgtgtcaaatgagccttgtcaccttgaagctttcaccttatcttctagctcttggaaaaaaacatttcaatttggaacccttcattcacttaaccttaagggaaaggagttcattttcttcttcttccaagcttctcctagtgttcttgagtcattgattcatcaagcttag

SEQ ID NO: 72439 - DNA, 246 bp, Glycine max
  Peptide Sequence Number=SeqID_189217
gaatccattgatgaagaagatcctaggcctacaagctccaatggagcttgcatcaacaagccctcaaaacagagcttaagaaatcccaaagccaaagaaaagttcaagtcaacagctgttaggatccgaaaagagaatgccgaattgagagacgtcaacctagacaccaccaaggccttggagcaggagaccaagagggcccgcaaggaagaacatggctggaacatgttccgaggggctttgtga

SEQ ID NO: 72440 - DNA, 381 bp, Glycine max
  Peptide Sequence Number=SeqID_189218
atgttgagaagctcccgtggcattgggttgaggcatgccactaaacgttggtccctcagcagcatatgtagggtatggttcgaactcccccagagcatgatcgcagggctcttcacgagcttcccccacaggctgagcaattggtgcatgccccaactagggttgttggccttcaaggggaatgggaacagagtggctcgttgggcatgtgcactgcattgggtagtgtatagttgggaggtaagtcgtacagtgggaaagagttcttattttgcaccatatagggactgcccgtgctgtctaacacctctccgcctcagcggcggtgctggtggtggacactgcggccgcattatcctccatcatccgtctcatacttaa

SEQ ID NO: 72441 - DNA, 559 bp, Glycine max
  Peptide Sequence Number=SeqID_189219
gacagagagcttaggggaagcagtaatgggatcatcggcggctatcatatgtggctgagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacaagctaaagggaatatgtgggccatcatcgataagtgcaaagagaagctaaatctagcggcgactcacgagcaaaggctagaggatgagtacgccaagatatcagcaaaaagggaagcaagggaaagggtaattgattcattgcaccaagaggcaacaatgtggacggaccgatttgctcttactttgaacaggagtcaagaacttcccccattgctagccaaggccaaagcagtggcggacacctactccgcccccgaggagatccacggacttctcagctatt

SEQ ID NO: 72442 - DNA, 300 bp, Glycine max
  Peptide Sequence Number=SeqID_189220
atgttgcactccatgctccagagtatccatagggggcaatccattattatgcagagccttcaaggcttgggcttgcccttcattatgagcatagaggagtttgatgctcaagtggcctggccaggagaccaaccttcttcttttggagggggtggggcctctgcagcccaggagcgtgatattgaggagccaccagcagcagtagcagcagagagggaggataagttcacccctcctgagcctttttattttgaagcagatgtgcacatggctcaggaggagggtacctccacagattag

SEQ ID NO: 72443 - DNA, 528 bp, Glycine max
  Peptide Sequence Number=SeqID_189221
atgtactacattcccaaggaaagcaatatcagagtagacctgctctctaagctgaccaacaccaagaaagtcgggaacttcaagactatcatccaggaaacgctccaaactcccaccataggtgatgttaaggaaattatgctcctacaagaacttcctaatccagggggtactccaccaaacaaggacgaagcccgacacctcaaacgaaaggtcagctattatgtcatccttgatggcgagctattcaaaagagggttgacaacacccctactcaaatgcttaaatagccaacggttagactatgtcatgagagaatttcatgaggcgaactgtggtctccatatcagaggatgctccctagccaccaaagcgatacgagctcgctactactggccaacactcaaggtagacgcccttgactttaccaggaggtgcagacgatgccaagagtttgtagacgtgtcacacactcctcctaacaatcttcacagtatgagctacccttggcccttcaccatgtactag

SEQ ID NO: 72444 - DNA, 216 bp, Glycine max
  Peptide Sequence Number=SeqID_189222
atggaggggcaaaggggtctttttagggttttttctggaccccaacttgcccaggctagcctctggttcgcctgggtccccaaatggcttagggttgaagtaaccagctcgcctgggcgagccaagttacttcagagtgaagcatcagcttgcctgggcgagctgcaagtccaccaagtgcccttttttgctataaataggcgtgagggaggttga

SEQ ID NO: 72445 - DNA, 420 bp, Glycine max
  Peptide Sequence Number=SeqID_189223
atggttgaaggcactcaagtcatgatagtggatgaaagctctcaaattcaagccatgaccatctaccaaaccaacctgggaagtgaatttgacatagatccgcaagacaaaacctctgacagaggcccgaaactaattgaagaacttgtccaactgcaacccagaccgaaactcaggcaatgtacatggctcaatagggacctcactaatcatgagcactggcgcatccccgatgccaaaccactatctcataagaaaagaaagatgggagaagaacggtgtaaagccatcaaagaagatgttgacaagctcttcaaggctaacttcattagagaagccaacggtcatgccccaaagagatcatcatggtcaaaaaggtcaacgacaaatggagaatgtgccccgactacactaatctga

SEQ ID NO: 72446 - DNA, 333 bp, Glycine max
  Peptide Sequence Number=SeqID_189224
atggcaagctcttggatgggaggatatgatgctaccttcaggctctctgcataccattttcgtgctagctattggtcatccttgacggtgacaatcttccctgtcagtgtagggaatttcattttcaaatggggcgtggagactatggctccaagctcattaagtgtctttctgttgattaaggaaaatggaattgccctggtcgataagaaccctggacaccatgaagttttcaatgatgttggagacgactacgaggttgtcttagttgacggggttgatgcctttgaagtccctatccatgaaagtgataggagggagacttcgcggtag

SEQ ID NO: 72447 - DNA, 201 bp, Glycine max
  Peptide Sequence Number=SeqID_189225
atgactcaggccctacttccagagtcatcaagtggtagtcaagacgaactaccccatcaagtaggttttgagaagtctgaacttgcaggaaggatggtggcctggtcaatagaactctcagagttcaacatccagtacgaaccatccatgtgtgatttccttgatgtggattttgagttatgtggagttttattgacttag

SEQ ID NO: 72448 - DNA, 282 bp, Glycine max
  Peptide Sequence Number=SeqID_189226
atgaaggacattaggtcgctacggccaaagaacttagcgaggaagagagtggcgtgtcgttgtgactccggagactcgatccactgcaggcacgacctcagaggacatgtgtcactgcaccccttccggagcacacggcaaccgttgcaactcatattaatttcctgggttgtgaagggaatatatatatatcatccatctcagttctcagttctaagaagaacagctccgtgtttctgcaccgctttgtcagactccacacatgcctccctcggtttttga

SEQ ID NO: 72449 - DNA, 771 bp, Glycine max
  Peptide Sequence Number=SeqID_189227
atggcccagtcgaactcttctagacttgggttccctgctcttatcaccgctttatgtaagtccagaggggttgcttctgacagcctggtcttcaaacgcctgagcctggtcattaacttggcctatatcaggaaaaactgttggaaccctgatgatctgatagttactatcaaaggggccaggagagcgaggacaaggccaactaaggtcccttccacatctacagctcctcctccagcacgtaccccagcagctccttctgcctcagcttctgcagatttttggcatcttgaagccatgcttcaaagcatccatcaggggaagattatcttattacatagtttacagatggtggcacctccagactctattcctttaatagagcagtttaatgagtgggtagcctggcccgggactcagtcttctcttcatagggaagatgaaggtcccacagcccaggtaccactgcagatggaggatgagccatctgagactaccactccagagcccttggtcagaaggaagaaggcagatgaaacacaagaagctgtagccacttctgagaaacctcttgaggccacttctgagccttcagaactagtggtagatacaacttcacctcagcaggcaacagacccttccactcctgaggatctaactacaccagtcctatctctgaacacctctcctacagctacccctgtgcttcacttaacaaacgaggaagatgttcagacacaggaaactcaggaccaatcacagaatttttaa

SEQ ID NO: 72450 - DNA, 291 bp, Glycine max
  Peptide Sequence Number=SeqID_189228
atgtcatcggactcgccgtctctggatgacaaaggtgcagatgacgacattagtctctacgtgtcaacgggctcgcttgcctcggactcgccgtctctgaatgacaaaggtgcagatgacgacgttagtcactgcatgctaccggaccctcgagtcacaatagcagaaggtggggtggtcgacaaaagcggggcttttgctcctacgtatcctcaatttgtgatgaagaactcagacctacgtagttcttgcttttgtgagactaaaatagtcttggtgttctttcactaa

SEQ ID NO: 72451 - DNA, 645 bp, Glycine max
  Peptide Sequence Number=SeqID_189229
atgagtaggaaagaattcttaaagaattgtaaaggttgtaaaagtttaaaggtttctcagaagttgttcaagaagatttttgaatgcaagtcaaggtcttgcttttatagactcttcatgtctggtcaagaaaaccattggaagagttataaccttgagaaaatcatgtcaagagttacatctcttgatcttttattcaaaacttgtcactgcttacttctacacaaccctctgaaggcgagggtgtgcagccctatgaaggcgaggacgtgcagccctctaaaggcgagggcgtgtagtcctctgaaggcgagggcaagcaatcctctgaaggtgaggacgtgcagccctgtgaaggtgaggatgtgcagccctttgaaggcgaaagcgtgtagccctctgaagacgagggcatgcaactctctgaaggcgaggacatgtagccctctgaaggtgagggcgtgcagccctcaaaaggcgagagcatgcagctctctgaaggcgagggcatgcagccctcgaaaagcgataggtactagtacccaagggtcccttatgagaaagcaagagattaactcatcgagatggcctctcatcctaaattcaaaagattggacattagatgtaggaaatctatgcagttaa

SEQ ID NO: 72452 - DNA, 318 bp, Glycine max
  Peptide Sequence Number=SeqID_189230
atgacagaaacagaaagagtgaaacataaagagggtttgagggtgttcttaccttcgtcgagagggagagagcttcgagtggcacatgatggtagcatgggagaggcagtgagagggcatcatcatgatgggcttggtcagagagtgaagctttgtcgcacgagagtgagagcgtcatggcatgaaacagattcgagtggtagctttgacagccacactggaaagaaggcgccaccaccacgttttagggtgcatgagagacaaagtgagagagggcacaaagagagggatcgagtgagactctcaaagagggcatga

SEQ ID NO: 72453 - DNA, 996 bp, Glycine max
  Peptide Sequence Number=SeqID_189231
atggtttcggattttggtaagaacatttggtgcccaccgtggggccgcgataaaacataccccgcagcctctcctcaactctctttcattcatacatggttagcactcgatctgaccgcagactcccatcctcatccggtagctatgacaaacaccaacactctacagcaactccaaaactgcattgcggagatggaacaacaccatgagaaggagttgacaaagctaaaagttgaccatgaccaactagaggctcatgtcagacatccccagggcgacgaacaatgtgcccacaccttgcctaaatgcacacaaggggaatcacacccccgatgcataggcaacactgcagatgatttgagtctctcccatatgcaccgtccaacagggcaaactatccgtcggcatccttttgtcaaccacattatgaaggtgaacctctacaccaacaataatgtgattctctatcgtgtcttccctacatccctcaagggggcaacattgacctggaacggtggactcccacccaggtccatagacaacttcgactccctcgttgaacgattcaatgcccagtacgccaccaacaggtctcaccgcataaccttaatttccttggcaagtcagcgacaagcagacaacaagtccctcaaaaaattcatagaaagatttgggcgcacagccgtccagatccagaatcttaaccccaatgtagcattacattccatgctcctcgccttacgccccagcaagtttgcaaacaatctatgcaaaaaccacccagtaacatggacaagctgtgcgagtgaaccaaaggctacatccagatggaagaaatgtctagattctagaatgaagtctgtcaacccgaacagaagcatgacaagcgtgaaggaaataccaaggctaacttgcataagtcagataagagacacaagccaggcaagcgccagcctctctccaaaggggacaagtacgagtgatacacacccctga

SEQ ID NO: 72454 - DNA, 285 bp, Glycine max
  Peptide Sequence Number=SeqID_189232
atgtggctcaactggtctctactgccatctactgtttgcagggatcgcccccgcaagacacttagtggacccgaagaagtccaacagggccctggggttctagctctgattatgggcctctgttggttcaacggagtgaccaccactccaatctcccctagccgaagtgtcagctgggatcgcgcccgcaagacacctagtaaggtcatcaggccccctactaaccgagctttcatcaagaagtactacgcccccaggcaggcgcagggtgagacaccacagtag

SEQ ID NO: 72455 - DNA, 264 bp, Glycine max
  Peptide Sequence Number=SeqID_189233
atgagtgaaattgaagaagtgcaggaacaaatgaagatcgatatggaagccatgaaggaacaaatgacaacaatgatggaagaaatgatgagcatgaggaagaagatggaggataacattgctacagttgttgctacgagtactgctactgagatggacccaattcacctggccagtttaaatcaagtgaatcgtccagtctcagatatagtcggtcaaggaggcgaggcaacgaaaaatgcatgtgggccttatcatgttcag

SEQ ID NO: 72456 - DNA, 267 bp, Glycine max
  Peptide Sequence Number=SeqID_189234
atgaagcactacgctaatagcaatcaccgtgaagttactttcaatcaaggagattgggtcatggttcgattatggccctatagacaatctacaataccaggacattcttctgcaaatgtaaagcttgctaagagccctcaaacccctggtgatattaagcacgtgatggtaatctaccgataccctaaattgcagttcctagttcaatgggaaggactcttgccagatgacacttcatgggaagattgggaactgctgaagcgttag

SEQ ID NO: 72457 - DNA, 279 bp, Glycine max
  Peptide Sequence Number=SeqID_189235
atggagttttttgatgatgtccatgaagagagttgccacgacaagagtagtatgattagggaggagcatgcccaattgtatgcccttcaaaaatcgatcaacaaccaccagaattgtattgtggccatgatacagggtaacccaacaagaaaatccaacgaaagatcctcccatggccggagtggcactgcaagacacaagaatctggaagagaatcttccttgcaagcacgcactcagcgcgttgttgctcgctaagcgagtcatatgtcacttctag

SEQ ID NO: 72458 - DNA, 523 bp, Glycine max
  Peptide Sequence Number=SeqID_189236
atgtcgacagaaaaagaacctactcccgctgcctccaactttatccgcgccatcattgataaagacctcgcagaacacaaatacgcgaccaaaaaatgggcaggcagcccaggcgatgccgcgcaccaagcgaccggccaggtagatttcgccaaaatccgcacccgctttccgcccgaacctaacggctacctgcatattggtcacgccaaatctatcttcttgaattttggcctggcaagggattacgacggtgtctgccatttacggtttgacgacaccaacccagagaaagaaagccaggaatatgtagacagcatctctgacatggtgcaatggctgggctttggctgggacaacactacaccgactggcaataaggaaaataacctctactttgcctcggactactttgatgtgatgtaccaggcggcggaagcattgattcaacatggtcatgcctatgtcgacgaacaaactgccgaagaagtgcgtatcaaccgtggcacgctgacagagccag

SEQ ID NO: 72459 - DNA, 690 bp, Glycine max
  Peptide Sequence Number=SeqID_189237
atgcatggattctcccatgttgatggttttgtggaaataagcaactgcttggcggaaatgattaaatacgcagccaatgaaccgtctgccggtctcttctttatccaacatcacactcaaaatgcagtgccaaatgtcatcaaacttaagaacaacattattgacaagtctcacgaaacaactttgcagaccgaagatttggaggattccgtcgcaatggtgagatcaatgaaagagtgtggattccccatagctgatgagatgatcggagacataaaaaaatcactggagggaataagtgaaatgaggggtaactatttttcaagtgtttttagcttttctaaacagaagactaaaactaaaagtctcaacaagtggccacaacttgattctatgggatcggtaaattccaacaccgagaagcaactgatgtaccatagcatgtcattgccagatgcatctgcaaatagtactgcatcttcacaagctgacaagccggtatcaagccaggttgaaggtgaatctcgacctgaaccaagtgatattggggataagttattgtcactatcagaaaattttgatgacttcaaagctagtaaacaagctaagctggaggattggcttgaaggaactagcaaccatggggagaattgcctgccaggtgatgagaaaatggctctgagaaaatga

SEQ ID NO: 72460 - DNA, 369 bp, Glycine max
  Peptide Sequence Number=SeqID_189238
atgtgtttgaaacatatcatgagaattcttattgaagctcattatctcgaatatgtgaaaaagaatagaaaggtacaatccgagggagctgatgcggaaggtggagttgccatcggagaaggtgaggccggcgtcgatttgggagaacttgcggccgcgatggaggtggtcgcggtcggcgagctcggcgtagtactcgacggtgccctcctcaggcggggcggggattccaacggtggaggggtgggaccacttcctgatgggctcagagtggcggttgtgcaacgtaaaagtgtagatgtggctgtgtcactggcaacactcccagagggagaggagcgacacaatgatgaaaacggaagcgagtaa

SEQ ID NO: 72461 - DNA, 447 bp, Glycine max
  Peptide Sequence Number=SeqID_189239
atgcatggcgccaccaccactggcgcttccgcgaaggagctgccacgtggagagggacgcgctaatagcagcagcggcttcgccttctgcttacgtggagtgggacgcgcaacctccactggcgcgttgtgcatggagtccagaaacgccagtcaaactggcgttttagctttgcaggtgacagggcacaatgctgcagcaaaggtgacagggcacagtgctgcagctgcaggaagcagggaaacgccattggagcctgcggcttgcgtttgcaggttcaacgcgccatcacgaggagcgctttcttccttttatatgcagttcttgtgctgcattgtgctacccgtttgctcagccttctccaagcttgcttcctttggttggttccttgcttcctttgcatctttggcttctgctgcttgtaacttcttgattagatttagttaa

SEQ ID NO: 72462 - DNA, 559 bp, Glycine max
  Peptide Sequence Number=SeqID_189240
gcctcaagaggttaacatcagcctcacatatttccatggaaaagataatgttgaggcctacctagattgggaaatgaaggttgaacaactctttgcttgccatcatattagtgaagagagaaaagttccattggctacccttagctttcaaggtgctcttaggaagaggcacatttcctcctactatgaaaaggagcttatggacaagctccaaaggcttagacaagggagtatgagtgttgaagaatatagacaacaaatggaactactccttttaagagttggacttagggaggaggaaagaacaagcatagctaggttccttagtgggcttaatatggaagtgaggaacaaggttgaactccatccatatagagacctagatgagctagtccaactttgtataagagtggagcaaaaacacaaaagaaagccttcttcaaaatcttatggttttcttagtgggcttaaaacaaagccaaggatgggacccatcaccagagccatggctagaagactccaagaagattgggccagggatgcagtagaatgccctagg

SEQ ID NO: 72463 - DNA, 567 bp, Glycine max
  Peptide Sequence Number=SeqID_189241
ttaccctcaccgttgagaggactacacgtcctcaccatcagagggctgcacgccctcacctctagaggactacatgtcctcgccttgagagggctacacgtcctcaccttgggtactagttaccctcaccgtcagagggctacacgccctcaccttgaaaggactacacgtcctcgccagcagagagggctgcacgccctcacctctagaggactacatgtcctcgccttgagagggctacacgccctcaccttgggactacacgtcctcaccatcagagggttgcacgccctcacctccagaggactacatgtcctcgccttgagagggctacacgtcctcaccttgggtactagttaccctcaccgtcagagggctacacgccctcacattgaaaggactacacgtcctcgccagcagagagggctgcacgccctcacctccagaggactacacctcctcgccttgagagggctgcacgccctcacctttagaggactacgtgtcctcattttcagtgtgctcgacatccacaccttaaaagaatttaaggtcctctgcccttaa

SEQ ID NO: 72464 - DNA, 924 bp, Glycine max
  Peptide Sequence Number=SeqID_189242
atgaagaaaatctattttttatttcttttgtcctttcttattgtgtactcctgtaaagatgagagaatcgaaggaataggcgttgaaagtccccgtgttaatttcgatattaatgctgtcccctatgcaaaattatctacttattcttttttcaccggcgaattgaaaaacctggttccggcacccaaagtaataccttatgaacctgccagttcgctttttacagattatgctttaaagaaaagatttatctggatgccggaaggtacaaaagctacttttgatggtgataccaaaacattggactttcctgttggcactgtattgataaaaagtttttattacaataccatacagcccggtaatacaacgaaaattctggaaacgagattaatgataagaaaatccagtggatggatatttgccgaatatttatggaatgatgaccagacagaagccaacctcgtatccggaaacgattttaccagcggaagctccaaaaatattacatttaaaaaagaaaataatgaaattctgagtattgactacagaattccatcggaatcggaatgctatgcatgtcacaaattagacaataagcctgtccctatcggggtaaagccccagaatttaaatacaacatacaattaccctggaggaattaaaaatcaattgcaaaaactggttgacgagggttatctggtcagctatcctgcaaacattgtttctacagtgaattataaagatacgagtaagcctgtggatatccggttacgatcctatctggatattaattgtgctcactgccatcagcagaatgcacgttgtgattatcgggctatccgattgagctttaaccagactacaaacctaaccaatatgggagtttgtgtactggcagatgaaccgatagatgcctcatga

SEQ ID NO: 72465 - DNA, 222 bp, Glycine max
  Peptide Sequence Number=SeqID_189243
atgaagaacgtcgaagaacagttgaaaatcttcgcgaattcacccacggaaacgttacggaagcgccttggcttggatttttcttcacggaaacaatttttttcactaatttcaagaaataggggagaagcttgccacccaactcgcccagacgagctaggttgcttcctccagaagcaaccgccttctggaggaatattctggaagctcaagtgggcctag

SEQ ID NO: 72466 - DNA, 282 bp, Glycine max
  Peptide Sequence Number=SeqID_189244
atgaagaggaagctgtcttgtggaaatttggatgagattttgagagattgtgaggaagcttccctactatggagagctaaatcctcagttggttcttcctatgggtttttcctcttcaccaattatagtgcaatagagctgtatgatcaacaatctcaggaccctgacagaacatggatggtgaatggtcaaagattgaaactgtaccatggtggagagtttgaaaaggcaaacaccatcttgcatttgatatcacctattgaggtatatgcgtcaagctaa

SEQ ID NO: 72467 - DNA, 1542 bp, Glycine max
  Peptide Sequence Number=SeqID_189245
atggccacatcaccacaaactccaatggaagagacaaaccacgtctttggaggaaagccttcattggcttcaaaaatactcacgagccatcttcgaatatttctcgagcaatatcccttaataccacctccttctaagatcatagatttcaaagattttgcttctccaaacgccacgcttcgagtaagaaaaccggctcacatggtagatgaggagtacatagcaaaacttgaaaagggcattgcactcatgaaagcactccctgatgatgacccacgtaatttcatacaacaagcaaaggtccattgtgcttattgtaacggtgcctatcacctaccccatccctttcagaacacaaaactcaacattcacaggtcttggtttttctttcctttccaccgttggtacatttacttcttcgagcgaatcttgggaagcttgctcggtgacccgaactttgccttaccgttttggaattgggatgctgtagaagggatgcaaatgccaccatatttcgcaaaccctaactcgtcgctctatcacaaactccgaaaccccaagcacttgccaccgcaagtggttgacctgaactatgatccatttgactttaatgatgatacaccttctcatcaacaagtttcgtataatctagccttcatgtacaagcaaatggtgctagcaagtaccaaagaattgttcatgggaagcccttttcgactcggcgataaccctactccgggtattggctctatagaggctgctcctcataacacggttcataaatgggttggtgctgctgataagccacaccaggaggacatgggaacgttctacacagctgctagagatcccgttttctatccgcatcacacgaactcggatcgactgtgggggatatggaaaaaattgggagaaggaagaaaggactatagtgatgatccagattggttagattctgatttttacttctatgatgagaatgccaattttgttcgcgtgaaggtaagagattgctttgatactaaaagattggggtatgtttacgaagatgttgatcttccatggttgcgaacgccacccacatcgcgaaaaagcaagctactaagagaagccaaaaagggttcacttttgagttcaaagccatggaaatttcctttggttttggattccataacgagtattgttgttaagaggccgaagaaatggaggagcaaggaggagaaagaacaagaggaggaggttttggtgatagaagggattgagtttggaagtgataaatatgtcaagtttgatgttcatattgatgatgatgaagacaatttgagtggtccggatgagacagagtttgtgggaagttttgtgaatgtgcagcatgggcatggccataatgtcaaaactagctttaaggtagggatatcgaaagtgctggagagtgtagaagctgaagaagacgatgaggtgctggtttctttggtacctaaggtgggaaaaggggatgccataataggaggcatcaaaattgagtttattccaaaatactag

SEQ ID NO: 72468 - DNA, 228 bp, Glycine max
  Peptide Sequence Number=SeqID_189246
atgggatacggcaaattcgttgctatatgtcaaatgggggtatccagagcagtgagtggcctggggactgttatttacgtggataccaccattggcgtgaagcttgtaacgccactggcaatgacgggaacgacgatgccgccattgacaacagcaggacagggtctgactaggagagataaagaagcccataccgtcattcgtactagcgggacaaggctgacttga

SEQ ID NO: 72469 - DNA, 171 bp, Glycine max
  Peptide Sequence Number=SeqID_189247
atggttttaatggtgaagatagagaaatcattgttgagtaaggaaactaagggcatcagcaagacaatgagtacaaagaataaagataaaagcttagaaggagtactcattgctgctttagcttatagtgtatattatatatgggatgcccatgcatttaacattttctaa

SEQ ID NO: 72470 - DNA, 519 bp, Glycine max
  Peptide Sequence Number=SeqID_189248
atggcacgcagagacaaattatggtcattctgcgccttttatcatccagaggcggcgtgcccgatgacatgcggagacaaattatggtcattccgcacaccttttcgccatccagaggcgatcgtgtccgatggcacgcagagacaaattatggtcattctgcgcctttccatccaggctcgatcgtgtccgatggcacgcaaagacaaattatggtcattcggcgcccttttgtcatccagaggcggcgggctcgatggcatatggagacaaattatggtcattatgcacaccttttcgccatccagaggcgatcgtgtccgatggcgcgcagagacaaattatgttcattctgcgcctttccatccaggctcgatcgtgtccgatggcgcgcagagacaaactatggtcattctgcgccctttgtcattcaagggcagcaagtcaagtgataaacgcgcagagacaatttatggtcattttgcaccctttgtcattcaagggcagcacatcaagtag

SEQ ID NO: 72471 - DNA, 796 bp, Glycine max
  Peptide Sequence Number=SeqID_189249
ccgcaacaccatcactgtcctcgccgttgaagactcagccatgcattccattgctgccaagtccccagaagccattaaggccatcattggcacccatgtcatccttgacttctttgatgagaagaagctcatggaagctcaagctagtagccaacagttgacaaccctattccaggcttcaggccttgctgtgaaccaacaaggcttcctcaaggttgcacttgttggtgaaggcgagatcgccttcgggtcggctgcgagcgatgccccagccgacgccaccgagctcgtcaggaccgtcaccagtgagccctacaatatctccattctccaagtcaccaagcctatcctagccccaggtgttgattcaccaaccccagcctcatcatctggtgcccaaccctcacaaggagccaaggcccccattgcagcacaaagtgccaaggcaccagttactgcacaagaggctaaaactcctatgccatcatcacaaggtgtcaatgcgaaggcacccgttcaggcacaggttgcaaagtctcctgtgccagctcagagtgccaaggcaccaactcctttggagaatgcggcctcgccttcacctgctagtgaaagcgttgccgagtctccagaggttgctgctgaagccccagcaacaagcccagttggggctgaggctccaggtcccttggctgatgatgttgctccggcagatgttactgctagcagtgcttcgaccacgaagatgggtttggttggggcagtgatggcctttgcttccctcttcattgttctgtaa

SEQ ID NO: 72472 - DNA, 267 bp, Glycine max
  Peptide Sequence Number=SeqID_189250
atgaagcttacttataacaatagaggggtgggagctaggaaggtggaggagaggaaaaaattttcaaatacgaatggtggtggaagggacattagggagtttaatggtttcattttttacatggagctagaggacatccctattgttcaaaggatgtatacatggtttaagccaaatagccatgtaaagagtaagttgggcagagtatttgtatctaaagaatgggttactcacttggcaagggagctctcatcatgtcttgaatag

SEQ ID NO: 72473 - DNA, 309 bp, Glycine max
  Peptide Sequence Number=SeqID_189251
atggtataccaagaaggcgcggagcttagactcatccagatcgcactgagtggaacctttgacgctgctggtgacgtcgaggaggcggtggccgccctcagggatgaaggcgtcggcgtagagggagagcccgcagaggcagaaggcgacggagagcgtgacgtcgatagggaacaaccgggggagcgccgcgagaaggaggcagaggagggtggagagttgggagagcgaggcggagacggagaggcatttggcctttggagcgaggagcgagatgcgggcagagcctctagagggattgggggttag

SEQ ID NO: 72474 - DNA, 147 bp, Glycine max
  Peptide Sequence Number=SeqID_189252
atggagggattgggtggtgcaggagagtcactggaagtgtcgtggcggcgttggcttgcagtggtggtggttgaaattttgatcggtatggtttgtagagaattgaaaatgatgaagtttgcactttgtttgaaaggatttggttaa

SEQ ID NO: 72475 - DNA, 610 bp, Glycine max
  Peptide Sequence Number=SeqID_189253
aggactacacatcctcgcctttagaggaccacacgtcttcgccttcagagaactacacgtcctcgccttcaaaggactacacgtcctcaccttcagaggactacatgtcctcaccttcagagggctacacaccctcgccttcagaggactacacgtcctcgccttcagagggctacatgccctcaccttcagagaactacatgccctcaccttcagaggactacacgtccttgcctttagaggactacacgtccttgccttcagagggctacacgccctcgcctttaaagggctgcacgccctcgccttcatagggctacacaccctcacctttagagggctacacgccctcgcctttagagggctacacatcctcaccttcagagtactacatgtcctcgccttcaaaggactacacatcctcgccttcggagggctacacgccctcgccttcaaagggctacacgccctcgccttaagagggctacatgccctcgccttcagagggctacacgccatcgccttcagaggccgcatggctccacatctgcgccttcagagaactcaaggtcctccacccttaattcttaatcgaggcttgcactcccag

SEQ ID NO: 72476 - DNA, 645 bp, Glycine max
  Peptide Sequence Number=SeqID_189254
atggccagaaacatcatccaagcaaaatggaaccactccaaagaagacgaagatgacgagcaagaagaagaagaagaagcattgtcactctgcgatcttccaatcaacctcgaggacccaccgaggaaccaagaacactctcgtcccaacgaagcatcacaagaggaattcaatttccggtcgtggggtgcccccttctccaaagaacatgaaatgtgtgttgcggatgaagtcttcttcaaaggccaaatcctcccattgcgcgtctcgttcagctccgaggccgggttgttagccaccgtgtctcaatctcaacaacattatggtaagcaattcgttaggtccgaatccctggatcgcaattcaagcgatttccgaagcagtaataatagtagtagaagtagtagtctcagaagccagaactcatcaactagctctgtcactgccgccactgccaccacaaccacaacaatccctaaaagtaaacccagaattcgaaaccaatttcacacgcacccaagcccaaaaccccagttaagagcatcagcaccaacacacaaccaaggcagaaaatccacgtcagcatggggaattttccgtttgggtgtggtcgctgctcccgagatagggttacacgatctcaag

SEQ ID NO: 72477 - DNA, 185 bp, Glycine max
  Peptide Sequence Number=SeqID_189255
atggttaaattcttcaataaatgggctgttgctccattgtttgtgcagtcagaagttctagctgaagcctctgtggtgaagagtggaagaaatgtgaccatggttgcattagagtttaagctgaagaagactgggaatttgatgtatattgctcataccaccttctataacatcccggttgccaa

SEQ ID NO: 72478 - DNA, 408 bp, Glycine max
  Peptide Sequence Number=SeqID_189256
atggcgtcgaaggcttcttcctctgcttctcaaacccaaacactctcttcaatttccgaccaaaaggagtttcctcaacatgtttctatgacccgcacttggcttaacaaattgggcatcgacaaacccattcctcagagttgcgaaacccgcggcttctactcccacttctttggaagcttcatcaaactcaacgatatcaagaggggacgaatctcttgcactattgctgtcaaaccccaaatcattataactgttgggaatgaaggtctcaagcttatgattttcagtgtttatcaagatagtgtttggataaaggatttcaaaatttcaagctttgttgcttatagtgctcttactcgattgaacaagattggtctataccaaacaagtcattttgatatatga

SEQ ID NO: 72479 - DNA, 228 bp, Glycine max
  Peptide Sequence Number=SeqID_189257
atggagttttatccagatccattactgcctataacaagtcaaatagagagtgctcttgtgaatgtgcataagcagtgggtgacaaacctagcaaacatggatgtgcaaggaagactccaattattgatcagaattttgcctgatgtcaaggggtcttatggaatagtttctcagtattgtctgccgaggcaagttggaaagacgattatgcaatatcttgaaagttaa

SEQ ID NO: 72480 - DNA, 165 bp, Glycine max
  Peptide Sequence Number=SeqID_189258
atgtatcttaaaaaagaaattaatctggaaccagtgtttgctgtggggagcattccagaaacttcttacaatgttgtgaaggaccagaagtactgtggggagatcaaggttgcactcacctttaatcctgagagaggcagtggactcggctatggtgatgaataa

SEQ ID NO: 72481 - DNA, 999 bp, Glycine max
  Peptide Sequence Number=SeqID_189259
atgggccaccgttgctgcagcaagcagaagatcaaaagagggttatggtctcctgaagaagatgagaaacttcttagatatatcaacacacatggacataaaagttggagttcagtgccaaaatttgcaggcatacatttgtctcgcttgcaaagatgtgggaagagttgcaggttgagatggattaattatctgcggccagatctgaagaggggttccttcactgctgaagaagagcagatcataattgacatccatagaattcttggaaacagatgggcacaaatagccaagcacctaccaggaagaacagacaatgaggtcaagaatttctggaactcatgcataaaaaagaagctcatttcacaaggcttagatccacaaacccacactctcctgtcttctcataggagaagctcagcatgtaccatctccaataatatccatcaaaattccaattccattttcattatgagttcacacataccaaatgcaccctttgaaactacttgtcaaaccttttctacattacctaaacctccaccaaacattgttcaaaccccctctagcattgtttcctcagaatttcaaacattatcaactattctttcagatgatggagaacccctccaacatttgccttatgaactattaatggaaaacgccaccaacatttgttcacctacatacatgaacccctcagcagttgaattgtgtaacgatgacaacaatgtgaattgggtttcaagacttaatgttcatgatttcagtgctcaaacactggaagaaggagcacaagtactgcaggtgcagcaagagaagggcaaaacttttgatgataagggaagtgatgtgagagaagctaacaagggaaatcttgaaaccagtgtttcttttgagagttctaactttgatcttgggtttttggagagtgtacttacctctgaattcatctctcatgatctcaattgtatggatgaacttgcatggaacttttag

SEQ ID NO: 72482 - DNA, 279 bp, Glycine max
  Peptide Sequence Number=SeqID_189260
atgtctagtagtggtgcggaggcaaaaccggtctgtggcgtctcggtgcaagatgacgctgccgtagggggccgtgttgcagtagctgtggcggtagtggacagtgtggaacaccttctacaaaacccttggcgtcgccacatgattcatcatcagagggggcagcaaggacgagaccgtcagtgccgatacgggtcgcggcgaccaccatattgcttgtgccgcatcgagtggtatcgacagagggggcaccttcgacgaaaactccagcatacctag

SEQ ID NO: 72483 - DNA, 507 bp, Glycine max
  Peptide Sequence Number=SeqID_189261
atgcctccgccgcagattccgccgccccctccgtcgttgtctccgccactcaaggcaactcagtcacccatgctcaccgcacccaccacatcctcttcatcgatgaacaaccaccatgtcgacgacgaagttcccagcaacatcacgaaggaacttgtccctctaggtatgctggagttgtcgtcggaggttccccctctttcgatacaactcgatgcggcacaagcaatatggtggtcgccgcgacccgtatcggcactgacggtctcgtccttgctgccccctctggtgatgaatcacgtggcgacgccaagggttttgcagaaggtgttccacactgtccactaccgccacagctactgcaacacggccccctacggcagcgtcatcttgcaccgagacgccacagaccggttttgcctccgcgccactactagacattcactcatttctacgcccatcctaatttgggatccaggttcattcctcctacaaccaacaccttga

SEQ ID NO: 72484 - DNA, 414 bp, Glycine max
  Peptide Sequence Number=SeqID_189262
atgctttctcataagggtagacccttgggtactagtaccctctccttcagaggactgcacgtcctcaccttcagaggactacacgtcctcaccttcagagggctacacgccctcgccacccttggaggactacacgtcctcgccttcagagggctacacgccctcgcctttagaggactacacgtccttgccttcagaggactgcacgtcctcaccttcagaggactacacgtcctcaccttcagaggacttcacgtcctcaccttcagagggctacacaccctcatcttcagaggactatacattctccccttgagaggactacacgtcctcacctttagagagctacgcgtcctcgctttcagagggctccacatctacaccttaagagaatttaaggtcctctgcccttaa

SEQ ID NO: 72485 - DNA, 153 bp, Glycine max
  Peptide Sequence Number=SeqID_189263
atggggctcttagcaaaccgtcattgccaatgggggaggttcaggcgtaggctaggcggtgcagctacaatgcaggctgcagcaggtgcagaaggactggaaatcgccagtcatggtggcgatttggttgttaaaaaattttctggcctataa

SEQ ID NO: 72486 - DNA, 492 bp, Glycine max
  Peptide Sequence Number=SeqID_189264
atgaagatcctcattgagagagggtacatgttcactatcgctgcccagtgggaaattgttcatgacatgaaggagaagcttgcttatgttgccttggattatgaacaagttatcaccattggagctgagagatttcgttgccccgaagttcttttccagccttctatgattggaatggaagctgttggaattcatgagaccacctacaactcgatcatgaagtgtgatgtggatatttctctcgctaagccaatctgctggcttagcgaggcatccgttgagtgcacccctccttcggctgagcgtgaggaaagatctggaagaaggatgagctgtgcatgttcgctgagtgaagggtcatccagtgaagtacaccgcttcagtccatccgttgagcgagaaaagcacacgctaagccaaaatccactaatgagcgctaagcgatccagagttgcgctaagtgtgcaagcacgaacaaagccacctatttaa

SEQ ID NO: 72487 - DNA, 396 bp, Glycine max
  Peptide Sequence Number=SeqID_189265
atgccgagacacaaaaagtgcaacccatgtaaaatacgagttgagccaaatcagtctatttttcatgcttgtcctgacaagctatgttggttcacctatattgacaactctagttacaataatatcagtggtggcaactttgatttcaatggtgatagtaatagtgacaatgatgatagtagtgataacaatataggtgataaggaccacaatgttagtattggttgtggtggtgacgatgttggtgatagtagtgttggtagcaacgacaatgataatgacgatggtgccaatagaaatggaggtggtggttgtgtgcaccctccacaccacattattccccccggccatggcatccattctacactctcattggcttccaacctcggtccatga

SEQ ID NO: 72488 - DNA, 1440 bp, Glycine max
  Peptide Sequence Number=SeqID_189266
atgagtgttgggtcgtcgtcgtccaccccggccgttgctggatatgagtgggataaggacaatgtgctgaaatataagtcttgtctatccttgatagcgagtgtcactgcgcttcaacgtcaagtgaagctggcgaaccctgaggactcctgtattatgggtgacttctcttggagaccactcgtgaagcaggtcagacctgaaggtggaactatgccactgtttgctgctactctgtctgttggagaaaggggtcaacttgctagtgagattgaccttattgctattgctgttgaggtcacccccaatgttcattcctctatttttgcaaagagaaagagggatgatatcgttgggtcgtttggatgcaagaagtcgagaacccctatgagcctccatgccttgaggttcatagggctcactacaggtcacctcacgactagacaagatatgcctccagctccattggaagttaaggctcttgttgttgttgctgctgctgctgcaactcctgctacgcctgtgcattcaccttctcctactactattattcaggaggttactcttgctgatgttgaagatgttgtgttagccactctggttgagtctgttgtggtgtcatcgtccaccgttgcatcccttttactaagtgttagtgtggtgaccactggtgctcccacggtactgtccccttctttggtggccctccctgttgctattttggaggctatggcgttgccttcttcgtcctcgcacccttgtgtgtccctcgatcatttatacaccttcagtgatgttgagttactatggggtgccacttacaagtcagagcagaagaccctgattggctttgtgtcaaccttcgagaaaaatctcatcaggtcagttggggtgcagaatgctactgactctgtcaagatgtttctccaaaggagtttgacaattttggaggagaatatactgcagcaccaagaggcagtgcaaaagatttcatccttggaggcagaggtctccaagtggagggctattgctcagactctatggcgagtggagctccctaaggtggccaatgccattgtcgcttttactgaggtcgtaagggaaaatcaccaactatcttccaaggttggtggtgcactgactaagttgttgcacacccggttagatggtgatgacctgtttagatgttgcaagaacttacagactgagaagatggacatgtgtggtagggtggagagcatggtggctgagaaggacaggcttgccaagaggattgctaagttagaggcttggctgagggagtcagagtctagattgaaggagtccgagctgcgggctgccaaggaaattgaggctagcaaggagttagaggaagagttgattttgtataagaaggtcgtggagcaacatgaaaaaggctttcagaaggctgtcaagtag

SEQ ID NO: 72489 - DNA, 215 bp, Glycine max
  Peptide Sequence Number=SeqID_189267
atgacactcacaacgagtgacatacatgcaagaacgtattaccatcatgactccagcatgtgtcacccacgtcgagtgacatatatgcatgagcatatcaccacgtcttcagtgctgtcacccacgacgagtgacatgtatgcaagaacacagtgctcaaaacctaggatgaactattccctggtcaatcctctaaagggctcgcaaaactcaag

SEQ ID NO: 72490 - DNA, 194 bp, Glycine max
  Peptide Sequence Number=SeqID_189268
gagtgtcagatagcggcagtggtggggtagctagcggcgatgaggggttgtcggaaacagtaacaaggtggttggcagcagtggtggacaggctagcggcgatgatggggtggctggcgactgtagctggggtgggtggcggtgattgcggggtggccggcgacggagatgaagttgttacttgtttggaataa

SEQ ID NO: 72491 - DNA, 258 bp, Glycine max
  Peptide Sequence Number=SeqID_189269
atgggtgaagctccagaggtgttctacattaatgggttctcaaagtttgaacatgaaattgaaacccaacaaaaccatcatgtgaatgatcagaaccatgattcttcttggtacgaggaaatcatcgatgaggatctaaaatggtcttttaaactcaacagtgtgctccataaagccattagcgagtaccaggacatagctctcttagatacaaagcgttttggaaaggtttgcaatctctgcttcttcttctcataa

SEQ ID NO: 72492 - DNA, 642 bp, Glycine max
  Peptide Sequence Number=SeqID_189270
atgccatatccagaggatgcgaattgtccagcttatctagacaatagccttatattagttgaactgaactacaacaatgaagaacttagattagagtttgaacatctattttctcacatggcagatgaacaagcttcaatttacaaccagattgttgaagctattaataaagatgaaagtggtatgttttttctctatggatatggaggtacaggaaaaacatacatttggaaaacacttgcaagttcactaagagctgacaataaaattgtaataatggtggcctctagtggcatagtttctctgctattgcctggaggtagaactgcacattcaaaatttaaaattccagttctagtttttgaagactcaacttgcaatatccatcaaggaactcaattagctgagctattaaatcagacacgtctaatcatttgggatgaagcacccatggctcacaaattctgttttgaggcacttgatcacagtcttagacatatcatcaaacacaactcaaaggacaatacaatctttggaggtaaagtcatggtctttggtggagatttccggcagatcccgccagtcattccaagaggtagccgcaataattccaaactgttatcttacttatatacattctaa

SEQ ID NO: 72493 - DNA, 150 bp, Glycine max
  Peptide Sequence Number=SeqID_189271
atggaagttcctcatgatgctcaagaattgaccccagtgaggttactaagaatcggagagatcgatcacattgagatgatgcccgaggaagaggaagtgtatcatgagcttctacgagatgtagagtcttcatctgaagaggaggattga

SEQ ID NO: 72494 - DNA, 237 bp, Glycine max
  Peptide Sequence Number=SeqID_189272
atggggttgtttttgaagtattttcgcgagggggctcttttagacgtaaaatgcatgcatgcaacacccaaaccgccagtgggactggcgggttcactgttgtgggaaccgccagtcaaactaacgagtttcaggtaccgttttcgtaggcctgtggcacttgctttttcaggtggcaggttgcctttttcagttgacaggccaaaagacaagttgcaactgtcattgacgagttaa

SEQ ID NO: 72495 - DNA, 140 bp, Glycine max
  Peptide Sequence Number=SeqID_189273
gaattgctggtatagtgagtgggagaggttctgcacaatcagaggttagggtttatgatctaatgtgggtgatcaaatgtgggattgtaacaatggatcacgactttgaggaagtgattttccacttcaatctcgtctga

SEQ ID NO: 72496 - DNA, 555 bp, Glycine max
  Peptide Sequence Number=SeqID_189274
atgctttcattcatatggtggattgtcgggttctactgggtaactgctggtggccaaagtttgacaagggattcacctcagctttactggctctgtatcacatttcttgctttcgacgtcgtgattgtactcatctgtgtttctgttgcatgtcttattggaatcgcagtttgctgttgtttgccatgcatacttgccattctttatgtagtggcagatccggaaggggcaacgaaggaagagattgaccagttgccaaaatataagtttagaataataaaggaatttaagaaagaaggtgatattgaagaatcttcaagaggaataatgaccgaaactgagagtgagacagccgccgaacatgttattgccttagaagatgcagaatgctgcatctgcctttctgcctatgataatgatgctgagctcagagaacttccttgcaaccaccattttcactgtacatgcatagacaaatggctgctaatcaatgctacctgccctctctgcaagtttaacattttgaggactggcaaccactatcaagaagtttga

SEQ ID NO: 72497 - DNA, 2448 bp, Glycine max
  Peptide Sequence Number=SeqID_189275
atggtgattgtggcaccgatgaagaatgtgaaaatgctgccaaacttggatgcacaggaggaagaagaagcaactgtggtgcgaggttatgccaagaaaggaattataaagtgcattttggaaaccggagaaggcgttaacgttcgagcggttgtgattcgagggatcacggggatggagaagggaagagctgctaaatatgtatgtgaagatgagaaagtgaagagtggctttgatgtggtggtgtggattaacggtctccaacttcaacggcattatgctgagtctgtggtgaatcatgtgaagcatgaattacaggagaagaagaaagaaaatgactctggtgagggaaaaggattctttgtggttctggatgattttcacaatgagaaccacaaggagtggcttgaatcggtgaagaaattgaaggaggtagcagaaacacgtgcatcatctggagggggtgtatttcttgtgattacaaggagtaaagccgtaattgaatttgtggatcagtcatttgatttcgttcacaagtatcggtttgataggtcgtcccattctgagtcacggtttctgtttgagcaaattgcgggcacaagtgtgagtgtaattaaatcagagaccgaagactctttgttagagatgtgtggaggaatccttggagcaatagaaacaatggagaggctggagatgctgttgaaatattacaacgagttcaacctctcttcctggtgtctaaggcaatgctttgcttactctttctttatattctcttcacaagattctgtgaagggtgagaagcttgttagactttggatggtggagggatatctggcacactcttcctcttcttcttctccagtactagaagatttgggccatgaatgtatagaggaattccttcacaggtcaatattcagagttaatgaagatggagaaatatacagcattttcaaagagggagaactggcagagttatgtgttcaccaggttgcacgtgttgattctgaaaaatttaggcatgaaggtgttgccgggttcaattggggacttgaagagtttgagatacctcgatttgtctcgcaacaacttcaacaaacttcctatttgcataggcatctggaggtggatgaatgcacaaatctgatgcacatgccatctgcgttaaggaaactgacttggcttcggtcattgccgcatttcgtgaccagcaaacgcaacagtcttggagaactcattgatctcaatgagcaacatcttgaaggcctcacattgagatggaatcatgatgacaatgacgaccaagatgaaatcatgttaaaacaactggagcctcatcaaaatttgaaacgattatccattataggctatcaaggtaatcaatttccaggttggttgtcatccctcaataatcttgttgagattagtttgtacaaatgctccaaatgccagtctctctccacactgaatcatgtccttgtcaatcttgaaaaactcacactcatgagtttggactctctagagttcataaaagacaatggcagtgaggatctgaggctaaaacaagtacaaatatcggattgcccaaagctcaccagttggtggaagaatccggaaacacacaatactactgtatttactgccatatcagaattggtagtcgaatactgtcccaagctggttagtttgcctctgtttcctatgcttgattatagattggttttagaaagcttcaacatgaaactgttgttgaacaccctaagacacaattctacgggaccagatccttccctctccaaattgaatcatttgacaatgataaatgcggatgagaaacaatatcaacgagaagagaagatgctgaaaaacttaacttctctatcatcacttgacatcaagaactgcaaagctttgaagtttatcaaaggttggaaacatctcaactcacttgagattttgcatattactaactgtactgatattgatctaccaaatgatgaatgggaaggtttgaaaaatctcagtaatctgatcatagaggatatgtcagatctaaagtctcttccagaaggaataaaacaccttaccaatctggataatctagaaatcagaagttgtcccaatttagaggttgtgccaaaggaagttggtgaaggcctcaacgacttcacatttattgttattgatgattgccccaagatagcttcattgcctgaaagcttgatcaacaacttcatagggttgaaaattggaaactgccccttgttggagccttggaacaaaagtagaccaaagcttcccctacaagcatcagacatacaggaggaacaaaatttgacttcaccagattcaaacaaaaccagtaatgaaattcaaaatgtgattcctccaaccaattctcgtccccagtgcaattactgcggtacgtttgcaagcctatactag

SEQ ID NO: 72498 - DNA, 519 bp, Glycine max
  Peptide Sequence Number=SeqID_189276
atggagatcacgattatatccgccgaaaacctttgcatgaacgggaagccactaaaagaccacccatacgtcgtcgttcacacgcagtcatgcaccaaattcttcacaacgaggatgccaacgcaagaagaaggtgggagcaagagcaccaacaacaacccttcatggaacgacaagttcagggtggacgatggagacagcgactgcatcacgctggaggtgcaatgcaagacgtggttcggcgttcgaagcgtgggagctgcgcgaatagcggttgctgattttgcggcggagaaaagcttgcagttgttgagttataggctttgggatgggaagggtcggagaaacggggtcatcaatttctcggtgagggtggtggagaaacctgcggagtctgaatctttgtgttcgatgcatgaggcggaagcacagagaacgattggtggaaatgatgattctagaggaattgttactgggattcctgttttctggaattaccctctcaatattccaagatga

SEQ ID NO: 72499 - DNA, 681 bp, Glycine max
  Peptide Sequence Number=SeqID_189277
atgtcatctcatgggcctcccttgtcacaggttatgcacaaaaggactcccatgaagaatcccggaagatttttttgtgacatgagaattgcagggaatggcaagggaggagactccttaagattctatgatgctaagcttgaggaggcgaaagaaatactaaatcaaatggatgtgaaacatgatgcaactgtatggaaggcactccttgctgcatgtagagtgcatggtaacttacaattcggagagaggacaactacaaatctttttgagttggaacccatgaatgctatgccttatgttatgttgtctaacaagcattctgaagcacgaaaatgggatgatgctgcgaaaatacgaaggttggtgaaatcaaaagtaataacaaaggggcctggatgcagttggattgagatgaactgcagagtgcgtacattcatttctgaagatagaggacatccaagggaagctgagatttattccaagattgatgaaatcgtaagaagaactaaggaagttggttatgttcctgatatgaatttttttttgcatgacatggatagagagggaaaggaggttggtcttgcttatcacagtgagaaattgggattacttgcttctcaaacaagtgcaccaattcggatgtttaagaatgagtttgtggagattgttctgctatga

SEQ ID NO: 72500 - DNA, 138 bp, Glycine max
  Peptide Sequence Number=SeqID_189278
atgactgttgtcattgtcacctccatcaatcatgatcgtggtgacagaaaggatgataatgacagcaatcaagacaacagaggtgattttatcacacccacatctattcatttacctgcccctgatgcctcacgatga

SEQ ID NO: 72501 - DNA, 1755 bp, Glycine max
  Peptide Sequence Number=SeqID_189279
atgggtaatccttctaagcttttcccatttttctttgcattcattgtgtttctgatgcccttagtttccttatcccacaatgacttctctacctttgccataaaaaccgtttcatacctagtttcctttagtgaaaatccaaaccataatggccacatcaccacaagctccaatgaaagagacaaatcacgtctttggaggaaagccttcattggcttaaaaaatactcacgagccatcttcgaatatttctcgagcaatatcccttaatgcaagagagtgttttcctgtggagttaccttctgatgcaataacttctacccgttgttgtccacctaggccatctccttctaatatcatagatttcaaagattttgcttctccaaacgccacgcttcgagtaagaaaacctgctcacatggtagatgaggagtacatagcaaaacttgaaaagggcattgcactcatgaaagcactccctgatgatgacccacgtaatttcattcaacaagcaaaggtccattgcgcttattgtaacggtgcctatcacctacgccatccctttcaggacacaaaactcaacattcacaggtcttggtttttctttccctttcatcgttggtacctttacttctttgagagaactttgggaaaattaattggtgacccaaactttgccctacccttttggaattgggattctgtagaagggatgcaaattccatcatatttcaataaccccaattcgtcgctttatcaccaactccgaaaccaaaaccacttgcccccacacgtggttgatctgaactacaataaacttgatcctaatgatgatacgccttctcatcaacaagtttcgtataatctagccttcatgtacaagcaaatggtgctagcaagtaccaaagaattgttcatgggaagcccttttcgccttggcgataaccctactccgggtatgggctctatagaggctgctcctcataacactgttcatacatgggtgggtgctgctgataagccacaccatgaagacatgggagcattctacacagcagctagagaccccattttctacgctcatcacccgaactcggatcgattgtgggggctatggaagacattggaaggaggaagaaaggactatagtgatgatccagattggctagattctgagttttacttctatgatgagaatgccaattttgttcgtgttaaggtaagagattgccttgatactaaaaaattagggtatgtttacgaagatgttgatcttccatggctgcgaacgccacccacatcgccgaaaagcaagctactgagagaagcgaacaagagtccacttttgagttcaaagccaagcaaatttcctttggttttggattccataacgagtaccgttgttaagaggccgaagaaattgagaagcaaggaagagaaagaacaagaggaggaggttttggtgatagaagggattgagtttggaagtgataaatatgttaagtttgatgttcatattgatgatgatgaagataatttgagtgaaccggatcagacagagtttgtgggaacttttgttaatttgttccatggacaaggccataatatcaacactagttttaaggtagggatatcgaaagtgctggagtgtttagaagctgaagaagatgatgttgtgctggttactttggtgcctaaggttgggaaaggagatgtcatcataggaggcatcaaaattgagtttattccaaagtag

SEQ ID NO: 72502 - DNA, 348 bp, Glycine max
  Peptide Sequence Number=SeqID_189280
gatcgcgcccgcaagacacccagtggacccagagacgtccaacagggcctggggtttccagctttggttacaggcctctacaaatcctacagggcgcccgtccccccatcaagtttatgccatcgtgacctagggatcgtgcccgcaaaacactctgtggacccggagaagtccaacagggtcttggggttgccagctctgattacgggtctctgtcgattctacggggtgcctgtcgcccccagcaaggtcatcaggccccctattaaccaggctttcatcaagaagtactgcgcccccaggcaggcgcagggcgaaacaccacagcagcattgggatggccggtag

SEQ ID NO: 72503 - DNA, 234 bp, Glycine max
  Peptide Sequence Number=SeqID_189281
atgccgatagctctgcaaacccaagtgcaggtgctgaagtcgctggtcaaaccagcgcttccatgcacctttggacgcgccaataagagctgtgatatgcagtcctttgtcgccagtcacagtggcgacatgccacgtgactcgtccctgtcgaaggcgccatcagcactggcgccatgcatggctgaaatggagaggatcgacatagtactaagaagtgagaacccttactaa

SEQ ID NO: 72504 - DNA, 198 bp, Glycine max
  Peptide Sequence Number=SeqID_189282
atgaagacaaagatgccattgaagcagctgaagctcgcggttcctgctcaggaaacccccatcacatctttcctgactgcaagcggaacattccatgatggagatctactcttgaatcagaaagggttgcgtcttatctctgaagaaaaagaatcacggaatctgttatttgcattatcacataccttcaatcagtga

SEQ ID NO: 72505 - DNA, 261 bp, Glycine max
  Peptide Sequence Number=SeqID_189283
atggtggctttgggtgaagtagaaagtgcttgggacattagaaatggctttggaagaaagaaggaagaagaaatggtgtttctcctaagctacacgaaggcaaaggctgaaaacgctcaagtgagaaatggtctcggacacagaaacgtcgcgcacactccagatatcttctcaacaatcccaacgcttcggaccaaatttcacgaagatccaacggttaacaaaggctgggcagtgtttataccgaggcagctcatgtag

SEQ ID NO: 72506 - DNA, 1107 bp, Glycine max
  Peptide Sequence Number=SeqID_189284
atgataggttcgaaccttttcgttctttcacctcctgtgcttgatacacatctagcccaatccatactctcccattgggcccacagtactcattctaacagtgtactttatcaccattctgcatgcatcatttacagattcattttctgtcctttttctttgttttcatttttgggttttgagcacctaaggcttacaatttacctctttgaacagccttcagatggtaaggaactggaatttgacttctcgctggatgaccttgagaccatcaaagtaattggaaaaggcagtggtggtgtggttattcagatgaatatacaagaggatattcgaaaacagattgttcaggaactgaaaataaatcaagcgtcacagtgtccacatgttgtagtttgctatcactcattctatcataacggagtaatatctcttgtgctagaatacatggatcgtggttctctagcagatgtaatcaaacaagttaaaactattctggaaccatatcttgctgtggtttctaagcaggtattgcaaggcctcgtttacctgcacaatgaaaggcatgtaatacatagggacattaaaccatccaatctgttagttaatcacaaaggggaggtgaagattactgattttggtgttagcgccatgctagcaagctcaatgggccaaagggatacatttgttggaacttacaattacatgtcgccagaaagaatcagtgggagtacttatgattatagcagtgacatctggagtttgggtatggtagtgcttgagtgtgccataggacggtttccttatatacagtccgaagatcagcaaagctggcctagtttttatgagcttctggcagcaattgtggaaagccccccaccttctgctccacccgatcagttctccccggagttctgttcatttgtgtcatcctgcatacaaaaggatcctcgggatagattaacatcattgaagcttctggatcatcctttcataaaaaagtttgaagataaagatctagatcttgggattttggcagggttgacaagggtattgtccttattcctatgtatcctcaagtgcgacgaggaactcaaacctaagtag

SEQ ID NO: 72507 - DNA, 1594 bp, Glycine max
  Peptide Sequence Number=SeqID_189285
atggcaattattgagataagagtggtcacactgttgatgtatggtgtaagacgcatggattcccaactgaagatgaatttgcagaatatttctatagaggcagatcatggcgtgaatcaaattcatgtggccagagaaagaggagatgatcacactacaaattctggaacagaaggtatttcttatgctttatccttctcaagtagtaagattcatgcttcttggcagctgccttccaagcttcttagcaattgctgcccttatcagttgttgtatgggagtttacctgacattgacaatatcaaggtttttggatcactttgttatttgtccaccttgacttcacacagatctaagtttgatgcttgggctaggaaatgtgcattcttggggcataaggctggagtgaaaggtttcctagcttatgatgttcacaatagtccaccagacgacactcctcccttgccacttgtttattcatcacctggtccttcaccatccgaaccacctcaacacacacatgagccatctaaccatattcaacctgacacactcacctctagtcctcgacggaaagctaagaagcaaataccagagaaaaacgcaaaagaagagaagaagaaaaggaaaagtggagtcgaggcgctgcagagttgtgaccgtagatcacttccttcatcatttctcttggatgctatgcaagcagaactagatgccttcaactccaaccatacttggactatcattgatcttcctcccaacatcacaccctttgtaaataaatgggtctacaaaataaagaggaaagctgatggatccattgagtgttataaagcccgcttagttgccaaagggtacactcaaactgaaggagtggactactttgatactttttctccggtggcaaagctccatacaattcgcttgttgttggctctagcttccaccaagaattggtatgttcatcaattggacgctaacaatgtttttctccatggagagttgcttgaagatgtctacatgacaatccctcaaggggttgtctctcctggtcccaataaggcttgcaaactcttaaagtcattatatggcctcaaacaaagcaacaggaaatgtatttccttggcctggaagcagctcattctaaacaaggaatctctctgtcaacgccagtattgccttgatttgctctcagattttggtgtcttacgcagcaagcctgcaagcaatcctatggatcctggcacgcaactagctgaagcagatagtccaccttttcctgatgttgcgagttataagaggttagtgggtcggttgttatatctcactactactcatccagatatctctcatgctgtacagcaactgttaggaagtctcacatcgtctgtctcagttcttgagatgcagcttatatatctggggggtgttaggaagtcccacatcgcctgtctcagttcttgggctgtaacttatatatctgttgggcaacttcacttggctgcccttcagagtcttcactgcctcaagggatcccctggaaaaggcttcgcagccttcttcctttcattgcctaatctccaagcttgggatg

SEQ ID NO: 72508 - DNA, 372 bp, Glycine max
  Peptide Sequence Number=SeqID_189286
atggacaaggatgtttattcgccaaccggattacagcgacaccggtgggatagtcgacactcggtagtggtgccggacagcaacattttctacattatagccttgctccgatttattccaccacccccaaagggaccacctacagaactattggtggaacaaaaccatgagattattcagttgtgctacaacagaggcttcgatttcaagttgtatctccctcactaccagtcaaaggagaactggatgcgacactatggagataagtggtccagattcgtcgagagaaaggccaattttgatcccttggctattcttgcacctggacagaaaattttttcccgaatccctcaacccttgtctatcacttaa

SEQ ID NO: 72509 - DNA, 300 bp, Glycine max
  Peptide Sequence Number=SeqID_189287
atgtatggaatcaaacttgtggcagtaataattgcagtgaggtccacggtacaaaaacctagggcttccatcaaactacgtgtagcaagaagcttttgccggaggcaatcggttgtggcgaccaatgcagtagtatgttgcgtccaacaacgaatcggtggaggaaatggaacagtcgacaataaggactttggtgtggctgccaacgtaacaaagttcgccgtcagtggtgcgagggagaatcttgccgtagtagctacaaaggaacttgatagtttgaccgttctcactactcaataa

SEQ ID NO: 72510 - DNA, 429 bp, Glycine max
  Peptide Sequence Number=SeqID_189288
atgttgactatgcccacgaaggttctttcgttcttacgccgctctctcattcgtggtcgccctctccttcaaccgcagtcttacaccgccgtttcattcttacgccgccctctccttcaaccgcaatctcttggaaacaaaaccccccatcacacagtgtctcccaacgccacgaagaagaggaaaagtcacaaagaaagtcatatcaagggcactgatgcttttcgttttgggactgttacttcaaggaacccgatatttttttctcgactgcaggctgaagtgactcagcggttgactagtgcaaaagagtcatcaagtaaacctgcattgcagagtcatgaggatcttgcaaagaaacttcagaatcctgaacctaatgcagacttgctaagtgagagtgcttacagaattaaagctcttatttaa

SEQ ID NO: 72511 - DNA, 567 bp, Glycine max
  Peptide Sequence Number=SeqID_189289
atggacgtggcgtggcgcggcggcgtgccggtggggcaggtggtcaacaccatgcacggcatttcggacagctcgcgcaagatcgtcgacatcgtcagcatcatcgagggcatcgccttccagaccaacatcctggcgctgaacgcggcggtggaagcggcgcgcgccggcgaatccggcaagggcttcgcggtggtggcaggggaagtccgcagcctcgcgcaaaagagcgcgcaagccgccaaggagatcaagggcctgatcgaggactccgtcgagcgcgtcagcgaaggctcggcgcaggccgagcaggcgggcgcgacgatgcaggagatcgtcgatgcggtgcatcgcgtcaccgacatcatcggcgagatctcgcaggcctcgcaggagcagtccagcggcatcgagcaggtcgacagcgccgtgtcgcaaatggacgtgatgacggtgcagaacacggcgctggtgcaggagctgggcggggcggtgctgcaactgggcaaccagtcgggcgcgttgcgcgagaccatccgggtgttccgcctgaccggacagcagtga

SEQ ID NO: 72512 - DNA, 267 bp, Glycine max
  Peptide Sequence Number=SeqID_189290
atgagtgaaatagaggaggtgcaagagcagatgaaggtcgtcatggaggccatgaaagagcaaatggccacaatgatggaagccatgttgagcatgaagaagataatggaggaaagggtgaggtctattgaaggaggaggagattatgcctttgctgacatggtagaactgtgcctagtgcctgacgttgtcatcccttcgaagttcaagccgtcacctggtatactaatctggaaccttcctaagtccattcttggaaagacctaa

SEQ ID NO: 72513 - DNA, 375 bp, Glycine max
  Peptide Sequence Number=SeqID_189291
atggagacatgtccaacagtggaggagttgctacaacagatgatggatcatggccagctcgaggtagtaaacctgtccccttcctctataagaacagcaaggcagtcccatggaggtatgctcctccaaggccaagtgagaggaaggatgataccgccagtattgactctcttttggcaaaatggaagacaaaggagaagaggtgagaggaggcgccatccactagggaataagccatggaagaaggagcttcaccaccaagatgagccttggataagaagctcggaaggatgcttcaatggaggaaaagaaagagggagagaaagagagaggggggagcacgaaattgaaggaagaaaaagggagagaagttaa

SEQ ID NO: 72514 - DNA, 599 bp, Glycine max
  Peptide Sequence Number=SeqID_189292
ggctacacgtcctcaccatcagagggctgcacgccctcgccatcagagggctccatgctctcgccttgagaggactgcacgtcctcgccttcggaggacaacacgtcctcgccttcagagggctacacgtcctcgccttcagagggctacacgccctctccttcagagggctacactccttctccttcagaggactacatgtactcgcctttagaggactacatgtcctcgccttgggagggatgcacgccctcgccttcagaggactacacgtcctcaccttcgaaggactatacgtcctcgctttcagaaggctacatgccctcaccttcagaggactacacttccttgcctttagaggactacacgtcctcaccttcagaggactacacgtcctcctcttcagagggctacacgccctcacctttagaggactacacttcctcgcctttagagggctacacgccctcgccttcagaggactacacgtcctcgccttcaaagggctgaacaccctcaccttcgtagggctacacgccctcgccttcataggactctacatatgcgtctttagagaactcaagctcctctacccttaa

SEQ ID NO: 72515 - DNA, 240 bp, Glycine max
  Peptide Sequence Number=SeqID_189293
tatggcaaagtgattcataagaaagacagctgttctcaaatcgttatgcttggccatgagaagttgacaaagttttcattaaaggtggcagcagcgacagtgcaggtttttggtagtgtgcatgaaggagatagggttgatgtcacccctagtcagagtggtgcgaaggagatgtgcctcgctaaaaatgctttgattgaggaaggaggcaattatggagagtggatgatagccaaatga

SEQ ID NO: 72516 - DNA, 705 bp, Glycine max
  Peptide Sequence Number=SeqID_189294
atgcgctttttcggtagcgcgatgtattttccgcacgtcgacggggcctttacccaatacaaagtggtggacagcgcgcagtgcattccttacggcgccgatcgcgacgacagggtgatggtgttcgctgaaccgctggcggtggcgatccacgcggcgaagcagcccggcgacgtgacggggaaaaagatcttcgtgtccggcgtcggcccgatcggctgcctgctggtggcggcgctgaaagcgctgggcgccgccgaaattgtctgtgccgatctcagcccgcgctgcctggcgatcgccaggcaaatgggggccgatcggtgcctgcatgccgcggacgacgatgttagcggttatcagcaggacaaaggatatttcgacgtcgccttcgaagtggcggggcatccgcagtcgctgcagcgctgcctggagatcacccgcgccaaaggcaccgtggtgcaggtgggcatgggcgccagcttccccgattttccgctgatgttgttgatcgccaaggagttgaacctgctcggatccttccgcttcgtggcggagtttgcgctggcggtggcgtggctggccgacgacgtggtcgatccgctgccgttgctgtcggcggagttcgccagcgggcaactggcgcaggcgctggagtttgccggcgataagcgccaggccgccaaggtgcaattggtgttttag

SEQ ID NO: 72517 - DNA, 366 bp, Glycine max
  Peptide Sequence Number=SeqID_189295
atgggtgatttatttgcgggccagcagcagccccagcaccagccctacggtggcgccgatgcctacgctgtgccagggtttatcccgcacgtagtcgtcggtgcggtgtaccgcttctttggcgcgcgcatagtaggattcgccggtgttcgcccagcgcgcctaaacctcactcagcgcctgctcggcgtgcgacttgatgtcgatgtaggcctgatccgcgcgatcgccggtgtattgcagcacttcctccagcgtctcggtcagcattctcagatcgtcatccagcgtagtttgctcagcatccgtatgtcttgccatagtgagatctccgtggttgaaaaattaagcgttcctacactatag

SEQ ID NO: 72518 - DNA, 801 bp, Glycine max
  Peptide Sequence Number=SeqID_189296
atggtctggcgctggctggcggcgggtgcgcggctggcggtgcgcgagatgcatccgctggccgaggcattggcaggctgcacgcacgcctcgctggtgccgacacagctctggcggctgctggcgcaaccgctgacgggcatgacgctgaaagaggtgctgctcggcggtgcgatgatcccggtggagctgaccgaacgggcggaagcggcggggatccactgctggtgcggctatgggctgaccgaactggcttccacggtgtgcgccaagcgcgccgatgcgcggccgggcgtcggcctgccgctcagcggccgcgaggtaaaactggtggacgaagaggtctggatccgcgccgacagcctggcgctcggctactggtgtcatggccagctgcagccgctggcggatgcacagggctggttcgcgacccgcgatcgcggcgcgatggccgagggggaactgcgcattttgggccggctggacaacctgtttttcagcggcggcgaaggggtgcagccggaggatatcgaacgcgtgttggcggcgcacccgcagatctcgcaggcgtttgtggtgccggcggcggacgtcgagttcggccagcggccggtggcggtaatcgacggcgatccgtcgctgtcgctggcggcgttgctcgcctggtcgcaggacaagctggccaatttccaacgcccggcggcgctgctcccgctgcctgacgagctgaaaaacggcggcatcaagatttcgcgccgccagttgcagcaatgggtggcgcagcgcctctctcaggcataa

SEQ ID NO: 72519 - DNA, 444 bp, Glycine max
  Peptide Sequence Number=SeqID_189297
ggccgtctgttctcctatggcgatgcgcaccgctatcgcctgggcgtcaaccaccaccagatcccggtgaacggcgccaaatgcccgttccacaactaccatcgcgacggcgcgatgcgcgtggacggcaacagcggcaacggcgccacctacgaaccaaacagcttcggcctgttccaggagcagccggacttcagcgagccgccgctgagcattgagggcgcggccgaccactggaatcatcgtgaagacgacgattactacagccagccgcgcgcgctgttcaacctgctgagcgccgaagagcaccagcgcatgttcacccgcatcgccggcgaactatcgcaggtgccggagcaaatccagcgccgtcagatcgagctgttcaccaaggtgcacccggactacggcgccggcgtcgccaaggcgctggggctgaaataa

SEQ ID NO: 72520 - DNA, 297 bp, Glycine max
  Peptide Sequence Number=SeqID_189298
atggaagtaggtaatggaaggaggtcaagaggttctgaaagtaagaaccaaaacataagatcacccagagagaaaaataacttagaaaacattttttctggaaaaaaaaacagtccttttgctaaacgcaagccttgcgctaagcgcatctctgttcatacgctaagtcgcgagtctcacacgcttagtgcccaacccttgcatctgaggctgattcatttcgctaagctagccatggccaagctgagcctaatcgaattcaatctgaattcagctaagcttcaacctgatagctaa

SEQ ID NO: 72521 - DNA, 171 bp, Glycine max
  Peptide Sequence Number=SeqID_189299
atggcaggacatggtagggatcagaaccgtgatgtggagccggcggagtatcggggactcatggctttccgtaagaaccacccgccaaagttcagtggagactatgatctggaaggtgccagaagccattctcttatcctgggttatggagaattcgtccctaacagttaa

SEQ ID NO: 72522 - DNA, 99 bp, Glycine max
  Peptide Sequence Number=SeqID_189300
atggtcatgagtggtggagaaggaggtttgggcctacaaaactcgttcgggcgaaattttgcccgcctaggcaagctggcccaactcagactcgcctgg

SEQ ID NO: 72523 - DNA, 378 bp, Glycine max
  Peptide Sequence Number=SeqID_189301
atgcatatcggggcaagatttcacccataccaccacagggagatgagtacggatcatgcgcaccaccacaactccgatctccccctgccaaagtgtcagttggtctgtgtcgtcatgacatatggatcacacccacaagacacccagtggaccctgagaagtccaacagggccctgggatttccagctctggttacgggcctctgttagtcccataggctacagggtgtccgtcccccccagcaagggatcgtacccacaagacatccagtggacccggagaagtccaacagggccttggggtttccagctctggttacaggcctctgtcaatcctatagggtgcccgtcacccccagcaaggtcatcagacctctaa

SEQ ID NO: 72524 - DNA, 372 bp, Glycine max
  Peptide Sequence Number=SeqID_189302
atggctcccgatcgaactcagctacagaatatggttaagaaggaaagtgagacctttaatgagtatgcacaacggtgtagagacctggcaacacaagtggcccttcccatggtcgaaaggaagatgattacgatgatggtagacaccttgccagtgttttactatgagaagttggtaggctacatgccttctagcttcgcggacttggtatttgctggggaaagaatcgaagtagggttgaaaagagggatgttcgattacgtctcctccgcaagtggcaatgctaggagaatcggaacaactggggcaaaaaggaaggaaggagatacccatgccgtcactttggcgcccgcatgggtcaagcccccgtag

SEQ ID NO: 72525 - DNA, 504 bp, Glycine max
  Peptide Sequence Number=SeqID_189303
atgggcttaatcagcggaaaccagtttggcccattaggggataatgggaaccctaatagagaaaatgaaggtcctataaggaaaaaggtgatttggttgaggaaggtcattaaaccaattgttcgtggccactgtcagattccgctgcgtgttgatcaagctctctatggatccagggctctctatgcttcagttaatggccatgctaacaatcttgccactcaagcagaccaagttgaggttgagttgactatgtatgacgcgatgagggttgtaacgtgggcgctatttgcttgtaaaaaggctctcaattcaataactgtcaaatataagaatggatttgtccaagcattcgatagagacttgaaggataataataccttttacatttattctgatcttgcaaattactccatggttgccagtggctacaatgagatcaattcacgttcgtcgtgtgaagcctggaacgataaagacattcatggtataggtgctaaatga

SEQ ID NO: 72526 - DNA, 297 bp, Glycine max
  Peptide Sequence Number=SeqID_189304
atgtattcgaaagagaagggcaccaatgttcagagcatcgtcggcaagcacatcaacagggttttcacctttgataaggtttttggtccttctacacagcaaatggatctttatgaacaagttgttactccaatagttaatgaagttctagagggatttaattacactatattcgcgtatggtcaaactggtacgggaaaaatctacacaatggaagggaaatgtaaaaaggccaagagtggtcctaatggaaagttgcctctaggagctggagttattcctagggttgtcaagtag

SEQ ID NO: 72527 - DNA, 668 bp, Glycine max
  Peptide Sequence Number=SeqID_189305
atggtttcttatttgtctctctcttcatccctatcgatgagaaaaaagggtgtaaggtgcatgttctacgtctctcaccagacatcctccaagctgttgcggtggacgagtttgcgtgtgggcaagagagcgtcgcaacccagttctcatcttttcaatccctcactcgctggaaaccttaagcgtcaatctctgaaaaacgcgatatccaatccaattcctcatcgccgacctccaccacgcattccactagttcaagcactctcatcaatctccaagtattggatatcccacattgatcacggtggtgccaaagccttcacagcacgagagaaggaggtcttggaaggaggggaaggagtgggagaggaggttgaggtcatggtcagtgagggacatgtgtttgaggtcgaagtcggcgaagcatggcttgccattaatggtcacagaccaaacgcgggggaattgggtgctggcgcgatgcggggacacgacgtagcagtttttgatgaagagctcggtgcggcacactttccaagacattctctggggcttggtccaatagaggggaaagggttcgaccatcgtcaatttggttcatctttggcttcagagatagagaaaatgagagtgagtgaggaaggaggagcaagagtcgcctttgcttt

SEQ ID NO: 72528 - DNA, 201 bp, Glycine max
  Peptide Sequence Number=SeqID_189306
atgttccaaatctttgtcaaaggcaaggagctttggggtcatgttgatggaactgattatgctcctgacaaaactatgcataaggaggcacatgccaaatgggaggtcaaagatgcacaggtcatgacttggatcataagctctgttgagcctaatatcgtcctcaatctcagacccttcaccactgcagcaaagatgtga

SEQ ID NO: 72529 - DNA, 240 bp, Glycine max
  Peptide Sequence Number=SeqID_189307
atggtggttaaagaccttattgataatgataagggtggttggaacctagacctccttaacaacattcttcaccatgaggatgtcgaggaagttcttcgtgtatcagttttgactaatggggatgaagacgcactatggatgatgggcagagatacattgggatatagtgggcggataggttcgatgaacctagaggaattagcgagtggtgactacccgacatttagtgcactcatttag

SEQ ID NO: 72530 - DNA, 972 bp, Glycine max
  Peptide Sequence Number=SeqID_189308
atgtggctaaaaggtattttttatctttttaatgatattcctgttgattttgatcatgtccttaacgtcattgacaacaaaatctctgaagaggataacatcacgttgctagctccgtttgaagatgaggaattttgttgtgtcatgtttcaagtgcaccctgataaagccctagggcatgataggatgaaccctaggttctataggcacttctggaatgtttgtggcaaccatatcattgacacgtgtaaatcttggctagctagtagctctatccctcatgcgttgaatgaaacaaatatctccataatcccaaaatgtgataaacctagaagcatgaaagatctaagacctatctcactttgcaatgcggcttataaggttttatcaaaggttcttgcaaattgccttaaacctttttttcctagcactatttctgaagagcgacgtgcttttgttgaaaatagagccatcattgacaacattctactagcaaatgaaattgtgcattacctgaattgtgagactagaggtcattggatctctatgttccttgagtcagttgttttctcgatcattgtcaacaacgaagaagttggacctactcatccgagtcaaggatcaaggcaagggaatcccttatccctatatctctttcttctttgtgttgagggtctcttgacattgatcaaattaacaaaagcatgggaggaatgtattgagctcaaaaacattatggagattcatggaaatgccttaggtgtaaaggagggtttggggagaggaaagtatccaggcatgcattctttaattggtcgtagcaagaagagcatgtccaattttgctaaagataaaatttggtgcaaaattcagtcatggtctggcagatttctatctagggtaggcaaagaagtcatgataaaagttgtcctccaagccatacaaacttattgtacggaagcgtctctttaa

SEQ ID NO: 72531 - DNA, 138 bp, Glycine max
  Peptide Sequence Number=SeqID_189309
atggcaccagatgcattcaaaatgtgcatggaggcgtgcctcttcctctatcatgtagctgtagcgatagctactgatccatttgagcatcctctgctgatactccatgatcttctcttgaaattggtggttgcaaag

SEQ ID NO: 72532 - DNA, 363 bp, Glycine max
  Peptide Sequence Number=SeqID_189310
atgcctcatatcactacccattcaagcgtacctcttagtgtgatatcactcacatcattatctactacacttactttggacttgcacaattgcacaacccgccgcgatttgtgcaacaattcttcgggcacaatgtcaacgagaggcctactagatttaccttctgtcaggacacgaccgttgaagtttatgaggatgtgggagatttttagtgatgataaggatctcacgtcatccgagattgcctattactgggatgttattagtgaagagatacttgagggagagatgctttcattcgacaaggaacatgattcctcgggagatgagagcgacatttccaaatatatgacttcgccctag

SEQ ID NO: 72533 - DNA, 405 bp, Glycine max
  Peptide Sequence Number=SeqID_189311
atgaggccgagccctggtgcagtgcctctttgcatatgcaagggtaaggctgcgtacaacatccctcccccataccttcgcataacgaagagcctccgggcaatggggtacgaagttttttattgtttatacatcatatccaatactcatctatacctatgcaccatagtatgtgaatttcatatttccattgagacccctgttgaagacagcacccggatttctcatgcatgctggaacttaacctctgagtccaaagcttcaaaaacattagagggaacaggatcagggcaaagctcatccgagacaatgttgtctagaatcttcttgataagtgttgcattaaacattgggcataacacaatgttaacaactagtaacttgaagaaaaattcaatttcgtag

SEQ ID NO: 72534 - DNA, 498 bp, Glycine max
  Peptide Sequence Number=SeqID_189312
atgatgggctgtcagtgccataatgttaatgctgatgttactcatagcatagatggagatttgttagctaattatttttggatgtctgttatgcattgtgggaaatttggagtgatcttaatccaaactgtcgcttattggcaggatatgtacattcgtgttaaacgtagtaagacaacctacttcatcaggtgcaagccatctgataaaattcttgacataaaacagaagttgcaagaacttgttgatcagccagctaataatcaacggttaattctacctgttactggagaagtattagaagactctaagactctggcagatcaaaaggttgaaaatgatgctgtcgttgcactgaccttgagaaaaggtaatgggtatactgttatccttttccttgctgccaatttagtttcctttcttccttcactggttgtgtgcagagtcctattgcctgttgtctatgttgtgcatcaaagatgcataagagatgcatag

SEQ ID NO: 72535 - DNA, 249 bp, Glycine max
  Peptide Sequence Number=SeqID_189313
atggatcaaacatcaagtgggtgtggtgttcgtcagttcaagagttacctattgcacaaacaagaaaaggacttaaacagtgatacgaatgcaatgatgaggtctcaagctgttttttcagaaggatcctttattggttgtcatgacttggaaaacagagttcaccatgacatgaatgttacaatcaaggacttgttgaagcgaatgaccctggaggagaagatatgtagcagaaagaaacacgcatag

SEQ ID NO: 72536 - DNA, 396 bp, Glycine max
  Peptide Sequence Number=SeqID_189314
atggcggtggtgaccctcagaaggatttaccagtctccttttcctcagtggtacaaccccaatgcaacctgcgcgtatcatgggggtaccccgggacattcaacagaacagtttgatcgacttaatgcaatagaggagtgcggacttcagaggccgaagcaattgaaagatgtgataacctctaggaggtttatattgatggcgctacgcgaggtaggcattaatggtagcccgtgtaatgttggggtatgggtacaaacccagaaggggtttaggtcggaacagcgacggcgtggcgagcttggtcgagttcaaagagaaccatggaagcaaggaccacaagtgaaagggactcccttatgtcacatcaacaagagttttgtcagcacgggctag

SEQ ID NO: 72537 - DNA, 330 bp, Glycine max
  Peptide Sequence Number=SeqID_189315
atggcttctacaagtggagatgctactctatcatctccaaaaatcacaaggctagaggcggagatgattaaacttggtgatcaaatgagaagaatgagttatgacaatgaagaaaggatggagagaatgagaaaagagaatgatgagagtttgggaagaatatataggagtagtgaagctttaagtgtgagaattgaaaatatagagcgaaaaagagtgatgatggatatgaagaggatgagagaggatggaggaatgaaagggatagggagagaagaaatcatacaagatatggaggtagacaaagagaggaagggattgagggagtga

SEQ ID NO: 72538 - DNA, 121 bp, Glycine max
  Peptide Sequence Number=SeqID_189316
atggagcctaactgtcatgatatacaaatgcctgacaggtcttccttaaacaaagaaaatgatttgaccacttatggaacttttgtggacgtggaccctcttcataacattgagaaccttg

SEQ ID NO: 72539 - DNA, 459 bp, Glycine max
  Peptide Sequence Number=SeqID_189317
atgttgcctgcggaagaaggttccgcaggttcttccacgaccataaaatgtagcctgcggaaccttcttccgctggatccagcggaagaaccttcttcgccttcttccgccggaacccgcggaagaaccttttcacctttcttccgcaggagcccgtggaagaactccttcttccgctacaatatccaacttccacttccacacgcccggaagaaggttcttctcgcggaagaatcttcgtcttcaacctcaggcaccacacatcactacacatcactaatgtcgtctatcctacggccatttacgcgattcaaacagacacgagctgtggaggagaagaagggaaccaaatttgaaatcgagaagcaaatgaagggtgcaaaggaagaacggaagaagacgaaggaagaagacgaacctttttggaaggagaagaacgaaagcgcgaaagaagaatga

SEQ ID NO: 72540 - DNA, 252 bp, Glycine max
  Peptide Sequence Number=SeqID_189318
atggcatttggtggacctggagctcgcctaggaaagctagagcttcatcctgaacaattagggggcccaggcgagccagaggctggcctgggtgagccaggttccagaaaactccctgaaatgaccctcttgcccctcccttttagtatctttcgtattcttgatcaaacatcgaatgatcatctgtttcgcactgtaactggcgttcaacaccataagtcgactagcaaggatcaaaagatcaacaaatga

SEQ ID NO: 72541 - DNA, 1608 bp, Glycine max
  Peptide Sequence Number=SeqID_189319
atgaccctggcgaagagggcgaacaaggccattatggagcaattgctagcctcattggacgctcggacattcttttcttccttcgctcatcttaaggccagagttgaccctcctcgatcttttgaagctgacgaggatgaagtcgtcaaggttatgcctaacgtgccatcaccttcagtctccttcagttatggggttgaggagtctggctaccgggttgatgttcggttcgagtcgcccttctcccgcagttcccgctcttctttcctccatgcctactacgttgatcccttagctgttcttgctactactcctcctttttctactatcgtgctactacttagtgttggtgtggcgactacaagtgttttagtggacttgcctctttgttcttcagccatgccagtttcagctttgactgtctcattgttggcgatgcttgccttgtcttcttgcacaagtgagaatggacaaagaaaccaggaagctctaaacaaagttgcatctttagagcccgaggttgccaaatgtagggccactgcttggactgtatggagaggccgagtcgtctgggctaaccaccagttattgtctagggttgatgatgttcttgctatgctgttacgcataaggctggatggtgatgaggtatttgaacgttgtaaagacttgttgaaagagaggaatgatttggcaagcagggtggagcacactgttgaagagaaagaagagcatactgcgacaatggtcaagtatgctaaggtgattgctgacctccaagcacagctgaaagaggcacagtccaagataaatgagtctaagcttgaggcgacgaaggagaaggaaacaaacaaaaagcttgagaaggagttgttggtgtttaagaaggaggtcatggagcagcatgagaagggattctacaaagccatcaggcaggtcaagttcttttctaaaggtcctgacttgagtctttttgacccgtttaaggatgtgaagaacaatgaactgcataacgaggaagatattgatgttggggaggaagatgttggtgaagaaaaagatgatggggccaatggctcaccaaggacggaccttgggtttggacgagccatggagattcgtcaaggctcaccaaggacaaaccttgggtgtgatgagccttggagattcatcaaggctcgccaagggaggaccttgggtatgacaagccttgaagactcgttgaggctcaccaagggcggacgttgggttttggtgagccttggagatccgtcgaggctcaccaagggaagaccttggattcgtcaaggctcgccaagggccgaccttgtgtttgacgagccttggagattcgtcgaggctcatcaagattggaccttaggctcaccaagagtgaaccttgggtttgacgagctttggagatctgtcgaggctcaccaagggcggaccttgggtttgacgagccttgaagattcatcaagactcaccaaggctttcgtgcctgtgggtctttccttgcttcacctcagactcgccaccctatgtcgccaggttgaaaggcttgaggctggatattggtattatatcttattgatgcttgaagcttag

SEQ ID NO: 72542 - DNA, 345 bp, Glycine max
  Peptide Sequence Number=SeqID_189320
atgagattggtcgccttgaccttgaagacgatccttaaacttgcaaaacacgtttgggttaaacttgaacatcttcttggacatgctattaagcgacacccaacctatcttccatgtcagcttcatttggaagaagtaaaagaacacgggcatgctgggtcgaatgttgaaaaatggacacaggacctcaaaagccctcaccattgcctaactgttatgatgaagttaggaaggtgccatgtttacatgttgcagcagggcacattgaaaggagttcagcggaagggtcaagttcagaacctcgaacaggcagcgatatacatagaagaagggtggacaacctga

SEQ ID NO: 72543 - DNA, 363 bp, Glycine max
  Peptide Sequence Number=SeqID_189321
atgactgccggcaaaggaaaacccatttttgaagtagttcttactttgggattgccattcaaggtcgctcccgactggcggaaatcatgtgcaagtcatggtgcagctatggggtatattgtttctctaaaatatggtgctctcgtgaatgatttatttttccttgctaaagcatgtttgcctttttatgtgaaaaaacccggtggaccattcggtcctgccaacaaatcttatccggagccccatgaattgcttgtcattcatgcatcctccaccatcgagtctggagccccacgaattgattgtctagcgcagttcgtctatcctccaccctcaaatcttatccagagccccatgaattga

SEQ ID NO: 72544 - DNA, 399 bp, Glycine max
  Peptide Sequence Number=SeqID_189322
atggaacacaaacgagtacttattggtgaagccatcatgcttcattcattagttgaactaccaagaatgtgtaataagtgttttgcctacctaggtgttatatacataacacaccttattgtagaagcaaagcttcatgatgaattaagaatgattcaaagatgttttgatgataacaaaggtgatgacaaaaagctcaaaggtcaatcaaagaatgagttcaagatgttcaagatagaatcaagaaagaatgagttcaagatgttcaagatagaatcaagaacacttcaagattcaaggatcaagcttccaagaatcaagatcaagattcaagattcaagaataaagagaagacttaatcaagataagtatgaaaaggttttttcaaaaactgagtag

SEQ ID NO: 72545 - DNA, 258 bp, Glycine max
  Peptide Sequence Number=SeqID_189323
atgtataatactacaataacccatattcgtctccactacagcggacactggcaaatggtcatcattttgcttaaggaaaaccttgttgtctggttttcttccttgaataacaggccaaacaactactttaaaggaataattaacagtgctttgaaaggacttgatgatactccacaacctaaatccaaggctggtgctaggaggattgttgttaagtattttaatgatgttagaccattggaatcagagagattatag

SEQ ID NO: 72546 - DNA, 308 bp, Glycine max
  Peptide Sequence Number=SeqID_189324
gaagagtttatgagggatccatagtggttcacaacatccctttgttgcatggccaagtcaaggtaggtgttgagcaggttaaagatgcagaggctcccgttcctgtacccactgacgaggcagctgtgtctccagcaaaatctcatgataggccggatcatgaggaaaacaaagtagatgatcatggagatgacaaggaaggaggaactggtgctgtgggtgcttcagatggtccgtggcatcgatggccagcagcggcgatggtggtggaagagccattttgctttttcatcgattcagccatttga

SEQ ID NO: 72547 - DNA, 516 bp, Glycine max
  Peptide Sequence Number=SeqID_189325
atggagataaatgggtgtgagagggtccttaccactgacactcctccacttaaaacagtttgttttggcttagctttggcttctctaatcaacaagggatgtgttctaacattgtgtcttgagtggcagaagccaaatcctttgctaagaagtcaaaattcgaacaagcactattttaagaggggcaataggatacattgtagcagctctaagggttgctctgcgaggaagcaacttgagaggagcaagaatgatccaaacatgttggttatcacatacacatcagagcacaaccattcatggccaactcaaagaaatgctctacctgttatggctgggaactcatcaaacagtatgaaggaagacaatatggaagacaaagagaggcatcacattgagatggatgagggagagtttagtgatggactcccttataagcctagtttgataaatcacagtgctaataaccaagaatctgaggacttctttgttggatacttgatgagttgggcataa

SEQ ID NO: 72548 - DNA, 342 bp, Glycine max
  Peptide Sequence Number=SeqID_189326
atggggatcccttatatcaaaattcttcttggtggtaggtccatacgtggaggccaggcaacatgccccgtgaacgatcaccttggagttttaccccctcaatttgcacaacaattggtatctgagttgattgttcaaccaggttgttctccatcgaagcttgttgttctacattgtgctgaagaccacgacagctcgccttttggttgttcatctgcaccttacctaggtacgttttgtgtacctgtacgtttgactgctagtgtcgctgccattgtcactgttgggttcaaggtacatttgactgccagtgtcgctgccattgtcgctgttgggtttgag

SEQ ID NO: 72549 - DNA, 243 bp, Glycine max
  Peptide Sequence Number=SeqID_189327
atgaaaaagtctcatttgctatacgactcaaagcgcgatagcgagcactggctaccggcgtcacttgcaccgtttccagagatgtcagcgtctttcgatcgacactacgaaaaagtctcattttctatccttaagactcaatggatgatgcaagcagtgactaacgtcgtcacctacaccctatccggagatgttagcatcttccgaccgatactaggaaaaattcttatttgctatccgtaa

SEQ ID NO: 72550 - DNA, 354 bp, Glycine max
  Peptide Sequence Number=SeqID_189328
atgcccttgcggggtaggattgcatcagaaaattatgtagctgatcatttgtctaggctgacgactgatgaggtgactccacaaggacctgggattcaagaagagttttttgatgagaagctatttaacatttcaataaggccatggtttactgagatggctaattttaaagcaattggtgcactccctgatgatctaacctgccaccaaaagaaacaatctcctacgaaggtgaaaaagaggctaagttttgaattgcaaaaagcagtagttgggctaagctcagccgttgggctaagtgcatatccaccgctaagcgcagcttcagcgcgcttagcacaaaggagaatctag

SEQ ID NO: 72551 - DNA, 264 bp, Glycine max
  Peptide Sequence Number=SeqID_189329
atgcaggggaaaaggaaaaggatagaccagaagcctgaaattctagaaaaacgtagaagaagaatgagaagaggaaaagtggagctgaggcactgcagagttgtgaccgtggatgacttccttcgtcatttcccttacttctttagaggcactgaatttcgtgctcttctcttcctctcccttcattcatcttcttctaccttcaagctcttatccatggcttcttatggtagtgagcttcttctagactcatcttctacttga

SEQ ID NO: 72552 - DNA, 1413 bp, Glycine max
  Peptide Sequence Number=SeqID_189330
atggccctggatgcatcaaccttcgaaaccataaccccttcacgcttcatcgccttcacagtacctcatccaacatgttccgattccactctccgagtcgccgtgctcgactcgccgctccaacccactgactcaccccgagtcggcgccatgttggtccccgaaggccgtgaaaccgattggatcttctccaccgaatcgggccatctccaactcctcttcagctcccctggaatttcacgtttgattctcataggaaccctcttcaaagaaggtactttaactcttcttcaatcacgtgcttatcaccgttccttggagtgttcattgcagcatcagggttttgaggtttggtcaaagcctcttcttttggctttgtctcctaaatctttgttcaaaaggggcattcctgagataccccttttgagttatgaggatagtttggtttctagtgtggtggttcatgaatgtgttgggtgtcatgttggtgaaatgttggttgaggatgttgaaattgaaaatgagagtgatcatgggagggagtttaggaggaggttgaggtttaagagaatgcctaatttgattcaaactgaaatttgtattattcctgagagagattgtgatggtgtgtgcattggtggtgatgtggggtttgtgcctgatcttaaggttttggtgcacccttacttggggcctatggtggctggtcttgtgttgaatagtgaatatgtggaggggcggattcggatggggtttaggccgaaggctttgtgccttggggttggaggtggggctttgatgacctttttgagaaatcaattgggttttgaggtcatgggtgtggatagtgatagggaggttttgagggtggcaaggaagtattttggattggaagaatgtgagtttgtccgtgttgttgttggggatgcctttgaatcgatgaacaagcttgtgtgtggtggaaaattgaatggtcggaggagttcttttgatgattgtgaggttaatggttttggtggtcacttagtggtggaggatgaggtcaactgtaaatttgacgttgttatggttgatttagattcgagcgacgtgaggaacggtgtaagatctccgccgttggaattcattagaaaggatgttcttcttgctgctaaattagttctttgtgagtttgggattcttgccattaatgtcattcctcctagcaggtccttctacgacaacttggtgagtcattttcaggaagtttttcatgagctgtacaagatagatgtagggaatggtgaaaattttgttcttattgccacagcttcacctctggtgttttcagttgaggattgtggtaattcttttcttatgcgactgaaatcagttattccggaagcattcataaattccataacaaagatataa

SEQ ID NO: 72553 - DNA, 195 bp, Glycine max
  Peptide Sequence Number=SeqID_189331
atgttgcttcaacaagcaagcattgcttcaagattcattcaagatcagcttttgcttcaaaacacactgtttccaacatatcatgtctctggtaattggaaaagaggattagagtcatcccttgaagaatttgagtcaagaagcaaggggccaaccaccttaagagctattggactaagaagcactctaaattga

SEQ ID NO: 72554 - DNA, 192 bp, Glycine max
  Peptide Sequence Number=SeqID_189332
atgtctttagttggacctcgcccggatattcccgggtattatgataaacttgaaggagaaaatcgttttgttctgcttcttaaacctgggcttaccagtgaagcaggaattaaatatcggaatgaagaacaaatacttgcccagcagaaaaatcctttacaatataatgatgagattttatttccggataaa

SEQ ID NO: 72555 - DNA, 369 bp, Glycine max
  Peptide Sequence Number=SeqID_189333
atgacacttcactcaatattcctgttggtcaaaaccatccaccgatcagaatcctttgtagcctttggatccctctctttccgatgtgatttgtttgggtgttacatggtggtagtgataatgacgatgacagtgacaataacaataatgatggtaacaatgttagtggtgatagttatggtggggacgatgatggtggtggtggtggtagcagaagtggcagtcagttatgatggtggcgggggtgtggtggtggtaatgatagatgtgatattggtggtgatgacggtgacaatgatggtgatgatggtagcaatggtgacaacaaaaagaattattgtcaaatgtaggaaacttatgtttttttaa

SEQ ID NO: 72556 - DNA, 210 bp, Glycine max
  Peptide Sequence Number=SeqID_189334
atggatacctcaaagccctacactggggcaatgaggggcaccatgcataaacctcaagtgaacctaggggcagatcagaaattctcacccaataggttccctgctataagaacattctacatcggttctaaaaccgatgttgaaagtgacgatgttgaatgtatgaatgttaacatcggttttggagaaccgatgctaacatacatatga

SEQ ID NO: 72557 - DNA, 156 bp, Glycine max
  Peptide Sequence Number=SeqID_189335
atggctaacgtcgtcacctgtacccttcccgaagatcaagcagtgactaacgtcgtcacctgcacccttccggagatgtcagcgtcttccgatcgacactacgaaaaagtctcatctggtatccgtaagaatcaaagcacggacagcaagcagtga

SEQ ID NO: 72558 - DNA, 132 bp, Glycine max
  Peptide Sequence Number=SeqID_189336
atgccttgcaaatatcaattcgaatctaggtccttcaagagcattttggaagttgggttgcttaaagaggaagcaactgggcagcaagctcctccacgttttgttgaaaaatggttttcgggacttccgtaa

SEQ ID NO: 72559 - DNA, 216 bp, Glycine max
  Peptide Sequence Number=SeqID_189337
atgaaggggccgaagaaggttgggagtgaagcacattggaaaactaatagtagatttcaagaagggtcagcctctgaagaatttcgtccattttggtggacatggtttgatcggagatattctgctataattctagaagatacaattctaacggattttggcattgtgtgccttggagaaattcaatttgcactactagcaggggacaacccataa

SEQ ID NO: 72560 - DNA, 252 bp, Glycine max
  Peptide Sequence Number=SeqID_189338
atggtgaagatggttccaaattcgcactgggaggcaatgagaaaccagtgtttggatgaggttgtgaattcggcaactacgatgaccagtgtcttgtcgccaacggttccgcatgacaagctcttggaacatggagacatgacactgtttgagaggggagttgagtcctatgggtttgccatggttgcaagcaagtgccaactagctatttttgcgctatggatggctgctaaaccaagtgagttgcgctga

SEQ ID NO: 72561 - DNA, 804 bp, Glycine max
  Peptide Sequence Number=SeqID_189339
atgatgattcaccaagatgttttgatgatgccaaagttgagttgtttcaagattaaagaatcaagcattcaagattccactcaaagattcaagaatcaaatgaagaaatcaagaagcatcaagccaagtcaaagtagtgaacacaagggagggtacatcctttgtggttcgcttcaaatagagtgtacatctacttggttgttcaaagagaacaagggagggtacatcctttgtggctctttgcttgagtttgaagacacacttggttacatagctaagattttctcccaagctgaaccttatggcatatgtaggattttccctccaccttgttgggtaccacctcgccctcttcaggagaaagatttatgggaaaatgcaaaatttcccactcgtattcagcaaatttacatgcttcagaacaggaaacccacgagaaagaaaattaggggaaggaaacaaaaacgtagaaagcagtcaaagatgggcatgggtacgagaactcccaaatcagattgctactttggattgaatgatgccaatgaatatgaaaagttagtgatagtagtcaccaacagagatggaaaccctatgtggaggaaattgaaggtgtattatggagctgacttggaaactggatcacttggaagtggttttcctaagacatcatccttaactaagaatgagtcagatagatatgccctgtctagttggaatttgaataacttctcgcgactgccaggttctaccttatgttttgaaggaagtcatatctcaggagttgtagcaagaaaaaaagtttaa

SEQ ID NO: 72562 - DNA, 477 bp, Glycine max
  Peptide Sequence Number=SeqID_189340
atgaatgatgaccctttatgtctcgtcaaacacagttccaggccaagggaagagcaatatctggcaaagtgggcctcatcaaggcttcatgatggcgacagtttggaacagatggtggatccagcaatcaaaaggacgttttcctccaaggctctctctcggtatgctgatatcatctccctctgcattcaggtgtgtaggatagcacatcattcatttctcagttatatgttcgttcgctcaatctttttttctgggggtgttgcaatgaaactgaacatgtctctcgtgcagcctgtaaaggaatttcgacctccaatgtctgaaatcgtggactctcttgtatcgttttctcaaaagctcgtttcaaagagtggtgcagcagatggcactgaacttgatccacttgagaggtcttttcgcactaccacctcgcgctttatcggttcacccgcattgagctatgtatctgcctga

SEQ ID NO: 72563 - DNA, 219 bp, Glycine max
  Peptide Sequence Number=SeqID_189341
atggaagattatggtgtctgtccaagcgttgatgagtatgacaagttaatacagtctctgtggttggaggctttggattgggaaatggcagaaaaactacaggaggaaatgaaagagagtggtttgcgtctcaagagcatcacaaggggtttgattagagctgtcaaagagacagacaaggaggttgtggaggctgaaagcattactgtagtggcataa

SEQ ID NO: 72564 - DNA, 176 bp, Glycine max
  Peptide Sequence Number=SeqID_189342
atgtgtagctcatcccttatctctaagcagactcatgcttctgagattgaaattagggatacaggatacagttcacctgaccatggccaaccggcaattggcagcacgaagagtgataccttttcctttggagtgttgcttctcgaactattaacaggaagaaaaccattcgacgg

SEQ ID NO: 72565 - DNA, 906 bp, Glycine max
  Peptide Sequence Number=SeqID_189343
atggatgaatcaccggcgaacagggagggcaaaaacagagcacagggaaacgaggaacaagaagatgatgactacatgggtgacctttctcagtttcttccttccgatgctctcttccctcccaagttgttttcatccaaaaaggtgacttcttccttccccgttttacccttgaaggatttttactcgcttaaagagagtactatacacagtgatgataactccctttataccgtgcagatttccagcaagaaagatccttcagtcaattcttccaagaaccggttgaaaactcatagctggcaagaacggagaaaacttgaaagagaaaggaagcaacaagaagaggatgagcaaacattagcgaaagttgaagctccaatagcacaatccaacattgggtttaagcttctcaaacagatgggttacactccaggttctgcgcttggcaagcagggctcgggcagggccgaaccagtggggattgaaattcgacggtcacgagctggtgtaggcttagaagatccccacaaggagaagaggaaaaatgagggaatcatgatggacaggaaaaggaggaaagaggaggacctaatgaaagaatttgggtccaggcaaaagtcacagtggcagagtaggagagttataattaattacaataaggcaaaggctgcccttgatcaattggagaatagggaaattgtggagccacaaaagaatgacgatgacgcagagggtgaagaagaagaagaggaagaaataactgaagaggacttgcacgatgttttgatgaaactgagggatgaatttaattattgcctcttttgtggatgccaaataggaggttgcctcatcttcatccatgccgaattgccgagggacatggcagcctgtcctctttcatga

SEQ ID NO: 72566 - DNA, 1506 bp, Glycine max
  Peptide Sequence Number=SeqID_189344
atggttcgcaactatgtgttcgtgaatcttgtcctcgtccttgtcttctcggcaactttggtttctcggtgtttcgcgtttacggatcctcctgacgtcacagctctgcaggatctatacagggccttaaacagcccaccagtgctgaatggatggaacggtaacgatccttgtgaggaatcttggactggagtagcatgttctggctcatcaattatacacctcaaaattcgtggattaaaccttaccgggtatcttggaggcttgctcaataatctacaaaacttgaagcaactagatgtcagttctaacaacataatgggtgaaataccactggctttacccccaaatgccacacatatgttcctgcagaataacagattcaccggatcagtcacctacctggctgagcttccactcattgatttgaacattcaagataatctgttcagtggcattcttccacagccttttcagtccataccaaacttatggattggagggaacaagttccatgcattagacgactctcctgcctgggcatttcctttggacaatgtacccattgagcaaaacactagtcgcccaccgataactcagacgaatgccgtcgagaactacgatcctcctaaagtaaggaagcaaaagaagaaacgtatgggtccaggaggaatagctttcattgttggtgcaggaacattattggtgacaggttttgcgctcttcattgcgatccgtttgaataagctccatagacagagaatggaggactatgaaagcaaccatagttcattgcctacaaagaggcatatagatgacgtctctacaacggcagtagatgagagtctgcagatcccaccttacaatgctgcatcccttttgggtccaaggcgattaacttcccagatccataaaagagcagcaggtgaaacatcaagaaaaagcttttccggaagagacagattcactggaaggacaaaggtttatacaatagctgaggttcagttggttacaaacagtttccatgaagacaaccttctgggagaggggtcactaggccctctttacagagctgaatttccagataacaaggttttagcagtgaagaatatcaacatggctggcatgtctttcagtgaagaggaaaagttcttagacgtcgtttgtaccgcttcccgtctgaagcaccctaacattgtttcacttaaaggctactgcttggagcatgggcagcatcttcttgtctatgactatgtcagaaatttaactctagatgatgctcttcattgtgccgcgtacaaacctttatcgtggagcacacgtctcaaaattgctttaggtgttggtcaggccctggactatttgcactcgacattctctcctcctgtctcccatggaaacttaaaggctaccaatgttctactggacgaaaatctcatgcctcgtcttactgactgtggcttggctattttgagaccgctgacaaatgacaaagtcaaaaatcgg

SEQ ID NO: 72567 - DNA, 215 bp, Glycine max
  Peptide Sequence Number=SeqID_189345
atggccaccacaccccccgttttgttgaaaaatgggattccggggcttccgggacacccctgggttgcttctggaagcaacccagctcgcctgagcgagctaaggtcgcctgggcgagctggccgaggtgcttccgtaacgcttccgagatgtttccgtaagcaaatccgtgaaggttttcgtccgttcttcatccgttcttcgttcttcaacgg

SEQ ID NO: 72568 - DNA, 1098 bp, Glycine max
  Peptide Sequence Number=SeqID_189346
atgggtttcgagttcgaattctccgcccggttcgggtgctccggttcggccgggtccggttcgatgagctcggccgacgagctgttcctcaacggtcagatccggcccatgaagctctccagccacctcgaacggccgcaggtcctggctcccctattggatctggaaggaaatgaagacgaggaggacgaggaagtagtagaagaaggcgttaacgttaacgttagcgttgtccgaggaagagatctgaggctgagggacaagtcggttcgcaggagaaccagatccatgtcccctctccggagcaacacgcccctagagtgggccgagaacgaggaggatcacgaccaaaacgtgaccaagcccaacaaaaccaacatgattagttcctccgaagcagagaaagtagaggatggttttggtttggagacaacaccttcggcctcgtcctcacgctcttcctccgccgggagaagctcgaagcggtgggttttcttgaaggactttctccgaagcaaaagcgaagggaggagtaacaacaagttctggtccaccatttccttctcaccaaccaaagacaagaaaaaccaaaatccaccaaacaccaacaaaaacgtggcttcttctgaaaccacgcagaaacccaagggaagtagtagttctcagacttgggccaggagaataagtgggaagcccacgaacggtgttgggaagaggcgcgtgccagcctcgccgcacgagttgcactataaagcaaaccgggcccaagcagaggagttgaggaaaaagaccttcctcccttacaggcagggtctacttggatgcttgggatttagttctaagggttatggggccatcaatggctttgctagagccttaaaccccgtttcctccagcttagtcttagccttaagaattaagatcaccccatgttcaaggggttcgttttacgagggttctggttctggttcttgttcttccctctccatccttcttgttgaggatgcggaactgataaaagtattattatgtacaatataccaagtcatgtactcgtactcgcagcattttgctatttacacagttgctgtgcagtga

SEQ ID NO: 72569 - DNA, 956 bp, Glycine max
  Peptide Sequence Number=SeqID_189347
ccttcagaggactacacgtcctcgccttgagagggctacaagcccgcacctttaaaggacaacacgtcctcgcctttagagggctacatgccctcgctttcagaggactacacgtcctcaccttcaaagggctgcatgccctcgccttcagaggactacacgtcctcaccttcagagggctatacgctctcaccttcagaggactacatgtcctcgccttcagaaggttgcacgccctcacctttagaggaatgcacgtcctcaccttcagagggctatgcaccctcaccttcagaggactacacgtccacgccttcacagggctacacgccctcgccttcagaggactacaggtcctcgccttcagaggactacacgtcctcgccttcagaggactacacgtcctcgccttcagaggactacacgtcctcaccttcagaggactacacgtcctcaccttcagaaggctacacgctttcaccttcagaggagtacacgtcctcgccttcaagggttgcacaccctcaccttcagaggactacacgtcctctccttcagcgggctacacaccctcaccttcagaggactacacgtcctcgccttcacagggctacacgccctcgccttcagaggactacacgtcctccccttcagaggactacacgtcctcgccttcagagggttgcacgccttcacacgtccttgcctttagagggttgcacatcctcgctttcagagggctccacatctgtgcctttagaggacttaaggtaagtatgcacgtggctcaactgatttctgatgccattcattattgtagggatcacgcccataagacaccaaatggacctggaggagcccaacagggccctggggtttccagctctggttacgggcctctatcagtcctacagggtgcccgtcccccccagcaaggtcatgccattgtgacatag

SEQ ID NO: 72570 - DNA, 147 bp, Glycine max
  Peptide Sequence Number=SeqID_189348
atggagcttgcatcatacatcatgagggatcccaagcggagatgggtgactcgctccatacattcgttgtttttagagaaagataaaagactcgatgccaacaacgaagattggatggaaaagttgcgacgagcactaaggagttga

SEQ ID NO: 72571 - DNA, 1533 bp, Glycine max
  Peptide Sequence Number=SeqID_189349
atgagaatgttttgcggaggtgtggagggtctgtcaaacttgttgatgtttctagtgagctttcacaacttattcgtcagccaggtctcaagagatggaagtgaattctttctaatcaaatttctgctatttgatatgttggatgtccgtcaagttataccaacattcatgtccatgatatatgacaagggcacttggttggtctcttataaagatgttcctaagtatcgtagaagtgtaattctttccagtatgtttccttctggcagaggtcatcatgatcttgttgatagtagttgtagtgttgacccagagggcattactaatggtattaacggaaatgctggagatggtgttcaagcagcagagaatcctgtgatgtccgagtctgccgcggaagtttgtgatttccctctagagcattgcatgaggatactgcctcatgatcagaacactggagccttcttcattgctgtactgcaaaaagtttctcctctgccagcaattacagaacaaaccaaaaaaaagattgacgagcaatatgtagaacaatcaaaccagagtcttaatgatgcacaagtaccacagattacttcaccagaaagtacacatgaagaagtcttgaatgctgtgtcagaggaaaatgtagatgacaatgaacccattaccgaagatttggaagttggtcctgttacatgtgaagaacagaattccaaggaaactcgagagcccgataatgtacaaaacacaacaaagagggttccaggtaaaagaaagctacaaattcaaggcaaatggaggggtgttgaccctgttgtttttttcaaagatgaaacaattattaatagtataaaggatttctatggaattgatgagcgttttcctttcaacggtcaccttgttacaagaaacagtgatacaaatcatgtgaaaagaatttattatatctccaagtcagtcaaggatgttcttgagttgaacttcaaagttgggcagcaacttaaaataacatcaattggcatgaagatgtttgaaagacaaacagcgcgagaaggtagctctgcaccatgtgctttccggatatcatctgaaggattgccccttattctcccatacataaccaaacagattctgcatgcatctccctcagacttcaagcatcttctgcagaacaaagaagtaaagtttgaagattttactgatgccgagtttggtgaaaaggcagcaaacctattgccaggctgttgtgtggtaattatgtgtatagggaaaacagttgttgcagagtctctccaagtggatgagtcaacgatagccattggatgctggaagggtagggcgagattgtcagtgatggttactgcaatggactgccaagaactactggaaaggcttttaatacgttttgacactgaaaagggctcctctgggcatttggacaattcctctaatgatgtggaagaagttcagcctgtgcaagagttgaacaggaaaaatgatgacgatgatgtgaaagctactgagttaaagtga

SEQ ID NO: 72572 - DNA, 702 bp, Glycine max
  Peptide Sequence Number=SeqID_189350
atgttgaggagactgagtagcatttcatggatggctcaaactggtacagctggagtagaatgtgttaaagatgcatcaactgcactcccggaggagacagcttgtggttcttttggaagaacattcttaaaaaaaattgcttgtgggggcaattgcccccataatgctgtgagtgcatctgccactgcttgtagaccagaaaaagttgatgctattgtaaattgctatgaggaggatgaaactaaggagcagaaggcaagagttttatctagaggagggtgcatagcttggttaggttttgtgtttgggattccatcttggttggagttggaagttgattatgcatgcacaccagaagaagtgcagcaacactttcagtcctgtggtactgtaaacagggtcactatcctgactgacaagtttggccagcctaaaggttttgcttatgtggaatttgttgaagctgaggctgttcaagaggctctcctgttaaatgaatctgaattgcatggccgtcaattgaaggttttgcctaagaggaccaatgttcctggaatgaaacaatatcgtcctaggcgctttaatccttacatggcatatggcttcaggaggccatatactcctccttacttttactccccttatggatacgggaaggttcctaggtttcgaaggccaaatcgttacatgccgtaccactag

SEQ ID NO: 72573 - DNA, 951 bp, Glycine max
  Peptide Sequence Number=SeqID_189351
atgctactcacgtgttaccaccaccccttccctcattcgttttcttcaacctcaacccattcactctgcaccacaaatagaaactgcaacctgtctctctctttctccatcgtaacctcgcgtcctctccacctcacaacgcaaaaccttaacctcactgctcaacgcttcaattccctcaccgtccgcgccgactcattttgcctccgatccgaacatgtcgccgtcgccggcgtttccaatttcgactctctcctttcgctgctcgagttctcgtgcctgctctcttccgccgtagcgtccgctgctgccgccgtggtcgcgggttccaagaacgagctcctcgtggggatcggtaccagagctgctccgttcggcggtgcgttgcttgtggtcggggttctagtcggcgcgtggattcggaggcggcagtggaggcgcgcgtgtgtggagactgggaagggcgggttggaggtgaacttgttggagaggattgagaagttggaggaggatatgaggagttccgcgacggttgttagggttttgtcgagacagctcgagaaattgggggttaggtttagggttacaaggaaggcattgaaggatcccatcgctgagactgcagctttggcccagaagaattctgaggctgctagagcattagcagtgcaatcagacattttggagaaggaacttggtgaaattcaacaggttttactagcaatgcaggaacaacagcgaaaacaacttgatctgattcttgcaattgggaaggctagtaagctatgggaaagcaagcacgaaaccagtgaacgacatgatacattagaaatgtctaattcagccgaggatgagtacctcaaatttgctgtggatacaggtgagaagagattacacgacagtcaagacaaactaatgtgggggcatttgttgaactctgtccagttatag

SEQ ID NO: 72574 - DNA, 174 bp, Glycine max
  Peptide Sequence Number=SeqID_189352
atgacccacatatcagatattaaacggataagaacagatactacatttgatcttagccaaaaggccgagaaagtccttaggacagtatttgtttggtcgaccagcaaccatccaagtctaacaaataccacggataatggatgccatcatccacaattaatgaagttgggatag

SEQ ID NO: 72575 - DNA, 768 bp, Glycine max
  Peptide Sequence Number=SeqID_189353
atggagagtgaaagcaagcaagttaagcagaagctgggggtcttggatatcctcaaggaagctgtaacattttatgccagcaacatcaacttcatcatcttcacctttctcacttcccttcctttcttttttgtcatggtttactttgaaactttgttccagcaaactatggttgagaccccagaaattatatcacttctaccttttaaggaacaaaattatctatattaccattttgcatatcatcctcacatttatggggtcgtcgacacacctggtaaaagttttagtgaggattatttgcctgttttgattcaacttggattcatttacttggtgcctcttcatgttctagggctctgctctgcggttgtaactatggattcggcttcaaagctgcgctcagaagagaataacattagtctcaaggatattaatttgctatgtagcacttgcaaagctattgatgttgtggatggtatatatgctattggggctttgcgagtttcgtattacctcagcactggtaatcagaagagaggactacttttgatgcttgttttcttcgctttgggactttgtttaaggttgtcatgtgtctcccttgaatgctataaaggagggtacgggatatttgtacaaattgggctcctcactgtgttaaatacactgaaatgggtgtcgtgcatgatttacttttctgattgcaaggagaggaaaatggagaagaaagttgatgaggaatcaggaaaagatcttgcaaaatga

SEQ ID NO: 72576 - DNA, 1023 bp, Glycine max
  Peptide Sequence Number=SeqID_189354
atggcttcttctacactcgctcccactctcagcctctccaccaaatcccactgctatctccccaacaccaaacaccggttttcatgtcccagaataaagttattctactccaagcaccgctccttctccgtctcagcttctgcttctgcttccacttcaaattcgcttcaggctctcatattcgactgcgacggcgtgatcctcgagtctgagcacctgcatcgccaagcctacaacgatgcctttgttcacttcaacgttcgctgcccctcttcttcttctccgggcccactcaactgggacgttcaattctacgacgaactccagaacctcattggtggaggcaaacccaaaatgcgatggtactttaaggaacacgggtggcctaagtccacgttgttcgagacgcctcccactaatgatgaggatcgggccaagttgattgacactcttcaggattggaagactgagagatacaaagaaataatcaagtcaggaactgtaaaacccagacctggagttctgagattgatggatgaggccagagatgcagggaaaaagctagctgtttgctccgcagcgactaaaagttcagttattctctgtcttgaaaaccttataggaattgagcgctttcaaggccttgattgcttccttgctggtgatgatgtgaaggaaaagaagcctagcccatcaatatacgtgacagcttccaagaagctaggtatatcagagaaagactgcttggttgtagaggatagtgttattggattgcaggcagcaacacaagcagggatgtcatgcgtggttacctacacaccttccacagcagaacaggatttcaaagaagccatagcaatctaccctgacttgagtaacgtaaggtataaggcattgctaacaactgaagctgccctgcagtggtttctatcaggaaaatggattgaaatatttgatgtttatcacaagatatttcctttgacaattcattatgttcaatgcaagaaaattgcgatattttag

SEQ ID NO: 72577 - DNA, 540 bp, Glycine max
  Peptide Sequence Number=SeqID_189355
atggctatgactgtggaggctcagttccatgttttggctgttgatgacagtattattgacagaatgctgattgagaggctcctaaaaacctcttcctttcatgttactacactggactctgccactaaggccttaaaatttcttggtttggttgaagatgagttgcggacttttgacactactgttgcatcagaaattcatcaggatgtagatgtaaacttgattataacagattactgcatgccaggactgactggctatgatctgctgagaaaaatcaaggaatctaaatctcttaaaaacataccagttgtgattatgtcctcagagaatgtaccatcaaggatcaacagatgcttggaagagggtgcagaagaattctttctgaaaccagttcaacaggcagatgtgaacaagctgaaacctcacttgatgaaatcaagagctaaggaagagcaagaccagcccttcaataacaaaaggaaggacatgaaggaaatccactccccaaataaaaccaggataaaatgtagcagttaa

SEQ ID NO: 72578 - DNA, 231 bp, Glycine max
  Peptide Sequence Number=SeqID_189356
atgagcagtagtacaagcaggtcacccagcccagtgatgactgcggagcagttggcttctctatttgttactggtggggaaaaacaattgaaaattacatgcaaacagggaagagttaatgaggcaatacaagataacaacagaatagcacactcccactttgtctgtgatcttgcaacatcacatgctgtattgacaacgacaaatgaagctaatgagatgtttgtttga

SEQ ID NO: 72579 - DNA, 1454 bp, Glycine max
  Peptide Sequence Number=SeqID_189357
atggttttcttgacactttcagtgacggcattcaaacacaaactcctctttttcttggcactttatgttcttgccatcggcgacggaggtcacaaaccctgtgttcagacctttgccgccgatcaattcgacgaggacacaccggaggagaaggatgccaagagctcattcttcaactggtggtacttggggattgtggctggctcaactgcttctgtctttgttgtcatatatcttcaggacaatgttgggtggggagtggggttgggagtgctggcaggggtgttggctttggcattggcactcttcttgttgggaatcaaaaggtacagaaaggaaggccctgcagggagcccattcaccaggttggcccaagtcttcgttgcggcgtggcgcaagtggcgcgtgcaggccacgcacggccactacaactttttccatgacgaggatgaggagcatcatgagccccatcatcatctccatgttcaacccaaaatccacactctcctccatactcatcaatatagtggagggaatgatgttggagttgtggtgggaagagcaaagtttttggacaaagcagcaatcatagatgaaattgatgcagaaagcaagacaagagacccttggaggctatgttcattgacacaagttgaggaagtgaagcttgtccttcgtttgattccaatatggctaagttgcttaatgttcactgttgtacaatctcaagtgcacacatttttcatcaagcaaggtgccacaatggaacgttccatagggccacatttccaagtccctccagcatcactccaaggcctagttggagtcacaatcctctttgctgttccattctatgaccgtgtctttgttccactagcaagaaaaatcacaggtaaacccactgggataacagtgctacaaagaattggtgttggactttttttgtcaatccttaacatggttgtgtcagcacttgtggaggacaaaagggttggtgttgcaaaagagtttggcctaattgatgacccaaaagccgtgttaccaatcagcatttggtggctgcttcctcagtacatgatcactgggatctctgatgcattcacaattgtggggctacaagagttgttctatgaccaaatgcctgagtcacttaggagtttgggggctgcagcatacataagcattgttggggttggaagctttgttggcaacattgttataattgttgtggaggctgtcacatcaagagctggtgatggtgagaaatggcttggaaacaacctcaatagggcacaccttgattacttctattgggtcttggcagggttgagtgctgttaatttgtgtgtttatgtgtggcttgccattgcttatgtgtacaaaaaagttgatgagggtcatcgaactagtagtgaccaacagggttctggccacaagaaatacaaacctggagt

SEQ ID NO: 72580 - DNA, 267 bp, Glycine max
  Peptide Sequence Number=SeqID_189358
atggttgaggtgcacatggatgacgatgccatagagtttgttcatcgtcagaagcaaaaggagggatctttggtggagatagctgatctgttagaggcccttggtcggttattggatatttcaatactattctccaaaaccaagaccgtagtgaagattctgataatccttcatggagaggtgctcatgattttcaggaaaggatatcagaaactgagcttattgatgatgcagggttctagggtccaactttcacttggaagaaag

SEQ ID NO: 72581 - DNA, 234 bp, Glycine max
  Peptide Sequence Number=SeqID_189359
atgtggcaatgggtggtgtttggcaatgtagacggtacgattagacatggcaagaaaattcgtatttatgggtacccgtccgaatctgtctcgactttgacaagtaatatcagagttgaccgggtatggattcgggttcgggtttttcctgataatcaaaagtcgggtatgagtacgagtatgagattattacatccgccccgaccccgaaactggatccgccccgccacttaa

SEQ ID NO: 72582 - DNA, 438 bp, Glycine max
  Peptide Sequence Number=SeqID_189360
atgatactaaggtgtgacaacattttagagaaaaatatacgtagtggaacaactgatgctgtcaatttgaaggagacaaacattccggcagccattgactctatttcagtggctgagggccttccgtcccctggttttcatgataaatgtaataatgagaaaagttctgatgttaatttaaatgaacaaattgggaggattcgtgaagctttgccaaatgaagatttaaaaattgcagagcaaccagtcttggagttaaacacatcaatttctgatacttcaatggaggacaaacgggaaactgatgcacttgaacttgatgagatgaaaatggaatatgattccactgctgcaaaacatttattgccagatgttataatgaaagataaaaggcttagtgaagtgagcactgcctcaggtgccccactcattgactaa

SEQ ID NO: 72583 - DNA, 1840 bp, Glycine max
  Peptide Sequence Number=SeqID_189361
atggaaatacagctaaaagacatccatgtgagtagtgcaaatagcaactcggcagcaagtttgtctatctcccaatattcttctcttgtcaacaacacagatctcaaatgccttaaagttcaatctgagattttccgtgaagtggatgattcggccactgagaaaaagtgcgaattaaacgccggagattgtttgtcaaacgacggcgggaatggacgacacgccgttttcaatgcgctggatactatgcttaaggacagtttagagcgtcttaagatgatgagggaaaacttatgtctggtaaagactggtctaactataggatatgcatgtgaatccaagtatgctgaagatacagctactattaggcgtttgtgcttagatggtaagctgggagcagctgtttggctttgggggaaaatggcgcagaaaggtgtcgtttctgatgtgtttacccacaaccatattgtaaatgggctgtgcaaaattgggcttctggacaaggcggatttggttgttagagagatgttagaatttggtcctcgtcccaactgtgccacttataatactttgattaagggctattgtgctgttaatggtgtggatagggctttgtatctgttctccaccatgacctatgctgggattctgccaaacagggttacttgtaggatactggtgcatgcactgtgtgagaaaggtcttcttatggaagctaaaaggatgcttgaagaagtattaaaggatgatgacgagaaagacatacctgatttagttatctctactgtatttatggatagctactttaaggatggagcaattattcaggctctcaatctttggaatcagatgcttcaaaattgtactaaagttgatgttgtagcttataatgttcttatcaatggattttgcaagagtcaacaaatgaaccttgcatatggatatgcatgtgagatgtttaagaaaggtttacttcctgatgcttttacttataatattattattggtgctctttgcaaggaaggaaaaattagtgaggcttgctataccgttggagttatgtctaatatgggaattatgcctgatcaaattacataccagattgtgattcgaggcctttgttttgctggagagattgttagagcaaaacacttgctttggtgtatgttgaacaatttaatggtgcccaagcctttaatatggaatctaataattgacttatatgggagatataatgatcttagtaatgcattttttacaagagatcagatgctgtctttcggtgtttgccctaatgtatttacttataatgctttaattcttgcacaagtgaagagtggaaatttccatggtgcttgctctctgaaggaagagatgatttcgaaatgtctctttcctgatgtggttacctataatttgttgataggtgctgcttgtaatataggacgtcttgattttgctcttctattacatgatcagatggtgcagaggggttatgaaccagatttaataacttatactgaacttgttagggggttctgtataagaggtaagatgaaagaggcagaagagctctatgccaaaatactaaaatctgaggatgcagatagagtgcaagaagctgtgcaagtagattctgttttgaagaaaattttggacaaaataagagctgatcctaactcccaacctgggtacactagagcaggccttgttgtttcacaatgggagattgggattaaaaagcctcatgaaaccaagcctattggtgtacgagagaatgaagaaaagggtggcaacaacaaaggaggaaaaggaagagagaaaataaccgaatgggcag

SEQ ID NO: 72584 - DNA, 411 bp, Glycine max
  Peptide Sequence Number=SeqID_189362
atgccggattttaccatccacgaataccacccgctgattgactcctcggatatgacgccgcaggactggcagtcaatcgctgacgacatccagctgaactacgatcgctatgacggtttcgtcattctgcatggcaccgataccatggcgttcaccgcgtcggcgctgtcgttcatgctggagaacctggccaagccggtgatcgtcaccgggtcgcagatcccgctggccgagttgcgctcagacggtcagcagaacctgctgaactcgctgtatgtcgcggccaactatccgattaatgaagtggcgttgttcttcaacaacacgctgttccgcggtaaccgcaccaccaaagcccacgccgacggttttaatgcgtttgcctcaccgaacctgttctccgctgcttga

SEQ ID NO: 72585 - DNA, 156 bp, Glycine max
  Peptide Sequence Number=SeqID_189363
atggcatctaagaaaaggaaggcaccttctacacctacccaggccagatatgacagatccagctgcataaacattgctattatgaaggaattttatgcgaacctatatgaccccgaggataaatcacctaagcaggtttgcactcctgaggcctga

SEQ ID NO: 72586 - DNA, 372 bp, Glycine max
  Peptide Sequence Number=SeqID_189364
atgaagaagatcctaggcctacaagctccaatggagcttacatcaaaagaggcttcttggaatggtttcaagagacttagtttttcagaccaagggttatgtgaggccgaagtcaccatcaaggaagagatcgagaccatatgtaaaagatttgaggaacttaatgtttgtggtaaagttactttcgagagtaaacttcgagaaattgcataccctgatcaaaactctatgtgtcctcctctgtcaaaggtcaacactaaaggtgcactgaagaaaccgatgaatagaagccaaagatcacaaagcgcgatccgtcttattgggagtatgttgatgcttttcattctgttcagaacagcaactcttcagtga

SEQ ID NO: 72587 - DNA, 882 bp, Glycine max
  Peptide Sequence Number=SeqID_189365
gtggtgacgggcaatccggtgatcgaggcggtgatcgagggccaggccggcgccaggcgggtgaccaattcgcgcggcgtggacatgctggccggctacgcgccggtgcctgccagcggctggggcgtggtggcgcagcggcccaccgcggtgacgctggagccgatccgcgacctgctgtgggcgctgctgggatacgccgcgccgctggcggtggtgttcctgctggccatctggtggtgcgcccggcagatatccctgccgctgtcgcaactggccaccaatgtcgagcatcacgacgtggccgtggcgatgcagcgcgtgaaatccgtcagggcctggtatttcgaggccgaacgcctcaagcgcgcggtgatctggagcttcaccagcctgcaggagaagatcggcaagctgaacctggccagcatcaccgatccactgaccggcctgcgcaaccggcgcggcacgcaggacgcggtggaccacctgcaggcggccggcacgccctttgccgtggtggcgctggacatcgatcacttcaagcgcgtcaacgacacgtatggccacacggtgggcgacaaggtgatccaggacgtggcgcaactgatgcgcgattgctcgcgtcccagcgacatcctctgtcgcaacggcggcgaggaattcctcattctgctgccgggcgtggcgccgaccgaggcggtgatcgtggccgagcggctgcgccaacgcaccgccgaacgcgaaatcgacctggtcggcggcatcacggtgtcagccggggtggcccaatggccgaccagtggaccggaggtgctgcaggctttccacgccgccgatgccgcgctgtatgccgccaaacagcagggccgcaaccgggtg

SEQ ID NO: 72588 - DNA, 534 bp, Glycine max
  Peptide Sequence Number=SeqID_189366
atgcatcagccagttttctcttcagacagcgatactcacttgcccagcaaaattcaaagtaaatcaatccacggtggtgttagtagtggttataatacttacacagtcctcgccaacaacaagagtaataatagcaaccttgcgatgaagagcaacacctccaacttcatcttctcatcacaattacatgcaccaccagagaaattacctgccacagccagtacttctccaaccgcatacattctttcttttgatgactccaccgtagttgcggctacgcgccaaaactacggtgaaaaacagccctaccaccaggaagtggtgctagggagtggtggcgcatgtcttccctcaaaaggggtctcagaaggacacgactttgaacctaaggccaagccaacaacaaagagaagtagaagctctgcggagaccctagtccatataatgacagagagaaagagaagacgggaactcacagagagattcattgcactttcagccaccatacctggcttaaagaaggttagtagttaa

SEQ ID NO: 72589 - DNA, 855 bp, Glycine max
  Peptide Sequence Number=SeqID_189367
ggactacacgtcctcgccttcagaggactacacgtcctcgccatcagagggctgcaggccctcaccttcagaggattacacgtcctcgccttaagaggtctacacgtcctcgcctttagcgggctgcatgccctcgccttcagaggactacacgtcctcgccatcagaggactacgagtccacgccttcagaggacttcacatccttacctttagagggctacacaccttcgcctttgtagggctacacaccttcgcctttgtagggctacacaccctcaccttcagaggactacacaacctcaccttaagagggctacacgccctcgccttcaaaggactacataccctcaccttcagaggactacccatccttaccttcagaggactacacgtcctcgccgtcagaggactacacgtcctcgccgtcagaggactacacgtcctcgccatcagaggactactcatcctcgccatcagagggttgcacgccctcgcctttagaggactacatgtcctcactttcagaggactacacgtcctcgccattagaaggctacacgccctcaccttcagagggctacatgccctcaccttcagaggactacacgtcctcaccttcagaggactacacgtcctaacctttagaagactacacgtcctcgccttcagagggccacacaccctcgcctttagaggaccatacgtcctcacctttagaggactacacgtcctcgccttcagagggctacacgccctcgcctttaaaggactacacgtcctcgccttcagagggctacacgccctctccttcagaggactaaaagaacgatcgactaaccgcctgaattctttt

SEQ ID NO: 72590 - DNA, 915 bp, Glycine max
  Peptide Sequence Number=SeqID_189368
accaagaagaagctggaggaagctgcacagtcaggaagtgttgatgacatcatcgaccctccatcccccatcagacgccacgtgaagtggaagatggcccgcaccaagaaaacaggggagatgacgactgaggccgcaaaggaaatcgctgataagatcgattcctttgaggagcaggcgtcacagggatccttcgtcccccatggacgtcaagatgttctcaccgctgctattggatgtccagaacaccctggacgtgtctgtgctgctggagccggtgtcaccatcaggcaatacttcagatcagctccatggacgtctcgcagctcttccttgctgcctcctgaagaattgcaacagctgacccaacaaatcagggaccaactagaggagtcgatcacagagaaatcccagatgcaatctcaggaacttgcactgcctctgaagcctctggttggtccctcaggtcctcgagtaagcacaaaggagagttgtgttgattcctcaataaacgatcatgagacgggtggctcagacaggtgcggcttgtacatcgaagcaaatcctgcccacctggttgccctgagaaggctttatgagggatccactattgttcataacactcctttgttgcctagccaagtaaaaatgggtgtggaggaggttaaagatccagatgctcccgttcctgtacccactgatgaggtttccttagtgggacagtcaattcacaccttccttgcttggccgacacatctggtcaagcctttatcacaacaggcaactgtgtctctggcaaaaccacctcaaaagccgaatccggagatcgatgatctgctttatctaatggcattgactatctcagagcttttcttgaggccttaccaggttacatgggatgccaccgtgttcggg

SEQ ID NO: 72591 - DNA, 801 bp, Glycine max
  Peptide Sequence Number=SeqID_189369
gaatgttaagatttatcatactgaattcgatgagtttaaggcaaagttgaagaggcgtaacctacacaaacgcctcgccaaccttcaggagggaagtatagatgtggcggtggataaagaattatatgccaacttatacagcccggaaaaccagagccctaagcaagtgagggtgagaggacatttaatcaggattggtgctaatagcctgaattccttcttagagactccagtagtcttggagaagggtgagacactgcctacctattccagcaacttgactcccacttcccacacctctgatcttaatatggacagagctaggttggtttatggcttagtcacaaggatggacatgaacattggcggcaagatctctggacagataaccattatggctcagtccaactcttctctcctaggcttccgaactttaatcacagccttgtgcaggtcgaggggagttggatctgatgctcttacttcttacaagagcctgaggccggtcattaacttggcctatattaaaaggaaatgttgggatgtgaatgaccaagcagttaattttccaagggcaaggaaaactaggtccagagcagctggtgttgcctcttcttctgcaccagcagttgacatcccttcatattctactccagctccacctccaacatcaacaaccccatctgcccaaagctcccagacttcggatgctaagttgcagagtttgtttgagggacagattctcattatgcagagcttgcaagaattggcccaccaaaggccaatcatgagtgtcgagca

SEQ ID NO: 72592 - DNA, 288 bp, Glycine max
  Peptide Sequence Number=SeqID_189370
atggagataaagggaagagaagagaatggagagggaattaggcatagggttaaggttgaagaggaaggggccgagagggagagaatgggaataagagaggagaaaaagaacgagctaggaatccctactccttgcttgtgttgtggcttgcctatagctcctgccatggcctgcctgttatatgatgtagctccatgtagagcttgtaggccttggatcttcttcatcaatggagtcattcgcttcttgaagatcaatggtagtagaatggagaaggtcgaaaggtga

SEQ ID NO: 72593 - DNA, 339 bp, Glycine max
  Peptide Sequence Number=SeqID_189371
atggttattgttgttccagggaagtttctagaagattcatctgaagccactaactccatggcgacatgcttgggtcgcgcgtatgcgagtcgcgcatcgttaggcggtgtttggatttggtggggtggtgcgtcaggtccggacatggagctcaggtcgatgagctccgaccatgggcggcactgcgcaaagacgtggcggagggacgaggagatgcacgacatgaaggggcgcggaacaccagtgtcagatcagaggctggaactgcgagacagcgtcaccggaggcgctgaatttggaggagtggccatggtggcgcactggcgcgtgaaccattag

SEQ ID NO: 72594 - DNA, 639 bp, Glycine max
  Peptide Sequence Number=SeqID_189372
atggttatgcttcgacagggcatgcaacatgttcgaaattactacaactcggaggctcaaatgatgagaagtagcttttctcagccattcatctctagaacatacaaaaccagtttcttgaagccaaaatcaaaggcagagatcaaagtattggctgctaagaaacacagtgaagcagaaaagagacgtagaatgagaatcaatggtcaatatgaaaccctccgaaatatcctccccaacataatcaaaaaggacaaggcatcagtattggcagagactataaagcaagtgaaggagctgaagaaaaaggtgtcaaaactggaacaagatagttctactaatccatcaaaggatgttgttaagtttcctagtggggcagaaaagttgcgtttggaaagatgtaacattgaggagggcctagtgaaggccacattgagttgtgaggatcgtccagaattgatgcaattaatatcaaaggcagtagggtcagccaacacaaaattggtaaaggctgagatagtgagtgtgggagggagaaccagaagtgtgttgtgggtgcaaggtcttggaaatgatggtatggggatgctcaagagccatttgaggactgcattgcacaagccgcgttcttttcagtaa

SEQ ID NO: 72595 - DNA, 252 bp, Glycine max
  Peptide Sequence Number=SeqID_189373
atgggggtgcaaatagcaattttcaaatttttgaatctgggcccttccagaacattttggaagctgggttgcttaaggaggaagcagcctagctcgcctgggcgagttgggcggcaacctcctcccccttttcctataaataggcgaatgggggttgttccaatgagtgcctcccttggctatgtatttcatccgttttgggtgaaaaacatgtttttcatgaagaaaatccaagccgaggtgcttccgtaa

SEQ ID NO: 72596 - DNA, 540 bp, Glycine max
  Peptide Sequence Number=SeqID_189374
aatgatgcaaggagagaaggacgtgcaaacggcaagtcccagaggacaaggcaaacgacaaagagatcgctgtgtcacatattcgcaattggacaatctgagctgaatcgaaactccaaaactactactcgatttcagagcccacaccgtggaatcataatcaattcattcatttcggatgctcacactcacggtcagcaagattacgacgctgtggatcctgtgttcggggctggtcctgggtgcgggataaggaatgtggaggccaagagggaggaggaggggatgatgatgatgatgaggatggtggcggatgctgacgtgacggagacggaggttgctgagacggcggaggtgacggtggcgtcggaggtggagtattcttctccggttccggtggatggttctcggtggttccaatgtgcggggccttgggatttcgtttggggagttgagtccaatagtcatctatctgcgtgtttggtagcacgttactcagccatcgacttgcatgaagctattgtgagcaatttgacgtga

SEQ ID NO: 72597 - DNA, 1770 bp, Glycine max
  Peptide Sequence Number=SeqID_189375
atgttttcactaggtcagaaaaagggatggtgttttacatgtgagtttgaatatctaattcagaaggcgaaagaagggatttctccactttcaccaattgggatattatctaagatacacaagattggaagccatctagggcgtgggagggaagaagatgctcatgaatttttgaggtgcgtggttgatacaatgcaatctatttgcctcaaggaagttggtgtttcaagtcctttggcagaagaaacaactctagttagttacacctttggaggttatcttcgatctaaggttctttcccagtcgaacagtctattttttgttaaggttcacattttcaacttttacagagtgataaagtgcttaagatgcctggggaaatctgagaggtacgagagaatgatggatcttactgttgaaattgatggggatattgggactttggaggaagctcttggacaatttacagcacctgaaatcttggataaagataacaagtataattgcagcaggtttgaaagccgctattctgagaaaacaggggcagagagaagccagatgccggagaagagaaaacaggcagagaaagtgcttccatttaggaacataacaaaaagagagcagaaactgagagtgagcactttgtacagccaaagggcgacgcaggatggtggtggatgtggggcagttacggttggtaccagcagagagaagtttgagggttgcaggttgcagatgaaatgtaaaacatatgtgaaagccaggaagaagttgacagtgttggaggcaccaaatattcttacaattgtattaaaacgatttcagtctggtaactttgagaagttgaataagtcagttcagttccctgaggttctgaatatggctccatatatgagtggaacaaaagataaatctccgttatacagcctctatgcagtggttgtccatttggatttggatatcatgaatgctgcattttcaggccattatgtctgttatgtgaagaacatccaaggagaatggttcaggactgatgacagcagggtagaacctgttgaattgtcgagagtcttgtcagaaagggcatacatgcttctttatgcaaggcactctccaaagccactgggtttagtaagtagcaatgtaatctcttctgctggaaagttcaagaggagaaacctggaagccattcctgctacttctaagacaagatcaaattccatggccacaagcggctattctccctctccacagcagaagcatggcaagtaccctaactggaatgatgccgatgattccttaagcaatgattttgcatatccagaagaatggagattccagtatggggtaagaaatacaatggtggattcttccagtgaaagttcacttttcagctcttcagatgcaagttcttgcagtactgcaagtatcaaggactctgccagttctgctgatttctcggattacatatttggtgaggtgggacccaattggtatagccactatgggctttcatctaacatgggggcatcttcctcctatgataacttggatacagatttcttagtggatagtaatggtggtgcaagtagaaggctccagcaggactcagaagataaagcagttttgtatgctaacaaaagcaaaaatcacagtggcagtaggggaattgaccttaaaagatatatcactgctaatcattatgacaaaaaatctggtgtacatgtgagaagaacaagcggagatgcatcagctcaaacgttttattga

SEQ ID NO: 72598 - DNA, 183 bp, Glycine max
  Peptide Sequence Number=SeqID_189376
atggagttagtggcttcagatgaatcttctagaaacttccctggaacaacaataaccatagaggaaaagcaaaactgggagtatgtttggattttgattctctggattttatttgtgagtagattgctggtgcttagatgggtgacattagttctaagcttcatgggttgcggttggacttaa

SEQ ID NO: 72599 - DNA, 663 bp, Glycine max
  Peptide Sequence Number=SeqID_189377
atgccagatcaagttgcccttgaaactgaggcaagaatgtcttctgtgatcaaggagaagaagaaattgttcaatgacttattgacatctaaaggaaacatacgggtattctgccgtactaggccattatttgaagatgaaggttcctcagttgttgaatttccagatgattataccatccgtgtaaatactggagatgaatccttgtctaactcgaagaaagaatttgaatttgacagagtttatggacctcatgttggacaggctgagttgttcagtgatgttcagccaatggaaggatcaagctatgataggggtttatatgctcgctgttttgaggagctgtttgatttgtccaactcggacacaactgctacttctcaatatacattctgcattactgtttttgagctgtataacgaacagataagggatctgcttttggagtcagggaaaagcttgcctaaattgtgttttggatcacctgaatacttcatagaactaatgcaggaaaaagttgataaccctctggacttttctagggttttgaaagccgcattccagggtcgaggaaataatccattaaagattaatatttctattgatatcatactttctgcaatggagctggtgatgtcaatgcacagatcagcatttgtatag

SEQ ID NO: 72600 - DNA, 288 bp, Glycine max
  Peptide Sequence Number=SeqID_189378
atgtgggatagaaaacacaggtgggagttcaaaaactctgatgattgtaaatctcgaaattctgtattaagccttggaaaccgagatacaatcaagaagtggagagatgctgcaaatgatgcacgtaaggagttatatgagaaggaaaaagaaatccaatatctgaaacaagacgatctgagacttaagcaagcacttaaagttgcaaatgatcagtgtgttctgctcttcaatgaagtacagaaggcatggaaagtttcttctgcattgcagacagatttaaagtga

SEQ ID NO: 72601 - DNA, 2202 bp, Glycine max
  Peptide Sequence Number=SeqID_189379
atggcatgccaccatggcttgcttgataatgctaaaattggaagccttgaaatacaactcaataaagctctgggatccattaacactgggtcaaatgttggccctgaaactgtgtctgcagctctatcaaattccaggacaacaggggaagggatggattcatctgcagtaaccaagaaactggaagaggaactcaagagacgcgatgctctgattgagaggttgcatgtagaaaatgagaaattatttgataaattgactgagaaagcatctctggctggatcacctcagcagtcaagtccattatctaggggatcagttaatgttcagcctcaaaatattggaagcttatggatattggctttattctcgttgtattcaaacaggaatgacactagcaccactgctagagctcgttctgtggatgttcttccttcatctttgatgatagataagaatgatggcactgttgctttagttaaatctggttccgagaaagttaagactacccctgctggggaatatcttactgctgccctgaatgactttaatcctgatcaatatgaaggacttgctgccatttctgatggtgcagacaagcttctgatgctggttctggctgctgtcatcaaagctggtgcctccagagaacatgaaatacttgctgaaattagagatgctgttttttcatttattcgtaaaatggaacctaggcgagtaatggataccatgcttgtttcccgtgttagaatcttgtatataagatctttgcttgctagatcaccagagttgcaatccattaaggtattgccagttgagtgctttcttgaaaaggccaacactggacccagtagaagttccagccgagcaagcagtcctggaagatcttccatgcaatatgttgatgagcagatccagggatttaaagtgaatctaaagccagaaaagaaatccaaattttcatctgttgtgttgaagatacgtggaattgatgaagaaacctggagacagcaagtaacagggggaaagcttagggaaattagtgaggaagcaaaaaattttgcaattggaaacaaggctcttgcggcactatttgtacatactccagcaggagagctgcagcgccaaattagattctggcttgcagagaagtttgattttctatctgttatgggaaatgatgcaccaggggggacaactggtcagttggaacttatttcaactgcaattatggatggttggatggctggacttggcagtgctctgcctccccaaactgatgcccttggccaacttttatttgaatattcaaaacgtgtctatacttctcaagtgcagcacttgaaggatatttctggtaccttggcaacagaagaggctgaagatgcagcacaagttgccaagttgcgttcagctctagaatctgttgatcacaaaagaagaaagattttacaacaaatgagaagtgatgtagctttgctgacattggaaaatggtggtttgcctattcaaaatccttctactgctgctgaggatgcacgattagcatctctcatttcacttgatagaatattgaagcaagtcaaggatatatctagactttctactgtgaacaccattgagaaaagtaagaaaagaacagtgctcggttctcttgataaattgacagaacaaatgtcttcacttcttgaaattgatcatccatgtgctcggaggtacattgcagatgcccgcagaatggttgagtcaattcctgaagaagatgaccgcattcaaaatctatcacattctcgcaagccatcaactgatacagactcgggatctggaactgatgtggcacagtggaacgtccttcaattcaatacgggtaatacctcaccatttataatcaaatgtggagcaaactcaaattcagaactaatcattaaagctgaggctcgagttaaggaacctaaaggtggcgagattgtgagggttgccccaaggccgtctattttggaaaatatgagcttggaggaaatgaagcaagtatttgctgaactacctgaggctttaagcttgcttgccctggcaaggactgccgatggaactcgagcacggtattctagattatataggaccttggctatgaaggttacatcacttaaagatatggtcagtgagcttgaaaaagggggtgcactgaaagatgtgagaacatga

SEQ ID NO: 72602 - DNA, 408 bp, Glycine max
  Peptide Sequence Number=SeqID_189380
atgacatcaacaccagttcacacttcacaggaaaagaaaatgatatggtcaatttttccaacattggttgctacaactaaccaacaagattgtcatctaaataagcctgtgttaaagttgaaagcaacatcgatacaagaacctgaggcgatctggagaaagagacgcgtcgctgtgattcgcagcgccatcgttatcgcaggttggtcgtcggaaattctcagagccactaacggagtgttagctgtgaccggagagaagtggtttgacggggaagaaaccgaaaacggagagaagtggtttgacggggaagaaaccgaaaacgaagacggaaagaccgatgaacttgatcttaatcaagggaagcaagctaacagaaaactacctttccagccaaatacattttga

SEQ ID NO: 72603 - DNA, 327 bp, Glycine max
  Peptide Sequence Number=SeqID_189381
atgtcaacattgttgttaaatggtggcgccatggtggatttttttgccaaacgccataggccccaatggttgggagatgttttgtcttctttgacatcaaaaaaggatgttattccttatgaaaactcgatgctaacgaaactatttgcagattcacttgtcccttcagccattttcgattataataacaccaatttggtccctactggacatattaaccttaaaaaagaagaagcatgtaaatgtatacctgttgaacttaagagcacatgctcagaagagttgagagtatctgcaggagctcctagaatgacggagcatctgtag

SEQ ID NO: 72604 - DNA, 228 bp, Glycine max
  Peptide Sequence Number=SeqID_189382
atggcggagcagggtaaccgctggagctgggacgtcgccggcttcgagccttggaagtcgccgtcgccggagcaaaacgatcagaaacctaccgcgccgttggcgaggagaaactccaccacctcctcggttcctccacactccgtggcttccaaagttgaagggttaagagaaaaggttaagaggatttcagtgactgttagtggcgaggatttgactgtgaattag

SEQ ID NO: 72605 - DNA, 270 bp, Glycine max
  Peptide Sequence Number=SeqID_189383
atgtcagagaagagatattgcctattggattattggtcttgttattgtcactataataacgtgagattcgaaagtggaaatcatgagatagtgtcattgtgtcaagatgtagtcgacaaggattggattaatattccaaaattcataagaataagaatatcagaggtgaacaatggattgggttgcttctacagagtgaaaggtgtcagaggagcaatacttgacctaactcctggtttgctattaccatcaacacataactcattctaa

SEQ ID NO: 72606 - DNA, 516 bp, Glycine max
  Peptide Sequence Number=SeqID_189384
atggctaagtttgacccagatatagtcctggagttttatgctaatgcttggcccacagaagagggagtgcgggatatgcggtcatgggtaaggggtcagtggatcccctttgacgtagatgccctcagccagttcctgggtgacccgctagtgctggaggaaggccaggagtgcgagtttagtcagaggaggaacagggccgatgagtttgacgaagaggccattgctgttatgtataccgggtcaggatttttcccggactgctgcagggaggcgggtgcggatcatgcgcaccaacatgactaccctaacccagatatggatgacgttgctactcagcaatgtatgccacccaccaggcacccactagacccggataagtctaacagggccctggggtttccagcgttgatcacgggcctctaccagtcattcggggttcccgtcacacctagtaaggtgatccggccgccgatcacccgagccttgattgagaagtattgcacgcctaggtag

SEQ ID NO: 72607 - DNA, 599 bp, Glycine max
  Peptide Sequence Number=SeqID_189385
atggaccagcatgttgtagcgcgtgccggccacgatcgaacggaagaactgctgggccggcacgttgttgaaggcgacgttgaagcgctcttccagggccggacgcgccttcggcagctcgcgcgcgagcgcgcttgccggcggcagcaaggcattcgccacggcgtcctcgctgccggacgccttgctgttgacggcgctggcgttggcgacctcgcgcctgatcgtatcgtaggtctggtgcggcggcgtgctctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 72608 - DNA, 225 bp, Glycine max
  Peptide Sequence Number=SeqID_189386
atgtacggttacgactaccgcatcgacggcacgaaaatcacgatccggccgctgaccatgcagacccggatgttccacgtgaactacctggtcggcagccggcgcggctcgtcgaacctgcgcgtgacctcgacctcggtggccaatgccggatcaagcttatcgataccgtcgacctcgagggggggcccggtaccagcttttgttccctttagtgagggttaa

SEQ ID NO: 72609 - DNA, 219 bp, Glycine max
  Peptide Sequence Number=SeqID_189387
atgataacgaggttgagcacaagaagccctgtggaggacattttgtcatatagacgagatattgtaggttgtagcgcaagggaaactccacaagattccccaagccagcaacaacctcgaacctatctgtggcaaggttgctgttactggagaccgcaccagccctttgctcataggggtaagaaaaaggagagaaagtccataaacaaacagatatga

SEQ ID NO: 72610 - DNA, 486 bp, Glycine max
  Peptide Sequence Number=SeqID_189388
atgaagaaagtagtcacaataataggagccaacgaggacaaggttgtggtggagatcgaggaagatgacaaagttggaggctatatgacaacaacaacaacaactttcaaagaggaggaagttcagcaagaggtcgtggacaagcttgatgaatcgatgagcagcaatgtggcctttggagatgaatccaaggtagaagtgaaaggaaaaggtaacattcttatccgtttgaagaatggtgatcgtcaattaatcccaaatgcttattatgtgccaaatatgaaaagtaatatcttaagcctatggcagttcctagagaaaggttatgatatccgcttaaaaggcaatagcttttctataagagacaatgcaagtaacttgattactaagcatcttcgatttgagcatctcaattttggaggattagagttgctctccaagaagaaaatggtgaaaggattgtcttacactagtcaccctgattaa

SEQ ID NO: 72611 - DNA, 1560 bp, Glycine max
  Peptide Sequence Number=SeqID_189389
atggcatcctcatcttcttgtcatgttactgaaataaaacatgatgtctttatcagctttagaggtacagacgtccgcaaaggtctgcttagccatttgaaaaccgaattgcgccgcagacagattgatgcctatgtggatgagagacttgacagaggagatgaaatatcatcctcacttctcagagcaattgaagaatcacaaatttcattggtcatattctcaaaagactatgcttcatcacagtggtgcttggaagagcttgccaaaatgattgaatccatggaaataaataaacagattgtactacctgttttcttcaatgtagatccatcacatgtgcggcaccaatgtggagattatggagatgctttagctaaacatgaagaaaaactcaaggaaaacatgctcaaggtaaagacctggagatctgctatgaaaaaagcggctgatttatcagggtttcattacccaaccaattttgaggatgaatcagatcttgtccatggaatcgtcgaagacatttgggaaaaattgagcaagttttgcccacgtgaatcaaatggtcttgttggaattgatcaaaacattgcacggattcagtccttattgttaatggaatcaagtgaagttctttttgttggaatttggggcatgggtggcataggtaagacaaccattgcccgtgctgtttttgataaattttcttctcaatacgatggtttatgcttcttgaatgtaaaagaagagttggaacaacatggattgagtcttttacgagagaaacttatatctgaactatttgagggagaaggactccatacaagtggcacaagcaaagcaagattcttgaattcttctatcagaaggatgggtcggaaaaaagttctggttgtgctcgatgatgtaaatacttctgaacaaataaaagatcttgttggcgaaccaacttgctttggtgcagggagtagagtgatcataacaagtagagatcagaatgtgcttacgagtgggggtgttcaccaaattcatgaggtcaaggaaatggactcgcgagattccctcaaactcttttgcttaaatgccttcaatgaaagccaacctaaaatgggatatgaaaaactaactgaagaggtagttaaaatagcccagggcattcctttagctttaagagttttaggtgcagatttccgttccagaagcactatagacatgtgggagtctgcattaagcaaaatcaagaagtatcccaacaagaaaattcagagtgtgttacgattcagttttgatggactggaagaattagagaaaaaggcatttctagatattgcattctttttcgaagaagacagcaaagactacgttattacgcaactggatgcttggggattttatggtgctgtagggatagaggttctccaacgaaaagctctgataacaatttcaaaagacaacagaatacaaatgcatgacttgacacgacaaatgggttgcgaaatagttcgtcaagaatctattaccaatccaggaagacgcagccgattgcgggatagtgaggaa

SEQ ID NO: 72612 - DNA, 558 bp, Glycine max
  Peptide Sequence Number=SeqID_189390
atgcctgatgagctaatttgcttgagatctacgtattatgttaagctttacgagaagaccacgggacaagacaccaagttacacattctatttgatggatttaggttttatgaacgagtatctgccagggagttggataaggcagctggtgtccggggtggtatgatgctgattctttactgtacagctgctctctttctattccaactcttagagagacccagcacggacactctagtcccttgccgtgttcgacacgcgtccgtatcaatgtccgacaccgacacgagacccgcagggttgggggacattgagaaaaggattgctctggatagggattgtagctttgatcacatatctgttgatgaggacatgaccaagagcaagggcaaggatccacttgaaggacttggaggacctatgacaagggctagagaaaggaaatccaaggaagctcttcaacaagtgttgtccatactatttgaatacaagcccaagtttcaaggagaaaagtccaaggttgtgagttgtatcatggcccaaatggaggaggactga

SEQ ID NO: 72613 - DNA, 264 bp, Glycine max
  Peptide Sequence Number=SeqID_189391
atggaaaatggaagaacaccaacaggaacagcagcaagcaagcagttctctctccacacaagtatttcactctctcggataacaagcaaactcgaaagcaaggagcaaggaatgcaggcaaagaatgaatgtcataacccagcttataaacgaagaacaacacaaaacgccaatggcatcagcgacttaagcaggcacaaatcgccaatgggtgttgcgtttcctcggcaaacctgcagagctagcttctgcagctgcacctag

SEQ ID NO: 72614 - DNA, 258 bp, Glycine max
  Peptide Sequence Number=SeqID_189392
atgggtcttggagattttgcgttgattatcacgcccggaacaccattacagaaccgttttcccattcccaccatagacgagttactggatgaacttggcgacgcctcctggttctcaaagctcgatctcctccaagggtatcatcagattttaatgaaggaagaagatatcagcaaaaccgccttcagaacccaccatgaccactatgaatttagggtcataccgtttgggctttgtaacaccccgtccaccttccag

SEQ ID NO: 72615 - DNA, 1251 bp, Glycine max
  Peptide Sequence Number=SeqID_189393
atgacttatcctaaggccctaaaaggtaatcagactgatacctatttcggaactgctgtggcggatcctttcagagatttggaaaatgactcccagcccactaaaaaatgggtggatgaggaagttgctttcagccagaattacctttcaaaaataccctttagagaaaaaataaaaaatcaattgagggatatctggaattatgaaaagatttctgcaccttcaaatgaaggagattttacttattataataaaaatgacgggctgcaggcacaatccgtgatatacagaacaaataataaaacgaagactacagaagtattccttgaccccaataagttttctgaaaaaggaaccacttctctttctcagctttcatttaataaaaaagggaatttagcggcttattctatttctgaaggtggaagtgactggaataaaattatcattattgatgctattacaaagaagcaaatcgatgatacattgacggatgttaaattcagtggtatttcctggcaaggagatgaaggattttattattccagctacgataaaccgaaagagggaaccgtgctttcagggatgaccgataagcataaagtatactttcacaaattaggaacaaaacaatcttctgatcaattgattttcggaggggataaaacaccaaggagatatatcggagcaaatgtttctgaagatcagagatatcttatcatatcagctgctaatactacaagcgggaacgaattatatatcaaggatcttaaaaatggaggtgatttcatacaaattaataaaggatttgacattagtgcgggtattgtagatacggagggagataacctgtttgttttcacggataaagatgctccaaatatgcgtcttgtaaaaaccagcattaaaaacccttctcctgaaaactggatcgatgtcattcctcagacagaaaatgtattgggaatttctaccggtggaggatatttctttgcaacatatatggtagatgccattgatcaggtaaagcaatatgataaaacgggtaaacttttaagagatatagttcttccgggaaaaggaaatatttcaggtttcggaggaaaggaagatgaaaaagaactttacttttcttttaccaactatattacaccgggaacaacttataagtttaacgctgatactggtaaatcagaggtttaccagaagccaaaggtaaaattcaatcctgaggattacatatctgagcag

SEQ ID NO: 72616 - DNA, 669 bp, Glycine max
  Peptide Sequence Number=SeqID_189394
atggctcaacatcgtggaggatcaggcaacttcgcggaagatcgcgaaagggccgcggaagcgggtcgaaaaggcggtaaaaacagcggcgggaatttcagaaatgatccgcagcgtgctgccgaagcaggtgaaaaggggggacgcagccgcgcgaaaaaatacaaaaatgtgcgccagtcctctattctggtgcgttatgtctgcttccacttcccgcctcagcctgcgtattacgcgtcaggagctggtgcttatttttatcacgatggtctggggtggcacctttctggtggtgcatcgcgccatggcgcactcggggccgttcttttttgtcgggctgcgtttcgctaccgcctcgctgctgctggcctttttctttcgccgctatttgcgccacattacctggctggaaatcaaagcgggtacgctgattggcgtggcgattgccggtggttacggattgcaaacctggggtatgcaaaccatttccagcagtcagtcggcgtttctgacggcgctttacgtgccggtggtgccactgttgcagtggctgtttctgcgccggccgccgggcctgatggcgtggctgggtattttgcttgcgttcaccggtctggtgctggtggcggggccgcaggatggcagcctgacgctgaatgccggtga

SEQ ID NO: 72617 - DNA, 246 bp, Glycine max
  Peptide Sequence Number=SeqID_189395
atggatgtaatgttgtttctttgctgtggtggtgaaattttgtcttgcacactttgggagaattactgtactcagttcctatcctatttgaatgaatgtggggatgatgggccgatgattattatattgacgcatgccagaataaaagatgcacagggaagttatccagctttagtaagcaattccttcaaggcgtcaaaactattgattaatgatcctatattggaaattcaggaatttaaatag

SEQ ID NO: 72618 - DNA, 405 bp, Glycine max
  Peptide Sequence Number=SeqID_189396
atgggtcccctccttgagaggattacatcagaaatgcctcatgctcctagccatagatttattctgattagaaggtgggaagagtcggtcggtaatgggtcagaagtttgcgggtatgatgaagaggtcatggtggggtctttcggttccaactcattgggattggattcttccaccttagtaggtgaatcttccaccaaaagggagtcgagtgacttctcgacatttataaaccaactaccagaaagagtgggcgagaacattacgactctggttgcagttgttgctgcccaattgaggcctttaacggaagttagatctcaacctaaggagcaccttgcgttgaaggaggcaagtgtgcctctccctatcatgcttcttaggtacacatgggttgatggtgag

SEQ ID NO: 72619 - DNA, 176 bp, Glycine max
  Peptide Sequence Number=SeqID_189397
atgttcagcccctctagtattgagaattctctcgaaattagtgaaaaaaattgtttccgtggaaaaaatccaagtcgaggtgcttccataacgctttcaagacatttccgtaagcgatttcgtggagattcttcatcgttcttcgttcgttcttcatcgttcttcggtttcaatcg

SEQ ID NO: 72620 - DNA, 207 bp, Glycine max
  Peptide Sequence Number=SeqID_189398
atggtggctcatggtggccaccggtggtcgtgggtggtggagaggaaggtgttaggagagctcatctcgctaagcgggagtccactttttgcgcttagcacgacaattcgcgttgagcacaactccccttgcgttaagtgcgaaaattctcgcttagcgcaattccctctcaagttggaattgcgcttagcgcgcttcttgcaataa

SEQ ID NO: 72621 - DNA, 348 bp, Glycine max
  Peptide Sequence Number=SeqID_189399
atgtcggcggaaggtgtcggcgatggtgccggggtgtcgctggatttgtcgctctccttctttcggaaattgactggcgaacacggtttgcaggccggccgtttcggcgtcggcaattttttcctgccgcaaaactccgcgttccacgatgaggcggttggcattatcggcagcgcgctgcaggagcagggattttcggtcctcaccgtccgtgatgtaccggtaaatgacgcggccatccgtgctgccgccatcccttaccagttgccgatccgccaatgggttttctctgctccggccgaatgcgcaactctggcggaattcgactggcgtatccacagtcactga

SEQ ID NO: 72622 - DNA, 237 bp, Glycine max
  Peptide Sequence Number=SeqID_189400
atgaaaaatgatgatgatgtttacacaatgttaatatacagtgagcaatactcgtgtgttggtcctatagaattattatgtaccattattagaacaccagatgctatactcaacctgcttcaatcaaccatcactcctactcatgatgtattacaacgggaagtggaacataccacatcaagattttgcattccttcgggatgtgacatggagaaactcaaggatttaatcaagtaa

SEQ ID NO: 72623 - DNA, 186 bp, Glycine max
  Peptide Sequence Number=SeqID_189401
atggcaaagaaaccagtagagaacatgccatttgaaataacaagtgatgaacctttgaaaagcatgtcattgtcatcatcaagcaatgcctacaacgtgccatgggtagaaaagtatcgtcccatcaaggtcgccgacattgtcgtcaacgaggacgccgtctccaggaaactattctcaaactaa

SEQ ID NO: 72624 - DNA, 222 bp, Glycine max
  Peptide Sequence Number=SeqID_189402
atgaagcaaggccgttgcaggaaggactttcgcgaactcaaccttcatatcttcgaactctccttcctcaccgcctctaactcaaccccaacatatctaactccattgttgcctctaacaatgatgacaacaagaaaatctccaacaccaagtggttcttcccccctctccatgacctatgacaagacttcttcaactctaccccgcatgggtcatcaatga

SEQ ID NO: 72625 - DNA, 294 bp, Glycine max
  Peptide Sequence Number=SeqID_189403
atgcatgaacgacaaagcaattcatggggctccgaaaaaggtagagaatggagaattgcactaagaaatcactacgcatggctccaaactcatggctggtggatgcatgaccggaaacgcaattcatggggctccgaaaaaagaggttgcatgaacgaaaacgcaattcatggggctccgaaaaggggtagagaatggataattgcactaagcaatcactacgcatggctccaaactcatggatggaggatgcataaacgaaaacgcaattcatggggctccgaaaaagggtag

SEQ ID NO: 72626 - DNA, 180 bp, Glycine max
  Peptide Sequence Number=SeqID_189404
atggcgcacaatgatcataatatgactctgcgtgccattcgacacgatcgtctccggatggcggaaagacacggtcgtctccggatggcgaaaaggttcggaatgaccataatttgtctcggcatgtcatcgggcttgtcgcctctggatgacaaaaggagcataatgatcataatatga

SEQ ID NO: 72627 - DNA, 312 bp, Glycine max
  Peptide Sequence Number=SeqID_189405
atgcagtcagctgacaagcgcgagtaccatatggtcatccgcacctttcatcaaccaggggcaaacgagcccgttgacgcgcagagactaacgtcgtcttctgcaccttctgtcatcctgacccatgaagtttactttagtcgtccgaagatattcaagcccaacgacgcacgagattcttctctgctgggcggtgacgatcagataagtaaagaggggcaactgccctaccctaatttcatccggggaccattgtttggtggcatgcaaccttcgcttgaccacctcgaggtacttaacacccttcgttag

SEQ ID NO: 72628 - DNA, 270 bp, Glycine max
  Peptide Sequence Number=SeqID_189406
atgtgtgaacataaaagaaaagacaagatacaaaatgattgtatgcaaggagtgattggtgcagcatcgatagagaaaaatatgacaaaaattagattaaggtggtttggacatgtacaaagaaaatcaagggaggcaccagtgagaagactagactgtatgaattatagcccgatgaagaagaggagagggaggccaagaaggacactggagaacttggtcaaatggatctcatggaacaggacatctgctcacaaggacagcagctga

SEQ ID NO: 72629 - DNA, 651 bp, Glycine max
  Peptide Sequence Number=SeqID_189407
atgccggcgatcaccggcactttaccgtcggcggcgtctctcgccacttcgatcaccgccagcttttcctgcaccgtcattgaggccggagacgccgtcgcgcaccaggtttttgatcaccgtatgagtggcgtcgagatccagagagaaatcgttgcggaactgggtcgtcaccgccgggaatacgccgctccagcttatggctttatggctcatcgtggaggcttgacgcttttcgccgattgccgcgacgaaattggcacaatgccggcggaacgcgggcgtgaaaaatctgggcgccggcgcaccttgaaaagagggggcgcgttaagcggaaagcgtcaggcggaaatcgcgcggcgtggagccggtcatcgctttgaactgacggctgaaggcgctgtgatcggtgtagccgcactgcagcgcgatgtcggtgatcggcagatcgccggccagcagttccgtggccttttccagccgcactttatggatcatctggcgcggggtgaggtggaagatacgtttgcagtagcgttcgatctgcgccaccgacaacccggtcagcgccgtcagctcctcaagcgcgatcggccgggcatagtggcggcggatgtgtacgtcgatcgccgccagccgttggtaggccgg

SEQ ID NO: 72630 - DNA, 876 bp, Glycine max
  Peptide Sequence Number=SeqID_189408
atggttccttctcccaataccaccgtgacatgtctaattaagaacacattttattttgtggacgaggactcagggcaaagaacatgcgagtgcgccagagttttcaccatagtaaactactgcaaggagaccctgtggccggcagtgacaccgggagaaaacttcaatggcggcggcttcgtcctaaagccgggccaatccaccgtgttcaccgccccggtcagctggagcggccgcatttgggctcgaaccggttgcaagttcaaccaaaacggaaatggaaactgccaaaccggttcatgcggcacaaccctaaaatgctcagcctcggggaaaacgccagcatcactagcggaattcactttagcacaagttgactactacgacgttagcctcgttgatggcttcaatgtgccccttttcgttaagcccattaacggaaagggaaactgcaccactgctgggtgtgactctgacctcagagccacttgccccaacgagcttgctgttaaagttaacggcaaaaccgtcgggtgtcgtagtgcttgtgatgtgtataacactgatgagtattgctgcagagggaattatgggaatccctctacatgcaatcccacgttttattcgaagaagtttaaggaggcatgtccaacttcttacagctatgcttatgatgatccaactagtattttcacttgttctgggacggattatgtggtagccttctgtgcttccaggaaacaacaggtatgctcttatcatagtaacaagcttcactgcagtggatcactagggttgaaatcgctaactggaaggtggtggatcgtgatgatgataacagtgttttcggtgcttagtttgtggattggattctag

SEQ ID NO: 72631 - DNA, 117 bp, Glycine max
  Peptide Sequence Number=SeqID_189409
atggaggacaataactctcgcaagatgtgtgatgaagttgacatgagtatggatgatatagttgaaaatgaaggttgtagcaaattcttcacaattatggaggttttaatgatataa

SEQ ID NO: 72632 - DNA, 141 bp, Glycine max
  Peptide Sequence Number=SeqID_189410
atggagcacatgagccgtgttggttctcctctcagaaggtgttcattgagctcgaacaaggtaggtttgcctgtgttactgccttactgcactacgcttcaagtctggttcaactatcagtttttggaattcttagggtaa

SEQ ID NO: 72633 - DNA, 399 bp, Glycine max
  Peptide Sequence Number=SeqID_189411
atggacagatgtagctggcgcttggcagttatggttgtgctcttgctgctgttaggcttattatgggaattcagtgcaactttggtaacagctaagttcaagcatggtggtggacctctagaggtgtggattagatggtttttagtatggttcaatggatctggatcaggaagaacaggattgttgaagtggattccatttgggactctagctggcaataaatctgctgctagtgttatggttgcacttgctggagctatcaagagtccaatagaggtgtcaaaggagttttctaatagatctttaatcattattaattctcatgcaagactaataacacaaactgtgcctggtgctcattcgtattcccaaggaagacccaactgggataaattataa

SEQ ID NO: 72634 - DNA, 565 bp, Glycine max
  Peptide Sequence Number=SeqID_189412
atttcctacatctaatgtccaatcttttgaatttgggataatcgaccctctcaatgagtcgatctcttgctttctcataaaagtggacccttgggtactagtacctgtcacctttagaggactacatgtcctcgccttcaaagggttgtacgccttcgccttcagagggctacacgccctcaccttcagaggactatacgtcctccccttcagaggactacatgtcctcacttttagaggactacacgtcctcaccttcagaggactacatgtcctaaccttcagagggctgcacaccctcaccttcagaggactacacatcctcgccatcaaagagctgcacgccctcgtctttagaggactacacgtccccaccgtcagaggactacacgtcctcaccttcagagggctgcacgccctcgccttcagagggctacaagccttcaccttcagaggactacatgtcctcgctttcagaaggctccacatctgcgccttaagagaatttaagggatcgcacccacaagacacccagtggacccgaagaagtccaacagggtcctag

SEQ ID NO: 72635 - DNA, 633 bp, Glycine max
  Peptide Sequence Number=SeqID_189413
atgaattccattggacccaaaattgatacattggaagaatcgtctgagtcttacaatatcaattgggtgattgttccgctcctgtatcttccaaaaggaaaaaagatctctgagagctatttcctaggtccgaaagagagtactcgggttcttccaataactaaaaagtatatcatgcctgaatctaactggggttcgcggtggtggaggaacaggataggccaaaagagcgattctagttgtaagatatctaatgaaaccatcgctggaattgagatctcattcaaagagaaagatatcaaatatctggagttcctttttgtatattatatggatgatccgatccgtaaggaccatgattgggaattttttgatcctctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaa

SEQ ID NO: 72636 - DNA, 159 bp, Glycine max
  Peptide Sequence Number=SeqID_189414
atggtcgatgacatctttgtcaaggtgaaaatggaagtaacaaggacatcaatagtcctaaatgtgtttggcagtagacgaagcagtgataaatgggtttatgatcccaacatggttggctcctggtaccgaatatatgcaaccaagaatgcatcatga

SEQ ID NO: 72637 - DNA, 702 bp, Glycine max
  Peptide Sequence Number=SeqID_189415
atgcaggatgtaatccacgccgacttcctggccgccactggtcgggcccttgtcacggttgcgcagcgccgcccaactgctcagcagggcggccagcagcaggccgatgccgagcacggtgcgccagttcagggtgggcaggttcatgcgccgaacctcgccagcacggcgtccacgtggccctgggcggccagcaggatgtcgcacagttcacgtgcggcgcccagcccgccctcggcacgggtctgccagtgcacgcgctcggcgatccacggatgggcgttggccggggccaccgccaggccgaccgcacccagtggcgccagatcgggcaggtcatcgcccatgaacgccacctgttccaggccgatgccgtgctgcgcgcacaacgcctgcacgctggccagcttgtcgcccacggcgatctgggtgtcgatgccgaggtcggcgccgcgcttgagcgcggactggctgttgcgcgcgcagtttcaggcccaggccatcctgcacgaagtacgccttgctctcgttgccgtccttgtcgtagtacagccgaccgtcggtgagggtgccgtccacgtcgaagcaggccaggcggatacgggccgcggcggcatgcaggtgggcggggaaggcgggcaggggggaccagggcatcagggcggcaggctcgttgggggcaggtgcggcgttacagactga

SEQ ID NO: 72638 - DNA, 342 bp, Glycine max
  Peptide Sequence Number=SeqID_189416
atgagtacaagaggaaaccctaacccagaggcatgcccattttctccaaagaaaagcacaacgggatgcttcaagttcaagtacttaataccaggagttcttgctaaacttcgggactccaagatcactaacaatcgaaggataacacagatttctgcttctgatgaactagtcttagtaccaccggcatccacccaacaggatcagacactgaaccaggaaaacaggattcctagtttcgctcttccaacctatcacaaccgccccagttgcctcaacagaaagaaaaaactattcgcggtgactcctactttcacccctgccaacacgcaccagtcctag

SEQ ID NO: 72639 - DNA, 129 bp, Glycine max
  Peptide Sequence Number=SeqID_189417
atggatggcacttggatacatagcataggagatatgcattgtgaggaagtggtagtggtgggtggtggagcaacttgcgaagagatatgggtggtgcacagtggtggtaatacattattttatgaatga

SEQ ID NO: 72640 - DNA, 381 bp, Glycine max
  Peptide Sequence Number=SeqID_189418
atggaggtaattgaggtggatgcggaaacggagactgaaaggtgttacgagaattcgaatgtggaagaggcacctggaaatggtgacaaggttgttagggttcagcaacagtcacaatcaatgttgttgtttgatttggagatgacgaatgcgaagttgaaagtggcgagtggagagaaggtgtggggctatgagacacaacgtgatttagaaagtgttaggccccttgtttatgtggctgctggttgcaatgaagtttctctttggaatgtagagaatgtgagctgccaccggcaagacgttgaagttggcattcccagtccaaaggcaaatgaagttttactcataccagaagcaattagcataaaccccattgattag

SEQ ID NO: 72641 - DNA, 195 bp, Glycine max
  Peptide Sequence Number=SeqID_189419
atgagggaaatgccgaacgaaaaactcaaaggacaaaaggttaaattttttggtgttcctgagccttctccgacgtacccaaaggctgaagcttttttgctgggacaaaaggttaaattttatggtgttcctgagccttctccgacgtacccaaaggctgaagctttttgttgggtttggccgttctttgcttga

SEQ ID NO: 72642 - DNA, 996 bp, Glycine max
  Peptide Sequence Number=SeqID_189420
atggaggtcattttagggaacgttacaagctattttgattcagctaagcagcttgtgaatgggattcccctgccactagatcttggatccaacattgatgatgtaaaagtgaaagtcaccacgactgctgattctctctccaagaaggctaaagaaaattcaaggatgatacacaaagtcatagatggagtgagactggctcttgttactgttgctgttgttatgatctttgttgcatttctcggattgtgcatgtttgattttgtattttctttacttgctttgccgtgtcctgtatactccttggtggttattggatggattcttgttacaggcaccttgttactttgtgctgcatttctatttgtccctaagtttatcagcagagaacctttagtttccattgctgatcttacccttttcatttatgaagaattggctgtaaatgtccattacatggaatgctttggttcctttgctcccataagaggtttgactgaagatgggagccaagcccaatggtttgtagatggacaggcaacatttgaagcaattgcgacttcaattcaagatgcaaagtcagttatcttcattacgggttggtggttgtgcccagagctatatctgagacggccttttgatagcttttctacctctcggttagattcgttactagaagaaaaggctaaccaaggggttcaaatctatgtgcttctctacaaggaggtttctctagctttaaaaatcaacagcttgtacaatatgagaagactgttaaaaattcatgagaatgtgaggggttcaattctaggtgttgaggtcaacgtttctagaaaatcatattctactcaactggttgtcatggaagatgagaatgggaaccaaaattctgcgccacctcaaaacgaagggtttctcatcccgaatgtatttactttagctataccgcaggttgatggaggttccaatttatcaattaaagtttggtggtcataa

SEQ ID NO: 72643 - DNA, 650 bp, Glycine max
  Peptide Sequence Number=SeqID_189421
ggtggacacgtgtcactaggtgccacataggatttgtgtgtcctggacagtacataagcctcccaagttctgagtcggtttgcgggcagaagaggttgtccgagggtgacgagtttgtcaagccctccaagtgtggacgagtgttgtccggtgtcgggcgtggtagccttgacaaatgtgagagttacaagtcgatgtggcttgtcaagcccccgagcttggtcatgtgttgtccgagctgcttctgccaagttgttcgtgatggacgtgtgtcagcatgtgtggcacttgcgaggtactcttgcgtacatgtcacacacgaagtgggcactactggagtaacgattgtgcgcgagtggagggaactttatggtacttctttcatcatgtcttctttcttgtttgattttgccattggtctgggcagtagtgattcaaggggctcgattgaacagtccattagagatcgagaggtcatcccaattggcggttcctcgtctgagcatactcgtcgaggtgcctctgatagcaagtcctcctctttagagaaggagccagtccgggttactgtgatcctccccccttctacttttgggagtgtgaggagagttggcggcgacggagatgtgaggtcatctccctacgtttga

SEQ ID NO: 72644 - DNA, 921 bp, Glycine max
  Peptide Sequence Number=SeqID_189422
gtgggatcgggccaccgtctattgctgctccgtctattgaaaaaaggggatcaaactgctggtgaggttggccttattgttgttgttgaggaccctatgagtctccgcgccatgaggcaggttgcgaggttgatgcccactgcgggtcgtcttccaattgagcaagatgtgctttcgactacatcggccatcgaggctcttgctgttgctgctgttgaagttgctattcctgttatccctgctccttcaccttatcgtgctattgatgttgtgcgggaggttgctcctgctactgctgaagttgttgtgtcagccactcaagctggttctgagtggctagtccttgtcggtgcggcgaccactggtgcttccactatgtcgcctccttcgtcgacttgggtggctctccctgttgttgtcttggcgattatggcattgccttcttcgtccttgcgtctccctggatcatttgtcggctggggtgcagaatccactgattctgccaaggtttttctccaaaggagcttggtgattctggaggagaatgaactgcggcaccaagaggcggtgcaaaagattgcgtcactggaggcggagtaccctaaggtggtcggtgccaccgttgcttttgctgaggccgtaagggcgaatcgtcaactgtctttcaaggttgacggtgccttagccaaattgatgtgcacccggttggacagtgatgatttgtttaggcgctgcaatgggcttacccggcttacgaagttggagtctgagttgcaggtgaccaaggagaggaaggacctcgacttgggtctctttgatcccttcatggatgtgaaggatgacatcttgcttgatgaggaggaggaggctgttgatgaagggcagggtgttgtggagcaaggcgatgatgtcgttgtctag

SEQ ID NO: 72645 - DNA, 165 bp, Glycine max
  Peptide Sequence Number=SeqID_189423
atggaggttctgcgtacctcgtttgccgccaccgaccactgcaacgctcgacgccagtaccttcaccttcacgccggtaccctcaacgctgctaccctcacgaacaagacgcaatgccgcacgaaaaagagaaaacgagagaaagcacagcgaacaaaaatggag

SEQ ID NO: 72646 - DNA, 249 bp, Glycine max
  Peptide Sequence Number=SeqID_189424
atgaaagaagagaaagctacaattgaagtcccagcgcctgcgtctaatgtaatcattgaggaaccttttcttgccaaggaaaagaaggaagaagaaatcaaaggcaaaaaacctgcaatggaactagctgccttagatgaggcaactgttaagtctgtgaaagccatgtttaaggatgaagtgatctgcacttctgaagacattgatgatagaggatacttggtatcagatgctcgaagtataggataa

SEQ ID NO: 72647 - DNA, 291 bp, Glycine max
  Peptide Sequence Number=SeqID_189425
atggatgaactgaaggatttgatcaaacaagttgcgcctcgtgggattctcccttatgatgttgatgaaacacaaatggtaacgcgattgtttttttggaaaccaagtcaccatgagtattcagaaaaagttataaaatttgaaataattgaactcaaaaccaacgagaacgtgatgaaggtgctcattgaatctaactactggaaaaagtttgggccaatagaaattttagctgttttcagtaaacctttaccgcaaatggaagacgagttgtgtttgtcgcaaaattag

SEQ ID NO: 72648 - DNA, 189 bp, Glycine max
  Peptide Sequence Number=SeqID_189426
atggcttgcatggcactacatgatgcgggggcagggaatccttccccgctttccgtccccgaaccttatcatgctccccgtccccgcttcctgtggtggggtattttttatcccgttctcgttcctcgactccctgtgagacctacggagactccgttttatattaaaaatgtcaaaaattataaataa

SEQ ID NO: 72649 - DNA, 195 bp, Glycine max
  Peptide Sequence Number=SeqID_189427
atgagagaccgacacaagccttcaatgacgacagaggcacacgacattccacagcaaaggccatgcaacatagttgaaacgttcgatgatgggtgtgaatccttgattcaagatttcttcaagatcaagcattgcctcacaatgaaaggtttcaagtcattcaaggcacatgtaatcgattaccaatacatgtaa

SEQ ID NO: 72650 - DNA, 213 bp, Glycine max
  Peptide Sequence Number=SeqID_189428
atggtgcctcctctcacctcttctcctttatcttcccctacaattccatggttgaaaatcaccattgaagctcaaagatccagcctccatagaagcttctcaagcaaacttatatatagcaataagggtaacaaagggtggatagccctcaaggtgaatctgagaaagtgtatgatcgcctcaagtgggagttcattcatgagactttattag

SEQ ID NO: 72651 - DNA, 315 bp, Glycine max
  Peptide Sequence Number=SeqID_189429
atgagggttcttaaggataaagccttaatccatcttattggtagtgatttggaagccaaagtcataagttttattcggcctgtgggcagttgtgatcttcccaagtttcattatgttccctcccatatttatgatattatcttaaccttggttcctcctgtgattactaactttgagaatgtccttgcttggaagtttaatgcagatggagatttatctttatcctcagcttatcaagtggccttcagggatatggttcagtctgattcgattttaaagcttatttggaggaacttggttgatactgatctttga

SEQ ID NO: 72652 - DNA, 115 bp, Glycine max
  Peptide Sequence Number=SeqID_189430
gatggtgagtcaggaggagctggagcttcagcatctgagtcatcaggaatgagtatcaaaggtggtgccggtggagctggtggaagagatagtatctcaacctctggagaagcag

SEQ ID NO: 72653 - DNA, 501 bp, Glycine max
  Peptide Sequence Number=SeqID_189431
atgacagaaaggttaaccaaatctttgcttgatggtgttggaataatgagtggatcagtgatgactcctgtgctgaaatcccaaccaggacaggcattcctaaatatgctccctggagaggtgctgttggcttcccttgatgccgtcaatagagtttttgaagcagctgaagctgctgaaaaacaaaccttttctgccacctctcaagctgcaaccagaatggtttctaacaggtttggggaagaagcaggagaggctactgagcatgtgtttgcaactgcaggacatgctgttaacactgcttggaatgtctctaagatacggaaggccatcaatccagcctcttcagcaaatgctgcaggagcactgagaaattctgccaaaaatagaaataccttagaagaaacaaactataaaaagtgtccacatgaaaaagctcctaatcctgaaaggacttcttttcctccagtagggccaatgattattactatgaggaaataa

SEQ ID NO: 72654 - DNA, 669 bp, Glycine max
  Peptide Sequence Number=SeqID_189432
atggccgaatcatccaggaagcgcaagggttcatccacctccactacggcaactagaacaccacgtctcggagccaccggagcatccccgacacaaattccaccttccttgtcatcctctacattgttttcatctgatgaacagcgtatctgtcaaggtgcaccttttgagggcaccattgttgacgactggaagtttgattactccagtcttgatgcccgtcgtatggtcaacaatgatcaggcacatatgaccggtagattgcttgctggttcattgacattcgattgtcgcatcatgcatttcatcattgttcacattctattacccagatcatcaaacttagctcaagcctctgaagaggatttaatattgatgtgggcttttctcaccggtcgtccgattgaatgggcccatttgatcagataccacatgcataaggcattgcggccaaatgcacctctgccttatccacagcttgttactttgtttcttcatcattttcaaattcccttggataatgagccctttgtgaaagtcaaatgctcttttgctattggtgccggtgcggtaacctccttaggctaccataaggacatggatgggcaatggttgaagaaggacgcgcaaccttcgcaagacgaacatactccctctcctccaccttaa

SEQ ID NO: 72655 - DNA, 339 bp, Glycine max
  Peptide Sequence Number=SeqID_189433
atggtgttaggagagaaagagaaggataagaagaagaagaaagctaagaccctcacagctgaggttgctttagtgttgaagcagtctctggggttggatcggaggaggggccatgcacaagtcactcctctgcatgtggctgccactttgctaagccttagaggcagttccttgagaagggcttgcctcaagtctcagcctcaccaaacttctcatcatcctcttcaatgtaaggcctttgaggctcaccagagaaggggctgcattgagcaacaacagcaacaacctttgctcaccatcaagaaggataaagggataaagggagaccaagaaggatag

SEQ ID NO: 72656 - DNA, 267 bp, Glycine max
  Peptide Sequence Number=SeqID_189434
atggagttagagcaactcgatgtcaaaataacctttcaccatggaggattggaggaagaaattctgatgcaacaacctgaaggttgtctcacgtgtgcaatggtgtgcacaagactagacatagcacaaatagtcaacattgtgagtaggtaccttaagagtacaactgatattggaccgatctatcaaggtgacatatcttgtgtccttgctgaatattcagattctgactacactgtagattggatgcaagacaatttgttatag

SEQ ID NO: 72657 - DNA, 240 bp, Glycine max
  Peptide Sequence Number=SeqID_189435
atgtctagtgttggacttagtgctcttgtggaagttgtaggcattggtaatgggaaggaagaccttaagcttgcagtagaagaaactaaagttggtggttgcaatgaggaagaggcagagaagggatcctacaaggttcatgacaaactagaagagatacatcctgatgacgaacaggttaacgatgttgtcatccaaatcatcgaaaaaggtcaggtcggccctcccaatcagcaatga

SEQ ID NO: 72658 - DNA, 519 bp, Glycine max
  Peptide Sequence Number=SeqID_189436
atgccactaaagggcaagcagttggtggtatacccctgcaaaacactttggagggcaaggctcaaggtcgttaaaggaggcagagattatgccttagctaacctagaagagttgttcctagtacccaatatcatcacccctcccaagttcaaggtgctggactttgacaagtacaaggggactacttgcccccagaaccatctaaagatgtattatcggaagatgggggcatacgcaaaagatgaggaactactgatacatttcttccaagaaagtcttactggagtagttgttacctggtacactaacttggaaccttcccgagtccattcttggaaggacctaatggttgctttcgttaggcatgaatctttcaaagaatacacccaaaggtggagggatcttccagcccaagtggttccctcaatgacggagaaagaaatgatcacaataatagtaggcacattaccagtgttttactatgaaaaatggtgggtacacaccttcaagctttgctga

SEQ ID NO: 72659 - DNA, 366 bp, Glycine max
  Peptide Sequence Number=SeqID_189437
atggttggtgtgctcctaaagagaagaatattgatgcagcatgggaagtcgcaggggaaccgagacacgacgacgtacaccaccacactccaccacaacattcagtcaatggcgcaaggcatgacacaggtcctctgtgccggtgagcaccttcatcgcgtgatggatagcaaagactgctcccttgactggcggatacagttctacatgtccccctacgcccacactcagaaacaacatgtatgctcttatcataataacaagcttcattgtagtggatcacaagggttgaaatcgttgtctggaaggtggtggatcttgatgataactgtgttttcagtgcatagtttgtggattggattctag

SEQ ID NO: 72660 - DNA, 225 bp, Glycine max
  Peptide Sequence Number=SeqID_189438
atggcagattggcccagttttaggacgaagccaccgtcattgaagttttctcccaaagaatcaaacaaagttgcttcaaaagataagcatggcttcaagattaatacaagattgcttcaacaaacaaagccttgcttcaagattaactcaagatcaagccttgcattaaaacgaagtgttttcaagacatgcaaggctctggtaatcgattaccaggcagtgtaa

SEQ ID NO: 72661 - DNA, 507 bp, Glycine max
  Peptide Sequence Number=SeqID_189439
atggtgcgtttaacaagggagagaaaatatcaaagtatttatggtcaagaaatatgcctgaaagagattggtatagaagaggttgtggaccaacaagttccagaaccaactgttgtctttcctagtggccttaaggacttgtcactgttgacctcatacgctgatcatggggcttgggaagtatggggtggcatggaacgtggtgatataaagttagtatcacatgggagaaagttgcagtcaaatattgtcctccatgaccagatattggatgtgagagatggcacaaagaaagaaacatttcatttgcccgtgagagagatgtcaataacactagatgatgtggcatcgttacttgacattcccatcactgacgctttttatgattttgaacatatggataaggaagcggcaaatcctttgcttgttgacttacttgttgttgaatacaaggaggcatttaatgagaccaagataacaagaggtggactagtccatttaagttga

SEQ ID NO: 72662 - DNA, 209 bp, Glycine max
  Peptide Sequence Number=SeqID_189440
atgggatgttgtgtgcgacatcaccatgatggtggagaggagttgcatgtgcagagccttgaaggtggagatcgcgcacaccatggaggagatgagatagagtggtggcgcaacttggaggtggtcagtggtgataatggttacatgactgtggtgagggggtgggtggtcatgtttctggttttgtccggggattgggtgagaagaag

SEQ ID NO: 72663 - DNA, 336 bp, Glycine max
  Peptide Sequence Number=SeqID_189441
atgcggggaagggtatttttggaaattgaaaatgttggtggggtgaatagtgatgaggtcgggaccaatagtaatttccagacaacaatcgtagcccaagccagccagcgcatacaggccgatacgagcccaaatccacttcaggcctctaattcatcattggtgagtggtgacataaataagcatttgcctacgttgttcgtgttggatgcttccaacttctcattgttctctgcatcattctcagggcacaagggaaaagctcaagccagtttaaacgataataagaaggtggccaggcatgttgtgggtcctacacgggatttcacccaataa

SEQ ID NO: 72664 - DNA, 420 bp, Glycine max
  Peptide Sequence Number=SeqID_189442
atggtgtggctcctagccacatgcactcttatttcacttttctcaatgtggaacttgacaaggatagaagttctactttgtaacatattgtccccagaggcacctcgactttctctgacttcttataattggtttaaagtattcattgcaatgctggtgggtaactttttataccctatatctgcagttcgttctcattttactcagtctattaattggtctggcattatataccatttgaaagatggaaaaatcaacaagatagatagaataccaaaaaggcaggatgtggctccagttttcactgacttgggaggaaaacatttgtatggaaagaaagggatgcctaccaaggtttcattcctcagttctatgaacaaacgtttgttccaatggcgtcaacctaagaaatttgagtaa

SEQ ID NO: 72665 - DNA, 1005 bp, Glycine max
  Peptide Sequence Number=SeqID_189443
atgcggaacggcaacaactatgcattcctttgtcaagatattaatgaacttgagcactccaatcaggctggtcttccaaaagtaacagtaattatgcccctaaaaggatttggagaacacaatctccataactggaagactcagttaacatcactttacggtggccctcaagaatatcttttagtagttgaaagtacagaggatcctgcatacaatgctgtagcaaaactaatagaagaattagaggattctgttaaagctagggttatagtagctggtttatcaacaacttgcagtcaaaaaattcacaatcaattggttggagtggagacaatgcataaagatagcaagtatgtattgtttttagatgatgatgttaggctacatcctggatcaattggagcactcgttcgggaaatggaaaagaatcctgagatatttattcaaaccggataccctcttgatttgccttctggaagtctagggagttactgcatctatgaataccatatgccttgttcaatgggctttgccactggtggacaaacattctttttgtggggagggtgcatgatggcaatttttctccagatgcattctgaagacttcaggcaagataattgtggtatagtctcggcacttcgagacggtggatattctgatgatatgactcttgcagccatagctggggctcacaaaaagctcattagttctccagcggttgctgtctatcctcacccccttgcaagtgatcttaattttggaaggtactggaattatttgaggaaacaaacatttgttttggagtcatatgtaaccaaagttaaccaagtaatgaaccgtgcattatttgctgttcactgttatttgtcatggggatttgttgcaccatactgcatggcagtgattcatgttgccgcagcactaagatttcgcgctagggagtactcacttgaaggaataaattacacttctggtggtgagaacactactttcccttcgtag

SEQ ID NO: 72666 - DNA, 345 bp, Glycine max
  Peptide Sequence Number=SeqID_189444
atggagataacaagcactagaaagttgaaattctcaaatcatacatctcttgaacattacaatcctggagcaactgacttagctattgctccaaatctccaatgcagaagtcttcaatcatgtcaaagactcgagttgcatgctgaggtaaattcagacaaaaatcttcagtactcagtagagataagcaatcagcaatgggcaaaaggaacaaatgaatacccaaaaaatccttcagttgaatcatctcccgcatgtgcaagaatggcatcaccacctggatgttcttccacatatgaggtaacatcatatacctacagtgggatgaaaccccaagaaatgtaa

SEQ ID NO: 72667 - DNA, 519 bp, Glycine max
  Peptide Sequence Number=SeqID_189445
atgaaactcatgatcacaagggagttggacacgaccaccctcaatccaattcgtgtcatgcaagacccttatcctggtgtgacacaaatccacacgtgcatctttgtgccactagccccaactatcgtgagagaagggatattagatcaacaaatttggtttgatggtggtgtggtcaatggtggtggtggtggttgggtttggttgtgtggtggttggtggtggttttatgtagtgaacttagattgttctatggcaaggccatgggagcaaaccattctgccatctgacatggcagcaatgagaattacatgtatctctctcggcacttggaataagatattggacgtcggatgcggacacacaacaaatgagaattacagccatatcattcaatgcacaagtacagatagcatgagtctggctttggaatctcgaaatggtgttgttggcagttgtgacctgacaggcctgtgggtgttcaaatctcacgatggaaatgtggttaaagaaaattga

SEQ ID NO: 72668 - DNA, 147 bp, Glycine max
  Peptide Sequence Number=SeqID_189446
atgttgacagaacttggccatacagttcacacctccttatgtgtgaaagcctacttgactaggttgatgtttaggctgggggtgatgaggtcaggactccattctttaagtacatcgtggtttctctttatcaactgggaagattag

SEQ ID NO: 72669 - DNA, 231 bp, Glycine max
  Peptide Sequence Number=SeqID_189447
atggctgccattgatgattctaaccccttcattcttcattcttatgacaatcttggcattgccttagtttctcatcctttcatcgtgttctctgttgatgtggtgttgtggatgaattggagtggagcggttgcagtactcgtttatgccaccgcattgtggtacctcttcgagcgtgtcggttacaatttcttgtccttcgtcaccaaagtttttgccaacaagctttga

SEQ ID NO: 72670 - DNA, 3036 bp, Glycine max
  Peptide Sequence Number=SeqID_189448
atgacagtaccattttactattgttattatttatccatattcctaatcctgagccatgtacactctcagactcagctgcaagatcaagaacatgcagtcctaatgaatataaagcggcacctaaaaaacccttcattcctcagtcactggacaacatcaaacactgcctctcactgcacttggccagagatcacatgcaccagtgactactcagtcactggattgactctggtcaacagcaacatcactcaaacactaccacctttcatgtgtgacctcaaaaatctcacacttgttaatttcagtaggaatttcattccaggggagttcccaacatttctctacaaatgttccaagctggtttacctcgacctcgaaatgaacgatttttcgggcaccattcctgatgacatagacaacttggttaacttgcagcatcttaatctcggttccacaagctttagtggggacattcctgcaagcattggaaggttaaaggaactgaaaatgcttcaacttcactattgtctattcaatggtactttcccttatgagagtattgccaacttgttcgatcttgaattcttggatatgtcctctaacttggtgctccctccttccaagctctcgtcaagcttgacccggttgaaaaaattgaagttctttcacatgtacagttccaacctgtttggggaaatccctgaaaccattggagaaatggtggctttggagaacttggatttatcgcgaagcaatttaactggacacattcctagaggcttgttcatgctcaagaatttgagcacactgtaccttttccagaacaagctctctggagagatacctggtgtggttgaagcatcgaatttgacagaaatcgatcttgcagagaacaatcttgaggggaaaatacctcatgattttgggaagctccaaaagctaacactgttgagtttgtctctcaataacttgtcaggggagataccacaaagcgtaggccgtattccatctctgatatattttcaggtcatgttcaataacttgtcaggtattcttcctcctgattttggtctctactcggagcttaaaacatttttggttgcaaacaacagttttactggaaggctcccagaaaacttgtgctatcatggtcagttacttaatttaactacttatgataattatctgagtggtgaattgccagaatcaattggccactgtagtagcctgaaggatttaaaaatttacagtaatgagttttctggtagcattcctagtggtctttggactttcaatttgtcaaatttcatggtgagttataataagttcactggtgagcttcctgagagattgtccccaagtatttcgcgcttggagataagtcacaatcggttttttggtaggattccaactggtgtatcttcatggactaatgtggttgtttttaaagcaagtgagaacaaccttaatgggagtgttccaaaaggtttaacatctcttcccaagctaacaactctattgcttgatcataaccagctcacagggccacttccatcagatatcatatcatggcaatcccttgtaactctaaatttgagccaaaacaaactctctggacatatcccagattcaattggtctgttacccgtccttagcgtactcgacctgtcagaaaatcaattctctggtgaagttccttctaaacttcccagaatcaccaatctcaatctatcctccaattatttgacagggagggttccaagtgaatttgacaatcttgcttatgacacaagctttttggacaattctggcctctgtgctaatactccagcactgaaacttaggccgtgcaatgttggctttgaaaggccatccaaaggctcttcttggtctcttgctttgattatgtgcctggtagcaatagccttgttgctggttttgtcgatttcactcttgattatcaaacttcaccgaagaaggaaacgaggatttgataactcatggaagctcatttcctttcaaaggttgagtttcactgaatcaagcatagtgtcatcaatgtcagaacataatgttattggaagtggtggatttggtacagtataccgtgttccggttgatgctttaggctatgttgctgtgaaaaagatctccagtaacagaaagttagaccacaagctagagagctcatttcgcgcagaggttaaaatactgagcaacattcgtcacaaaaacattgtgaaattgttgtgctgcatctctaatgaggattctatgctccttgtttatgagtatttggaaaactgtagcctagataggtggctgcacaataagagcaaatcaccaccagctgtgtcaggttcagcgcatcattttgaacttgattggcaaaagagattgcaaattgccactggtgttgctcatggtttgtgctacatgcaccatgattgctcgccaccgattgttcatcgagatataaaaacaagcaacatccttttggatgctcaattcaatgcaaaagttgctgattttggtctggctaggatgttaatgaagccgggggaacttgctaccatgtcatctgttattggctcatttggctatatggctccagaatatgttcaaacaacgcgagtcagcgagaagattgatgtattcagctttggggttatactactggagttgacaactggtaaagaagctaactatggtgatgagcactcatctcttgcagagtgggcgtggcgccaaattattgtaggaagcaacatagaagagctgctagacattgatttcatggatccaagttacaagaatgaaatgtgcagtgttttcaaacttggagtgttgtgtacttcaacacttcctgctaaaaggccttccatgaaggaggtgctacacatattgctccgctgtggagaaggatttgcgtttggagaggggaatgttaggcaatatgatggtgttcctcttcttaagaattcaaaatgggagagtagtttggatgctgttgacaatgatagtgatagtgactag

SEQ ID NO: 72671 - DNA, 231 bp, Glycine max
  Peptide Sequence Number=SeqID_189449
atgacatctatggccatgagagagaaaaaaaaggaatcaaccaggcattcgaaagaacttaatcatcctcatgaaccacccgatgtgggactcgcaacacgcccccttgagtcagggctcgacgccacaaagcgaaggctaacagcactatccacaccatcgagcagaaccacaaataacttcaataggaagcaagagacacggaagcaaaaactgctgataccatattag

SEQ ID NO: 72672 - DNA, 180 bp, Glycine max
  Peptide Sequence Number=SeqID_189450
atggtcgagagggtactaggccaaggccaagccaaatacctaaggaggtgcaacacatattgcttagctgtggacaaggatttgcgtttggagaggggaatgttaggcaatatgatggtgatccccttaagaattcaaaatgggagtagtttggatgctgttgataatgatagtgaataa

SEQ ID NO: 72673 - DNA, 3042 bp, Glycine max
  Peptide Sequence Number=SeqID_189451
atggaattattcactccaccatgtcttaaattgttatttcactctcttgtgatcttattcttgctctttaaccatgcaaacactcagtctcagtctcagttgcatgatcaagaacgtgcaaccttactgaagataaaggaataccttgaaaaccccgaattcctcagtcactggactacttcatcaagctcctctcactgctcatggcaagagataaaatgcagcaatggctcagtaactggattgactttgtccaacagcagcatcactcaaaccataccctctttcgtatgtgacctcaaaaacctcacaattgttgatttctacaacaatttgattcctggggagttcccaacatctctctacaattgctccaagttggagtacctagacctgtctcagaacaactttgttggcagcattcctcatgacattggaaacctctctaattatttgaagtatctcaaccttggttacacgaatttctctggtgacattcctgctagcattggaaggcttaaggaacttagaaatcttcaacttcaaaataatctattgaatggaacattccctgctgagattggcaacttgtccaatcttgacaccttggacttgtcctctaacaacatgcttcctccttcgaagttgcacggtgactggacccggttgaacaagttgaaggtttttttcatgtttcagtccaacttggttggggagatcccacaaaccattggaaacatggtggctttggagagattagatctatcgcaaaacaatttgagtggaccaattcctagcggtttgttcatgctggagaatctgagcataatgtttctatctagaaacaatctttctggggaaatacctgatgtggttgaagcattgaatttgaccatcattgatctcacacggaatgttatctcaggaaaaataccagatggttttggaaagctccaaaagctaaccggtttggctttgtctatgaataacttgcaaggggagataccagcaagcataggacttcttccatctctggtagattttaaagtatttttcaacaatttatcaggtattctccctcctgattttggtcgctactcaaagcttgaaacatttttggttgcaaataatagttttagaggaaacctaccagagaacttatgctataatggtcaccttcttaacatctctgcctatataaattatctgagtggggagttgccacaatcacttgggaattgtagtagcctgatggaactgaaaatctatagcaatgagttttctggtagcattcctagtggtctttggactttaagcttgtcaaatttcatggtgagttataataagttcactggtgagcttcctgagagattgtccccaagtatttcgcgcttggagataagtcacaatcggttttttggtaggattccaactgatgtatcttcatggactaatgtggttgtttttatagcaagtgagaacaaccttaatgggagtgttccaaaaggtttaacatctcttcccaagctaacaactctattgcttgatcataaccagctcacagggccacttccatcagatatcatatcatggcaatcccttgtaactctaaatttgagccaaaacaaactctctggacatatcccagattcaattggtctgttacccgtccttggcgtactcgacctgtcagaaaatcaattctctggtgaagttccttctaaacttcccagaatcaccaatctcaatctatcctccaattatttgacagggagggttccaagtcaatttgaaaatcttgcttataacacaagctttttggacaattctggcctatgtgctgataccccagcactgaacctcaggttgtgtaattctagccctcaaaggcaaagcaaggactcatctttgtctcttgctttgattataagccttgtggcagtggcctgcttcctggctttgttgacatcactcttgatcatcagattttatagaaaaagaaagcaaggattggatagatcatggaagctcatttccttccaaaggctgagtttcactgaatcaaacatagtgtcatcactgacagaaaatagtattattggcagtggtggatatggcacagtataccgtgttgcagttgatggtttaggctatgttgctgtgaagaagatttgggaacacaagaagttggacaagaatcttgagagctcatttcatacagaagttaagatattgagcaacattcgtcacaaaaacattgtcaaattgatgtgctgtatctctaatgaggactctatgctccttgtctatgagtatgtggaaaaccatagccttgacaggtggctgcaccggaaaaataagtcatcaaccgtgtcaggttcagtccatcatattgtccttgattggccaaagagattgcatatagccattggagctgcacaaggtttgagctacatgcatcatgattgctcaccgcctattgttcatcgagatgtgaaaacaagcaacattcttttggattctcaattcaatgcaaaagttgctgattttggtctggctaggatgttaatgaagccaggggaacttgccaccatgtcatccgtgattggctcatttggctatatggctccagaatatgttcaaacaactcgagtcagtgaaaagattgatgtcttcagctttggagttatgctattggaactgacaactggtaaggaagctaattatggtgatgagcactcatctcttgcagagtgggcgtggcgacatcagcagttaggaagcaacatagaagagctgctagataaggatgtcatggaaaccagttacttggatggaatgtgtaaggttttcaaactcgggatcatgtgcaccgcaacacttccttctagtagaccttccatgaaggaggttctacgagtattgctttcttgtgaagattcattttctaaaggagagagtattattggccactatgatgatgttccccttcttaaaaattcaaaaagagagcataagttggatattgataatgatagctag

SEQ ID NO: 72674 - DNA, 402 bp, Glycine max
  Peptide Sequence Number=SeqID_189452
atgtgcgtgtccagacttaggatgttggctctcaaggggcatgggagtggagtggccaacgttctcctcgggcacatgtacaacattgggtggtgcatagttgggaggcaggccatatggtggaaaaaggtgcttgctctagacctgcacaaaatggggaccacccgtacttcccaatgcttaccctccctaacctaccatatccgaaactggacaacttacttgattcacaccagatgggtgggtcaaatctacctcagtggtggcacttgtagtggcaaccgcaactcatttggtcatttggtctttcatggcctccatgtcggccatcatatgttcctaaacttcctctatctcgctcatgattcaagccttggcacgtgttcagtaagggtgtcgtaa

SEQ ID NO: 72675 - DNA, 1697 bp, Glycine max
  misc_feature (15)..(15): n is a, c, g, or t
  Peptide Sequence Number=SeqID_189453
ttttcagtggaattntcattcctggtgagttcctaaaatctctctacaaatgctccaagcttgagtaccttgacctctcacagaattactttgttggcaagattcctgatgatattgacaacttggctaacctgagttttcttagccttagtggcaacaacttctctggtgatattccaaccagcattgggaggttaaaggaactaagaaatcttcaactttatcagtgtcttctcaatggtactttccctgctgaaattggcaatttgtccaaccttgagtccttgtatgtgttctcaaaccacatgctccctcccacaaagttgccatcaagcttgacccagttgaacaaattgaaggtctttcatatgtatgagtccaacttggtaggggaaatccctgaaaccattggacacatggtggcattggagaaattggatttgtcaaaaaatggtttaagtggacaaattcctaatggtttgttcatgctgaaaaatctgagcatactatatctttaccggaacagcctttccggggagatacctagagtggttgaagcattcaacttgacagaacttgatctttcagagaatatacttagtgggaaaatacctgatgatttgggaaggctcaataacttaaaatacttgaatttatatagcaatcagttatttgggaatgtaccagaaagcattgctcgtctgccagctctgacggactttgttgtttttctcaacaatttatcaggaaggttgccagagaacttgtgctaccatggaagtttagtaggtttaactgcttatgacaataacctgagtgggaagttgcctgaatctctaggaagttgcagtagcctgaatattctaagggttgaaaacaataatctttctggtaatgttcctagtggtctatggacatcgatgaacttggaaagatttatgataaatgaaaacaagttcactggtcagcttcctgaaagattgtcttggaatgtttcagtcattaacaacctcttcaatggtagtattccactggagctaacatctcttctccatctaacaactcttctgcttgatcataaccagctcacagggtcacttccatcagatataatatcatggaagtcgctaataactctagatttgagccacaatcaactctctggagtactcccagatgtaattgctcagttacctggccttaatattttggatttgtcagaaaacaaaatctctggtcaaattccacttcaactagcccttaagagactcacaaatctcaatctgtcctccaatcttttgacagggaggattccaagtgaattagaaaaccttgcttatgccagaagcttcttgaacaattccggtctctgtgctgatagtaaagtactaaaccttaccttgtgcaattctaagcctcaaagggcaagaattgaaagaagatctgcatcttatgctataatcataagtttggtggtaggagcctccttactggctttgttgtcatcattcttgatgatcagagtttacagaaaaagaaagcaggaaatgaaaaggtcatggaagctcacttcctttcagaggctgagtttcacaaaaacaaatattgcgtcctcaatgtcagaacacaatattattggcagtggtgggtatggtgcagtatatcgtgtcgttgttgatgatttacattatgttgcg

SEQ ID NO: 72676 - DNA, 199 bp, Glycine max
  Peptide Sequence Number=SeqID_189454
gcatctcactgaacatgtatgcgagcggggattatgatatctatggattcctcgagcctcagtccattcaaaggtctgggcaatcgcagtttgaatctgaaagttacataaagagttggatgcagagttcacaacgcgatgtgtatcttggagcctacctaaatgggacagacaactaccttaaggggattattaatag

SEQ ID NO: 72677 - DNA, 258 bp, Glycine max
  Peptide Sequence Number=SeqID_189455
atgacactagaatctcgtacaatgtacaacttggccacaagtgtagcacatgtgccgaaaggaaatccataccataatgcaacttctagagaaatggtcatctatcgtgcaaataacattattctcagaaaggaaatgatgcaatcctaccccccaaggacattggatagaagactccaagaagattgggcaaaagatgcaagagaaggcactagggttctcatgagccttagggtagatttcaggcccatgggctaa

SEQ ID NO: 72678 - DNA, 1056 bp, Glycine max
  Peptide Sequence Number=SeqID_189456
atggagctggttgaaccaacagttcaagaaatcaattgggaacggagagcattgttttcttgggaggaagagcaactagcccagcttgaatcaaagattgctcattacaacctacaacaccaactggacaatgagattggttattctttttcactgccagatgttttactgcagttttacaagctttttgctactatggtcaaaggaaaaaaatcaacgaaatcaaaacatttgttgtggcattgtgcctgctgcaatttatggaagatgagaaatgaggcttatgatgggcaaaaattacttcaacattctaagattatatggcttgggcttatgatggatggcctgtgcaggaaccatatgttgtcggatgcaagaggattgatggatctgatgatgaggaatggggtttacccagatacaattgcttatagtactctcttgcatggatactgcagcagagggaaggtttttgaagctaaaagtgttcttcatgaaatgataaggaatggttgtcaacctaatacttacacctgcaacacattgctccaggaaatggttgtaatatttgcagttataacaatattatcacttgcctctgtgaaggaggaaaggcaaaggatgccatttcccttttacatgaaatgttggataaagaatttcatgtataaagatttgattgcaagactttgccaggatgaaaggtttgcagatgctaatagccttctttataaattgattgataagggatatggcttcgatcatgcatcattcatgccaatgattgatggcttaagtaaaagaggaaacaagcggcaagtagatgaactagcaaaaagaatgatgaaattggaattggaagacagacttgttgataggacttattcaaacagaaaaagagtcattcttggaaaactacataaagatggaggaagtgactggcaggacataattaacagcacaattgactttcctgaaatgaccgcaggagcacttttcgaaacaccaataagcgcaggatcaacaatggctaaaatcactcctaatggaatctga

SEQ ID NO: 72679 - DNA, 417 bp, Glycine max
  Peptide Sequence Number=SeqID_189457
ctggttccctccgaagtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggacgtggcggctga

SEQ ID NO: 72680 - DNA, 474 bp, Glycine max
  Peptide Sequence Number=SeqID_189458
gaagaaacctggaggtgcaggaagcaacagccgtgtttgctttgctcctccgttcactacaagaatttgtttcagaagattccaacgacaacaaaagagagattcagcaattgaatgaagttcagacagaagctatggacgcagattctgaatatcgtgaaaatagtgattcttcatttgtttgggatgagaattcacaactttacttccacgccagtagtggattctaccatgaccctaatgctggctggtactatagcagcaaagatggttgcaaatttgaggatgggaattatgtacttttaggttccaataaggatgataacgtagaaacgtatccgtgcgacgaaactacaacagaaaatcctcaacaaatatatgatggtaacaatgatgaggatcacccttccttccttgaaagtaaatatgaaactcaccaacaggcaggaaccctggttgatgaagcacctgcta

SEQ ID NO: 72681 - DNA, 479 bp, Glycine max
  Peptide Sequence Number=SeqID_189459
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatgaacgatatcgtcataggcgacagtaagagggctaagagtggtagggggagcaagtttgcccctatcgctattcctatgtacgagtgggcttctgcagaggtcaactcataccctagttggcttcaaactcttgtgtctatcgagggtttgaaggggagggtcgatataacgacattgggtgattccaagttactgatcgtagagccctatagcgtcgagaagcgtgtttcatga

SEQ ID NO: 72682 - DNA, 222 bp, Glycine max
  Peptide Sequence Number=SeqID_189460
atgattgacctgatcttagccctgaagatcgagatatgtggattgaagatctggtgggagagaaaacttcaatatggcagacagatgaacttaggcgttcaaaacccactccagttgatgaagctagggcagttgttcctaagaatggtctatggccattttgaccaagtgttcaagagttttgtccttgttatccccaaaggcacctacatgaacacataa

SEQ ID NO: 72683 - DNA, 675 bp, Glycine max
  Peptide Sequence Number=SeqID_189461
atgccttcggcgaggctttcagggtcaccaaggctcgacgttgctattgacatgggcaatccatttctcaatctcactgttgatggtttccttaagatcggagctgtcgcagccacgcgatcagctgctgaagatacttatcatattatccgaaacgggaatatctcaagtcatgatttcgagaaaacgttgaagaagatgtgtaaagaaggtgtatattggggaactttagctggtgtttatcttggaatggaatatggggtagagaggatccgtggcaccagagattggaagaatgccatgattgggggtgcagtaactgcgactctgttatctgttgccaccaccaacaacaaagacaaaattgtacctgatgccattactggggcagcaattgctactgctgcagacttgcgtagtgttattgcctccataatatttcctagcccatcaaaaacatcttgtcctcaaggtgttagctgtaggaagattgaacctagatccaaaattagaatgggtgtaggaatgagtgaatgtatattagtggcacagaggcagaactatggtcgtgacggtaatgttggtggacagtgtgaaacacctccaacaaaatcacttgtgccgcaacttgtgtcatcgacagagggggcacctcctttccttttctggccatga

SEQ ID NO: 72684 - DNA, 483 bp, Glycine max
  Peptide Sequence Number=SeqID_189462
atgacgaaggaagtaatccacggtcacaattttgtagcgcctcagctccacttttcctcttctccttcttcttctacatttttctctctggttttaggctcctccccctttttcctcttcccttgcatggctatttatagaaaacaaccattgagtgcagggaagggaaattcgcccaagctagctgcttgcttagggctatgttggatttcccctatagttactttttgggaaaaggaagaatcaaaagaattctcagactgtgtcgttttgaattctttgacaagagagaagggagacacaaaagaattcaggcggttagtccttggcgaattctttttggcaaagggagaagagatgaaaagaatgaataacacaagttttcaaggtttagaaaaccagaaaactttggaaagcttttggtacaaagaagaagaagaagtttcaaagagattcaaggcttgtaaaggattgtatgaataa

SEQ ID NO: 72685 - DNA, 480 bp, Glycine max
  Peptide Sequence Number=SeqID_189463
atgggtggagtgacaaaagttttaccttactgcttgaggaaatgggcccttacagccaatcaggatggtgtggacgacactgtctgtgagaaatacgacataagcaaggaaaaaggggcccagttttgccagacttgcagagacccttcttgggagatgtgcggaaaaaggcaaaggtcatccagaagtagaacactacccccccatgttttgtctcgtgggggttatgaatatttagagcataagctcctggctgagaagaccaggaagaagctggaggaagctgcacaatcaggaagcgttgatggcgtcattgaccctccatcccccgtcagacgccacgtgaagtggaagatggcccgcaccaagaaaataggggagatgacgactgaggctgcaaaggaaatcgctgagaagatcgcaagtcattttcaactaaccattagaattatatttctttattttgtgaatgccatgtga

SEQ ID NO: 72686 - DNA, 948 bp, Glycine max
  Peptide Sequence Number=SeqID_189464
atgcaatcacagggactcacactccctcctgagcttgaggttggtcattcagctgctcgtgtcagcacaaaggaaagttgtgttgataactcagggaacgacccagacacaggtgactcagagaaatgcgggttgtacgtcgaagaaaatcctccccacctggtttccttaagaagactttatgaggggtcgacaaccgttcacaacatccctttgcgccatgatcaagtgatcccattcatgtacccactgaagaggttcagtgcacttaacaccttcgttgcttggccaacacatcttgtcaagcatttatcagaacatggagctatgggattggtgaaacctgcagataggccgaatcatgatgtcgatgatcccctatatctaattacattgaccatccaacaactttttcttaactcgttgcaggttatgagggatcttaccgtgtttggggtgtttaatgacaacttccccttgcatatgattgagacaagtatgcgagcgggagatgctgatgtgtatggattcctcgagccacaatccatacagagatctgggcaatcacaatttgaatcaaaaagttatattaagaagtggatgcagaattcaaagagggatgtgtacctaggagcctacttgaatgggccagacaactacctcaaaggaattattaacaggtcagttctatttttcaatacatttgcattagcactagttgggaacattgatatttcaattgtacaatacgcatccatgtttgtattaaaaagtactttgaaaggatttaacgatactccacaaagtaaatcaaaggttgctgctaggtggatagttgttaaatatttcaatgatgctagaccattggaaccaaagagattgaaggcgcttcacatccagtgggcaacttattatttgaaagttaaaaatgaaacaattagtgtttaa

SEQ ID NO: 72687 - DNA, 501 bp, Glycine max
  Peptide Sequence Number=SeqID_189465
ttgttggaaactgagaagctaccaagttgtggacaattatatattgaaactcataaaaggaaagatgagtcatttgtaaatgaagcagcaaagactatagcggaacaaattgaagtaggattgactcaaagcatagttgaagaatatgaagtttctcctcttgatgttgttggtagagtgttagggttagaacactctgggagagtgcgatgcatgggattaggagctgttccttctaatacattcaggaacacaagacttcgagcttttagtctgagctcttcttcatctggtgttgcctttccatcttcaaaccaatggcaagagaaatacaacaatttagaatcagcttttaaggcctacatgataatgaaggaaggaaggatccctgaagaattagctagttatttcactcctgatcaaacacatccaaatgatgcttcaagtgttcctaatacacctttggatgcaagaggatcttctggtgctagcaacccttag

SEQ ID NO: 72688 - DNA, 1083 bp, Glycine max
  Peptide Sequence Number=SeqID_189466
atgtgttgggtatgtctagatacgtcaggaggggccagagctggagcttataagccacgatggttaggcgctaccgccccctactcatccccaggtgaaggcttatgtgaatcggtcatggttaacagcccttgctataacacaatatcatgctgggacaataacttggtgaatgtgtttttggagagatggcaccaagagacatctttcttccacttgcccattgaagagataaccattacactagatgacgtgtcttgtttgttgcacttgcttgtggtaggcagacccaaagatcatgtcccatcactctttgacagagaggcagtgaagatcctattgatgagtcatatggacattctaacaaagactaaggcttctgtggtagcaaacgcaagtgctaggatgaggttgaagtggctagaacacctttaccaccactatgttgagtcaaactcttatacatcgggagtagcagcgttgatgttgtatggccatctctcatgtgcaagccagtatagcagcaagcagtgtggaggttatatgaaattacttttgtcatgggtatttgcgcatctactcactgttggttactcagaggcagaggattatgttgtgaacaatttgtccattttctctggcttcattagatgcgagactgatgtgagattatatcgttcggagaggagtaacaacaacatatcattcatcttggtgatgttgtgccacttggtggcacaaccaccacgtggtcctgtacgcttactccccgtaaaagtacaaccattagcaggctatgtactaggtggagactactcttgtaaggcttggaactctaacaaatccttttggagcattgggaatgaaaacaagaattctaactggagttttgggggtcctagaaataaagattctaattggggcaagaaaagtaattggaattatggatctagtgatgctaatcaaagcaccatttggagaagaaatagtagctggaacatagcaaatgcctcaagcgatgaaggttccaatgaaaattccattggagtaggtggtgggaactctcagtggttaccaaagtag

SEQ ID NO: 72689 - DNA, 735 bp, Glycine max
  Peptide Sequence Number=SeqID_189467
atgcaattaaaaggtgtgcctcaaggcttttcatctctggtaatcgattacacaacattggtaatcgattaccagaggccaaactcgagttacacagcttcagaacatggaaacctaggccatatcaacttcctaaccccatttttaagccttgtaatcgattacacaccctttgtaatcgattaccagaggccatatttcaattatcactcaagatccatagctggccagccaccacgcaagcctccttgctttgtggtctttgttcttttatcggttgactaccaggagctcgcctgtttagcttggttttgggcaatagcaccccacctgacgtccccaaggtctcctgacccctgcgacatatctccaggtggcgaccgggtgatgttacaagtcgactctccacatccacaaatcacacataaacccaccatcttcagttgcccaccttcaactgagctcacgtactcccacgtagcccttatcctcgttcctctcaagactgggtccccatcaatctctccaagcttccacaacatccaagcaattcaacatacaaacatcataaactatccaaaaccaagaaaacagggcagaggcagaaaactctgcccaaaacacaaccaataccacggctttccttactcaaataccccagtaacattctcttcgttccaattcgttcaccgttggatcgactcgaaaattttactggagttccctagtacataa

SEQ ID NO: 72690 - DNA, 327 bp, Glycine max
  Peptide Sequence Number=SeqID_189468
atgcgctacttttccaagttgaacaacccgggagtgggagagagacaaggagtgattcttctctgcgttccaaagaaattattggacaagagattgaaaggaaaggagagaactgagtatacgacattatggtttctccggtcaagccatccggaattgtgtttggagttagatcggaagcacccactgggaaccaaattttttccggcaatagagattttttgggacgatggggtgaagggtgcaccatggtcgaaaatcgtctccgacaacgacaaaatggtcagtgacaggatcacacaggagaagaataatcttgtttggtag

SEQ ID NO: 72691 - DNA, 237 bp, Glycine max
  Peptide Sequence Number=SeqID_189469
atgaagagaaaaggagcaaacaagcaaaacatggtgagtagggaagaggatgaagcaaaattgatgatcagtaaagtaaagccgccaaaattccacttgcgtagcagcaaaagactccactttcttaatgcaggaagattcaccaaggaacattggcaagattcatactttgagatacagaagcctttgccctgcaagaacgggtgcacgtaccattgtgcaagcactgccatctag

SEQ ID NO: 72692 - DNA, 294 bp, Glycine max
  Peptide Sequence Number=SeqID_189470
atgagtgatcatgaatcatccacttattcaaaagatctagttcttagcttcccacttctcaaagtgtttgaagctaaaggatgtgagtggtcaactaagcagaatctttgcatacaagcacctctacttgaaagcccacaaaacctgactcagaaaaacgatcatcttggactcattcaccgttggatcgtcgtgaaatttgagtaccacgttcgcaacccaatttcgagcattctaaccattgggaatcgcaaaatcatgtctgagcttagaggaaaatccttcgcattgtag

SEQ ID NO: 72693 - DNA, 1117 bp, Glycine max
  Peptide Sequence Number=SeqID_189471
gttagtgagtgaatcctccaattattcagaagatctaattcttaacttcccagttctcaaagtgcttgaagctagaggatgtgagtggttaactaagcagaacattagtatcaaagcacctcaacttgaaaggttttccatagcaatatggaactccctatcaaatgaatcacataaatctgccatcaagatttttgctcctaatctaacagatttctcttatgagggtgatcttgagcaacatatcattctgttgaattcagcatcaattcgtagtgcgtctgttgtggttgttattgatgaggacaacaaagaaagaatggaaaatcttgggtttaaagtgcataatcttcttgcacaaatccgtgaagtggagcgattgaaactattgttttacaaggtgtcagtgaaggtcaataagtacactcgttctagtgcaccaacactttcaccctcactcctcattttcgagcgaggatttgtagaagttgcaactgatatcgggtgtgaaagattttcgagcgagcaacaagggcttattattaagtggaaaaaaagaggttcaattagcctcatcgcgcgctgttggaagccatttgggcacggtgacgacgccgataatgctaccattgtcggaagagaatgcaaggacgacctcctctgccagatcgagtccgacggcttcggcaactttgtcgacgtgtacgacggccaggggatggtggacccgaagcaggttccgttggaccacgttctcttccaacccaacaaggggatggtggacccctccagtaacctccactatgataacatgcttttcacgcagatcgatgcggtgtattccgcgttggactccttggcctacaggaagttgccagttcacatttcagaaaccagttcgccttccaaaggggatctggacgaaaccagtgtgaacctcgagaacgccaagaactataacgggaatcttattaagatctctctctctctcccccctttcaggcattacttggttgttcctgtggtgcacattcctactgttaaatatcttcagaggaaaactgacgactattatttgggtaaagaaactgatagttgttgtcacttcggaatataa

SEQ ID NO: 72694 - DNA, 363 bp, Glycine max
  Peptide Sequence Number=SeqID_189472
atgcccaacgagaacaccaaccactccactcccgttctgcttgagggccagcaaccccagttggggcatgcaccctttgttcaacctatggaagaagcccataaagagctctgggatcacgctctgggtgagtttgaaccataccctacatatgtcattgagggaccaatgtttggtggcatgcctctgcctattgttgtgggagccattcaaccccgcccgctgcaacctttgcatttctcgggaaggagactacctccggccatagaagaaagagagaagtttgatctcatagtggagacgatgagggccattgggggatcaatgattatccatttttcgacatggaagagctatgcttag

SEQ ID NO: 72695 - DNA, 390 bp, Glycine max
  Peptide Sequence Number=SeqID_189473
atgggcaccacaataagccatatcaatgatcaaaccaagcttagggaggtggctcagggtacaagaacaacaacaacaactacaacaatcagggtgcttactgaagattgctggtctgcatctaagaggaacgacaaccatggaagtggagccaaggttgactacaagaacaacaaccgggtgaagccgaaggtggaaagaaaggtgtttgggagagcgggtttgaggcgacaacatttgatgatctcattcaagaaggcccatgtgatgagaatcatgaaactggccaaatacaggctaaaggcccaagtggagaaggacgaaggcccaagtggagaaggacaaagcccccgagtggagaaggatgaaggcccaagtggagaaggatga

SEQ ID NO: 72696 - DNA, 882 bp, Glycine max
  Peptide Sequence Number=SeqID_189474
atgaatttggtattgcttgaagttgaacagttgttacaagccaatcaaagatcacttaaagactatccttccatgccatatcctgagaacgcaaatttactaacacatgcagacaatggcctcattttgtctgagctgaatttcaacaatgaagaacttagatcagaattccttaaccttttttctcaaatgacaaaccaacaagcaaaaatttataaccaaattattcaggctgtcaataaaaatgaaggtgggatgtttttcttatatggatatggaggaacaggaaaaacatttatttggaaaacacttgcagcctcattgagagctgacaataaaatagttattatggatgcttctagtggcatagtttctttgttattgcctggaggaagaacaacacattcaaaattaaaaattcatgttcccatatttgaagactcgacatgcaatattcatcaaggaacacaattgactgaattattgaatgaagcaagtcttatcatctgggatgaagcccccatggcttacaaattctgttttgaagcacttgatcaaagtctaagagatgttattaaggcaaaatcaagttctgataaaatctttggtggtaaagttatgatatttggtggagattttcggcagattctgccagtcattcctaggggtagccggtctgacattgttaatgcaactataaattcatcttatctatggaatcattgccatgttttggcactgtcgaaaaacatgcgtttagaagccaatatagatgcaacagacagagaagaaactttagcttttgcacaatggatccttaatattggtgatgggattgttggccagcaaaatgatggttatggttcaattgaaattccataa

SEQ ID NO: 72697 - DNA, 279 bp, Glycine max
  Peptide Sequence Number=SeqID_189475
atgtcgatctcctcctgcgaaagtatcggttggtctgtgtcgtcacgagataggggtcgcgcccataagacacccagtggacccggaaaagtccaacagggccctggggtttctagctctgggatcgtgcccgcaagacacctagtggacccgaagaaggccaacaggggagtgcctgccgcccctagcaaggtcatcaggccccctaccaatcgagctttcatcaagaagtactgtgcccccaggcaggcgcagggcgaaacaccacagcagcattag

SEQ ID NO: 72698 - DNA, 384 bp, Glycine max
  Peptide Sequence Number=SeqID_189476
atggcgaaattcgactcggagatagtcatggaattctatgccaatgcctggcctaccgaggagggagctcgggatatgcgctcatgggtgaggggccagtggatcccctttaacacagacgccttcaactaccagaggaggagccaggttttcggctttgacgaggatgccatcgctcagcttttgtgcatactggggtcacaacttgctgcatggagacgagtgcggatcatgcacaccagcatgaccatctatcagtttgcaggaacaacgcctatgagacaccccatggatccagagaggtccaataggaacgacaggcctctgccaattttacggagtgcccgtcgtccccagcaaggtcattcagcctcctattactag

SEQ ID NO: 72699 - DNA, 883 bp, Glycine max
  Peptide Sequence Number=SeqID_189477
atggcgccaccacctcctcttcctactctcctcctcaccacccttctctccctattctcctcttctacatcggccccacccacaaccacagcatgccgcgacacgtgcggctcaacgcaggtgaagtaccccttcggcaccggccacggttgcggctcccctctgttcagcccctacgtaacctgcggctccaacggcaccggcgaccaactgttcctgaaaagccacaccggctcctacccggtgagttcgatctcctacaccacctccaccatcaccctcagtccaccttccatgtccacctgcagctccatgcacccttcatccaccaacttcggcctagactggacctcccccttccaaatcgcctcctccaccttcctcctcctctcctgccaaccccccaccacttccctatcctcacccatctgtgacccttccttcgattacctctgcgcatcactctactcgtgtcccgccgtcgtcgccctcggccttcccctcttcccgcccagcaacacctgctgcgtctactcccccgccaacctcgacggcaaaggggagctcgacttgaaagccatgaagtgtggtgcctatgcttctgttgtatcgctcggggataaccctacggaccccactcactgggtctatggagtggccttgaagtactcttttggtggggctttggataataactatggcactaccaagtgcagtgggtgtgagagtagcggcggtgtgtgcggctttgcgccgcctgggaatgggtttgtgtgtgtttgtaaaggaggctataacaccagcttggattgctccactactttcaaccagaaccaggactacgtttgggactcttcctctgcgaatcacatcttcttcactt

SEQ ID NO: 72700 - DNA, 1053 bp, Glycine max
  Peptide Sequence Number=SeqID_189478
atggcggcggggtgcatcagcttcactgccacgcgcgaccgctgctttcgcttctccttctccaacgcgggcctcaaatccgtgacgacggacctcggcgatggcaccatcatgcactgctgggcccccaaggcccacaaggactccaagcccaacctcctcctcatccacggcttcggggccaacgcaatgtggcagtggaacgacttcctctcgcccctcacgcgccgcttcaacgtctacgtcccggacctcctcttcttcggagactcccacacgacccgccccgaccgctctgaagccttccaggcccagtgcgtcgcggccctcctccaggcccacggactccagagaaccagcgttgtgggtataagctacggcggcttcgtggcgtacagtctcgcggcgcagttcccggagcgcgtggagaaggtggtgctatgctgcgccggggtgtgcttggaagataaagacttggacgaagggatgttccaggtgaagactgtggatgaggctgcggatattttgctgccgcagacgccggaaaagttgaggcagctcgtgcagctcgcgtttgccaagcctgtcaaaaccatgcccacttgctttctcaatgattacattaacaaagggaaaaaagttagaagaacaataatagaaatcggaacattgggaactggcagggctagtgcgtgtgatctaaacgtttccccgcggtatagtgcatgtttggtgatgtgtactgataaccgccaagagaggaaagaactaatcgaaacattacataaggatagaaaattatctaatcttcctaagataacccagcctacgttaataatctggggagaaaaggacctggtcttccctatggaattagctcataggctacaaagacatttgggagagaacgctcaactagtggtcattaagaatgcagggcatgctctcaatgtagagaagcccaaggagatgtacaagaatttaaaatccttcctcattgatcccgctactccaactccaactgcgcaaaaaaaccacagtaacggtagctaa

SEQ ID NO: 72701 - DNA, 1758 bp, Glycine max
  Peptide Sequence Number=SeqID_189479
atggacttcatatttgtgctattgctattgggttgcttatgttcttttgtgttgcctgatacgcaaggagatgcactatttgcattgaagatatcattgaatgcttcagctcaccagcttactgactggaatcaaaatcaagtgaatccttgtacttggtcacgtgtttactgtgactcaaacaacaatgtcatgcaagtatcactagcatatatgggattcacaggatacttgaccccaataataggagttctaaaatatcttacagctctatctttgcaagggaatggaatcactggcaacataccaaaagagttaggaaacctgacaagcttgagcaggttggatttggaaagcaacaaattaactggagaaataccctcctcccttggtaatcttaaaaggcttcaattctttctgctagattcaaataatctgagtggccaaatcccagagcagttatttaaggttcctaaatacaagtatggatgtttcactggaaataatttgaattgtggtgcgagttatcatcaaccttgtgaaactgataatgcagatcaaggttcatcccataaacctaaaactggcctcatagttggcattgtgatagggttagttgttatccttttccttggtggtctgctgttcttttggtgcaagggtagacacaagagctacagacgtgaagtttttgtagatgttgcaggtgaagttgatcggcgaattgcatttggccaactaagaagatttgcatggagagaactacagatagctacagacaacttcagtgagaaaaatgttttaggacagggaggctttggaaaggtttataaaggtgttcttgctgataacacaaaagttgctgtcaaaaggttaactgattatgaaagtcctgggggtgatgcagctttccagcgtgaggttgagatgataagtgtagccgtgcataggaacctgttacggctgattggattttgtactaccccaaccgagcgcctcttagtttatccctttatgcagaacttaagtgtagcctatcgtcttcgagaactcaaacctggtgaacctgttctagactggcctacaagaaaacgagtggcgctgggaacagcccgtggcttagaatatcttcatgagcattgcaatcctaagattattcatcgggatgtgaaggcagctaatgtattactagatgaagattttgaagctgttgttggtgattttggcttggcaaagttagtcgatgttcgaaaaactaatgtgacaactcaagttcgtggaacaatgggccacatagctccagagtatttgtccactggaaagtcttcagaaagaactgatgtttttggttatgggattatgcttttggagcttgttacaggtcaacgagcaattgacttttcacgtttagaagaggaagatgatgtgctgctacttgaccatgttaagaaattagaacgggagaaaagactagaagcaattgttgaccgcaacctaaataaaaattacaacatacaagaggtagaaatgatgatacaagttgcattactctgtacgcaagcaacaccagaggatcgtccaccaatgtccgaggttgtaagaatgctagaaggagaagggttggctgaaaggtgggaggaatggcagcatgtggaggtcaatcggaggcaagaatacgagagattacaaagaagatttgattggggagaagattcggtctataatcaagatgccattgagttgtctggtgggagatga

SEQ ID NO: 72702 - DNA, 1187 bp, Glycine max
  Peptide Sequence Number=SeqID_189480
caattgggagcagatgcaagatccatcttcaaaccctaattccaatccaaatcccaatcctcacaatgccaatgccgcatcccagctaccgcgtccaccgccggccaccaccgccggcgccggcgcctcctcgtcctcgctgttcgcgcgctccggcgggcctcaccaccggcgagcccattcggaagtgagtttccggctgccggacgacatgatggacctctcgccgtcggatccgttcgccggcgggtcgtcgacggccagcatggaggagatcggatcggaggacgacctgttctcgacgtacattgacgtggacaagctcggcggcgcaaacgggtcgggcgcctccggaaacggagcggatccgaccggcgaaaccgagaagagtccggcgaggccgcgacaccggcacagtagctccgtcgatttcggggaaattatggatgcgaagaaagctatgcctcctgataagttagctgagctatggacaattgatcccaagcgtgctaagagtatttgctgtggatttgattttgtttattgttattctcatggtggtggtggtgttacgaatagaatacttgcaaatcggcaatctgctgctcgatcgaaggagagaaaagcgcgctacatacaagaacttgagcgcaaggttcagactcttcagacggaagccacaactctttctgcccaattgaccttataccagagggacacaacaggactgagtactgaaaatacagagctaaagctccgtttgcaagccatggagcaacaagcacaacttcgtgacgctcttaatgaagcattgaagaaggaagttgagaggcttaaggttgctactggtgagatgatgagccacactgattcctttaatctgggaatgcacctgatgccattttccggatcaaatttcgttccaatcccgccacaatcaggtccttctggtcaccaaaacatgcagatgccaccatttggtctcaccccatccacaatgccaagccatctactgcatcaaacaagttctcatccatattcagaaatattgcaaaatgaccagcttggtcgtttccaggggcttgacattagtagcaaaggatcaactctcgtgaagtctgaaggcccctcactctccgcaacatggcatttggtgtttctgggagctggaatattgggaatgaaag

SEQ ID NO: 72703 - DNA, 276 bp, Glycine max
  Peptide Sequence Number=SeqID_189481
atgacactactatgctctatgcttggtgcttggccaaatgcacttcagtttctttatcaagtagtgtgcaatgtctttaactcctgttcccagattgctcgcatgcttactgtgaagcgggaaagagaaattgaggagggtatcaataagaggttgtccagaaagcttgataaaaaatggaagaaaagcattgttgtaagaccacctccatctttaaagaagctccgggaggaagaagcagcagcagaagctgcagaagctgaaaaagctgcatga

SEQ ID NO: 72704 - DNA, 564 bp, Glycine max
  Peptide Sequence Number=SeqID_189482
atggcgatggtgctccctgaggagctgatagtggagattctgtcatgggttccggtgaagcctctgagacttggaattcccttatcttccggtagaggtaattttgaatactgggtacgattttggaacccagcaagaatgatcctgtcccaagagtcgccacacttacgtctacgtcgacgcgattatatacttttagaggattatgtgaagtttgggtttgattacggtgattggagtgacacttacaaggtggcggcactctgtttcaatactaaatcacagaattgggaggtgagacttcactgcatgggcgacacttgccggataaacattttaacttgccctgcttttcccattagtcggaggtcggtggcaccgttaactgtaatcttttcgtatgatctaaagaaggagacatataatttgtccatgcctgatggtctgtctgaagttcctgattatcttctcaaggttggggttttgaagggttgcctgtctttcggacactcacaggagaagaacccatttcgttgtttggctaatgagggaatttggagttga

SEQ ID NO: 72705 - DNA, 162 bp, Glycine max
  Peptide Sequence Number=SeqID_189483
atgggacaggaagctttgaagggaatccattcgggtgctgagttgggagaggttgcgaagggaaacatggagagactcgaagcagttgttgttatggaattcttcagtggtgtttggcatgtgttcttgttgttgattgttggttggtgtgagactcagtga

SEQ ID NO: 72706 - DNA, 2328 bp, Glycine max
  Peptide Sequence Number=SeqID_189484
atgaaattagaggttccacggttcgatggaaccgaacctctcagctggatcttcaagattaatcaatactttgagtaccatgcaacgctcaattcacctcctagcccggagatacgtcgtgaggtacaagcccttcaacccttgaccttggtgcaggcagcaggcttggcgcgcttgcaagaagagaaactcgcggacgtccgtccgccgccacgtccgcgtccttcgcccccaccaccatcccttatccgcacgaaccctagccacaccagtgacaaccctcgctcaccccctcttccacctttgttgctcgcaccaccgcgccaaccacctgtgatgaagcgcttgacatcggaggagataactttacgccgtgagcgtgggttatgcttcaactgtgacgagcgatatcacagaggccaccgctgcgcctctcgcgtattccttctcatcactgaagaagaggaaccctcaacagctaatattgaccctaatgacccacaacccaacccacctgatgcacctaacccgtacccgacccaaatacgccttcgctcgttagcaggccatctggcctccgaaacgttgcattttgaaggtgtcatcactgatctccacttgcttgtcaccaaactgggacttccttgccggtccacgctaccattacgagtcatggtgggtaacggccaccacctggaatgcaccaccatttgtgaagcagttcccatttccattcaggacatcgagttcactgtggaactttatgttttacccattgtcggcgcaaatgttgtgttaggtgtccaatggcttaaaacattaggccccatcctcactgattacaactccttgtacatgcaattcttttatcagaatagcttggaacctgtttcatacttccatatcacagtcctcactgaacctcatacttctccctcaactcctccacctttccctcagcctattcaggacttgcttcagaaattctcagccttgtttcaggagcctcagggtctgccgccgtccttcttatgcgcaagcaagatggcagctggcggttctgcattgactattgagccctcaacacagtcatcgtcagagacaggttaccatcagataagaatgcatggccccgatattcccaaaacagttttcagaactcatcacggtcattacgagttcaaggtcaaatatcttggacatatggtatctcaaaaaggagtggagcttatggcttcgaaggtggaagccatacttcaatggccagtgcctcagtctacatgggtcgtgcgtagcttcttgggactcgcgggattctatcggcgtttcatcaaggggtacgccaccattgctggccccttacttcctttcactgtggagaccgatgcatctggcatcgacatgggtgcagtcctctcacagaacaaccatcccattgcttttttcagcaaacccttcaaccctaagctcctccgcgcctcaacgtatatccgcgagctgttcgccattaccgctgtaatcaagaaatggcgccaataccttcttggtcaatgcttcaccatccttactgaccatcgcagtctcaaggaactcctcacccaggtcatccaaatgtcagagcagcacatgtacttagcccgcctcatgggctatgactacatcattcaatatcggaccgagaatcataaccaagccgcggacgcattatcgcgacttccagaacaggacccttccctcttcatgatcctctctattccatccttaaccttcctggaagagcttcgtcaccaattgaatgctcatccggactacactcaacgccgacaagagatcactcagaacccggccaattttcccaccttcacggtctcgcaggatttagtgatgaataatggtcgtatttggttgcctcggggattacccatcacttccactctgctcatggaataccacactacacccacaggtggtcatgcagggatcgtgaaaactctggccaggatctcaaaaaattttagttggtcaagcctccgagaggatgtcaaacaatttgtgactaagtgcttggattgccaggtgaccaagtacgagacacagaagggaaacaccaccattctcgtcatggtggaccgcttttcgaagaggattcatctgggcatgctccaaacatcccacacggcacgcatgccgtttttggagaaatgcatcgaaaagaagagaaaagtgtcaatggtgagcaattctttggagaactattcccttgtggaggtcatcgttgccgacaatgggaagtgcaaaagtgagcttgaaatcgtttctaaaagctaa

SEQ ID NO: 72707 - DNA, 501 bp, Glycine max
  Peptide Sequence Number=SeqID_189485
atggagaagctcaatgagttcaaaaacattcataggaatgaaggatgtgtcgtcctagggcacaagcatgatgcatgccatgaaccaaaaatttgggcatctagtgatgatgttagaatggtgctgaggaagttgctgctggctgcgaagctcggaaggaagacgaggaaccaagagagacacttgaagaaaatgatcgaggagacgaaggaggtgctgaagaacacaagggaagagtatatgaagaaggagatagctaattttccggaggatatggaaaaaatgttggaaatggtagacatgtataccaaggaaattgagcgagagatgatggaagcagacaaggatgatgaagacattcatgaccaagccacagtggttgatcatcatggagcagccaagtacaaaggaaagaaacgtgttgttgtcgaaggtggagagggattgaaattgcttatggaagccgttaatgcaatagagatcaaagatatgtttaattaa

SEQ ID NO: 72708 - DNA, 411 bp, Glycine max
  Peptide Sequence Number=SeqID_189486
atgtttatcaagaggagagtgaagcttgtactgatcttgaccaacaagtcagtgaggcaagaatcattctgcaggaagaagaaaagcatcatggggaagctgaaagaggtcagaaccgttaagtcagaccaagagcaacagagaagaaggacaaagagcaaagaagagatgcacatggagaaaatgatcaaggaggccaagcaggagctgaggaagctggaggaagagaataggacgaaggagttgctcattcacatgtttaatgtacgtgctgagacaggaagttttcctgttctgaagggtttaaccgagaaggagcttaaagggttgcaggatctgattaacatgaatgtgaacaaaattaaccaagaattggaggaactaaagaaggatgaagccactgcggtctaa

SEQ ID NO: 72709 - DNA, 120 bp, Glycine max
  Peptide Sequence Number=SeqID_189487
atggagagacatgcttgtctaagtgcaagctctaaagatgttgttcctttgcattgttcaatgagaaagggtaccccaactcagtctctgttcatggatcttcaccgtataatcaagtga

SEQ ID NO: 72710 - DNA, 426 bp, Glycine max
  Peptide Sequence Number=SeqID_189488
atggatgaaaaatatttagttattgtcaactctagaccacgggttataagttgggaaattggggaagagattctgaaattccctaatggtttgggaaatgtagagcatatttctatatcgagtgatgccaaaaatttagttacatcagattttaaggatcaacatgaggctgctgaaggagtccttcttgatgatgatttgaatgagccaacaatgggagagaaacttgccagtctaagtgttctggatgggaacaaatcaaggagtgatatagagcaagaatcttctatcccaacaaagcctccaagtgcagactctgtacatgttttgcttaagcaagcattaaatgctgatgatcgcacccttctgctagattgcttgtttacacaaattgagaaggttctctttctctcctatttctattga

SEQ ID NO: 72711 - DNA, 336 bp, Glycine max
  Peptide Sequence Number=SeqID_189489
atgggtgctgcgggctccaagctcgagaaggctctcggagaccaattccccgaaggagaacgttactttggcctcgagaatttcggcaacacttgttactgcaacagcgtcttgcaggcactatacttctgtgttccgtttcgcgaacaattactagagtattatggaaataacaaaagcatattggacggggaagaaaatcttttaacttgcttagcggacttattttcacagccttacccttgcatatgcaaagaggctgtttccggattcgaacccatgaccaacaagtcaccaaggcacaactttaccgctgcaccagggctcgccctctaa

SEQ ID NO: 72712 - DNA, 360 bp, Glycine max
  Peptide Sequence Number=SeqID_189490
atgtcggagtgcaacaagcaagcggtggccatgacaaacacgattatcaaacctctgggctattgcaatggaaggaatagaaagcagagtctcattactgactatacactcaaagcaagtgacttttcatactcaacattatgtttaagatattggggcttaatatttgcaaagataccattgtgggtgatgaaatgcagagaggcagttcacattatcctgacaactgataatgatccactaggtcaagctttagcggaagagctggcacggcgccttgggcgagaaagattgtatatcctgtcatttattttccatgttaaacagtctgtttatgcatgcaaaggtgtccatatctaa

SEQ ID NO: 72713 - DNA, 3195 bp, Glycine max
  Peptide Sequence Number=SeqID_189491
atgcacttaccatatttttccttgacattaggtggttcacttttcttatttgatcggaaggtgctgagatacttcagaaaggatggccataactggaggaagaaaaaagatggaaaaacagttagagaagctcacgagagactaaaggctggaagcgtggatgtgttgcattgctactatgcccatggagaagaaaatgaaaattttcgaagacgcacatattggctacttgaagaggaactctctcacattgttctcgtccattatcgacatgtgaagggaaccaaggcaaattttacatgtgctaaagaaaatgaagaaactcttccttatgctcaacaaactgataaaattatgcccaaaacagagatggaaacttctttatcatctactcttcatccacatagttaccaggttccttcacaaactatggatagaagcatgaacagttcccaagcatcagaatatgaagaagcagaatctgcattcaacaaccatgcaagttctgagttttattctttccttgagttagaacgccctgttgagaagattacacctcaacctgctgattcttattctcctcggccactcacaaatgatcaagagaagtcacctgtcattcctggggtgaattatatctcactcactcaagacaataaaatcaaagacattcataattttggattgacatatgaatccccaaaaccccttggcttttcctcatgggaaggtatcttaaaaaataatgctggaagtcaacatgtgccttttcagcctttatttcctggaacacagcctgacaacatgggaatcaatagcaaattttcccaaggacatgagataatggtgccatatttgaccaccagcattgctaagcagcatgagaatggaagtctcatacaagctgaaggaaattggcaggcttatgatgttgattctttacgcatgtccagttggcctatagatagtgcttattcaggctcatcatgtgacataacttgcagcaaccgtgagcaggaggttaatgatgttgatttgcagaaatccttggaacagtgtcttctacatccatacaaacaaaacaaggttttcatgcaaaatgatcctcaggaaaaacttttgaatgaaaaagaaaagataaaatcagacctagaggccaatagaatcctggatggaatagaagacacatatttcacttttaaaaggactctgttagatggatctccagcagaagagggtctgaagaagcttgacagtttcaaccaatggatgagtaaagagcttgcagatgtggaagagtctaataaaccatccacttctggtggttattgggatacagttgaaagcgaaaatgaggttggcaacacaactattccttcacaagggcacctggacacctatgtattggatccatctgtttcccatgatcagctttttagcattatagactattccccaagctgggcatttgaagggtcagaaattaaggttattatttctggacgattcttaagaagtcaacatgaagcagaacaaggtaaatggtcatgcatgtttggcgaggtagaagtgccagcagagatcattgcaaaaggtgttctttgttgtcatactcctccacacaaggctgggagggtacctttctatgtaacttgttccaataggttagcatgtagtgaggtgagagaatttgatttccaagtcaactatactccagaagttaacactacaggtgagaatagaggcagcacttttgatacttttagtatccgatttggagaactgttgtccctggggcatgcctttcctcagaattcagattcaattagtgttagtgagaaatctcaactgagaagtaaaatcaattctttactgagggaggaggaggatgattgggacaagctactgaaacttactcaagaggaagatttttctccagaaaatttacaggagcagctgcttcaaaatcttctgaaagataagttacatgcatggctccttcagaaaataacagaagaggggaaaggccctaatatattagatgagggtggccaaggtgtgcttcattttgcatctgctcttggctatgattgggccctagaacccacaatagttgctggtgtgaatgtgaactttcgggatgtaaatggatggactgctcttcattgggcagcattttgtggcagggagcgcacagttgctttcctcatctctctcggcgcagcacctggagcactgactgatccatgtccagaacatccttctggtagaacaccagctgacctagcttctgcaaatggacacaaaggaattgcagggtatcttgctgagtcttcactaagtgcacacctcacaactctcgatttgaacagggacgcaggagaaaattccggagcaaaagtagtccaaagagtccaaaacattgctcaagttaatgatcttgatggtttatcatatgaattgtcattgaaagattcattggctgcagtgcgtaatgccacccacgctgcagctcgtattcatcaagttttcagaatgcaatcatttcagagaaaacaactgaaggaatatgatgatgacaaacttggattatctgatgaacgtgctctttcacttgtaaaaatgaatatgaaatcacacaagtctggaccacgtgatgagcctgtccatgctgctgcagtacgaatccaaaacaaattccgcagttggaagggaagaagagaatttttaatgattcgacaacgcatagtaaaaattcaggctcacgtgagaggtcaccaggtcaggaaaagctgtgggaagataatttggtccgttggaatcttggagaaggttattttacgttggcgtcgaaaaggtagtggtttgcgtggatttaaaccggaggccaattctgagggaactatgatacaagatgtatcttcaacagatgatgactatgatgtcttaaaagaaggcaggaagcaaacagagcaaaggttgcagaaagccctagctagggtgaagtcaatggttcagtatccagaggcaagagaccaataccataggctgttgaatgttgtaactgagatccaagaaaatcaggtaaagcatgagagcagttataacaattcagaagaaccgagagaattcggtgacctcaacgatcttgaagcattgttggacgaagatattttcatgcctacagcaacttag

SEQ ID NO: 72714 - DNA, 162 bp, Glycine max
  Peptide Sequence Number=SeqID_189492
atgtcaggctccccatcaaatgcagaaatgagccgtgcacatttttcttacgcagccaaatttttcaattcatgctcagtcagatgtaaggaggaagcaaggagttttgcagtcccgacgaagacagggttgttaactcaccaaagaatgcccaactattag

SEQ ID NO: 72715 - DNA, 1125 bp, Glycine max
  Peptide Sequence Number=SeqID_189493
atgggtaacaacaagttcaagttgtcagatatgataccaaatgcttggttttacaagctgaaagatatgagcagatcaaggaagagaaatggttctcatgttatgaagagtaaagtgtcttcaccaacaacatcacaaaggtctctgccaagatattcacagtatttttccactgagccaataagagctggtaagctatacaacactcccattcacaccaaagacttggacttgccattcactgattcacctagaaggtcttccaagagaagggctaggagaaaaaccatctacaagccttctcccactgtcgttccctcttccggctatgactccccaaatcattggatcaagccatgtcaagttcagtcaccagattatgatgtgtcttcagctgaaagctcttctgagtctgatcttcatgaatatgcttattctgagtctgaatgtgacagcttttctgttcctgacttgcttaatggagtagacactaattgcagctgcagagttagctcttccactaatgacatcatcattgacatgaacagtgagtccttcattgggaatcctgaaaagcaagatgggtttgatgcaatttcacagcttggtcttgctccaatattgacaaggccaatgaagtttgatgataaggtcattgaagcagctgagttgagaagttcaacggatttggatcagctgcaggatgatcagtctttctcaattgagattctcaaagaggaatgcaatagaattcaaaggaggagaaaaagcagtcatagaaagccctttgctaattctgcaggcataaggcttagggtccattctccaaaacttgcaagcagaaaaattcaagcatgtgcaaggagtgtgtcacccatttcaagcaaagctccaaggagtacaggcttcctagatggatttgctgttgttaagtcctcatttgatccacagagtgacttcagggagtcaatgctggagatgattgtggagaacaatatccgcgcatcaaaggatttggaggacttgcttgcctgctacctttccctcaattcaagtgaatatcgtgatctcattgttaaagcatttgagcaaatttggtttgacatgactcaactaagaatgtaa

SEQ ID NO: 72716 - DNA, 1503 bp, Glycine max
  Peptide Sequence Number=SeqID_189494
atgataattggtaatttctatcgaatacgcagtgcttttaagtatggtgcccgtaaacttggatggattcttatgttaccagaagatagaataactgaggagcttattaggttctttacgaacacactggaaaggcatggaagcactccggggaatgtaaacaagtcatttttgagcttatctacagcatccagaaaggataggaaacctgaaaatcaacataattatgactgcagagatgaaagagaaagatatgtagtacaagatgcaggggagttctttgactcctctaggtatggaaatgcagttggaagtcttaaactttgcgaagattctaaggatgttgcaacatctggggtcttggatagtgcaagcactaatggttggtcttattgttcaaatgggcaatttgaaaataatatttctgatagtgaacctgctctaaattctgttattgatgatgagaaagagaagcaaggtgtggctggcaattcacccagatcgcatactgatgaaaagaatatggcagtctctgaagcttcaaagtcattgttggaccttacaggggattatgacagtcacattgggaacttgcaatatggtcatatgtgtaatggttatcctgtctctcctgtggtgcctagtcctcctaggtctccgaagtttccaaataggaatccatgggaaactgttcgtcaatgcgtacagattaatcacagtattcgttctcaggcaaactcaaatagtgtaatgggacaacaagtttacgtcataaatcatccttctctgccaatgacttcttttggttcagaagagaagagaaaagtacgaggaacaggcgcatacttccctaatatgacttctcgtccttacagggacaataggccaatgccaggaaggggaaggggtcaagcaccaggtactcatggacatctgcagagacacacccgtaacaatggctttgccctagctccacaagagatgaatttgtctgcggaaggaacctttgaacatgctctagaaggatatcctggtcttggtagtactaaaatcagatcatctgagacctatttccctcaaccttctacatggggatcacattatgctaatggtttcgttcattcatctgagaaacatgaatctgtacatgtgagccctcagcttcaagtagtgccaagaaatgaaactagcatttacccagagtcagtcatttctactcctaggggcactgtgcctaacactggggaggtgatggagaagtctgattcattgtcagtagttgattccaaaagcattaacagtaatgatcaatacatggaaactattaagactttgcctacctttcagcaggtgctaccaaaggatggcgattttatgtttctagtgttaagtggaaaacagattgatgacctttatgcagtcttcaagcctggctacagtgtctttggtggagtccatggccattcaaattgccgtgatgatgcccccgagaaacatgcgtag

SEQ ID NO: 72717 - DNA, 303 bp, Glycine max
  Peptide Sequence Number=SeqID_189495
atggcacttcctggtggagtggagagggatgcagtgctaggagaggaaagcaaagtaggcattggaagggtcattgatgagcgtgatgggaaggaggcagtgaatggcagagataagggttggggaggcacgaaaggaggttgggaggggtggaagagaagaatttgtcccatagggggagagttagatatcagtgtgggtgaggaagagaaaggaaattttgggaaagggttttttggaggagaggtggaagaatttggaagggttggaatgggaattggtggaatgggaaatggcatttga

SEQ ID NO: 72718 - DNA, 1842 bp, Glycine max
  Peptide Sequence Number=SeqID_189496
atgggagaaaattgttatgtggaaatcgacccaactggtcgatatggcaggtttggagatattcttggaaaaggggcaatgaagacagtgtacaaagccattgatgaggtgcttggaattgaggtagcatggaaccaggtcagactcaatgaggtgcttcgcacgccggacgatttgcagcggctttactcagaggttcatctcctcagtaccctcaagcatcaatccatcttaagattctacacttcttggattgatattgatagcagggccttcaactttatcacagaatttttcacatctgggtcactgagagaatataggaagaactataaacgtgtcagcatacaagctataaagaattgggctcgccaaatcttacaaggtcttgtttatctacattgtcatgatccacctgtgatccatagggacctcaaatgtgataacatatttgtcaatggtcatcttggacaagtaaaaattggtgacctgggactggctgcaattcttcacggttcccaattagcacatagtgttataggcacccctgagttcatggcaccagaattgtatgaggaagaatacaatgaacttgctgatgtatactcatttggcatgtgtgttttggaaatgctcacatctgaatatccgtatagtgaatgttctaatccagcacaaatctacaagaaagtgacatcggtaaattcagattctggtggaaaactaccaatggcctttttccggattgaagacatggaagcacaaaggtttattggaaaatgcttagtacctgcagaaaagagaccgtcggcaaaagaattgttgcttgacccttttcttgtgtctgatgatccatcatcaacaatgaaatttgcaattcagaaaccatttttgaacgtcaatgagatggagaaactgcaattaagtgatgatcttcctaggactggaatgaaagtgattgggaagctgaatcctgaaaatgacactatctttctcaaagtgcaaatttctgataaggatggttctgttaggaatgtattttttccctttgacatattatctgacacccctattgatgttgcaactgagatggtgaaagaattggagattgaggatggggagccttatgagattgcaaacatgattgatagagagatatctgctctgctacctcacagaaggcaaagtagctgttcagatgccttccacacattcaattatctagatgatgattgtgatgatgatggacctcatcatcattttcgctcgttctcttctagttcatcattccaagaatcaatgtcagatttagtcagtaaaggtgaggaaatatcaagtggatattattggctccatgatgatttgcatgatgataccagttcacgatgctcttcacaagggacatattccaacttgaattactattctgtggatgatcatcaagagtacaacgtgccatctttgagaaaagataaacttccaatcacaaccagtcacaacaagggcaaaaagatttccaccggtgaagacttaagcaatttcaaccagggcaaactcatggtaggatcacaggttcctctcactagtaaaagtaagatgatgataaacaatcatcatagattaacaaggaacaggtcattgattgatataaggagccaactattgcaccgttcactggttgaagaggtgaacaaaagaaggttattcaagacagttggtgctgtggagaatattggatttcaggcaccttgtgatgttaccacaaaatggtcacagcatgcatgtgttgctccaaatgagaactctccaaggagtggaaggaacggaaaaattaagagatga

SEQ ID NO: 72719 - DNA, 567 bp, Glycine max
  Peptide Sequence Number=SeqID_189497
atgaagagagaaatagagagaaaaatgaagtggaagcactttgtaggtgtgtgtatgaaggcaactattggtattgactttttgtcaaaaacaatgtaccttgaagatagaactgttcgcctgcagctttgggatactgcagggcaagaaagatttagaagtctcattccaagctacataagagattcttctgttgcggttatagtatatgatgttgctaacaggcaatcatttctgaacactaacaagtgggttgaggaggttcgtacagaacgtggcagtgatgttattattgtattggttggaaacaaaactgatcttgtagataagaggcaagtttcaatagaggaaggagatgcaaagtcccgtgagttcggaatcatgttcatagaaaccagtgcaaaagcaggcttcaatatcaagcctttgtttcgtaagattgctgctgccttgccagggatggaaactctttcttctacaaagcaggaagacatggtcgatgtaaatttaaaacccacggtgaattcatcccagacagagcaacaaggaggaggttgctcatgctag

SEQ ID NO: 72720 - DNA, 540 bp, Glycine max
  Peptide Sequence Number=SeqID_189498
atggtcatagtacagctaaagacagcactgcttcattcccttaacgcgtatattgtgaggtccaagaaacctgtgtttataagagctctcaagttccgtgctcacaagtccactttccctaaggcctctttcccaagaaaaccaacaatgccctctttgttgcaatccatgtttcgttctccaaagaaatctaagcacgcagacatgctgcaaggactcaggagtccctcaaatgtgcatgaaactccactctttccatcgccgcttaccccggcttttgtaacggctcgtgaggtggagaagagggaggaggctttgaggcaagaggtggaagatgcatgcaggagttttgagaactatttggtggagatgattgtggaagaagggaagaccagggacctgatggatgtggaggaacttctatactgttggaagaacctcaagtgtcctgtgttcattgatttagttagtagattttatggagagctttgtaaggacttgttttctccggatagtgaggaaggtgacagttccaagtga

SEQ ID NO: 72721 - DNA, 171 bp, Glycine max
  Peptide Sequence Number=SeqID_189499
atggcaaagaagcaccagtggtctagtggtagaatagtaccctgccacgatacatcatcagcagttatagaatgggccatgtcagagatgatggaaaaccctagagtaatgaccaaagctcaagacgaagttactataaactttgcaagtaataacgaaataccctattag

SEQ ID NO: 72722 - DNA, 1590 bp, Glycine max
  Peptide Sequence Number=SeqID_189500
atgaagtcccttcaagtagggcaagcacaacaagactacgggagtcacactgatggaagtgataaagtttcagacaaaagcattctatttcccaacaaattcatcgcaatagctgatagcttcaaaggagaacattcatggttcattgctcctcaaatcccaacagacttttcaattcaagtccaggaaaccacttataatgttcacaagtaccccttgatatcaaagtgcggttacataggacaattggaaattcagcctttgatctcaaattctggcaatgtgctcaagctcgaaaacttcccaggtggatctgaaacatttgaaacaattctaaagttctgttatggcctccctatagacttcagcccagataacatagctgcactaagatgtgcatcagagttcctagagatgactgaagaactagaagatggaaatctcatttctaagagtgaagctttcctcacctttgttgtgctttcttcatggaaagacactatcactgttctgaaatcttgtgaaaacctatctccgtgggctgaaaacctccaaattgtaagaagatgctgtgattccattgcatggaaagcttctaaagatgagctcacaagcgaggatgcgacacctaatcaagaaagctggtggttcaatgatgtggcagccttccgcattgaccattttatgcagatcatttctgcaataagggcaaagggaaccaaaccagagaccattggtaaatgtatcatacaatatgccaagagatggctgccaggaatggaggtggagttagaagggcttagaggatatgggcatgaaaagtgtaacctacagttcagtatttttagtgggaagaagaaagaaagcagtggacacagcaaggagcaaaagacaattattgaaagcctaataagcattattcctcctcagcaagatgcagtctcatgtaagttcatgttgcagatgttaaagatggccatgatgtattctgtatcaccagctctcacaacagaccttgaaaagagagtgagtttggtgttggaagatgctgaggtgagtgatcttctaattccaagatatcaaaatggagatcaaggaaaaacggtcattagcatgactatttcatctgaagaatgcaccatgctagacatagatgtagtgcaacgaattgtggaatacttcttgatgcatgaacaacagcagattcaacagcaacagaagactaggaaattcaatattagtagactcttggacaattacctagctgaaattgcaagagatccaaatctttcaattaccaagttccaagtttttgccgaatttctaccagaaaatactcgatcatatgatgatggcctatatagagccattgacacctacctcaagacccatgcttcactgaccgagcatgaccgtaaaagactgtgcaaaatcatgaactgtgaaaaactctcacttgatgcatgccttcatgctgcacagaatgagagattgcccctaagaactgttgtccaggataatactaatcctcctcataagcagaaaaatgaaaacaaaacagaaatgctccccaaatcaatccctccctga

SEQ ID NO: 72723 - DNA, 228 bp, Glycine max
  Peptide Sequence Number=SeqID_189501
atgggaaaactcatagttatgaaggaagtgatgagcatgagtgaattggttttatatcatggcggtatgcctattttcatttccttgatcatgtgtggttcaaacttcaatcttttcgctcaggtgtgtttcttcccaaattgtgcaaatgctggtcgacaaatgggtgagatcaaaagctcagatctctcagatgaacctgccgttgctccattcccgcaatactaa

SEQ ID NO: 72724 - DNA, 474 bp, Glycine max
  Peptide Sequence Number=SeqID_189502
atggaggacacgtgttatttcacccgacaatatgagaacaatagaaaaggaacaacacataagagggttttgatagggtttaaggaagcgcggagaccgttgtcttcaaagaagtgttcactgttcaaatcaaaatcgatggcacacatcacaaaccttcccatgacgccactgatgcccagcacttcctcaaacgacatcaaagaaatcgcgtttaagactgctccttcagcttccaaggttgaaatcaagcgcttcctagaaaccttctacggcttcgaggtcgaaaaggtgcgaactttgaacatgaagggcaagaagaagcgttacgcgggatcgttggtcgcaaaacccgattacaagaaggcctacgtcaccctcaagaaaccactttcgttctctcaggatccttaccactttcgttctaccgtagaagacaagaagaaagagaagatgttgaccactcactgctag

SEQ ID NO: 72725 - DNA, 459 bp, Glycine max
  Peptide Sequence Number=SeqID_189503
atgaatgatttgatgacaaaatcgttccaaagttacgccgaactgaagaaacaggctgagaaggacaatcttgaagattctcatgacattgaagcagggaaactcaacaaccccacggattaccataacctctcacagttcttccaagaagttgaagcaatcaaggttgaaatggaagaggtcgctaccctcttattcgaccttttgcaactgcatgaagagacaaagtgcactgacagtgcaaaagtcctacgtggcctaagagaccgcatggtgtctgacatggttaccttgttttgcaaggcaaggatcatcaattcaaggttcgaggttcttgaccaatccaacataaccaatcacactttatcagaatcctgtaaagaaggaatccaaattgatgaccagaatgtctgtcacaaatcgttttgttggccaggatcgtgtggccagtgttggtaa

SEQ ID NO: 72726 - DNA, 502 bp, Glycine max
  Peptide Sequence Number=SeqID_189504
cgtatgttttccggtgcatcatcttccaaatcagcacaaagcaccacgccatatggcacgagtcctttcacagtctccatccggaagccaatagccccgttgaactgcaccgcatacaacctcaccggaacatgccccacaaacctacaagaccatcagagcactccagccaccgccacgtgtccagattacttccgttggatccacgaggatttgaggccatgggcccgcacgggcatcacgcaagacatggtggagagggcaaagcaaacggcaaattttaggtaccctggcaagatacctgatttggagcttatgtttgattgtgtggattggcctgtggttttgtctgatcgttacaatggccctaatgttgagcaaccaactcccttgtttcgggcagagattaatataaagccatggcatattttgttgggagagttgaaagaaggcactacgaggataccatggctgaacagagagccttatgcttactggaaag

SEQ ID NO: 72727 - DNA, 207 bp, Glycine max
  Peptide Sequence Number=SeqID_189505
atggcactttctggtggagtggagagggatgcaatgctaggagaggaaagcaaagtaggcattggaagggtcattgatgagcgtgatgggaaggaggcagtgaatggcagagataaggggggagaattagatatcaatgtgggtgaggaagaggaaggctattttgggaaagggttttttggaggagaggtggaaaaatttggaaag

SEQ ID NO: 72728 - DNA, 252 bp, Glycine max
  Peptide Sequence Number=SeqID_189506
atggttttctcaacaacgatcatggaggcgtacttggagatgacatgggtctgttattttactacaaagcgcttacctgaggggcgcgttccaccagaacgtgacacgtggcgtgacttgacaggacgatgggacaggggtggaagtggtggcctgccaggcgctaccagtagtggtggggccccaggcgcgactactagtggtagcctgtcaggcgcgtccactagtggtgggcccaggcgcgtccactag

SEQ ID NO: 72729 - DNA, 252 bp, Glycine max
  Peptide Sequence Number=SeqID_189507
atgggttttggaggtggtgggttgtggtgtttggcgggtgattttgtgttttgtgacacgacggtggtggttcgtggtggtggtttaaggcaggacaatggtggtggtttaaggcacttgaatggaggtgtctgcctgtggttatgggtcatggtggttgtgcataatggttgggtgactaaagaaattgatggcaaaagagaaacattgaatcttggagtaagaataacatgtttctacaagtacatgtga

SEQ ID NO: 72730 - DNA, 873 bp, Glycine max
  Peptide Sequence Number=SeqID_189508
atggtccaaaaagcaattgacaaagggagattgaaattcaaagagaaaccaatgaaggttgatactaatccattccacatccaggctaattatattgaacccatgcagatcatgatgatgggagctttgattggaacgccaaagatgagtacgcctttatctaaagaggaggggaatgaaggatccagttctcgttttaaagcattcgaagtaagtgatttggaacttcgaagaggaggaactactgaaggttccaagaaaggattctatgaataccgaaattctccatgggtgaataggaacatgtcaataacccagtggaggaggcatcagagaatgacaagggatgcaatattggagatgcaacaaagaaatgattccttggaagccatttatggagtaatttggatattacccgcagagtatgctgaagatgatcaaaataggcacatattgagagattatgtcaaggaagactattttgatgatccttgtctaaggccaaagaatgctacagtcttcgatccacctagtgatgacatgagctatcacatgaagtcactccacttgacaactatggtagaagatcaagtcattaataagattttggtggatggaggggatgcattcaacatcttaccaagatctatgctgtggagaggggtcatttgtttggatgtttctataggtagcaggagaagacctacaatgcttttgaagcttttcttttggaacaaagatggaaaacttgaaatggtagaagctggaagtggccaagtagtggctagaactgctcttttcaaagttgaagattccttctatgtgaacaacaagtcaagtgataaaaaggataagttcttttgttgggattga

SEQ ID NO: 72731 - DNA, 129 bp, Glycine max
  Peptide Sequence Number=SeqID_189509
atgaaagcttaccttgacgaacacttgcagggcacaacaactaaagggcatgagcccgaggtcacggtggtgagaaagtcaggcacacgccacgcggagctcaagggggtgcgacaacctagggtctaa

SEQ ID NO: 72732 - DNA, 261 bp, Glycine max
  Peptide Sequence Number=SeqID_189510
atgtgtggacttagtagagaattggtggaacacagattgcctatctataaggggagaaaaccagtgaagcatgcaccaagaagatttgctcctaatgtcatggaggacatcaaagcaaagatagaaaggctactgaaggccaatttcattcaaaccataaggaaattgcttgtgtgcatagattttagggacttaaatgtagaaacaccaaaagatgaatatcctttgctagttgttgatatgttagttcattcaacatag

SEQ ID NO: 72733 - DNA, 456 bp, Glycine max
  Peptide Sequence Number=SeqID_189511
atgcaagaagcaatcagcaagataaaagtagaaatattattaattaacggaaaagaaaaagagaatgacaaggtggtggaatcttgggatgtgtgtaaatcaaaagggagggagaagaagaagaagggggatgaagggggtgcgcctgaggctgggtgttgggttaggttgaggttcattgggagctacatttcttcaagatccaaggttgatacctcagtcagtggcactggcaccaacactcattatggatccaagcgccacaaatacaaagaaatttctagtcctttcccgaaagttgatatccaattccaagctctggatttaatagcaactataatagaatccagattacatctctcctgtttgaaaatagttgcatttctatccatttccaatcaacttggttactcatgtttaaagataaaaataaagaggagtaaccccgcaaagtaa

SEQ ID NO: 72734 - DNA, 1671 bp, Glycine max
  Peptide Sequence Number=SeqID_189512
atggccagcctcctcctgacacttgactgcgaggctagcccttggggggcggattcgtttgacccaacatcttctcaagaactacttaagaaacaatgcattctacaagttccagtgtccccaactattgagttaaataacaacatttaccttcaggtcttccacatggcaagcaaaaatgttgatgctgatcagaggataactcatgacttggagaagttaacaacagacttgtcaggactggtcactggaatggtaaagccatctgtggatattttgtggttcacttggagaatgaagctgttaacaggtcggaggggagttgccatactctatgcttacatgttactcggtttgggatttctaagaactgttactccagattttggtgatttgattagtcaagaacaacaacttgaaggaacatttaggttcatgcatgaaagactttgtactcatgctgaatctgttgctttctttggaggtggtgctcgagaaaaagctggctctaatatgaggaagtgtgaagtgggtctcagtttgacaggaaaaatggtcgagtctagattcagggaacttctcctccactccaagtaccttttaaaaaagaagtggctgtttggaatcctggatgattttatcacaaagcaacttccacataatgtgacttggggcttgagcttaatatatgccatggaacacaagggagaccgcgcatcagtaactactcagggtgagctggcacatgcactgaggtttttggcatctgttgtttctcaaagctttttagctttcggtgatattcttgaattgcatagaaagtttgtagaactctctggtggaattaatcggatttttgaacttgaagaacttcttgatgcagcacaatctgagaatttcacgagtgttagtgctatacctccagtgagggatgttcattccagtgatgtcatttccttctcaaaagttgatatcgtaaccccttctcaaaagatgttggcgagggagttaatatttgacattaagcatgggggaagcctacttgttactggtccaaatggaagtggaaaaagttccattttcagagttcttagaggactatggccaattgccagtggaagactctctagaccatctgaagttgtggatgaagaggatggatctggttgtggcatcttctatgttcctcaacggccatatacatgtttgggaaccctaagggatcaaattatatatcccctttcctgtgaggaagcagaggttaaagtactgaagatgtatggaaaagatgaaaagcatgctgacaccagaaatttgttagacacacggttaaaagctatcctagagagtgttcggttgaattatcttctagaaagggagggaagcaactgggatgcgaatttaaaatgggaagacattctttctcttggagaacagcaaagattggggatggcacgcttgttctttcataagcccaaatttggtattcttgacgagtgcaccaatgcaactagtgttgatgttgaagaacacctatatgggcttgcaaaagatatgggaatcacggttgttacttcctcacaacgtcctgctttaataccatttcattccatggaactgcggctgattgatggtgaaggtaattggaagcttcgattgatcaagcagtga

SEQ ID NO: 72735 - DNA, 807 bp, Glycine max
  Peptide Sequence Number=SeqID_189513
atggtgtattacaaaatatcacatgttgatggtcggataactaatccggaacaaagaattgccagtgatgtgccaaggttctgttcagagttgagtgagattgtacaggatgatctaactgcggtgactgatggactgctatacacttggcggctgtgttcgtatgcaagccctaaatatatcttctggattttggcctacgtacttggagctggggctacaatccgaaacttctctcctgcttttggtaaacttatgtccagagagcaggaattggaaggagagtatcgacagcttcactcgcggttaaggactcattcggaaagtatagcattttatggtggagagaggagagaagaagctcatattcagcagaagtttaggaccttagttagacatattaatagagtgctacatgaccattggtggtttggcatgattcaggattttttattgaagtaccttggtgctactgttgctgttattttgatcattgaacctttcttttctggccatctaaggcctgacagttcaactttagggcgtgcagagatgctaagcaatctaagatatcatactagtgtcattatttccttatttcaatcgctaggaactctttctatcagtgcaagacggctcaaccgactcagtggttatgccgatcgcattcatgagttaatggccatatcaagagagctaagcctggataatgggaaatcttcactgcaaagacaaggaagtagaaattacataagtgaagctaactatgttgggttttatggtgtcaaggctagtgaattctactga

SEQ ID NO: 72736 - DNA, 294 bp, Glycine max
  Peptide Sequence Number=SeqID_189514
atgccaccatccctcattcctccaagctcaatccaacctcactcacatgctcatccacctggtaggctttatctatgccaaacatttcacagaagcaaagcaacacaaggttgtaggttcgaagcttcagagaagcattgttgcatttgcccatgcccttcaccaactcaaatgtgtaatccaaaattgtctttcgtcacaccaatgcacatgacaatggtgatggtggccttgtcggagaggatgccaagggcgaacatgtggcaaaggattgtgggtttaagagagggttga

SEQ ID NO: 72737 - DNA, 699 bp, Glycine max
  Peptide Sequence Number=SeqID_189515
atgtcttcccttcaactgttccaactaactcatcatggccggagttttctggcttcaaggagaaaaactttgctacttgcaactggtatcttagttgctggtggaactgcagcatatgtgcaatcgaggtttagaggtaatagagatgatttattaggtgattcctatgagcgcaataatgataaagaactcacaaaggaggaggtcatgaaaggaacttctgcaccaaagaataaacaaaagaaaggagggttgaagtcacttcaagtccttgctgcaattcttttatctgagatgggccaattaggtgcaaagaaccttttatctttggtttctatagtggtgctgcgaaccactttgagcaacaggctagcaaaagtgcaaggtttcctatttcgcgccgcttttcttcgacgtgtgccattgtttctgcggctaatttcagaaaatattcttttgtgtttcctcttatcaaccatgcagtctacatctaagtacattactgggactttgagtctgcacttccgtaaaatattgactaaacttatccattctcgctattttgaggtagatattgctgatttgtatcctctttgcatatgcaagagtaaggctgcgtacaacatccctcccccataccttcgcatagcgaagagcctctgggcaatgggatacgaagtaaatagaggtaaaacatag

SEQ ID NO: 72738 - DNA, 1935 bp, Glycine max
  Peptide Sequence Number=SeqID_189516
atggataaggtttcatcagactgtccgtacccgggatgcttcttttgtgtcatgaaggaagggaatccaagcaagcgcagagcaagtgtactgaaattctttagagaacttccgtgtcaagatgatgatggtcaggttctccctatcagtggcctttggaacactgctatggcacacccaaatgacccggagttcctagagctaggaatatttgaatgcatgtctgctctcatatggaagggactgaagaacaggcgctggctttctcatgaccaaaatatatatattccttattatgcagctcatatcatcggttcctacacaatgaatatggaagaatttgcagaaagtgccgtgcatgctggggtcattcctcctttggtcgagcttttacgaggtagattaacttgggttgagcagagggtggcggttagagcattgggacacttggctacatatgccagcacttttccagccatagcaagtcatggtgaaattcttgagctctccatccaattggcaatgagttccctggaaatagtttattcacacttttaccaatatgttgatagaagacttagctatcattgtgatctgcttacacgtggcatgggtggtgttgaaatggagtccaggaaggctgaggaatgggctagtcagttgcagtgttggtcccttcagctaattaattgctttgcttttaaacatgaatttcttcctaccatatgcaaacccgaatttctgataaaactacctggcatgtggggtggacttgttaatgaaaattcacctgctggtattggtttattaagaacaatttgtcatcaaaaacttggtagggggcctgttgccagttgccctggtattattgatgcattgtgtaatattgctcggtcttcagatgattggcagtatatggctattgattgccttctatggctgcttgaagatcccaatacatgtcacaaggtgattgataaagtggtgcctgcattagttgaccttgctgagattacaactctgggtgatcataaaaagcttggcgatttagttgttaatgttcttcaagagtgcatccagtctcaagggtcaggacgaagctcgattagtagtcatactaaagagcagattgaggatattttaaattcaaagcagagattaaagtgggaaaagaatatgcccaaggaagatctacatattaagcaggctgcagcgctggttgtcaaacttgaaggaaattctctgttctcatctggaagtattgctggagctgcatcaaaatactctgaagctttggcattgtgtcctatgagatcaaggaaggagagagttgttctatacagtaatcgtgctcaatgccaccttttgctgcaacaacctttggctgccataagtgatgctacccgtgcactatgtctccataaacctgtcaatcgtcatgccaaaagcctttggagacgagcacaagcttatgacatgcttggattagcgaaagagagtttattggatgctattttatttataaatgagtgctctcagtcaaatgatcctgatctctcactgaggcaaaataaagttccagattatgccgagcgtttagttaagaagcagatgcgtgctgcttggttatttcgagaggcagctattaagcatggtggggtccatagtcagggtgatggcggtgatatgtatggcccagagactgatgattctgaatgggagacagctagtgaaagtgatataggaaatgatggacgggatgacatgggcgaagacgacgatggtgattggaataatgatgatgagaggaaaaattatgacaaaccctcgatgaaagctttagtttcgacttttagacttcttgaaaagaattggtctcctatgcgactctggattttgggtaaccagcctttccttgtttgtagcatcacttga

SEQ ID NO: 72739 - DNA, 219 bp, Glycine max
  Peptide Sequence Number=SeqID_189517
atgagacaagccaacagctcaaatggcaccacccaaagagtgaaaatgggatggcacttcctattatgcaacttcattcttgacgttgacaatttacaagcatttaaggtggtatctcatatggcgcctcttgcaaaagacaaaagaccaccaaaaggtgccatcttagatggtgtgtcctcttgcctacatagaaaagaaacccttgcaagtaaatag

SEQ ID NO: 72740 - DNA, 573 bp, Glycine max
  Peptide Sequence Number=SeqID_189518
atggaagacattgtaaggatggaagatctttttaagaggtggattgagtatcttgatagcatacaatcaagggtcagtcactcaccaccgataaattgtgatttttgtggaggagagcattgtaatgacaattgtcatctctactccatgaataactcttggtggggacaagagttactcccttacaatcaatatgaagaagaaagaactcctaatcttgaaggtgtgtttgcggaattcatggcataccatgctagctctaaagccaatcaaaactcaatgcaaaatcaggaaattcatgttggcaagagctactccatggaaaattatcagtgggagcaagagttacaaccctacaatcaatatgaagaagaaagagtttctaatctagataatctattgaagcaattcaaggaatcaactgaacctactcaacgagcatttaaaagtttagaaattcaagttggaaagctagcagaagaaatggccaaatttgtggccacaagtgaagaaaactatgtagaagttgaagctcatgaggaaagccttgtagaagagcattattcaacataa

SEQ ID NO: 72741 - DNA, 338 bp, Glycine max
  Peptide Sequence Number=SeqID_189519
atggctttatcctcctttgatgagttccctaatgaaggagaggacttgtcaaaagggtcatcattgaatgcttggagagttgttgttgttgtgattgtgagaaaaattgggcatcaaggtgttgagcatgagtttctggatgatggtggtggatcttgtgatgcttgttttatgctgtctgatgagccagctagcatttggactacttgcttgaaagtagagtcaaatctagaaatggttttgggagtgagaggtggtgttggcatttggatggcattgttgttactactactcatgcaattgctcgcattgcttgttggagacttcataggagaagg

SEQ ID NO: 72742 - DNA, 782 bp, Glycine max
  Peptide Sequence Number=SeqID_189520
tcattcttcttcacactgcgcgcgcgcgtgcgattgcttgcatgccaatggagggtcacgccgacgtctccgccacatttccgccgcctcctggccaccacggcgccgacacgtatatcgtgcagctcccgaaggaccaagtgtaccgcgtgccgccacgcgagaacgcgttgatcgtggaacagtaccgcaacccagccaccgcgaaaaaaagacgcggcggttgttgttgctgctgcagccgtcgtgtcttcctaaccgtcgctcttatcgttgtggcaatcgttgccgtcgttggcatcacgctggccacgttgtactttattttcagcccctcgggtcccaagtttactgtctcccatgtggccgttaataggaacaagagctcgcgggcggcgccgcagtacgaggtttcgttgagggcgaggaatccgaacgagaagttggcgattgagtaccaggatggggacgtgtcgctgttgttcgatgacactaaggttgccgaggggaagtttccgacgttggagcaagggcgaggtgaggcgagtgaggttacggttgagctgaccggatccagtggagcgttgcccaggcgaatgaatggtggggacgcagccgtggatttgaaattggagatgaaacttgcgataaggataagaaccgcgggactcgaaacgtgggccatgaggtccgatgtggcgtgtgagtttaaggtcagcgctctcgggaacgacacgcgagtcttgtcacagcaatgcgataccaagttcaagcaatattaa

SEQ ID NO: 72743 - DNA, 1394 bp, Glycine max
  Peptide Sequence Number=SeqID_189521
gtggctgtgaagatgtaactttctcaggaacagcttcatctaataactcttcagctcgttctggctccaagcctctccacatgccaaaccctgttgttaaccgaacccaccaaaggaaccatcccaaagtgtcacctagggagggctatgtcaacagtggaagaagggtccctaaagaagcaattggtatttctggtgaacttgaaagcatgatcaccgatcgtcaaaagggaagcagctcccttgttcgtgcttcttctagcaacgtgatgatgtttggtaatttaggtaaccttaggcaaggagggaacacaaatacctattctcagaaccctgttgctagtggaagatacacaaaccaaacggtggagaatgtaagtaaaggaagcaaggaacaaccggacgcattggctctttacgatgctgcaattgcaattcaccctaataaagcttcctacaggagcaacagaagtgcagcattaacggctctagggaggcttctggaggctgtgtttgaatgcagagaagccattcaaatagagcctcgttataaaagagctcattaccgattgggaaacttgaacatgagtgacctcacacgagaaaaagatggagaaatggataaggctcattatcattataaacaagcaggaccagaggctgacacagaccagattgctaaagtcaaaaaaattcaggtccatttgaacaaatgcaccgaggcacgtaggctaggagattggaacaagttgattaaggagaccaactatgctgtttcatttggtgcagattctgccccacatatatttgcattgcaagccgaggcattttttatgctccgtaggcaccaacatgcagaagaagcaatgttgaagggatctaattttgatgtggatcattgcatccagttctttggacctatttgcaatgcaaatacattggtgactcaggcttgggttcatttggctgctggcagagctgtggccgctgctcgatcaaacagaaacgagcttttcaaggcatccaaattctccgaagcatgtgttgcctatggagaggggttagagaatgatccatataactcggttttgctatgcaaccgagctgcatgcagatccaaaacaggccaacttgagaaggccatggaagattgcaatgctgctcttagcttgcatccatcttacagcaaggctaggctgagaagagcagattgtaatgccaagttgaaaagatgggaaacttcaagacaagactatgaaatattgcttaaagagacaccggaggatgaggaattaagaaggactttgttggaggccaagagcattttatccaacagcgaggatgacagaaaaagcacacttgttgtcaatgatcaatactcaaatcctttgtag

SEQ ID NO: 72744 - DNA, 266 bp, Glycine max
  Peptide Sequence Number=SeqID_189522
atggcacttcctaatggagtagagagggatgcagtgcaaggagaggaaagcaaagtaggcattggaagggtcattgacgagcgtgatgggaaggaggcagtgaatggcagagataagggttggggaggcacgaaagggggagaattagatatcagtgtgggtgaggaagaggaaggcaattttggtaaagggtttttggaggagaggtggaagaatttgggagggttggaatgggaattggtggaatgggaaatggcatttgagat

SEQ ID NO: 72745 - DNA, 576 bp, Glycine max
  Peptide Sequence Number=SeqID_189523
atgatgagaggagagcggttcccaaaggcatgttttcttgagtctagtttacaccgaaagggcattcttacaggtcatcagggtggtggcctcagaaatgttgccaatggacccataattgggggtccatttacactaattaatacagagaaacaggcaattacagaacataattttcttgggaattgggtcctgctctactttggctatacctcatcccccgattgtgggccagagcaagtccaaattatggccaaggcaattgatatattagaatcaaaacagaatcttaagattctaccagtatttgtttccactgatcctcaacgtgatacgccctcacaacttcgtgcctaccttaaaggtgtgcttatgatagctgaggtagagggtgccaacacagttgagtttgactcaagaatcataggattaactggacctgttgcagctattaggcagatggctcaagaatattgtttttactttaaaaaggtagaagaggatggcagtgattatcttgttgactgttctcacaacatgtatgcacttgttctacccttattcatccttctgtag

SEQ ID NO: 72746 - DNA, 237 bp, Glycine max
  Peptide Sequence Number=SeqID_189524
gaggaggcaccatctaagatggcacttcctggtggagtggagagggatgcaatgctaggagaggaaagcaaagtaggcattggaagggtcattgatgagcgtgatgggaaggaggcagtgaatggcagagataagggggtctgtgtggatgtaaatgttgaggaggttgggaagggagaggtggacaaatttggaagggttggaatgagaattggtggaatgggaaatggtatttga

SEQ ID NO: 72747 - DNA, 300 bp, Glycine max
  Peptide Sequence Number=SeqID_189525
atgaaggattctcagttgaagcagcgagggtggcattgtgaaggagttcctcttcgtgtctcagtagtggcacacgacaaagattcaagagaagcaacaaggagagcgagtgataaaagagcacgagtgagacttgtttgtctctcatcccctactatcctcaagttgttcacaattagatatatctctgacccgtctgatggcactcaaaatctagcaggaaactcatacattttcacctccaatttctcagagaattgggaattccaaagagaatatatgggtgacagtcttgtgtag

SEQ ID NO: 72748 - DNA, 153 bp, Glycine max
  Peptide Sequence Number=SeqID_189526
atggagattataattctacaggctcaaggttcatctcaattaatcatatttaagctcaaaatgggagcaagggattcatcattcatcaacaaggtatggaaggggcatcctgggctggcaaagatgtctctggtgctggagtgggctaggtga

SEQ ID NO: 72749 - DNA, 462 bp, Glycine max
  Peptide Sequence Number=SeqID_189527
atgcaccacttggcgggtcaccccaatgtcatacaaattgttggagcttatgaggatgttgtggttgtgcatgttgtcatggagctttgtgctggaggagagttgtttgataggatcattcaaatagggcattacactgagagaaaggctgctgaacttgctaggttgattcttaatgttatggaggcctatcattctcttggggtcatgcatagggatttgaagcttgagaattttttgtttattaatcacgaggaggagtcacctcttaagaccattgattttggactcttgtgttctttagacaagttatacaaaaagagaataagaggccacccatgggttcaggttggaggtgttgcacctgataaaccacttgattctgctgtcttgactcatttgaagcaattctctgcaatgaacaagctcaaaaaaatagccattagagtgagtatccagtag

SEQ ID NO: 72750 - DNA, 198 bp, Glycine max
  Peptide Sequence Number=SeqID_189528
atggaggaagcactggaactgtcacgtgtgaaggacatgaaggagaggatggtgggcatggagcgcctccaccaacttctagaagcttccagaaagagcctatcgtcttgcaaaacatccagttgctgcatcgagcttgcaaatggaggtttggagaagtatttcacggagtggtacctgcttagaaccttttgttga

SEQ ID NO: 72751 - DNA, 2286 bp, Glycine max
  Peptide Sequence Number=SeqID_189529
atgtccaacttggactcactggacttatctgacaactcattggccttgacatttatccaaaattgggttccatcttttcagttgagcaaaataggattgcgatcttgcatgttaggtgtggtaggaaacaaattatcaggacctatccctgcttggattgggagcaatatgcaagagttggaaattttgagtttgggaagcaatcatttcaatggaagtttaccattgcagatttgttatctaagaagcattcaactcttggatctctcaatgaataactttttctgggcaactttgcagatatcaaaagatctttctactatcaccttggcagagcttttgaccgcacttcaggctccgaaacaaagaactcatgagacaagaaggccagatatgaaatgccataaatgtggacaattagggcatgtggagaaaatcttcaagtcatcaaaaaaacaagagaatgtacaagctgctgttgaagaggtcgatgaagaagaaatttttgttgtttcttgctttgttaccacaagatcaacagaaagttggctaattgacagtggttgcacgaaccacatgacttacgatcaagaattattcaaagatcttgatgcaacctacaacacaaatgtcagaattggaaacggagcaaaaatagcagtgaaggacaaaggaaccatcatgatcgaaggttgcacaggtctgaaattggttcctgatgttctatatgttcctaaaattaaccaaaacttgttgagtgttggccaacttctagagaaaggctataaagttctatttgaagataaaagttgcatgattaaagattcagataataaagaattattcagagttcaaatgaaaggcaaaagctttgccttgaatttgattgatgaagagcagcttgttgtgcacaaggttgaagacaacacgctgaatgatgttgtacaaggtctgcctgaattggaagagaaatcactcatcgtcaacaaaagctctttcaaaccaaaattgatgaagttgaaagtctttggctgcttgtgtttctcttatattccacaggttaagagagacaaacttgataaaaaggcggaagcgggaatctttgtaggctatagctcaacatcaaaagcctatagaatattcttgccacaaagtaataaagttattgttatcagagatgtgctattctttgaagaagaaaaatggagcaaggaaagtgagaagcttcaaattcaggaagagagcgaagaagatgtggatgaccagccagttagaggaactagatctctctctgatatttatcaaagatgtaatgttgttataatggagcctgtagactacaatgaagctgcaactgattcgaagtgggtaagtgcaatgaaggagaagcttgatatgattgaaaaacatcaaacatgggagctcacggagaaacctaaagataaaaatgtcattggagtgaaatggatttatagaaccaagcttaatgctgatggttctgtaaacaaacataaggcgaggcttgtcgtgaagggatatgcgcagatgttcggggtagacttctcagaaactttttctctggttgctaggttggataccataaggatttgtagttcatggacaggaggagaaagtctatcggctgaaaaaggccttgtatggcttaaagcaagccccaaggtcttgacggatgttggaatagtcattgtctccttgtatgttgatgacttacttattacaagaagttcaaaggagatgagtaaagagtttaaaggaggaatgaaagaagcctttgaaattactgatcttggaaaaatgtcttatttccttggtatgcaggtgcaacaagatagaggtgaagtctttgtaagtcaagaaaaatatgcaaaggaaattcttagaaagttcaagatggaggaatgcaagccaattgcaacgctaatgaatcaaaaggagaaattcagcaataaagatggagctgaaaaggttgatgaaaaactgtacagaagcttaataggatgtctgaagcaagatgtcatagcacaatctaccgctgaagctgaatacatagtagatgttgtagctgcaaatcaagcaatttggctaagaaaacttatggttgatctatgcatggagcaaaaggagagtacacaggtgcaaaagcaaggtgacgtgcagctgctgtattgcaaaactgaaaatcaacttactgattttttaacaaaatcacttcctcaagcaagatttgagtatcttcaacaaaaacttggtgtatgctgccgttga

SEQ ID NO: 72752 - DNA, 249 bp, Glycine max
  Peptide Sequence Number=SeqID_189530
atgacaaattgtttacctgtgggaggcttaattatccctgtttgtcaaacttttgggggggcttatcaaaaccgaaaacacaatattcttgcttggtccagagtgggaggcaaagaagacgacgatggtggcataaatccggtgatggcgcggtctaggtcggtggcggtgacggcggttacggtgggttgcagtgatggagaatttagaccacggacgaaagggagagggtggttcttgccgagttag

SEQ ID NO: 72753 - DNA, 1461 bp, Glycine max
  Peptide Sequence Number=SeqID_189531
atggattcggccaacactagcgggagcttgcaatcctcaagcggcgccgatgaagagtacgattcacgcgccgaatcatcaccactctctgcgttcttaaccaaccaaccacaaccaccaccaccaagccaagttgttcgctttattctaccatcacaacaacaacagcaccatcaccaaaacacccacatgttcgaccctttatcaaactacttggatcccatcacacaaagttcaacatcactattaaaccttgacgtgatgtggtccaaaacaggtagatccgaatcaaaccaaaccgatcttgttgggttgataccttgttcatcatcctcagtaccctcgccacataacgaagcttttgtgtcaagtcaaacacgagggaacaatagtggtgcttttcctaccttgcctccagaaagtggttcccgcggactaatgctttcagtgtcagccgccaacaatgatcagattcaaacccacaacaacaacaacaactgcaacgtggttcgaaacccgaagaaacggtcaagagcttctaggcgtgcacctaccactgtgctaaccacagacaccaccaatttccgagccatggttcaggaattcactggcatcccagcaccacccttcacatcctcgtctttcccgagaacaaggttggatctctttgcttccaccgcaacaccaactttgagatccaacgttaacgttaaccctttcgaccctccaacacaacctccttaccttcttcgcccctttgcacaaaaactccaacttcgaagtcttcacccgtttcctccctccttttccaacactttaccaccaccttcaactaactctcctactaattcaacttccattaactaccaccaacaacaacaacaactatctgagcatttcggccttgcgaaacagcctttcaactttaacaacaccaccccagacactagtactcttgaggcatatcatcatcccaagtacactcttggtaactcttcttctgttcttgtctccagaacacaacaacaacactccttggaaattccgccgaatctcaaaatggggttgtatgaggaactggaactgagacacgaccatgttaacaccgacctcggatgtcttcatcagaacatggtttcgtcaacatcagttggagtgggagcattgtcaagtgacaacaacaacaacttgagtaatgctactaattcttcaacggaatgggcccagagaacgggcaccattaccaacaatgattgcgatcacggaagaggaggaggagctctcagtggcactgttaactacaacgacattggggagggagctgtagtcactaatggcaaagtacactactcagcttcttcatcggattttcatggagagaagggaccagacttcactgtaactactgcagccagaactcaaggtatggtggaatcctggattaattgttcttctgattaa

SEQ ID NO: 72754 - DNA, 381 bp, Glycine max
  Peptide Sequence Number=SeqID_189532
atggagacaactgggagagagcaaattaagactgaaacagagggtgaaattagaggcacaaagaatggcgctgacttttttgatgaaccaaaaaaacttgttagagtgaaaagagagacagagaaggatgttgtggtggagcattgcctcgcccccaaacgcatgttacctgaaccatactcgtgttctgattggatagtgcacgtaatcgaggaaacgttactagcagtagcgctctttgaaaattgctcagcaaaagaaaatctgagtccactgccactgactcactggccactgccatatttctgcattgttaccctaaaaactggggcagtggggcgcgctctactccctatgctgccttcgtgttttatgaaataa

SEQ ID NO: 72755 - DNA, 1119 bp, Glycine max
  Peptide Sequence Number=SeqID_189533
atgactcatgaggattgggatctctttgccatcgttagaagttgcaaagctgctacatttactgccaccacaaacacagaaaccccacccaccactaccaccaccaccacctccaacactacctcttgctcgggtttgagccaagaaaatggctcattctcttttcccaatctggtgcaaccaacaaccaatgggttccaagagcttcaacaccaacaattgttaataaacttcaaccccaccaacaccattactagcactagcactagcactagtggccttggcatcaatcccaattccacgttttctgaagttgcgggattcattggacaacagcagatacagcaaagtctccaccaccatctcgttcctgctcccacaaatcacaccttcattggaacaccctccactactggttttgacaggttccaacaacagcaactccaaaccccagaacaacagcaaccacagcaaaaccaaccaccccttcaagcaccacaaacaagtcacatcctttcaccaaccacacaaccacaaacacccagatcaagaaaaagaaagagccagcagaagaaaatggtatgccatgtaaccgcacaaaacctctcatcagacttgtgggcatggcgaaaatatggacaaaaacccatcaaaggctctccatatccaaggaactattacagatgcagtagctgcaaaggatgcgctgcgagaaagcaagtagagcgaagcaccagcgaacccaacacgttcatcgtgacctacaccggcgaccacaaacacgcgaaacccgttcaccggaactccctcgccggcaacaccagaacaaaactatccaccacccgtttacccgaaacccatgaaaccgtgtcttgtgtaataatagaaaacgcatgctcttcaaactctgagctttctcccatgtcggtaaggtccgacacgctggaaaacgaggcaacgctcgtacccggcgaacccgattgcccggacacggatattgaccctgaggtgccctctgaagaagacgaagacgttttgatacccaacacaggtgccatgtcagactcgattttcttggggttgaccaattttgaccgcgacggcgtttccacgctttaa

SEQ ID NO: 72756 - DNA, 342 bp, Glycine max
  Peptide Sequence Number=SeqID_189534
atgtccggggtgtgggtattcaagaatggtgtgtttcgtttggtggaaaaccctcaagctgaggtctcagataggcatggcaagggaagtagctcaaagagaaagatgttggttcacttgccaaccggggaagtggtttcttcctatgcttttcttgagcagatcttaactggattagggtgggagaggtactatgatggagaccctgacctctaccaattccacaagcactcttcaattgacctaatttccctcccaaaagatttctccaagttcaactccatcaatatgtatgatatagtcatcaagaaccccaatgtcttccatgtccgggataagtga

SEQ ID NO: 72757 - DNA, 288 bp, Glycine max
  Peptide Sequence Number=SeqID_189535
atggaaagcatgatgttagaggataagttaaagagttgccagaggttgaagagaagtttgacagagcagttgagcaaaatggaagagaatatgttgataatcattgatcaatataaagagaaggtgaacctagcggctagtcatgggcagatgttggaagatgaacaggcaaaagtgtcggctttgcaggttgaaagggaagtgagagaagcggtgacagagttattgcataaagtagccatgagatggatggatagatttgatctcactctgaataagagtcaatag

SEQ ID NO: 72758 - DNA, 303 bp, Glycine max
  Peptide Sequence Number=SeqID_189536
atggggagtggaggggagagtaaatgttgctttaatcacaacatgtatctatgtatatgtgaaagggcaaagtcagaaacaaccttccccagaatatgtagcaaagaatcagctcccttaacgaacacaacccctcaaagggaagagaattttaagaaggccagggcacaaaattccaaagcacaccacagtgcctatttcgggaaaagagctctggaggcagcaagaggagcagcttttgcagagatacctaggttttgtaagcttattattgttagggtttcctctgtaatggctggctaa

SEQ ID NO: 72759 - DNA, 525 bp, Glycine max
  Peptide Sequence Number=SeqID_189537
atggatgatggagttcctaaagggcatggtgaagccagtggctgccactgcagtggtgtgtttggttgtggccttgtccgtctactagaagctggggctggagctagagctggttgttgccattattggagtaggggtagttgttgccatctttggtctggtttttgcttttgggggttttgttccatcaggaagtccattgaagacagtgttgtggtcaatagtaagttgtctgaggaggataaagctactcttcagttattggttttgaacaataattcaaataatatccagaagttgttgattttagtgtttctagcatatttggggtgtcttgacttgcttggttttctgttgagccttgacttccttgctcccactccaacccaacttcacactagtttgttgattgaattgttggtggtcattgagttctttatcggattgttgctctatttttggaccgtgatgctcatcatcacaatttggggatactcatatttttatggtagattcatgagttaa

SEQ ID NO: 72760 - DNA, 249 bp, Glycine max
  Peptide Sequence Number=SeqID_189538
atggcacgcaaaccaaggcaggattttagcgtttcaaagcccccacactttttcagacagctctctctctccctcacgttgccattttcttcttcttcattctccattgaagctccaagcaaagcttcaacctttggccatcatttctgccccaaatcgcgaaaggagggcattttcggggtcgtgaagtgcaaggctacgagtgggacttcgaaatttcaggtttgggtggacttctttctctcttaa

SEQ ID NO: 72761 - DNA, 264 bp, Glycine max
  Peptide Sequence Number=SeqID_189539
atggccaaagaatttgtgaatggttttgttcatcaaaacgacattgttgtcataacccgcaatcccctcaaaggcgattccggctccatgtaccgcaacacattcacctcagtattttccgttatggccgaagaatttgtgaatggctttgttcatcaaaacggcatcgctgtcataacccacaatcccccccaaaggcgatttcggctccatgcccgcaagttgctgagtgatgcaatcctatcccgcaagggcattggatag

SEQ ID NO: 72762 - DNA, 876 bp, Glycine max
  Peptide Sequence Number=SeqID_189540
atggcaacccaaactttgtgtgaatctcctcttcctgttgttgacttcatcaatgaaaacatgaagccgggcaccgatacatggcttggagcctgtcaattggtgcggagaggatttgaggattacggttgtttcctagcacgcttcagtaaggttggtccagagcttctcaactccgtttactatgcaatggaagaactctttagtcttccattggaaaccaaaaggagaaaaacaagtgataaaccaaaccatggctacactggacaagtacccacatcgcctctatttgaatcttttgcgattgacaatccatccagtattgaagattgtcaaaaattcgcacgcataatgtggccaacgggaaatgaccatttgtgtgaaagcgtcaacgagtatacaaagatgttaaaagaactagaccaaaccgtgaagagaatggtatttgatagctatggcctggacaagctgaaatgcgagtcattcctcgagtcaaccaattatgcttttcgaagctacaaatataagatacctgcgacagatgagagcagcgtgggagtgaattctcatacggactcaaccttcataaccatattgcatcagagggtagatggcctagaagttaaattgaaagatggagaatggtttggtgtggatgcctcacctttgttttgtgtcatggctggtgatgcatttatggtatggagtagagaaaggataagagcttgtgaacatcgtgttattctgaaatcaaaggtacccagtgagagggcacagacattggaggatctagtcgatgaggaacatcccatacgctataagccactcgacctatatgtatatgttggttttttcgtttcacagaggaagccgtaa

SEQ ID NO: 72763 - DNA, 108 bp, Glycine max
  Peptide Sequence Number=SeqID_189541
atgagttccataggcatggagtccttccaagagaggttgggatttatgagaggtggattaaatggaacccctcccaagaattcaaatgtcacaagggactatgcctag

SEQ ID NO: 72764 - DNA, 624 bp, Glycine max
  Peptide Sequence Number=SeqID_189542
atgtcagcgcttaacacctgtggttacgtctctacccttttttgggttcctctcattaccgaaaccgaaacagaaaccatttgtggtgaaccagtggatctcgaagttttgccctttgtcttccgtgatggccagcctttgatgaactttcaacttccaaaacaagatgatgattttgattattacgggaatagtagtcaggatgagagcttcccagtgaagtcttttaaggaaaaggatgaagtggatgcgtggcttttcagcaaccctattcgtcttcagcagcgagggaagtacgaggatcccacggctttgtttcagctccctcttcagcttgctgccgagagggaaattgccagataccttattggagagtttggaattggtgtttctgagggaattcgcgcacccttccatgaatcctttctctactgtggcttcaaattttcggatcctctcacccaagcaatgaatatgatggggctttacgactttgcttactggttttcctggctcatctgggaggcagttgtcacgatcctatcgtccctccttataatttcttttgattgcattattatggggaccttttctggttcttgttacctgcccagtaaggggtga

SEQ ID NO: 72765 - DNA, 243 bp, Glycine max
  Peptide Sequence Number=SeqID_189543
atggccaccactttgcatttgcttgagtctaggattggaagtaatggagacagtgccgccgttgccgttgccgtcgccgtccgtttgtcatgtgctcgcttccgtggtgctcgcgtgcgtggtggtgccgctgctgtcgtcgcgccgctgtgcgtcgggctggagtctccttttgcaggtgacattcaggtagggttggattgggtcgggtcagcccaaccggtgttgcgcaaatttttttaa

SEQ ID NO: 72766 - DNA, 141 bp, Glycine max
  Peptide Sequence Number=SeqID_189544
atgagtttgaggtttcggtcctcacttcgtgctttaaaaccatgtgcagtttatgggccagaatcaactggccgtggtcagatgccaggaagaagttggaagccgaaactcatcaaggtgcttagggacggacgcaagtag

SEQ ID NO: 72767 - DNA, 396 bp, Glycine max
  Peptide Sequence Number=SeqID_189545
atggcactggaggatatggaaaagataaccttcatcactatgtggggaactttttgcttcaaggtgatgttttttgggctcaaaaacattggcgcaacataccagtgggccatggtggcgttattccatgacatgatgcataaagagatcgaggtctatgtggatgacattatctctaaatcaaggaccgaggaggaacaccttgtcaatttgtggaagttgttcgagcgattgcataaatatgggttaaggttgaatcctacaaagtgtacttttagggttaaatccggaaaactgctcagctttgtcgttagtcagaaaggaatagaggtagatccagacaaagtaaaggcaatcctcgaaattctgaagccacgtactgagaagcaggtctga

SEQ ID NO: 72768 - DNA, 177 bp, Glycine max
  Peptide Sequence Number=SeqID_189546
atggtggttatatcactgtcaatgaaactcaaggaagagcactgctctattggtttttcgaggcaactcacaaaccagaacaaaaacccgttctcttatggctcaatggagtgtatatgcgtatatgttcttggtagaaataggagtagtgggggcaagatacgcgggttaggctaa

SEQ ID NO: 72769 - DNA, 1365 bp, Glycine max
  Peptide Sequence Number=SeqID_189547
atggacgagttgcatgaacaagccaaaagctacatccaaatggaaaaaatgttgaggttcaagaacaaggttcaacaagccagacaaaattgcgacaagaaagaaggaaacactaagaccatctcacacaagtcggacaagaggcacaagccaaacaagtgcaaacctctcccaaaagggcctaggtacgaatgttacacacccttgacggccaattacactacaatccttgaggaagcattcaacttggaggtacctattaggctacccccaatgaaactcccaggccgaggtgtgatcaacaccattgcgagcagattctcttatggaggacagtccaaccaatcccgcaatgtgacaccttatcctcccacaagggagcctgccaaaccaaaccccacaacagctaaagccttgaccgtctaccaagcaagcctggatgacaaattcgacgtagatccatgtgacaacacttctgatagaggcctaaagcctatcgaagagctcgtcaagctgcagcttagacccaaactcgggcagtgtacgcagctcagcagggacctcaccagccatgagcacaagcacatcgctgatgtcctacacagtaatgtgctaagcttcctggacgcttactctagatacaaccagatcaggatgcacgctccagacgaggagaaaatgacatttatcactgaagatgccaacttctgctatagggtttatgtcaacgacatggtcttcaagtctcagagcataacccaacacgtggtagacttggaagaggttttaagagaactccgtaaatacgacatgcgcctctacccgaaaaaatgtactttcggagtcggcaaagtccaaaagctaaatggaggactagcatccctgtctaggtttctccccaagcttgctgaaaaagcgaagctgttctacaaattgctcaagaagactcagccgattacccctactcctatatctcttagtagtcgacgaagcccgctaccaaatgatagagaaggtggcactatcactcattacctcagcctgatgactcagaccctactttcagagtcatcaagtggccctggaaatgtcactctaaagcaagcccttaaatttaacttcaaagcctcaaacaatcaggccgagtacgaggcactcattgcaggaaccagactagatgaccctgatgtagctctaagtggagcttgtaggccttggatcttcttcatcaatggagtcctttccttcttgaagattaatggcaacgaaatggagaaggagaaagatgattggagatgccacttcaaggagaagatgagtcaagaagaagctcaccaccataggaagccatggataagagcttga

SEQ ID NO: 72770 - DNA, 258 bp, Glycine max
  Peptide Sequence Number=SeqID_189548
atggatgacattgtaagaatggaagatctttttaagaggtggactgagtatcttgatatcatacaatcaagggtgtgtttgcggaattcatggcataccatgctagctctaaacccaatcaaaactcaatgcaaaatcagtttagaaattcaagttggtaagctagtagaagaagtggccaaatttgtggccacaagtgaagaaaactttgtagaagttgaagctcatgaggaaagccttgtagaagagcatgattga

SEQ ID NO: 72771 - DNA, 402 bp, Glycine max
  Peptide Sequence Number=SeqID_189549
atggaaattgtcagaaagggtgtgcaaaatgtctgcaaactcttggcatcacctacatttctttgtgaagtcaagggcgtcagccctgagcgttggccagtagtagccagcatgcactacctttgttgcaagggatcattcctatatatggagaccgcaaattccttcatggagttctcccatgacataattttcctattgctgaccttccatttcaggagtcagacttcattctcgtatgatggcaacacccctgaattaggaaattctttagggggtctgatgcaatcctatcccgcaagggcattggatagaagactccaagaagattgggccagagatgcaagagaaggccatagggttctcatgagccttagggtagatttcaagcccatgggctaa

SEQ ID NO: 72772 - DNA, 1758 bp, Glycine max
  Peptide Sequence Number=SeqID_189550
atgggtggcagtcattcaaggggttcgattcagcaacccctgatggaccatgaggtcatttccattggcggttcatcctcgaagggtactcgttgtggtgcctccaacaatgaattctcttcctcagagaggttgagggcttcgcactgtactggtggaggcacctcttgcctccgcgagagggcgtggccttccactgcttccccatccagggaccatgtcctggtcatggtgattctctccctttctatttttggggaagcaaggagaagcagtaaggacgttagggtgtctccccttgtgcaacgtagccatagcactaggtcgccatcatccccacttgtcattgttggctatgagtgggtgagggacgatgttctgaagtataagttatacatcgcctctatagcgagtgtcactactctccaacgccaagtgaagctggaaaatcctatggactcctgcaagatggttgtccaggcttgcaggagtgatgacttccctttcttgacgacggcgtcaggcattccgccctttttcttcatgtacagatgtttgtttgaggttttgggtttccttctccccttgaccgcttttttgtgtgctcttcttgagcacttgaacatcgtgtccaagaagttgtttgagtttgactcaaacatctttcgccgcttgaaggactatttcttcaatgtcctagctactgatgttgtggctaatgatctgttgacccttatggagagggtcaacaaagctattttggaacacctgatggccttgttggacgtgcggcccatcttatctctttcctcggtgagcgatcctcttgctgccttggacggtaaacattttatcttgtcttgtcttccttctttgtgtttgaactgcattgccggatctgctggtgggaccatgccaccgtctgttgctgctcctgctactagagaaaggggtcaacatgctgttgaggttggccttgttgctagtgttgttgaggtaagctgcagggttaacaccttgtttgggtcaccctatgagtttgcaagatgtgctagcagtcgtcgaggctctcgcttccaccgttattgttgttgttactctgttcctccaactcctcatgtcgtacctattcaggaggttacttctactgctagagtagatgcgtcggctacttctactggttttattgcagcgtctttatccaccgttgccacacccttgttaagtgtcagtgtggtgaccactagtgctctcgtgatgtcgccacctcctttttcgcctccaccagttccacccattgctgtgttggtgctgaaaaagaagaccccgaatggctttgtgtcagctttcgatagaaaccttattcagttagttagggtggaaaacgctattgattctgccaaatgccccaaggtaactaatgtcattgttgccttcgctgaagctgtgaggtcaaaccaccaattgtcttccaaggaagagagaaaagacttggttggcaaggtggaaggcattgcggtaaagagggatgagcttgccaagcttgaaggggagttgataatgtacaagaagaaggatgtgaaacaacatgagaaaggctttaacaaggttgttaggcaggccgggttctttgccaagcaccttgacttgggcctttttgactcattcaaggacatgaaggatggtgttctacttgacgaagaagaaattgttgcgaaggaggaggctactgatgaggagcagggtgctaaggagtga

SEQ ID NO: 72773 - DNA, 306 bp, Glycine max
  Peptide Sequence Number=SeqID_189551
atgatgacaatattgtttgcattacctgacacgtgtaaaaaacacctggtactagtacataatcttgtatctaaccaccaccaggctaaggttgtggcaaaatacatacaggattacatggtgcatcttcctcctatggcagaatcaatctatagtgcaagcctatggtgccccatgtggaacagcctcaccccaacaacaccacatgttgcttccactcgccccatgcctcactacacttctcatatgcaagacgctctaagggaatcctcggtacatacccaaactgcctcaaaacccttttag

SEQ ID NO: 72774 - DNA, 437 bp, Glycine max
  Peptide Sequence Number=SeqID_189552
atggtcagccatggtggcaatgttatgccttaccctacccagtcgatagtgaaggagtgtgtggataggttagggattaagggcttagagatgaacaacacccttgatgatgtgtcatgccttttacatcttcatatcacaatatgtatccttgatcacatagaggtgagctacaccaagaaggagatcagaggtcagtggaagttagagcttggtattatggcagatcagaaggcatatgttgtgatgttcgcaggcaacaggggtattggcatggcttatttgactagggaggcattgaatcaattgcaaatggctgatgttgtctgggttttgaggcagtttgggtatgtaccgaggattcccttagagcgtcttgcatatgagaagtgtagtgaggcatggggcgagtggaagcaacatgtggtgttgttggg

SEQ ID NO: 72775 - DNA, 216 bp, Glycine max
  Peptide Sequence Number=SeqID_189553
atggcacttcctggtggagtggagagggatgcaatgctaggagaggaaagcaaagtaggcattcgaagggtcattgatgagcctgatgggaaggaggcagtgaatggcaaagataagggttgtggaaagagggcacgtgaggttgttgaaggggtctatgtggatgtaaatgttgaggaggttgggaggggtggaagagaagaatttgtcccataa

SEQ ID NO: 72776 - DNA, 630 bp, Glycine max
  Peptide Sequence Number=SeqID_189554
atggaagacattgtaaggatggaagatcgttttaagaggtggactgagtatcttgatagcatacaatcaagggtcagtcactcaccaccgataaattgtgatttttgtggaggagagcattgtaatgacaattgtcatctctactccatgaataactcttggtggggacaagagttactcctttacaatcaatatgaagaagaaagaactcctaatcttgaaggtgtgtttgcgcaattcatggcataccatgctagctctaaagccaatcaaaactcaatgcaaaatcaggaaattcatgttggcaagagctactccatagaaaattgtcagtgggagcaagagttacaaccctacaatcaatatgaagaagaaagaggttctaatctagataatctattgaagcaattcacggaaacaactgaatctactcaacgagcatttaaaagtttagaaattaaagttggtaagctagcagaagaagtggccaaatttgtggccacaagtgaagaaaactttgtagaagttgaagctcatgaggaaagccttgtagaagagcattatttaatgaaaaagatgaagaaaaaaatgaggagaaagcacaacaatgggaggagtgctcacaagtaa

SEQ ID NO: 72777 - DNA, 222 bp, Glycine max
  Peptide Sequence Number=SeqID_189555
atgtctgagctaagagaaataccctcgcattgtagcattttcctttcccgcagaaatccagagctgtctcgggagaaaaataaatcgcatgatgacagtacaagtggaggcttcaatcccttctctgtctctttgacgtttgagaactctatcggaacagttagaggaaaaaaattggaggaatctcagggaaccactagaggtgctactatcgctggctga

SEQ ID NO: 72778 - DNA, 420 bp, Glycine max
  Peptide Sequence Number=SeqID_189556
ggaagtgccatttttgcaagtgggagcccatttcctcccgttgagtatgagggcaaagtgtttgtgcctggccaggccaataatgcatacatatttcctggatttggtcttggtttaataatgtctgggaccactcgagtgcatgatgacctgctttgggctgcctctgaggctttggctgcacaagtgagccaagagaactttgataagggactcatatacccaccattcaccaacataagaaagatttcagcacacatagctgccaatgttgcttctaaggcttatgagcttggcttggccactcgtgctcttttatcactcactctccttgttgcttctcttgaatctttgtcgtgtgccactgctgagacacgaagaggaactccttcacaatgccaccctcgctgcttcaactga

SEQ ID NO: 72779 - DNA, 219 bp, Glycine max
  Peptide Sequence Number=SeqID_189557
atgagacaagccaacagctcaaatggcaccacccaaagagtgaaaatgggatggcacttcctattatgcaacttcattcctgacgttgacaatttacaagcatttaaggtggtatctcatatggcgcctcttgcaaaagacaaaagaccaccaaaaagtgccatcttagatggtgtgtcctcttgcctacatagaaaagaaacccttgcaagtaaatag

SEQ ID NO: 72780 - DNA, 389 bp, Glycine max
  Peptide Sequence Number=SeqID_189558
atgcgggaacagaacgtgaatttcaaaggaggaggtaaggggttcgatgatgccgaggctgtggagcttcttggtgattcgttcaatggcggaggagatcgacagaaagtggaggagtttaacatggataaagttatacaagagtttgaattattgacaagggatgcagaaagagttaagagggaaacactcaagaggattttggaggataacgcatcagcagagtatttgcagagtttgggtctcaatggaagaactgaccctgagagtttcaaggcctgtgttccaatggtcacccacaaagaattggaaccttatatctacagaattattgatggtgattcttctcctactctcactggaaaacccatcacaaccatgtccttaag

SEQ ID NO: 72781 - DNA, 1134 bp, Glycine max
  Peptide Sequence Number=SeqID_189559
cccggacggtaaaaagctgtatgttggcgtcggttcaaacagcaacatcaccgaaaacggcctggccgtagagtaccgccgcgccgccgtgctggaagtggacaccgcctccggtgccagccgcatcttcgccagcggcctgcgcaacccgaccgggctgcagtgggaaccgcacagcggcaagctatgggccatcgtcaacgagcgtgacgagatcggcgccgatctggtgccggactacctgacctcggtgcaggacggcggcttctacggctggccttacagctatttcggccagcacgtcgatcggcgggtgcagccggcgcggccggatctggtggcgaaagccatcaagccggactacgccctcagctcccacgtcgcgccgctggggctgctgttctacacggcgaacgctctgccggccgagtatcgcggcggcgccttcgtcagcgaacacggcagctgggatcgctcgccgctgaacggctaccgggtcagttacgtggcgtttgagcaaggcaagccggtcggcaaactcaaagcggtagtcaccggctttgtctccgacgacgagaaggaactctatggcgcaccggtaggattaacggtcgacaaggccggcgccctgctgattgcggatgacgtgggcaacaccgctggcgtgaaacagcggctggccttcgaagctgccgatcgccacgccgtcggctgggccgctggtgaacatcagtgcggcgtgcggcccagcatgccgtctgaacagcggaaacatgcgacgctgatcgtcgcacgccagatgaaagaagctgtcccaggccagcaggccgtcgaacttcgccggcaaatccagctggcgcatatccatttgtcgccattcctgctgcgggaaacgctgccggcagcgcgcgatcatcgcctgagcaccatcgacgccggtgacccgatacccctgttcgataaaataggcggcgatcggcgcgccattgccgcagccgagatccagcagccgcgcattggccggggtgagctgcaaaaagcaatcgaggcacggccgttcaaacagcgtggtgggtctgaggcgtttccaggcggcggcatgttcgtcataaagtgggataatggtgctcgcca

SEQ ID NO: 72782 - DNA, 759 bp, Glycine max
  Peptide Sequence Number=SeqID_189560
atggccacgccaatgatgtgcgctgcgcgccagcagatttggccgatagcccagctcggccgccgccgccagcacgctttcacgcgcgctgtccgagatcgaggcgccgggcgtaaaggcgcgcgataccgtccatttagagacgccggccttttcggcgacgtcgctggcggtggctttgtggtgtttcatcatggttgcgtcgatccctgcttcggtgaagtcaaactataccccgctcgctcagatcccctaagcgcccgccggcatttctgctgcaattatgtcccgtttttgcacccgattgcaaatctcgacattcacggtggcattcagagacgcatcgccgttttgtctcctgctttgcacccggccaagacctaccaggtcggcgtagcgctggccaacttcgatctcaacttcgtctctatcctgcgcagccaaatggcgcgggaactggctgcgcagcagctgcaaggccagttcgtcgatgccaaaggcgatgtcgccctgcaggtgcaacaggtggacgatctgattaatcagggcgtgaacgccattatcctcaacccggttgatacgcaaggcgtccagccgatgatagcggccgccaaacgcgccgcgatccccctgatcttcgtcaaccgcaaacccgaagtgccgctgagcggcgcgacggcctacgtcggctccgattcggcgctcagcggccgcctgcagatggaggccctggcgaaaaaaatgaattaccgcggcaac

SEQ ID NO: 72783 - DNA, 699 bp, Glycine max
  Peptide Sequence Number=SeqID_189561
aataccgctacggtggcgctggcggcggaagcctttggcgtggagagcgggcagatcgccaagacgctgtcgtttcgcgtgaacgacggcgtagtgctgttggtgatggcgggaaccgccagaatcgataacaagaagtacaaacaattcttcggcgtaaaggcgcgcatgctgccggcggaggaggtggagtcgctgaccggctatccaccgggcggcgtttgcccctttgccgcaccggcagcggtaagaatttactgcgatcgcagcctgtgccgctacggtgaagtgcttccggcaggcggcagcgataactcaggcgtgagaattgcgccacaacgcctggccagcatcaccggagcagagtggattgacgtgacgggctcatcgggttatggcacaccgcttcgatattgtggtcatccgggccgatcacaaatgccgcatagtagtgggcatggtaattgggccgcaaaccgggtgcgccattgtctttgccgccggcatttagcgcagcgtggtagaacgcatcgacctgttcacggctgcttgcggcaaatgccaggtgcagatgcgccggtttttcatcggtttgaaacaggcacaatgacacgttaccccgatcgtgacaaagttcgacgccatagccgggttcgccttcggcaacgatctttacgcccagcggcgcgagtgcattga

SEQ ID NO: 72784 - DNA, 1494 bp, Glycine max
  Peptide Sequence Number=SeqID_189562
atgaagaacccgcattcaatgatgatgctcgatatggtgaccaaacagctgcaaacccgcggttatatggcgctgctgctgaacatcaccgccggggaaaactaccgggcggtgatggcgatggccgatcagctgcaggtcgacggcattttgttcctggcgacggtgttaaccaaggagtgggcagcgatcgcgcaagatctgcatcagataccgctggtgcaggtatgccgcaatacggaaagcgaacacattgatgtggtcaatatcgacggctaccgcgccggcgaagagatcgccgcgctgctgatagagcaaggccaccggcgctttggttacatgaaggggccggacacgcaaagcagccatttgctgcgcatggaaggctaccgcgacaaactgatggccgccggctttcagttggatcgagtgctcaccgccggccactacgatcgccaacgcggtttccagctgatgagcgaatacctgcaggcaacgccggaaagcgagcgggttgaggcgctgttctgcgagaacgacgtgttggcgctaggggcgctcgaagcgctcaggcaaacggcgccgtcgtccgcgatggccgtggtaggtttcgatgatatcgacgaggccggctcagccaactgggcgctgaccagctacagccaacgcatcgaccggctggtcgaagaggccttgaatcgcctgatcgacaatcgcgccacggcagacggcgcctggcggcaaggggaattgcggactgccgaagtttgccagatttcacgtagcgcgatcaaaaaggagggcattttgacccattttgcagagtggcttagccacatccaggcgcttgaggttgaactgcaccagccaacaacgcgctgcgatccgaagcgtgtcgcggcattgctgcatgaagactttgaagagattggccgctcaggcctacgttatgacaaacgccagaccgttgcggcgctggagatggaaacggattatccgcagattttcgccgaagggccacgccgtgcgttgcacagagcgttcgtcgatttggcttctgacagccaaggcgggttggctgatgcggcagaagacaggtctcagagggataaagctgcaggcctgattatgggctttctcctgcggccaatcatgccagcgccggctgctcatgccgctgaactaattcgtttttcaaccggccataagcccggcggtcttctgctgtctgcaacgcctgccggtaatgccgttctcgccacgcggcgtaggtctcatgtcatgcatcttgtcattcacaccatccaacgccgccagcctttcaatcttcagcaagatatcaatcatttctccaaaatgcgtcatttcaacgggcactatttgtacgctaaatgcgcattggcgtccgttttcatcgttttcggcgcccaccacggcgttggctatactgaatggggacacatcccaggagcctccccatgtttgaccatgtga

SEQ ID NO: 72785 - DNA, 744 bp, Glycine max
  Peptide Sequence Number=SeqID_189563
atggagatcgccgcgctcaacgtctccggcaatccgctcgatcccggcgaactggggcaacgccatcagcgccaaaccgacaatacgctggagctggccgggctgctgggggtgaaaaagatcgttatgatgagcggcctgcccccggctagcccgcatgacaccattcccaactggatcacctataccgtcagctggccgccgacggtgaaaaactgtctggattatcaatggaatgaagtggcaatcccctattggcaggcgctggtcgcccgggccaaagcgtgcggcgtcgagcgctttgcgctggaaaacttcagcgccatgctggtgtggaacccggaaacgctattccggctgcgcgaggccgttggcccgatggtgggtctgaacctcgatcccagccacctgatctggatgggtgcggatcccatcgcggtggcccgcgccctcggccccgccattcaccatgtgcacggcaaagacgtgcgccttgagcgcggcgtcgttgaggttaacggactgctggagaccaaaccgatcgacgacgtggcccgccgcgcctggaactatgtcgccgtcggctgcggccgggatctgcagtggtggaaggcgttcttctcggtggtgcgcatgatgggctacaacgactgggtgtcgctggaaatggaagacctgaccatgtcggtcgatgccggcatcgtttcctccgttcaggcgctgcagcagagcatcagccagtaa

SEQ ID NO: 72786 - DNA, 807 bp, Glycine max
  Peptide Sequence Number=SeqID_189564
atgaccgacgatctgacgcagccgatccatttccgcgaaggggactgctttttgctgaacagtcggcggcgcttcagggtcgcgtccgatccggcgttgccgccgcagggaggggagcagatcatggccgaggcgacgcgcgacggcatcgccgtgcataacggcggtggtgaggtctttttgatcagcgggcgtttcggtttttccggccagcatgcggcgctgctgtttgatgcgctgccgccgatcatcaacatccccaaagcctcgagccaggcgggcgttttgcgctggacgctcgaacagtggacgaacgagttgcgtcacccgcagctcggcggtgcgctgatgtcgacccacctggcgcacttgatgctggtgcaggtgtttcgccagttcctcgaaacggcccatgggctgccgaaaggttggtttctggcgctgaccgaccgccagatcagcctggctatcgccgccatgcacgccgagccggcgcgcaactggacgctggaagagctggcccgcatcgccggcatttcccgcaccgtattcgctcaacgtttcaaagggctggttggcagcaccgccatggaatacctctcgcgttggcgtatgctgcaggcggcagatcgtctgcgggccggtaaagaaaacgtcgcgtcgatcgcctactcgttgggatacggctcggaaagcgcgttcagcaccgccttcaaacgggtgatggcgcagtcgccgtcgcagtatcggcggcaaacgccggccggggcgagtgaaccggagggaaagggggcgcagcggccgtga

SEQ ID NO: 72787 - DNA, 171 bp, Glycine max
  Peptide Sequence Number=SeqID_189565
atggataagtggatggatacaattgacatgggatatgtgattgcatcgaggtataatatttatttaaaagaccattgtcctttaccgccggtagcactgttatggtctagcaattgtcatcctcaggacactataagacttgactacgtgacaggacactgtaagacttga

SEQ ID NO: 72788 - DNA, 867 bp, Glycine max
  Peptide Sequence Number=SeqID_189566
atgaacaatgaccataaagtgtggctgatcaccggcgcctcgtcgggcctgggcaaagccctggccgaagcggccatcgccaacggcgatcgggtggtggtgaccgcccgccgtctcgaccgcctgcgggcgctggctaagggccaggaggatcgcgtgctgcctttggcggtggacgtcacggatgccgccgcgcgcgataaggcggtcgccgataccctggcgcggttcggccgcatcgacgtgctggccaacctggccgggcgcggtgtagccggcgcctgcgaagagttcagcctcgaacagctgcgcgagcagatggagctgaatttctttgcggcggcggagatgacccgcgccgtgctgccgcagatgcggcgccagggcagcgggaacgtgatcaccgtaagcagcatcgccggtctggtggcaatgaacgccgccggcccctattgcgcggcgaaatttgccctcgaaggctggacggagtcgctggccatcgaggccaggccgctggggatccacgtgaccctggtcgagcccggcgccttccgcaccgaatttgccggcgacgtgaacatgcggccgacgcagcgcatcgaggcctaccgcccgtcgattgcaccgtttgaaacctacctggcgcagtccgccggccgacagatgggcgatcccgccaaagcggcgcagcgcatgctggagttggtcactctcacggccccgccggtgcgcctgatgctggggcgcgacgcttacgccatgtgggacaccaccctcgccaaacgccagcaggagcttaacgcctggcgcgaacggggtgaagacaccgcctttgatggcgcagaactcactgaaattcaactgtaa

SEQ ID NO: 72789 - DNA, 180 bp, Glycine max
  Peptide Sequence Number=SeqID_189567
atggcgcagtacctggtcgaacgggtcttgccaggcgtgcatcgccagatcgaaggtgccgttatggatcggcagcagccagcggccgagcaaatcccggtgcgcctgcacggtttgctgagggtgcatatgcacatagggccagcgtttgtcgtaggcgccggtttccatcagcgtcag

SEQ ID NO: 72790 - DNA, 342 bp, Glycine max
  Peptide Sequence Number=SeqID_189568
atggctccggatagaatacagctacagaacatgtacaaaaaggagcacgaatctttcaaggaatacgcccaaaaatggagggatctggcagcccaagtggcacccccaatgacggaaagggagatgataacaatgatagtggacatgttaccggttttctgctatgagaaaatggtgggttacacacctttaagctttgttgatttagtttttgccggcgaaaggatcaaaatgggtttgaaaagaggcaaatttgatcatcctgctttgacgtatgagaagactagggcaaataaagaggatgagaagggggaaggaactcatggttgtagaagcaaatga

SEQ ID NO: 72791 - DNA, 1356 bp, Glycine max
  Peptide Sequence Number=SeqID_189569
atgtctacctttatgtctgattctaccatcagtctgaatggcagtgactctgcaggcttgattgagcaatccatcatggattgggaggtcatctcaataggtggttcctcgtctgaggatactcgtcaaggtgcctccgatagcgagtccttttcttcggagaagggtgtagccttttgctgctgtcggggagcttgtcccgattactatgatactccccattctgcttccaagggtatgaggaaagccgtttctggctatgagtgggtgagggatgacattctaaaatgtaagtcctgtctgaccttggcagcgagtgtcgttgtgcttcaatgccaagtaaagctggcaaaccttgaggactcctataagctgaccgttcaggcttacgggaatgatgacctctcgttcttaatggcggcacctggtcgtctgcctttcttcttcatgtacaaatgtttgtttgaggtcctaggtgtcattctacccttgaccgcttttcagtgtgctctgcttgagcacttaaatgtggccccttcccaacttcacccaaacagactgctttttaaggttttggctattgatgtcgtggctgatggcatttcactgatgcttaacagggtcggggagctaccgcttcctattctactgggtcgacaaagccattttggagtagatgtcgatctcattggacgtgtgggccattttgtctctttctttggtgagcgatcctctcgctgccttggatggccacttgtgaagcaggttggacttgcaggtgggactgtgccaccatttgtttttgccccgtttgttggagaagggggtcaaccagctagagaggttagccctattgttgttgctgctgagagggatgatgttgttgggccgtctggccacaagaagtcaaaggcccctatgagtcttcctgctctgacgcaggctgcagggttgatgcccactgcggatcgccttttgactgcacaagatgtgcctccggctccaccgaccatcaaccatgcatattgttctactgtggcaccgctttccgccatcgcaacacctttattaagtgctggtgtggcggccactggtgctcttatggtgctgcctctttccacgtcggctccgatggcttctccctctgctatattggtggcaatggcgtcaccttcttcattttctcacgctcgcatctcccttgataatttgtacacctctagtgatgctcattcactgtggggtgagtttgacaattctagagaggaatggattgtgacgccaagagactgtgcaaaaggtggcatccttggaggcggaggtcgccaagtggacggctactacttgtactctttg

SEQ ID NO: 72792 - DNA, 237 bp, Glycine max
  Peptide Sequence Number=SeqID_189570
atgaagacttggatgcagagttcaaaacgcgatgtctaccttggagcctacctgaatgctgctttgaaaggacttgatgatactccacaacctaactccaaggctggtgctaggtggattgttgttaagtattttaacgatgttagaccattggaagcaaagagattaaaggcgcttcgcatccagtgggcacaattttatctcaaagttaggatgttaggaaacttaggatgttag

SEQ ID NO: 72793 - DNA, 703 bp, Glycine max
  Peptide Sequence Number=SeqID_189571
atgacttctgctggacctaccttctctttttctggaactccgactatcacgactgcgaaactaaactggaagaactatttgtcctggtctgattcagttgagctgtggttccttggccaaggatactacgatcacttgaaaaaaggtattgatactgttccaagtgacagaaaatctgagtgggagaagctggattatcagctatgtgctgtcttgtggcaatcagtcgaggcagatgttttggagatccttagatcgttcaaaacatgttgttctttttggaagaaggctcgagaaatctttgccaatgatattcagagtttgtttaatgcaactatgaaggtcacagccctcaaacaaaccagccacgacatgattgcacacataagtaaagctcgggctgcagtggaagagttgaagaggttccttgtggctgattcgctggaggaagtgaataaaaagccggataagttctatatggttcttatcttgaggagttttcattcagattttgatcatgtgcgtgatcaagttcttgctggagatcaagtaccatcgacggattctctcatcactaggctgcttcgggttccccatgcgttgaaagaagaaaactcagctgacacggtggaaacatcagccatgattgcaacccgtgggagaaggggaggtcgtaacagtaaaggaggtcgcagtgaaagag

SEQ ID NO: 72794 - DNA, 168 bp, Glycine max
  Peptide Sequence Number=SeqID_189572
atgttgatgcaatcctctaaaggaggggagccatcaccagagtcacggctaggagactccaagaagattgggccaggaatgcaggagaaggtagggtaccccacacgtttagggtatcctggtaatgtaggatttttcagtccttgtattttaggacacatagactaa

SEQ ID NO: 72795 - DNA, 210 bp, Glycine max
  Peptide Sequence Number=SeqID_189573
atgggtgccaagtacctcgaagaggtcaaacgagggtcgcatcccaacaatggatggtccccggatgaaattaggcaaaaaagggcacttggtggattgcagcttgcccaggcgagctgttgcttaatccagaagaaactggctcgcctaagcgagctggttccttcacccctaagcaatttgagggcccaagtgagccagggtccataa

SEQ ID NO: 72796 - DNA, 432 bp, Glycine max
  Peptide Sequence Number=SeqID_189574
atggaagaggtggaaacaaacgtacaagcctatgcccccaatataagggaggcattcttcttaaactggttttcatcaataaggattagatacctgggggacaattcgactctcatatctagcagcaaggaggacaacttgatggaagtaataaagaacaacaaagagtggttgggtcaatggtttgagtccttttcaacttggcaatcacatttgagctcagaaaacagactcattagggtaaggatctttggggcaccattaatgttatggaatgatcaaggtttttcaaagtttactgctctagtgggaaaactcatcaagatgactgatgaaatgaataatatggacaatttggagtttgtaaaggttctaataaggaccgcaataatatcaccgataatgttgttccgaaaattcagtgatgagtag

SEQ ID NO: 72797 - DNA, 916 bp, Glycine max
  Peptide Sequence Number=SeqID_189575
caagaatcgcgccgttcatgataatcaacaacagaatggccggccggaggcgaaagcgcaggcaccacaatacccagccgctcagaatcaggctggtcagcgtgccccacggactggtgacggtttcggtgatccagaacagcacgcgcaacagatgcccgctctcccccggttgccactgccagccggaaagccatacgcccagcggcatcagcacggccctggttcaggttatggcacaatatcggcagtttcgtcgggccagtcgggcccgtgcgttatcatgatgatagcgcatcctctgaaggttctggagagtcacatgcagctgaaacgggtagcagaagccaaactgcccacgccatggggagatttcctgatggttggttttgaagaactggcaaccggccacgaccacgtcgcgctggtttatggtgatattagcgatcacaatccggtgctggcgcgcgtccactccgaatgtctcaccggcgatgcgctgttcagcctgcgctgcgactgcggcttccagctggaggcagcgctgaccgccattgcggaagaaggacgcggcgtgctgctgtaccatcgtcaggaaggccgtaacatcgggctgctgaacaaaattcgcgcctatgcgttgcaggacaaaggctacgacacggtggaagcgaaccatcagctgggctttgccgccgatgagcgtgacttcaccctgtgcgccgacatgtttaaactgctgggcattaatgaagtgcgtttgctgaccaacaatccgcgcaaagtggagatcctgtcagaagcgggtatcaatatcgttgagcgcgtgccgctgatcgttggccgtaacccaaaaaatgcgcactatctcgatacgaaagccgagaagatgggacatctgctgccgaaatcgtaa

SEQ ID NO: 72798 - DNA, 276 bp, Glycine max
  Peptide Sequence Number=SeqID_189576
atggtcacgccctttcccattcccgtcactgcagctcaggtaggaacgtacttcataggacaatactatcaggtgcttcaaagccaacccgagttcatgcaccagttttactccgatgccagcaccatgctccgtatcgacggcaatgccagagaaactgcagcagcaatgcttgtttttgtttctgtcgtgtgctatgttgttgtgttggtcgttcgagtcgggggcaaattggtttccaaatacgcacgggatttgtttggcggtgttgtgtag

SEQ ID NO: 72799 - DNA, 369 bp, Glycine max
  Peptide Sequence Number=SeqID_189577
atggaagacattgtaaggatggaagatctttttaagaggtggactgagtatcttgatagccgacaatcaagggtcagtcactcaccaccgataaattgtgatttttgtggaggagagcattgtaatgacaattgtcatctctactccatgaataactcttggtggggacaagagttactcccttacaatcaatatgaagaagaaagaactcctaatcttgaaggtgtgtttgcggaattcatggcataccatgctagctctaaagccaatcaaaactcaatgcaaaatcaggaaattcatgttggcaagagctactctatagaaaattatcaatgggagcaagagttacaatttctacaatcattatga

SEQ ID NO: 72800 - DNA, 288 bp, Glycine max
  Peptide Sequence Number=SeqID_189578
atggcgaagggcacaaaaatggtgaagaagaagaagaggaagaggaggagggtggttttgatttggagtgcagctatgcaattgtatagaggaatccaaaacaataaggccaaagtgagacttcaggaactgagaaagaagctcaacagtgttagggaatctaagcaattagcaatagaagttgctgaagttgtgaacaataaggccaaacaacttgaacaggcactatcccaaaaagctataagatatgaagcatggaaacaagaactagagcatgaaagaaagtag

SEQ ID NO: 72801 - DNA, 315 bp, Glycine max
  Peptide Sequence Number=SeqID_189579
atgactaatgcaaactgtccgcaagaatcattgcattcagtctcaaatgggaatctaagggatttcaaagagaccataatctccatgaaagctgaagcagagatcaagcaacaagattataaggaagaagtggtagctgatcatgcatcaatcatgccaatgattgatctgttacctactgcttacagggatgctggcagtggaattgcactaaaaactcttaagcgtgtgcagaaagcctggggtcaaggaagtatatctagtttactgcctcagcagaatgattttcttgattactatgattgtagtggttaa

SEQ ID NO: 72802 - DNA, 231 bp, Glycine max
  Peptide Sequence Number=SeqID_189580
atggcacttccttatggagtagagagggatgcagtgctaggagaggaaagcaaagtaggcattggaagggtcattgacgagcgtgatgggaaggaggcagtgaatggcagagataagggttggggaggcacaaaaggtggaaagagggcacatgaggttgttgaaggggtctgtgtcgatgtaaatgttgaggaggttgggaggggtggaagagaagaatttgtcccataa

SEQ ID NO: 72803 - DNA, 300 bp, Glycine max
  Peptide Sequence Number=SeqID_189581
atggagattgttcctctgactggcagacctattgcggagaaaaaggcatctgtctatgctgaggctgctcttggtgttggtgttgggaatttgcaaagaatccgtgccttcctttggattcggttgagggattatggtgtactggattttgatgctggcaatgctcggcggctgcctcttgttgataccacatggcagcagctggcagagtggattaataaaggagggatggtacctgaagagattgcagctgccgcaacagaggaatgtgaaagaatgttgattgtcattacccattga

SEQ ID NO: 72804 - DNA, 639 bp, Glycine max
  Peptide Sequence Number=SeqID_189582
atgctgccctatcccagcggcaagctgcacatgggccacgtgcgcaactacaccatcaacgacatgatggcgcgccagttgcgcatgcggggctacaacgtgctaatgccgatgggctgggacgccttcggcatgcccgccgagaacgccgccatcaagtccaaggtgccgcccgccaagtggacctacgacaacatcgcctatatgaagaagcagatgaaggcgatgggcctggcgatcgactggtcgcgcgagatgtgcgcctgcgatcccgagtactacaaatggaaccagtggctgttcctgaagatgctcgaaaagggcgtcgcctaccgcaagacccaggtcgtgaactgggacccggtcgaccagaccgtgctggccaacgaacaggtcatcgacggccgcggctggcgctcgggcgccccggtcgaaaagcgcgagatcccgggttactacctgcgcatcaccgattactccgacgaactgctgggcgcggtgcagaacgacctgcccggctggcccgagcgcgtgcgcctgatgcaggaaaactggatcggcaagtccaagggcctgcgctttcgccttcccgcaccctatcatcggccaggacggccagttgatccaggacggcaagct

SEQ ID NO: 72805 - DNA, 546 bp, Glycine max
  Peptide Sequence Number=SeqID_189583
atgtgtctctttcacgcatccactcacgttcttcaacaatggtctctctcactagcaaaaaccctaagcgattttctatccttccctgatcccgcgaatgctctgccaactctccctcatccgcaatccccacattccactctccgcctaccaccacatcatcaacgtgtccctattgtgatggcatcaaatctgttggccgacgaggaaggagttgggccccccttggagctgctttgtaagacattgtatgcgtgggaggaggccgtgtccccactcttggccacagagagggagggtttggtcccgaaggactcgacggtgctggaaactcttggtgaatgtctcaacgatgtggcggaatggggggccagtaaggagagactgttggtgaagttgccagtccaggaccttctggctcgcttcgatgttacttgtacagcttttgttggggatgggaggctaggaggcatttctggaacaatatcagcttatgagagtccactgatgttgtggatgttgtttttgaggatcacgatcttctaa

SEQ ID NO: 72806 - DNA, 279 bp, Glycine max
  Peptide Sequence Number=SeqID_189584
atgaccctggaagactccctggcattgttctcagtgctgccacttctttttggcttcctgttcctcctaaatgagtctttgacttcctccgtgacgaaaactctaggaatgagtgcttttcaagatggagaagatggagacgaggatgaaaatgcacaagaggaggatgaagaagatattagtcatgatgattataatcaggtagcaagtgccatgaccacttttgtgtggatgaagatgaggctggagactacattacaagcccacttttgttattaa

SEQ ID NO: 72807 - DNA, 429 bp, Glycine max
  Peptide Sequence Number=SeqID_189585
atgctgaccctgcgtccctttgctcccgcggattacgccctgctttcgagctggttcaattgcctgtccgaagtggtgcaatggggagggtcgcatctctcgtacccgctggcacaggccgatctggatgccatgctgcgcgaaggacaggtccaaccgcccacccggcgttgctggatggcatgccgaggtgacacgccggtgggtcacgtgcaactggcgtacgactggcgcgacgtcaatgcccgcctgggccgtgtcgccatcgccccggccgaacgcggccagggactggccggcccgatggtgacgctgatgatcgacgaggccttttgcacgccaggcattgaacgcctggagctgaatgtttacatgttcaatcagcccgccatccgcacctaccataagttgggcttcacgttcgaaggc

SEQ ID NO: 72808 - DNA, 312 bp, Glycine max
  Peptide Sequence Number=SeqID_189586
atggcgggtgtcgattcaatcgacgataaagcgcagtttcaagacgccaaggtcgccataggccagttccaggtcgcggtttgcgggcacgtccagatagcccgcgtacgagccggtgatgacgtgctggcccgcggccagcgccaggccttgttcgcgcaggaaattggcgagccagtacattccggccttggcgtggccgttgggatggatgccgagatgctgctcgacttcggcgccatcaacggacatcgtgatggtcataccggatcgcgcggcgtccggagaggcgatactcgagcccagaactag

SEQ ID NO: 72809 - DNA, 399 bp, Glycine max
  Peptide Sequence Number=SeqID_189587
atggcatcaagaaagaggactagaaccaatgacatcccttcatcatccatcctagctcctcagtcagcaaccataggaccagatcttgaagctcaacttccgttggtgagaccaaatgaggctgctcctcctaagcttgcaccggcacgggttgaaccaatgccagctgagccacgatctctagtggtgaatccacctccttctcctgagcttgaagtagttcccccatctccacctcttattatcatctccgatgcatcatcagatgaaactattgcccctcctgattcaccagctggggaaacagctgatccccctaattcctcagttggaggaattgcctatctttctgattcatcatctggagaagttgttgctctcactgattccccagtttag

SEQ ID NO: 72810 - DNA, 1380 bp, Glycine max
  Peptide Sequence Number=SeqID_189588
atggtaaccattgtggcttcttacaatgtcactccaaatcaaccaactcccaaggatcctttatggctatccgatagtgacctaatcggcaacctaggtcacatatccgtcatctatatttacaaagctaaacacaacaccgacaccattgagaggttgaggaattcgcttagcaagattttggtctacttctatcccgtagctggcaggttgaacttgacaaaaagtggtcgaatagaagtggattgtaatgcaaaaggggtgagattgcttgaagctgaaaccacaaaaacatttggtgattatggagatttttcaccctccgagtccaccgaggaacttgttccaaaagttgataatactcaacccagagaggaaattcccctgctgctacttcaattaacaaggttccttggtggtgatgaaggccttgccattggagttactttcgctcatcctttgattgatgccaccggcctcattcacttcatcaatagttgggcaaagctggctcgaggagaagcactagagcctaatgaaatgccttttctcaatcgaacaatactcaaattccaacaccagccatcatcctcacaagtccttggttcgagtgaaaccgagttcgatccacataagcatgatctcgagaagcctatagcacaaacaccgttgggagtagagcgaaagaaggtaagtgcttcaatcttgaaactcacatcaagccacctggagaggctaaagaagaaggctaatgatcaaccttcaaaagaagggtcaagaccttataccagatttgaagttgttgctgctcatatatggagatgtgcatccaaggctcgtgaatctggtgagaaccacccaaccctagttacttttagtgttaattttcgcaatagattgaatcctcctctccctcagaattattttgggaatgctctggcaaaagtagtgacacccgaatgttatgagggagatatcatatcaaacccattaggttttgctgctcaaaagataagggaagcagctcaaatggttacggatgagtctataaggtcacaactacatgctagtttaggccaagggcaactgaatcacataagggcttttttcacgggacatgcacacagtattaatattccttttgatgtgaatcatagcattttcctcacaagctggatgaacatgccagtgtatgaatcagattttggttgggaaaagcctttgcattttggtatagtaagtcgggctcaagtagatagggcaaccattcttccaagccctgatggggatggtgttgttatcactatatttttccagacagcacttatggagcttttcttaaagttcttcttcgaggatatggataatatggagatatga

SEQ ID NO: 72811 - DNA, 468 bp, Glycine max
  Peptide Sequence Number=SeqID_189589
atgaggggggctgttacaaaaatgttcatgacccttaggctatgcatttcgactattttgggtaagaaaacacgtttccgcgaacaaaaatcgagtcgaagtgctttcgtaacgcttccgagacattcccgtgagcaaatttgtgaagattttcctccgttcttcgttcgttcttcattcttcaatccgctgtcgtcccttgtgacggatgcgtggggtgctaataccttccccgtgcgtaaaaataactcccggacctttcgcaaattaaagttcgtagactacacctttccggtttttccgacgtttttctcaaataaacgttggtggcgactctgcgcattttcctttcttggaagacgcacccgtgagccccgcgtcgccctcccgccgaagggtaggttacgacagttggcgatggttttcggagagttaggccaatcactcagtgtgcattccttaccatga

SEQ ID NO: 72812 - DNA, 306 bp, Glycine max
  Peptide Sequence Number=SeqID_189590
atgaaagattgtagaaatacaagtagtagggatgtctcctccacctctaagacctcacaatcactcacaaactcatctcaagctctcaagacggcttcctcttcaagctctgcgaacatgcacaactcatccttcttccagattcttcctcgtgctcatccgaggattgttgcgctcagcggatggctcgctaagccgacaggttggcatagcgagagggtgaaaatcagcactatacaaactcacctaattcacctgaaattgagagaaaaaatgattgttaaacacacaaaatggaagtactaa

SEQ ID NO: 72813 - DNA, 327 bp, Glycine max
  Peptide Sequence Number=SeqID_189591
atgcctattttcatggaccctagctcgcccaggctggcctttggctcacttgggccactaaatagcttcatgatgaagaaaccaacttgcttgggtgagctcattgcttcagtactaagtttcagcttgcctaggcgagctccagctcacctaggcgagctacaactaccccaaaggtttcaaggttcagaagtggagggaattgagagaactaagaaagaagaagaagaaagaagaggaaacaaagttgaggcactgccgaatcacgactatgatcaaactctatatcatttcttgttcggtgttcttcgtgtgaccatcggttag

SEQ ID NO: 72814 - DNA, 351 bp, Glycine max
  Peptide Sequence Number=SeqID_189592
atgaatgaactagtcaacattcccacatatggagaggctaaatggagggctaatggtgatgaaagagaagtggttgtggagagaaccaatgagacaaacagtgtcacagtcataatttcaagcatggttgagatggatattggtgtgaagccaattggacagaacttgcaccaaggtgtggaagcaatgctttccaagtttattttgatgatgccaaagactcaagtcaagaatcaagagtcaaacaagtttcaagaatcaaagagtcattcaatcaagaatcaagattcaagtgaagtttcaagagaagactcaagatatgcaagaacttcaagaaaagcatcaagataa

SEQ ID NO: 72815 - DNA, 336 bp, Glycine max
  Peptide Sequence Number=SeqID_189593
atggctcaatatatagccttcattagagcattcgagatgctacagacacacccaacaaggataacagatatgcactactcctataacagaattattctaccaagcctactaagtgataaccactccctcactgatcgaatgctgatagaggtagcccagctggcagtaagggatccaagaccatctaggtttaggggtttatttagagattctcttggtgcttggctcagtggtttgtatgggtttttcaattacaccactaatgtgaatttggaactacatgcaattctaaatggtctccctcttgcttggcagaaagagttgaaaaatttctaa

SEQ ID NO: 72816 - DNA, 303 bp, Glycine max
  Peptide Sequence Number=SeqID_189594
atggaaaaattccttgctacctatatggagaccgtagacaggtgtttcaatgatgctaagatggacaagagcagtgtgcatgatgttgtccttgttggtggctcttctaggattcccaaagtacaacagctattgcaagactttttccatggctgcattgttgtgtggaggcattacgaatgttccagacttgtgttgttggatgttgcaccactgtctctcggtgttttggtacaaggatatcttatgactgtagtgattcctaggaatactactattcccgtaaagaggacatgggtataa

SEQ ID NO: 72817 - DNA, 336 bp, Glycine max
  Peptide Sequence Number=SeqID_189595
atgacagtgtgtgccgaccttgttcgtggtgccaaggacaagcgcctcacggtgaagggacctgttaggatgccaactaaagtccttaacatcaccaccaggaaatccccatgtggtgaagcttttgataaatttaacacaacgcaccaacagttgccaaatattttgatttctggtctgcttaacatttcaaaactcacacttctgagagagccaaggagaagagaaagagggaggggatatgataactcacagttcacgatgataggtctggactcaggtgcgacagagactgcagaggccttcggagctgcaacgggcttcaattcgcgttag

SEQ ID NO: 72818 - DNA, 264 bp, Glycine max
  Peptide Sequence Number=SeqID_189596
atggccatagaagaccaacagatcagctttgatctgttccatgaagagaaagctttgactgaccaaaatgtttgtttgaagggtttaggtaagactttagagccccataagggaaatgcctataagaggggtgaagacccctcaattatgctggaaattgcgatgaacgcgcaaagcgcgccagttgcacttagccaattcatcgcaattgtcaattttttaaatttccagatgatcgggccaaggccaaccatgtcacgctaa

SEQ ID NO: 72819 - DNA, 318 bp, Glycine max
  Peptide Sequence Number=SeqID_189597
atgatgaaggaatgggtaacatgtaacataaggagatccaaaagtcaagacattcatgaaaatcatccaagcaacccaaccatggcttgtagtgagcttcaaaacaaggaaagggaaacaaggctcaaaagggctattgtcgcaacctacccttcggcaggagggcgacacgtgactcgtgttccacgaaagcaatacgcgcggagtcgccaccaacgtttatttgaggaaaacgtcggaaaaaccggaaaagacgcgatctacaaacttttaagtaaaaggttcgggagttgtatttacgcacggggaaggtattag

SEQ ID NO: 72820 - DNA, 636 bp, Glycine max
  Peptide Sequence Number=SeqID_189598
atggagaagctccgccagcgccatcgcgccgagaagaaacaacaacactccgccgccgacgcgctccgccccggcgcgtggcagtacaacgccctcatggatgaccttgagcgcggccccctccccatctccgcccttgctcctctatacagcgacgaagaagaagacgaagacgacgacgacgccatcgacgatcaatacgacaatgatggcgacgagggtttcattaacatcaagtcgaagagtattaactgtatcctcagcgagagacctgtgagaatgagaagcaacgacagagggtttttgagagagcacgttgttgttgttgaagaagaagaagaagaagaagaggaggaggaggtggaggaggaggaggagaatgagaatgaagacgacgatgttttggggttgtcgatggagatgagggttttcgcggagaggtttattgggatggagagtttgaagatggagatgatgaaggagacggagcggtgtaggttggagatggagaagaagcggatccagatgattctggaatcacaaaggaggatcgttgattccattggcatggttctaaattgtggttgtgattgtggtttcatcgcgatccttgacattgtgggaaaatgcggctga

SEQ ID NO: 72821 - DNA, 162 bp, Glycine max
  Peptide Sequence Number=SeqID_189599
atggatgatcagtgggtgaactgcacgcgccttacaaagctgcatagaggcactccagatctggtgttcgccaaaaaatatggtggcggccggtgtccagagatggcggttggcagcaaacaacaggcagagtgggatcaacccgctctgatgccaagttga

SEQ ID NO: 72822 - DNA, 363 bp, Glycine max
  Peptide Sequence Number=SeqID_189600
atgtggatgccagataatagaactctcaccctccgtatcagtctccctatacccctcattcattctatccccattccgtcaccgttacagttacaacctctgtccgtcctcatccccaacatgaagcgaggcgaacccaatcactttgttaaactggttcaaaatattcctaaacgagacactctacccccaacctttaaccccagcaaaaacgctgcaattcgttgctccacccctcgagataatagaacggaagtgatgtgtgatgctaaatcgaggagccaacgacgatgtcatcggtgctgcaaacgcgaacaacattgtctttgtgaatttggaactcaaggattttatacttgttaa

SEQ ID NO: 72823 - DNA, 309 bp, Glycine max
  Peptide Sequence Number=SeqID_189601
atgcctggacttagcagagatttagtggaacataggctacctatttgtgaaggaaagaaatcagtgaagcatgtaccaaggagatttgctcctaatgtcatgaaagctataaaagcagaaattgaaaggctattgaatgctaagttcactactagaaaaaatcttctttgtggtcaccctccttctcgctgccaccatccttctctgcctgcaccacctgcccttcttagatctaaacccccctctccgccatggatgttagctggtcctctgaccccaaccttatcaagatctcctgggacgaagtag

SEQ ID NO: 72824 - DNA, 966 bp, Glycine max
  Peptide Sequence Number=SeqID_189602
atggcttctaggaaacgtaaaagtattggttcaagacctacatcacagtatgacacaaggagattctcttccttaaatgattggaccagatacacagataatgtgctggggagaaacattttaccagagaggaaagtggacatatatcactctgagctagatgagtttaaggctaaattggagaggcgtaatttccataaacgcctcaccaatttagtcggtgggagaatagacctagctttggtgaaagaattctatgcaaatttatacagttatgaggaccatccaccaaagcagtccagagtcagaggtcatttggtgaagattgatgctgacagtctcaacacattcttggagacacctgtggtattagctgagggggagaccttacccgcttactccagataccgcaggttgcctacagactacatagagatagaggttaccttatgcatacctggccgagggttcatcttgaactcagagggccattttgggaagaattgggctgccttgatggcttctaggaaatgtaaaagtattggttcaagacccacagcgcagtatgacacaaggagattctcttccttagatgcttggaccagatacacagataatgtccaggggagaaacattttaccagagaggaaagtagagatatatcactctgagctagatgagtttaaggctgaattggagaggcgtaatttccataaacgcctcaccaatttagtcgatgggagcatagacctagctttggtgaaagaattctatgcaaatttatacagttatgaggaccatccaccaaagcagtccagagttagaggtcatttggtgaagattgatgctgacagtctcaacacattctgggagacacctgtggtattagctgaggaggagaccttacctgcatactccaaataccgcaggttgcctacagactacaaagagatagaggctgcctga

SEQ ID NO: 72825 - DNA, 264 bp, Glycine max
  Peptide Sequence Number=SeqID_189603
atgtgtgctaagctcatcagggttgcgcttagcggcaccatgaaattcagaaaattcactaagtatcggggcttagcgagccaggctcgctttgcccaatggttgccacaatcaaatgcgcttagcttaggtaggatgagtgtccatcctcacaagatgaactcgcttagcacgctaggcttagcgcacagaagcggcgcttggcgaattctacaggtcaaaaaacctgcaactctcactaagcctggctctaggtcggcttag

SEQ ID NO: 72826 - DNA, 264 bp, Glycine max
  Peptide Sequence Number=SeqID_189604
atggattgggtggtgctagagggtcacaggaagtaccgtggcggtggtgatcgacagtggtggtggaggatgatgagcccttgcacctctttgatgattctgccatttggtgaagtttctgaaaatttcaattggtgtggggcggcattagagagagagagaggggacatgagtgttctaaacttagagagagagaagttgtatttaaagatagggatggctggtaatcaattacatactattataatcgattacaagtgttaa

SEQ ID NO: 72827 - DNA, 423 bp, Glycine max
  Peptide Sequence Number=SeqID_189605
atgaattggcgtggagcggttgcggtgctcgtttatgccaccgtattgtggtacctcttcgagcctgtcggttacaatttcttgtccttcgtcatcaaagtttttgccaacaagttaccattgtacagcgaagcaaaattggcgttctttgtgtatctctggtatcctaaaacagaaaagaaaatcgacgataactgtctagagctcaaagttaaggctatagattttgtaggatttacttggcacggggctttgatttgcggccaaaaaggactcggtggaattctaaaccgtgttacttctcaggcaacactgcagcctcctactgatcaggtgcacatggacaaacaaggcagttgccgagaagttacactaatgaagcagattgtgcaatgtatacttttaggacacgtgcacctttag

SEQ ID NO: 72828 - DNA, 1944 bp, Glycine max
  Peptide Sequence Number=SeqID_189606
atggcttcttcttcacaggagacgcactcttggacgttgggaggacttattggtgcctttattgaccttgttttagcttatttcttgttgtgtggatccgcttttgctttctttgtgtccaaatggtttagattttttggactttgtttgccttgcccctgcaaagggagttttgggtttaggagtagccgtttctgtgtgcatagattgctgttcgaatggccttctaggaagatatgttccattcaagttatggcggttaagaggttcccttttgatctggtttgggttaagggtcattcatgcagtgccaatgataaagttgttacagagagaacacatgataatagggttgttgagttggaagatgaggcatcttgcagttcatgttcaggaccgtgtttgcttcccttcgttgattgggaaaacgtgtatgatgctaaggggaagagggtcatgagtatgaaacgaaggtctggagttcggtgccataggagggctagttatgattgtgcgaaagtttcttcagctgttccttcagaaaacctgcaatctgatgttgtcctcattccttgctcgccttgtgatggcagtataattagagataaaacaaatgcaggcatgagtcctacctcagggaaaggagttagtgtagatgatgccaaagatgaccaaactggccatgatttggatgaaaagacctgtcatagttatgatttcaatggatcaatggttgatagtccaggacacgacaaatgtttattgtcattggaacactacataaataatgtgtgtgacaatgtccagattgttggtaatgaagaggaccgtgtcaagatgttagaaaatgcacttgaagaagagaaagctgcctatgctgctctttaccttgagctagagaaggagagagctgcagctgctactgctgctgatgaaaccatggctatgatatcacgtctgcaggaggagaaggcgtcaatggaattggaaatgaggcaataccttaggattatagaagaaagagttgcttatgatgaagaagagatggatattctgcaagagatccttataagaagggaaagggagaaccactttttggaaaaggaacttgatacttacaggcagatggattcgaaaggaagtgaccaatcatatggcaaggcaaaggtgcaacatgatcaatggggacaaagacctccaattttggttggaacatatgaaaatcgaagcaccagatcatttgttaagaaagatgaaataaaagatatttcttcaaattatatggtttctcagacttacagcaatacgaaagacggactagatctggagaaaaacacagaacataaggatcaagtgcatgtcaacctgcatagctccttttatgatactgatccgaatgtttttgatgtccatgtcattaacgataacataaaactaagggaagagcaaaatgaaaagttaagtatctcttcattgagtactgttacaaatgaactcacaaatagatatcttgaatttggaggtcaaacagtacagagcagtgatgtattaagtaatcgccgaaggacagataagccagaaaatggtaatggtgttgatggccccaccagtcacttatctatgttctcaaactcaagatgcagaactttgtctttagattctggaagtgattcttcaagtgcagttgaaaatgaaaagttaaagattggcaatgagattgaaattcttggagaaaggttgaggatggtgaaacatgaaaaggaaaaattgtctttcttttcagagaacggagaaagtgaaaagggccagcttccttgcccccttcctcatctaagcttaaaatggttcactatgctgctgccatatgagacaaatgacaaagatttgcttaaatttgacacgactctgcaaatacaagttcagaatatggacagaacaaggtag

SEQ ID NO: 72829 - DNA, 186 bp, Glycine max
  Peptide Sequence Number=SeqID_189607
atggtagtgcaggtgaggatggtagggatcttaggcattgaaatcaatggaggtggcacgattgctgatgacaaaggaaccgttggacaatctcaaagctttggatttggtggaaaaaccgagaggaggaaggagatgaaagatgaagacgaggaaggagacaaaagacgaagacaaggaagatga

SEQ ID NO: 72830 - DNA, 139 bp, Glycine max
  Peptide Sequence Number=SeqID_189608
atgatgaatcaaaccagggtctttgaaggagtgaagggaaaggccaagatcctcagtacactagatattgtggtagagaatccaaataagcttaaagtagtggcacttgctgctggttgttactcttcttgcagaccag

SEQ ID NO: 72831 - DNA, 255 bp, Glycine max
  Peptide Sequence Number=SeqID_189609
atgaccactaagttgctctcagagggccgcacaaggccaaggggaagagatgctgcatcccatgctccagagcatccacagagggctggtctcctggctcaggtggccaggccaggagaccaaccttcttcttctggaaggggtggggcctctacaacccaggagcctgatattgaggagccaccagtaccagcaccaccagcagcagagaaggagactactccagatcagaaaatgtatatcatatcccggtga

SEQ ID NO: 72832 - DNA, 105 bp, Glycine max
  Peptide Sequence Number=SeqID_189610
gttgcaggatgtatcatctgtgggggaactcatgaatatggatgttgtatccctgttgaagaacaaaccactcataaagtcaattacatgggaaatcagccctga

SEQ ID NO: 72833 - DNA, 686 bp, Glycine max
  Peptide Sequence Number=SeqID_189611
atgggggagatgcatgaaattccccaccacaatctagccgacttcgagccttgcctcggatatgccactgaagggcaagcagtttggagggccctcaatttctcccccaaccacaacccttgcattccacagcggttattccaagtacccaatgtcgtcacccctctcaagttcaaggtcccggactttgacaagtacaagggaactacttgccccaagaaccatctaaagatgtattatcggaagatgggggcatacacaaaagatgagaaactactgatacatttctcccaagaaagtcttactgaggcagctgccacctggtatactaacttggaaccttcccgagtccattcttggaaggacctaatggttgtctttgttaggcagtatcagtacaattctaatatggcttcggataggatgcaactacagaacatgggtaaaaaggggtatgaatccttcaaagaatatgcccaaatgtggaaggatatggcagcccaagtggtgcccccaatgacggaaagggagatgataacaatgatagtagacacattaccagtgatcgaagtgagtctgaaaagaggcaaatttgatcatcctgctctgacgaatgagaaaactggggcaaatgaagaggatgagaatgagggagaaacccttgctatgactgtcattcctacacg

SEQ ID NO: 72834 - DNA, 216 bp, Glycine max
  Peptide Sequence Number=SeqID_189612
atgaaacacaaagttcatagagtgagaagtctggtcttggaagcaagatgtttgcaccggggcgagcaaccgttgccacatccagaagtgatgaaaacatcatcacttgatgatgattggccttgtgaaattgccatcttcccacaaggacttcttgattggaagaatgatggtcagagaaaggaatataacgggagcaagaacgtgaagaactga

SEQ ID NO: 72835 - DNA, 315 bp, Glycine max
  Peptide Sequence Number=SeqID_189613
atggcttttctggattggcaggcagctctacctcagataattgcgcatactgaagaggttttcttcaagaaaaccattgataatttgaggcatgctgcatatatatgctgtaaagagttaaaggataatccatacattatttgcccttataaaccagaagggtccatggctatgatggtaagactaaacctttcacttctggaggatattagcgatgatattgatttttgtttcaagcttgctaaggaggaatccgttatcattcttccaggtccaatagggagaaaaggaaattctaaaaacaaagaatgttga

SEQ ID NO: 72836 - DNA, 612 bp, Glycine max
  Peptide Sequence Number=SeqID_189614
atgtttctcttcacccgagtatttcatcttgctgcactccgcatccccttccttgaatgctccagcctcgaaaaactcctctgtgcctaccttcgctacatcgcccacgtcgccgcgacgatctcaaccctaaccctcatctatctgcaacgccagattcatggcaagacgacaggacaataccattttgaaccccgcgctgtaccgcgagcggctcttgaggacgttcaattctcgtggattcgtgaagttccgcaacctcacgaagatttcacggctgaacaggaacaagaagaggagagagacgaaggggcaagcacaggcgatgtttatatcacttgtggatgcacacaagccattgatgtgtcagtggcaatgcttgctcgccccggtgcaaacatcttgcttccaagaccaggcttcccactctatgaacttagtgcttcatttagaggggttgaagtgaggcattatgatctgcttccagagaaaggttgggaggttgatctagatgttgttgaagctcttgctgatcagaacactgttgctttggtgattataaatcctgggaatccttgtgggaatgtgtatagttaccatcatttggagaag

SEQ ID NO: 72837 - DNA, 1014 bp, Glycine max
  Peptide Sequence Number=SeqID_189615
atgactacaccaccgagctctcttcctcctcctgagtcagcacctttgttgtctacaccgaagaagactagaaaagcaacatggctcagattattggctaccatacccgtcgggatggagaaaccaatggttcatatggatcctaccactgggaaagttgatggtccccaaagaaagaaattatggacatatttgggaatcatcgctcgagacaatgtggatgttacatttgttaactggaaaaaagttcctacaactgaatttgatattccagaagcgtttgaccaaaggacgaagaagataatccttaagacggtaggaaagggatggaggcagtttaagtcagatttgaccttcaaatgggctctagcacaaggcaaggaggaggaggatgacactgtctatgagaagtatggtatcaccaaggaaaaattgatccaattttgtcagagccgtaaagacccttcatgggagaatgttagaaagaaggctcaagccatccaaaaactaaacattccacctcacgtgttgtctcgtggggttagcatagggcagttttgtcgcccatggatgtcagaatgtgctgacaactgccattgggtgactaaagcactctggtcatgtccatgctgttggagccggtgtgatgatcagacaatactttggacaagcttcaaaaatctctcgcatatttacgtcgatcactccctaagagttgcatcgattaacagaaaatattacggagtagctgacacagaaatcagtgacaagttggagcaatcgatcaatgaaaaagacccaaacacgggtgaattagacaaatttgggttgtatgttgatgacaatccctcttgcctgattgcccttggaaaagtttatgaggggtcgacaactgtccacaaagttcctttgggcaatgatcaagtgaaggttggtcttgaggaagttcgagatgctgatgctcatgtccctgtaccccattcaagaggttcaattagcatagcaatcccttaa

SEQ ID NO: 72838 - DNA, 210 bp, Glycine max
  Peptide Sequence Number=SeqID_189616
ggccctgggattctagctctgattacgggcgtctgtcgattctacggagtgcccgtcgcccccaacaagcctagggacagccagcaactggcggcagactcaccgccaccacctccagaatccacttcagctcatctacaaaggctagagcattgcctacgatacatggccgaccagcaggcacccaaccaccaggacaggtatgagcag

SEQ ID NO: 72839 - DNA, 495 bp, Glycine max
  Peptide Sequence Number=SeqID_189617
cggttcaatcggctggctgttcgagctgctaaggcccagcagcccctggtcgagccgctgcgcgctgtgtgcctgaatgcgcttgtcattcacccaggcacctttgccgcggcaggcgtggaaggtttcctgatgattaggatcgctgactacgccaatcaccggctgattgtcgcagacaatcgccagcgagacgcaccagttgtgcaggccgttaagaaagctgctggtgccgtcaatcggatcgatgacccagataaagcgcgcgccgctgacgtcaccgccgctctcttcacccagcaccgcatcgtcaggaaaacgctcatgaatcaggtgttttaccagcagctcaacgttgcgatccgcctcactgaccacatcctgcaaatccttcttgtgctccaccaccagctgatggcgctgctgataccacgccagcgcgcggctggcggcggttttcgccacctcacaggcatagtgataacgggcatctaa

SEQ ID NO: 72840 - DNA, 1104 bp, Glycine max
  Peptide Sequence Number=SeqID_189618
atggggagtaagaaaaaaaatggtggaaagggagagattgtggatggttccaagattatggagttagttggaaacgagaaagttttcagcaactttgtggaccataagtttgatgaattggataaagacagagatgggaaactctccatgaaggagcttgaacctgctgttgctgacattggtgctggtcttggtttgcctgctcaaggcactagtcctgattcagatcacatttattttgaggtcttgaatgagttcacccatggcaagcaagaaaaagtgagcaagactgagtttaaagaggttctctcagacattctgttgggcatggctgctggactaaagcgagaccctattgttatactccgcatggatggggaagatctccttgagtttgttaatggtccaagttatgaagcagaaatggcatccattttctctcagattgagtcccctagtggatcctttcgtgaacatgtaattgaagcttttgggagactcactgttgatcaaggaattcctccaacatcagattcttgggttttcaacaacattgtggatccagcactatctcaaggtggccctgctttggacaagcctgcttctcaagagacatttttggaagaatttaagaaagtcgcattgagcgtggttgattttcttaaagagaaacctgtcattgttgcccacagtgaaaacacatttgatggacgcggtgtcaagagacttttatccaacaagtttgaattagacaggacgttgaacttagctttagagaatctgccaaaagatcgcaatggaaaaatatcaaaggactatctgcgggtggcactagatctggtgtctccatctgctggtttacctccagttggtgcaattgaagagattgataaggtcattgttgaagcctttaagatggtgaatgcagaggacaccaagacagttaaagaagacgaatttaagaaaattttaactgaaatactgggtagtatcatgttgcagttagaaggcaatcccatatctgtttcttcaaattcagttgtgcatgagcctttaggctcatcttctacactcttgcagccatcttctagtgaaacagcataa

SEQ ID NO: 72841 - DNA, 579 bp, Glycine max
  Peptide Sequence Number=SeqID_189619
atgcctcatcatggtggatactttgttgggaatgtgagcccggctaggatggatttccggtggttttgcctgggcaattgcattgcaatcttgtcgtgcatggcaactcctgagcagtcaattgcaatcatggatctaattgaatcacgatgggacgaattaattggggagatgcctgtcaaagtttgttatccagcaattgaaagccatgaatggaggctagtaacaggatgtgaccctaaaaatactagatggagttaccacaacgggggatcctggcctgttctattatggcttctggctgcggcatcgatcaagactgggaggccccaaattgcaagacgtgcccttaacattgcagagagcaaattgctgaaggacaactggcccgaatactatgatggaacgacgggccgatatgttggaaagcaggcccgtaagttccagacctggtccattgctggttacttgtctgctaggatgatgctcgatgatccatcccatttaggtcttgttgctctcgaagaagacaaacacctccagcctttgctcaagagatcaacttcctccactttctga

SEQ ID NO: 72842 - DNA, 567 bp, Glycine max
  Peptide Sequence Number=SeqID_189620
atgattatgtatgtagctaaaaatattatggtgcagtcacagataaatggatttgccaaaggagctagtattggtgatgttttcattgtatcagattgtgcttttcatgacagaagaatacccatacctgtttttgatttgtatggagttggtgtacgtaaaacctttgaagcacccaaccttgtaaaggagcttaatctaaaggtgggtaaattgtctactggtgactctttagatatgacacagcaggatgaatcgtcaatcattgcaaacgatgccacagttaaagatatggagggagcagctattgcttatgtttctgaccttttgaaagttcctgcaatgtttgtaaaagctgttactgatatcattgatggtgacaaaccaactgcagaagaattcctgcaaaatctggcagctgtaactgctgcacttgatctggcagttgaacaagccctacttcatgggttctgttatttgtttgaaattcagacattaatcaaggacaatgtgctagtactgagctcaagcacaaacctgctagactttgacttaatggctggttaa

SEQ ID NO: 72843 - DNA, 2160 bp, Glycine max
  Peptide Sequence Number=SeqID_189621
atggcgaaggtgatcggaatcgcaacggattgctatgacccgttggatcctaatggaaacatttccgtaacttttgacatcctcgaacgtactacagataatggatatctggcaagggtgacccttgaaaactactatcaatatcggcatgtagagaaacccgggtggaaactaggatggacgtgggctaacaatgaagtgatatggtcaatgagtggtgccatagcaactgatagagggaattgttcatcttacagtggttctcagatgccacattcatgcaagaaagatcccaccatagttgatctctctctagatgtctcgcaaaacaggtcagagcattgttgccgtggtggtctcctctctgcctggtctattgatcctttcaatgccttctcttcatttgaacttgaagttcgcaacgtgggagataacaacccacttggacaagctcctaataatcttacattgatggccccaggtcctggttacacttgtagcccccttcttgacactgatctctctgtctcctcagattttgggggactaagacaagttcctgttctcagaacttggaagtcaacatgtgcatactccagtttcatagcaaacacaataccggtatgctgtgtttccctctcatcattttacaaccctgccatcacatcttgccgtaattgcagttgtggatgcagagaagcagataaaagtacagcatcttgcataaggcctagttccttgccacggtctaatggagacaacacaattgatgaaataatagaatgcaccgaccacatgtgcccagttcgagtccattggcatttcaagaacaactatatgaaccaatggagggtgaagcttacagtttctaactacaattacaacagaaactactcaaactggaacgtgctggttcaacatcctggtttcacccaaaaagcaagaacttacagcttcaacagcactagacttcctacccttgggctccaagactattacaacaatgagctagtgcattctgataagggtgttgtgggtcttgtgacaacagaaatactattggataaagatccaaattctttcacagtaagtaatggatgggcatttccgagaagaatatatttcaatggggagaactgcgaaatgcctttacctgacacgtttccaatgttacccaatggtagctccagtttaagagctacttactgtggtgttgaaggaaaatggacctttgcttttcatgtatttacattgattgaagtgtctatctatgcacaatggtgtagatttccgcaaggggctccttgggtccattatcatgggacattcaaagatctcaatataaacttgatttggactgggaatgatccaactttgggggttgatagtataggcacgataccatctgctcttgcaacatatgctgctattctagcattacaaccagacttgatcatcaatgcaggcaccgctggtggcttcaaggccaaaggagctagtattggtgatatttttgttgtatcggaatgtgcttttcatgacagaagaatacctatacctgtaagtgttattcctcttgactgcaatgaatggaataatcttttggtagtggtggtgttctcttattatgtatgtgataggggagaagtgggaaagagggtagaagttttgccgtcaacatcaatatgtgatgtcttgcagatttttgatctgtatggagtgggtcttcgtaaagcctttgaaacacccaaacttgtaaaggagcttaatctaaaggtggctaaattgtctactggtgactctttagacatgacacagcaggatggatcattaataattgcaaatgatgccacagttatagatatggagggagctgctattgcttatgttgccgacctactgaaagttcctgcaatttttataaaagccgtgactaataacgttgatgatgacaaagcaattgtagaagaattcctgcagaatttggcagctctaactgttgaacttggtctggcggtcgaacaagagttggaggcatcatcagaaactccattggtgactggtgcacaggatttccagggtattgtgtatccatggacagattcagattgggatgagaggggggcaataaaaaaatcatccaacaattatacatcttag

SEQ ID NO: 72844 - DNA, 453 bp, Glycine max
  Peptide Sequence Number=SeqID_189622
atgcaaaactcacccaccgttatcgctgctccgccaccgctccccctccccctccctccgccgccaggtagtggtgggacacttccgacgcgacggagggctcgccggaggagggttcccggtggcgatgaaggtccagcgaacggtggcggcgacgggaaggggaggacagtgatttggaagatggagttgggagctctgacgaagggtggcagcagtgggaaggggatgacgtttatttggccggcagggctccacggcggagggaaggggagcggtggcggagcaacgaagacgttgggtgagttttgcattgtgacagacaaagagaatggagggatggtggggtcgacggtcggaaatctagtcgaagatacgacaaaggagatcagaatcaaatgggtgggagggagggagggagggagggagagatggggacaaagggataaaatg

SEQ ID NO: 72845 - DNA, 318 bp, Glycine max
  Peptide Sequence Number=SeqID_189623
atgggctatggtagaagcagagcatcctctgttttggacggtttcactctaaaccccgtgccatacccggttatgctaatcttatcactgatcctgttattcctcggcatttcggggtggatgctgttagccacaccagtggtgcttatactcgtagttcgttggttatcgtcagtgtatacttcagaatggttcttctttaactccttgccattggagaggcgtaggagaactcaccacttcccatcagagggtagctcccctcggggtgttgctgcttgttctcgtgcttcttcattttcagtccacttttcttga

SEQ ID NO: 72846 - DNA, 888 bp, Glycine max
  Peptide Sequence Number=SeqID_189624
atgtctttgtttccgaccgataggtctcacaatgggagttttaagagcccagaagcactagttagtgtgtcagaaacggaggaatttgatttctcaaaagcattagataggccaagggctttgaatatagagagacaaagatcatgtgatgaaagatcaatgagtgaactatccataggcttttctccacgtcaattggccacaaaagttgatagttcatctcgcctgggagaccttcttgatcatctacattctcctctgccaaagtcaggtattaatactccaagatcagtgacattggatccacaaattccacctccattaacattagaagcttgggaagagctgagacgttccttggtatattttcgtggtcagccagttggtacaattgctgctttggataattctgatgagaaacttaattatgatcaggtatttataagagactttgtcccaagtgctttggcttttctgatgcatggggaaacagacattgttaaaaattttcttttaaagacccttcgccttcaatcatgggagaaaaagattgacagattccagctagcagaaggggtgatgcctgctagttttaaagtattccatgatccagttagaaatcatgagaccctgatagcagattttggtgaaagtgcaataggcagggttgctccagttgattctggattttggtggattatattgcttcgcgcatacacaaaggctacaggagacccttctttggctgaacggcctgaatgtcaaaagggtatgcgcttgatcctgagtttatgcctgtcagaggggtttgacacgtttccaactttactatgtgctgatggatgctgcatgattgatcgaagaatggtgagttttctgaaattttga

SEQ ID NO: 72847 - DNA, 961 bp, Glycine max
  Peptide Sequence Number=SeqID_189625
gttccgcggaggaaatgagaatgatgaaaaagtggtgaagtgtgtagagagcgttagagtgatagtgatggggattgcagagaactcaaagggtttggttcttgctgtggcatcgggtgtgttcataggagcaagcttcgtcctcaaaaagaaaggtcttaagcaggctgctacccacggcactcgcgcaggagttggcggctattcttatctactccagccactttggtgggctggcatgcttacaagtaaccaacttaactcattttcttcccaatttttaccttctttaaacgaactcaatattctcgcagtgcttattggtgaggttgcaaattttgtcgcttatatatatgctcctgcacttctcgttactccccttggtgcactaagtattattgtcagtgctgttttggctcacttcttgctcaaggaaaagcttcagaagatgggcattttgggatgcgtcttctgcattgtgggttcagttctcattgttattcatgcacctcaagagcatgctttaaattctgtccaagaaatatgggatctcgccactcaaccattatttctagtttatgtggcggcagcagtttcggtagttttagccttggttttgcattttgaacctcgctacggacagacaaatatgctggcactggatacattcaacacagcaattgtctctcccgtatattatgtcatgttcacaactctgaccattattgctagcgtgataatgtttaaggattggtctgatcagagtgcaggcagcatagcctctgagatatgtggatttgtaattgttctttctggaacaatcttattgcatgcgacaagagaacaagaacaatccaacaagcaagggtccttaacatggtacattggtgaggacttggtaaagagcatcgaagatggacacctgaacctgttacatggttcagattatgttgaaaagtga

SEQ ID NO: 72848 - DNA, 147 bp, Glycine max
  Peptide Sequence Number=SeqID_189626
atgaagacagacgagtttggacagacagccatatacaagtggaccaatgagagggatgaccggccaccaataatgactaatgaggacgatggctctccacattgtaaaagacaattgagtaatagagggttctggtattgttattaa

SEQ ID NO: 72849 - DNA, 102 bp, Glycine max
  Peptide Sequence Number=SeqID_189627
atgaaaagccagttgaaggctatgcctatgtgcgtggggcaggctgacacagacgatgtagaaggattagagaagatgatgacccgaacaaacaacatataa

SEQ ID NO: 72850 - DNA, 951 bp, Glycine max
  misc_feature (234)..(234): n is a, c, g, or t
  Peptide Sequence Number=SeqID_189628
atgaacgattccataatcctcaagaagcgccattgcatcactaacctgaaaaccctaacaccccacatcacctgcctcgccgtccaccgcaatctcctctacgccgcatccctcaacctcatcaacgtcttcgaactcacccattactcccacatcgactccttcaaccaaagcccctcctcaggcttcgtcaagtccatcaccttcaccaagtcaaaagtcttcaccggccancaagaccgcaagattcgctaccccgaaactacgttaccgtacgacgccacaagacgaggctctggatcaaacattctgacaaccgtttcgggtttggcggttaacgagaggtttatgtattcggtttcgtgggatagaagctttaaggtgtgggacttgctgagttaccggtgtttggagtccgttaaggcgcacgaggacgcgattaatgccgttgctgttaacggcgacggcactgtttacacggcgtccgcggatgggagcattaaggtttggaggagggacggcgaggcgaaacggcacaagttggtgagcaacatagggaggcagaagtcaacggtaaacgcacttgcgttggagggtggtggggcggggttgttttctggcggttgcgatggcgagatatgccggtgggagtgtgggaagaacggcatcgttgagatggagactctaaggggtcatggtggggccatattgtgtctgatccacgtggcggggttgttggcgagtgcgtcagcggatttaacggttaggatctggcaacgggagagagggagtactaatgggtatttttgcagggctgtgttggaagggcacgagaaaccggtgaagtcgttggtagcattttcggacgctgagggtgagagagactcaaacgccattgttacgctcttcagtggaagccttgacggggagattagggtgtgggagctgtaa

SEQ ID NO: 72851 - DNA, 687 bp, Glycine max
  Peptide Sequence Number=SeqID_189629
atgggcccgaaatctaccctaaggctcataagaaccctagggccttcccttgaatctctagcccaatttacttggagtcttctatccaatgcccttacgagagtactactcgtcctcgccttcagagggctgcacgccctccccttcaaaggactacacgtcctcccctttagaggactacacgtcctcacctttagaggactacacgtcctgacctttagagaactacacgtccttgccttcattgggctacacaccctccccttcaaagggcttcacgtcctcgccatcagaggactacacgtcctcaccttcagtggactacacatcctcaccttcaaagaactgcatgttctcccattcagaggactacacgccctcgccttcagagggctgcacgttcccaccttcagagggctgcacgtcctcgcctttagagggctacacattctcaccttcagaggactacacgccctcgccttcagagggctacacgccctccccttcagagggctacacgtgctcacctttagagggctacatgtcctcgccttcagaggactacacgtcctcgccttcagagggctacacgccctctccttcagagggctacacgcgctcacctttagagggctacatgtcctcgccttcagaggactacacatcctcgccttcagaggactacac

SEQ ID NO: 72852 - DNA, 306 bp, Glycine max
  Peptide Sequence Number=SeqID_189630
atggagcaatgcatgtcacaaccaatgaaggatatggactgtactgaatgggtttggtggataaccacattgtctacttacatatattgtagggaaagagaaattgaagcggtgatcaagtttgcaacttgtgatagcatgaatcaattatgtgagcttctgagtggcaaacaagtggatactccacatgaagcacttactatcattcacactatattgagggaccttgcaactcagtgcacccagccttacaaggcagattttgatcctcttagtcgtacttattggttgaatttgaagttttaa

SEQ ID NO: 72853 - DNA, 309 bp, Glycine max
  Peptide Sequence Number=SeqID_189631
atggcttcatcgtcgtgccgcgtcaaatcccggccaatagtcgccttcgccaccgctgaagctcgctcttcctggacggagcaactgagaccttcgtatctgaactcctcttacttttcgctttacgatatcctcggcatcccttccgacgcctctaaccaagaaatcaaggccgcgtaccagcgactggccagagtctaccaccccgacatggcggccatcgaccgaaaaaactcgtctgctgacgaattcatgaagtgtagaagcaaagcttccaagattattttgatgatgccaaaagatttttaa

SEQ ID NO: 72854 - DNA, 249 bp, Glycine max
  Peptide Sequence Number=SeqID_189632
atggtgcttcaactttcacttccagttgatagttcagagggcttgcttggagatgcaaatgacatggataatgtaattgcatatgtgaaagatcttgaaatcacaccagagaggattagacaatttttacctaaagttaattggaatctaatagcttcaatgtatgttggtggttgtaatggtgatgaatgtgaatcaagcttggagatgctctcaaattgtcatgtttattttgcctgtgcaacttaa

SEQ ID NO: 72855 - DNA, 987 bp, Glycine max
  Peptide Sequence Number=SeqID_189633
atggtattcgtggtgcctggcaaattggaaagcattggagaagatggaactagaattcctctatctgaaggggattcttgtggtgaagagcttttgacatggtatcttgaacattcttcagttagcacagcacaggttgctgactttggacttgcgaggttggcttatgctgccaatacccattcggaggaaaaactggaggaatctcagggaaccgctaaagattccgctatcgttgtcggaagacacgtgagtccgcttagagaggagcataagaggaaggagctagaggaaaagtttaacaatgtcgagaaggatgctgaagaaacgagagaatctgccaggcccaaagctcaagagcattcttctgatcttaggaagcacaaaactgctttcattgatcttgtgtcaaaccaaaggaagcttgaggcagaactcagtcatgcggttaagcaagtggaagctactagacaagaccttgcttctatgaacgagaagaaggaggagtcggatttgatggcacaaaaattgtctttggagatgaaaaaatttcacaaggatttggaacaaaaggataaaattttgtcagcaatgttgaggaagtctaagctggagactacagagaagcaaatgttgttgaaggaggttaagttatcaaaggctaggaggaagcaagctgagcaggagacacaaaggtggaaggttgttttagaaggaaaacatgaaagacgatccttaaaaagcatgttgcttaacttgagttcaaggatggatgttttccctggtagtagaggtgtgcagcatagttccacagggtcctcaaacattgcaaatgaaccagaccaacttttagcctttcctgatcattatttgcagcaaaccaatggagacttatgtaagattaatttcttcaaacttccattcttgccaatgctaagcattaggaagattgtgttagagctgaggcagaaaggtatgcaaccttga

SEQ ID NO: 72856 - DNA, 156 bp, Glycine max
  Peptide Sequence Number=SeqID_189634
atgtcagtcactttacggcggaaagaaagtgttgacagggcaagaggtgctgacagcttagaagctagagtctattttcacttatctcaagaaaattatacaagcattaccaatgagagttcagcagtgagtgctgatgataagagcaaaaattaa

SEQ ID NO: 72857 - DNA, 243 bp, Glycine max
  Peptide Sequence Number=SeqID_189635
atggcggttccaaagtcagaaaagatgcaaggggtttcaacgaagaacaacggtggtttgtggtggctaatggtggttgtgggtgatggagaaagagcttggaacattggaaatggttttggaagaaagaagaagaataaaatggcatttttcctaagctacttggactacaaggctcaaaatgcaccagtgagcaatgctcttggaacggatacatcgcgcatactccagatatctccttga

SEQ ID NO: 72858 - DNA, 306 bp, Glycine max
  Peptide Sequence Number=SeqID_189636
atgaccacagattcacctccaccccttatgttcccacggacccagtctccagtggagtcgccaactgtcgcaacctacccttcggtgggagggcgacgcggggctcacatgtgcgtcttccaagaaaggaaaatgtgtggagtcgccaccaacgtttatttgaggaaaacgctagaaaaaccagaaaaggaggtgagtttagttatcaaaatggtgttagtagttaaagtgttagcttctcaaagaagcctcttgagaaagcttctcaaagaagccatgaggaagcttctcgaggaagcctcttaa

SEQ ID NO: 72859 - DNA, 267 bp, Glycine max
  Peptide Sequence Number=SeqID_189637
atgaaacatggatcaattgacattgtgctgttggtgacccaagcgggggtagaagacgtggatgtcgcgggggaagggaggttgtggtggcggtggtgggagttgccggcaagaacgaggcgggagatgagggcacagaggaggagcagatcacagagtctgtgttccaaacagattcctattttagtaatatatcttccctgttttccagcatggcataaaatgaggtctgtagctatcatgaaatatgcttgcagcataatttga

SEQ ID NO: 72860 - DNA, 636 bp, Glycine max
  Peptide Sequence Number=SeqID_189638
atggatgttgaaggaagagccagcaagggaaagcctctcactctgaaccttgaacaaggtcaagaaaagggtacccaaaatgatgattatggtctcgcttctgctcatagcattgaccgagattcgtggcaacaagtagggttgatgctggtgacaagcttcaattgcgggtggatattaagtttttctaatctgtgtttgtggccattgggttggacttggggtatcatatgccttattgttgtgggattctacactgcctatgcaaactggctcttggcagcatttcatttcattgatgaccgcagattcattagatacagagatcttatgggatatgtttacggcaagagtatgtaccacctcacctgggttttccagtttttgacccttcttcttggaaatatgggtttcatcctcctcggaggcaaggcacttaaggcaataaactcagaatttagtgattcttccctgaggctccaatactacatagtcatcacaggagctgcttacttcttttattccttcttcttcccaacaatatctgcgatgagaaattggctgggagcttcagcgttgctcactttcacatatataatatttcttctaattgttttagttaaagatggtaattaa

SEQ ID NO: 72861 - DNA, 918 bp, Glycine max
  Peptide Sequence Number=SeqID_189639
atggctgaatcctgcctcctatctctcccttccctcttctacgccaaaaacaaaaccctttctctctcaattcccactaatcctctcaacctgcaattcccatgctcaaactcttcgctttttcccctcaccaccaagactacgcgccactcttctctcctcacattcgtggctcagacatctggttgggccaaagaaggggaggaggaagaagccgcgtgggagaaccaaggcgacactgcgtggggaactgaagaaggtggcgatgatatagaagatggcggcgaagggggtttcgctgaagaagaagctgaagaagttaagatcttcgttgggaacctgcctttcgacttcgacagcgagaaattggcctcgcttttcgaacaggctggcaccgttgaggttgctgaggttatatataatagggccactgaccggagtcgcgggttcggatttgttaccatgagtacaatcgaagagcttgagaaggctgtcaagatgttcagtggttatatttttgtgctccttaagtatgtgggcaagcaagaatacgattcccaagttaatgtgtatgaactaaatggaagagtgttgactgttaataaggctgctccaaaaggagcacagcctgaacgcccaccgcgcccaccacaatcctttagagtctatgttggcaacttgccatgggatgttgacaattctcggctggagcaaattttcagtgaacatggtaaggttgaggatgctcgggtggtctatgacagagagactggtcgatcacgtggttttggctttgtcacgatgtccagtgagactgatatgaatgatgcaattgctgcccttgatggtcagagtttggatgggagggcaatcagagtgaatgttgcagcccaaaggcctaaacctagctcgttttga

SEQ ID NO: 72862 - DNA, 1449 bp, Glycine max
  Peptide Sequence Number=SeqID_189640
atggagatggaacgcgtcttcgagtttcctcacactcacatggatcggcgcccgagaaagagagcgagattgggctgggacatccctgaggtccccaaggctcaggtaggattgttttgtggacaagatgttgggactatttcaagctttgctccttcaaggggtccctcagaaaataccactagttctctatttgttaagccagttgctcgaaatggttctcccccttggcgagatgatgacaaagatgggcattacatgtttgcgcttggagaaaatttaacttctcgctataagatacatagcaaaatgggtgaaggaacttttgggcaggtcttagaatgctgggatagagaaaggaaggaaatggttgccgtaaaaattgtccgtggtattaagaagtatcgagaagcagccatgatagaaattgaggtgttgcaacagcttggtaaacacgataaaggaggcaatcgttgtgtgcaaatacggaactggtttgactatcgtaatcatatctgtattgtgtttgagaaacttggaccaagcttatacgattttcttcggaaaaacaattatcgctcatttcccattgatcttgtccgtgagattggcagacaactattggaatgtatagcattcatgcatgacttgcgcatgattcatactgacctgaagcctgaaaacatactactagtttcaccagagtatgtcaaagttcctgactacaagagttcatctagatcaccaagttcctatttcaagagagttcccaaatcaagtgctataaaggttattgattttggcagcaccacttatgagcgagaagatcagaattacattgtatcaactcgtcattatagggctcctgaagttatccttggtatatatacatactgtaaatgctgtggaaagaatgcctgtctaactgtgttttgcatgttgacacatgacaatcatgagaagggctatatgcaagctaaagttgattttggcaatgatgttttaggacttggctggagctatccatgtgatatctggagtgtgggatgtatcttggttgagttatgcacgggcggagctttgtttcagactcacgaaaatttggagcatcttgccatgatggaaagggtacttggtccattaccacagcccatgttgaagagagtcgaccgacatgctgagaagtatgttagaaggggtagattggactggcctgagggtgcaacctcaagggagagtatcaaagctgtaatgaagcttcctaggcttcagttgacccttttccctcccaaatatatgcagaaccttgtaatgcagcatgtagatcattcagctggcgatctcatacatctcttgcaggggttacttagatatgacccctctgaaagacttacagccaaggaagctcttagacattccttctttatgagagatcaatttagaagataa

SEQ ID NO: 72863 - DNA, 288 bp, Glycine max
  Peptide Sequence Number=SeqID_189641
atggccagagagattttcaaaaaccgtgactcggttttttctggcaggccttcgttacacgctgcgaaccgtttaggatataacggttcaaccgtgagttttgcaccgtacggtgagtactggagggaaatgaggaagatcatgattctggagctgttgagtccgaaaagggttcaatcgtttcaagctgtgagacttgaagagagagagaaaaacatcgtaaagagatgttataagaatgtttgtaaattacgagaggggttccaggggatgccagatacatgctaa

SEQ ID NO: 72864 - DNA, 186 bp, Glycine max
  Peptide Sequence Number=SeqID_189642
atggtaagggtagaaattcctatcctgggtcaaggccgcacgctaagcgcgagatcagctcgctatgcgagacgtttgtctcttgccaggctcagtgcacgactggcgccaagcctaaatccacttactcgcgctaagtgcgaaggtggcgctaagcacgacgtcgtgatttcagagcctatttaa

SEQ ID NO: 72865 - DNA, 972 bp, Glycine max
  Peptide Sequence Number=SeqID_189643
atggctctcaaacaatggctgtacgagcaaatgaaagaaatggccttctctaccttttatctatctcttttcttcttcatcagcgtcctctacttgtttaacctcacaagaaaaaccaaatccaaaaccaatctgaatttgccaccatcaccaccaaaactaccactcataggcaatcttcatcagttaggctcactaccacatcgatctcttagagacttgtcactcaaacatggtgacatcatgttgttgcagttagggcagatgcagaatccaacggtggtggtttcatccgcagatgttgccatggaaataatgaaaacgcatgatatggccttttcgaaccgaccccaaaacactgctgcaaaagtcttgctctacggaggcattgacattgtttttggactctacggggaaaggtggagtcagaaaaggaaaatatgtgcccgtgaacttctgagcactaaaagggttcaatcatttcatcaaatcagaaaagaagaagttgccatattggtgaataagctacgtgaagtgagctccagtgaagagtgctacgtgaatctaagcgacatgcttatggcaacagcgaacgacgtcgtgtgtagatgtgttctcggacggaaataccctggtgtcaaagagttagcaagggatgttatggttcagcttacagcttttactgtgagagattacttccctttgatgggttggattgatgttctcactggaaaaattcaggaacataaggccacttttcgtgcattggatgctgtttttgatcaagcaattgcggagcatatgaaagaaaagatggaaggagagaaatccaaaaagaaagactttgtggatatcctactccaacttcaggagaataacatgcttagctatgagctcaccaaaaatgacctcaaatcacttctactgatctctcaagtctttgagccgcctctatacacaacaggatattaa

SEQ ID NO: 72866 - DNA, 101 bp, Glycine max
  Peptide Sequence Number=SeqID_189644
atgggattctattgttcctgtcttaaatcaaaggtgcttgggttgattggtgggacatggaggggagaggctgacggagagggtgacggcgccggagagaa

SEQ ID NO: 72867 - DNA, 1014 bp, Glycine max
  Peptide Sequence Number=SeqID_189645
atgtcgagcatcgtcaaggagatcctggcgagcccgatacaaatggcggaccaggtttcgaagcttgcggaagaggcccagaatttccgacaggaatgtctggaactgaaatccaaaactgagaagctggcgggcctcctccgccaggccgccaggaacagcaacgacctctacgagcgtcccacgcgccgcatcatcgacgacaccgaacaagtcctcgacaaggccctcgttctcgtcaccaaatgtcgcgccaacagcctcatcaagaagctcttcaccatcatccccgccacagccttccgcaagacctccatgcagctcgagaattccgtcggtgacgtccaatggctcctccgcgtctctgcctccgccgacgagcgcgacgacgagtacctcggcctccctcccatcgccgccaacgagcccatcctctgcctcatctgggaacaggtcgccattcttctctccggcgcttccttggacgaacgttccgacgctgccgcttccctcgtctccctcgctcgcgacaacgaccgttacgggaaactcatcatcgaagaaggaggcgtgccaccgctgttgaagcttctcaaggaaggaagaatggacggtcaggaaaacgctgccagagccatcgggttgcttgggaaagatcctgaaagcgtggaacacattgtcaatgctggtgtctgttccgtgtttgccaaggtcctcaaagaaggccacatgaaggttcaaacggttgttgcgtgggctatttctgaactcgccgcgaatcacccgaaatgccaggatcatttttctcagaacaatgccatacgcttgctggttagccatctggcgtttgagacaattcaagagcatagcaagtacgccattgcgaacaaacacaaatccattcactcggttttaatggcgagtaacacaacgagcgcgcaggaagaggaagatgataagcagatggtggctcacccgggggcgaatcagtcagccaatctgatgcacaacgtg

SEQ ID NO: 72868 - DNA, 1446 bp, Glycine max
  Peptide Sequence Number=SeqID_189646
atgtgcatgacataccaatcaaagtccaaggatggtgaagaaatagctttcgtgcaggcgaaatatctgttccctaatgagttaaaagttgatgaactagtcaatgtgctgaaggagaagaaaattggtgttgttgcacacttttacatggatcccgaggtccaaggcattttaactgctgctcaaaagcagtggccacatatccatttatctgattcactggtcatggcagattcagcagtcaaaatggcaaaagctggatgccaattcataacagttctaggtgtcgattttatgtcagaaaatgttggcgtgtataggatgtcaaataagcaaattggctgttctctggctgatgctgcagctactcctacttacatggaatatcttgcggctgcttctaggtctacttctttgcatgtcatatacattaacactaagttagagacaaaggcatatgctcatgagcttgtgcctacaataacctgtacttcatcaaatgttgtccagactatcctacaggcatttgctcaagttccagattttagcatattttatggacctgattcttacatgggtgcaaatatcaaagatttgttccaacaaatgacaaaaatgactgatgaagagattgctgcaatacatcctaagcacagtcaagactctattaggtcattactgcctcgacttcactattttcaggatggaacatgcattgttcaccatctatttggccatgaagttgtggagaagataaaagaaatgtactgtgatgcattccttactgcccaccttgaggtacctggagagatgttttctttggcaatggaagcaaagagaaggggaatgggtgtagtaggctccacccagaatattttggatttcataaaggataggattcaggaagctttggatagaaatatagatgaccatctccaatttattttaggaacagaatctgggatggtgacttcaattgtggcaacggtccgtagtttgttggagcctgcgaagtcctcttctcaaagagcaaaagttactgttgaaatagtctttccagtttcatcagactcaatctcaacaacaacctcaagtttatcctcaggtcttaattctgtcaaagtgggagatatcatacttcctgttgtgccaggaatagccagcggggagggttgttccattcatggtggctgtgcatcttgtccatacatgaagatgaattctcttagctcactcctgaaagttagccatcacctacccgatgaagaaaatatcctttcagcatacaaggcagagcgatttaagttgcaaacaccaaatggcaaatcagtggcagatgttggatgtgaacctattttgcacatgaggaacttccagagaagctcgttgatcagattcttcgtccccaacacagttgaagttcagtgtgataaacttgagaaataa

SEQ ID NO: 72869 - DNA, 876 bp, Glycine max
  Peptide Sequence Number=SeqID_189647
atgggtcttgaatcaattcaacaagaaccatgttcggcatcacacttgtcgtgtttaaactcccaagaagaagcaactccaattcatcagcaccggcaatcttcatcagccacgcacgttgccccctacagcgaggaggcagaaaagaaaggtctgttcgtaagcaccaagagtgtccgatcgtttcagttcattatagttgaagaagtggctgaaatgatcggtgtgattcacgaagcgtgtgctacaagttataagaagttggcctctgtgaatctgagtgagttgttgattgcactcacgaacaagacacgcctgatggtagtagaagctttggagaacttggaaggaagttgttgtgtgattgcacaacataaagaaaagatgaataaaagggaagatcatgaacaatctgatacgaaagacttcgtggatatactccttcaacttgaagaagctggtatgcttggctttgagctctcccatgataacctcaaagcaatgctagtggacatgtttataggggcaagtgacacaacttcaacaactttggaatggactatggcagagctcatgagacatcaaaatacaatggaaaaggtccaggaagaggtgagaagagtggtggggtataaagcagaagttgatgaaaatgatgtgaagcaaatgaattacttgaaatgtgtagtgaaagaaactttgaggttacacccacctgctcctctgttgcttcctcgagaaaatacctctgttgtgaaactgagagggtacgaaattcaagccaagacaaggctaatgttgaacgcttgggcaatccagagggaccctgaattttgtgacggaccagatgagttccttaaaaaaaaagggtattaa

SEQ ID NO: 72870 - DNA, 426 bp, Glycine max
  Peptide Sequence Number=SeqID_189648
atgggtccaaaaactaccctaaggctcatgagaaccttagggccttctcctacatctctgccccaatcttcttggagtcttctgtccaatgcctttggggggaaaaacttaaaattcttaagtgatacatttgaacagtatgagattctccaaaaacaacctcaagatgttgttacacttcatcaaaagatttactttctgagacaaactctatccaaatttgttggaagcactaagaaacttaacaaaatgttaagatacaacaaatgcccaactaacaaatttggaaatggatataaaggaaaaaagaatattcatgatgaagaaatcatagtatgctacttatgtggaaaggttggacacatgtcatctaattgtagacatctaccaactattggatcatccaatgcttttagaactaactag

SEQ ID NO: 72871 - DNA, 345 bp, Glycine max
  Peptide Sequence Number=SeqID_189649
atggctaggagcatgctcaatggcaactctacacctaaacacttatgggctgaaacatgtttcatccttaacattaaggacaacttgggaaaacttgattctaactttgataacggaacattacttgggtactctaaaacatccaaggcatacagagtttacaactctagaacctcaattgtggaagaagctatacatgtaggatttaaggacacaaagcctgatacaaaaatgttagagcttgatgaatcttttgtagatataagatgggacaaaggcattggaccactgatagaacaatctacaagaacaaatgcgtccaatcaaataataggacaaccttaa

SEQ ID NO: 72872 - DNA, 277 bp, Glycine max
  Peptide Sequence Number=SeqID_189650
gattggctctgagggctgggcacgggggtccccgtcccgacccgtcggctgtcggtggactgctcgagctgctttccgcgggcgagagcgggtcgtcgcgtgcccggtcgggggacggattgggaacggggcccttcggggcctctttcccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 72873 - DNA, 223 bp, Glycine max
  Peptide Sequence Number=SeqID_189651
ggaagatgaaggtcccacagcccaggtaccacaacatatggaggatgagtcatccaagactaccactccaaatcccttggtcagaaggaagaaggaagatgaagcacaagaagctgcagccacttctgagaaatctcttgaggccacttctgagccttcagaaccagtggcaaatacagcttcacctcagcaggcagcagacccttccactcctgaggattag

SEQ ID NO: 72874 - DNA, 225 bp, Glycine max
  Peptide Sequence Number=SeqID_189652
atggcaggaggatcatacgaggaagccattgcagcgttgaccaagcttatcagcgagaaagccgacctgagtggcgtcgccgccgcaaagatcaagcagttgacgtcggagctagaaaccgccaccgcaaacgggtcgacgccgtttaacccagacgagaggatccgaaccgggttcgcccacttcaagaacgagaaattccaaatttccaatttgcctgcgtag

SEQ ID NO: 72875 - DNA, 744 bp, Glycine max
  Peptide Sequence Number=SeqID_189653
gacaaggcattttacccaaaacccattagagtgttcttgaggaatgttgtgttgcgaaacaacaaagtgatagtatccatggttgtaggagtccaggtaaccttgtccaatgactccatttctaaggccactagataccttcatgaaggaaacacttatcatgagggatgggagaaggcttatgactcccatataaccagggctctgtacaaagacaatactgagaagactggtgcgtcctaccctgcttgtcgaactagagaaaagatagctcctcagaggttgaaagacctcaatgaaactgatgatgatgaagaggacaatgttatcaaggttgttgtagacaagctggttaaagctttagatgcctttgacgccaaaatcttatggattcagattgtgtgggttgacacattgaaagcctcctcatccggttatgatggaagtgacaattttcaacaccatgatttcattcaagtgttgaatctggttaggacgtatcatttcgatgatgcttatgcgtgcttcaccaaggatgctgacagccactccttctataatgttgatggagagagaaaagtgaatctcatgaagacagtacaaaatgaaggctttaatctcttctccttctctctaacacttggaaaccctatcagagcaaatcagaggaaaagcttgaggaatctcaggaaattgctagagatcctgctatcgctgtcagaatacacacatgagcctacttag

SEQ ID NO: 72876 - DNA, 897 bp, Glycine max
  Peptide Sequence Number=SeqID_189654
atggccataaagggagccatggtggaggaggagaaagccaacaacaagaagcaacaacaacaacagcagcagcagcagcagagtgggaataattcgcaaatgtcaattgcagggacgagtattaaggggagggaatatgaagacgcggggacaaaggcacagatgaaggccatggcagccagagccttatggcaactctcgaggggaaacttgacagtgtgtaggagcataacagagtcaagggctctcttgtgtttcgcggttctgttggaaaaaggaccagacgatgtgcaatcgtattcggcaatggcgttgatggaaatcactgcagtgtcggagcaacattcggagctgaggcgctctgctttcaagccaacttccccggcagccaaggcagtggtggatcaactcctaaaagtaatcgaaaaagaacaaccggacctgctcatagcttgcgtgagatcagtgggaaatttggcgaggacattcagagcaaccgaaacaagactcatagggccgttggtgaggcttctggacgaaagagaggcgcaggttagcatggaagcggccattgcgctcaataaatttgcttgtacggacaactaccttcatgagaatcactgcaacgccatcatagaggcagggggcgccaagcacttgattcaactcgtttactttggggagcaaatggttcagattccttccgtcacgctgctttgttacatagcgctgcacgtccccaaaagcgagactctggcgcaagaagaggtgctcattgttctcgaatggtgcaccaagcaggcacatctcatcgaggaaccctccatccaaccactcttaccagaggccaagagcaggctcgaactctatcaatcaagaggaagaggattccgctga

SEQ ID NO: 72877 - DNA, 141 bp, Glycine max
  Peptide Sequence Number=SeqID_189655
atgcaacctaaagtactaaacctcgatccatcattcttcagtcgcgttaagcatgttgaagctgcgcttagtgttggatgcacactgagcccaaatggtgagctgagcgcaactagcacttcaagacttagcctcttttaa

SEQ ID NO: 72878 - DNA, 1647 bp, Glycine max
  Peptide Sequence Number=SeqID_189656
atgaggcgaggatccgcaagtccaaagcaaaaaacaagatattggtacgtagtggggacgtttaaggatgggcccctatatgactccactgcctacactgagtgcaaagagaagccagaggaaccactttatggaggaggacttttcaagactgagcaacactctcgtcgtggcagcattgccaacaacagctatgtgccttcacttgttctgtataatctcactcagggcaccatttactctttttccgcatgggtgagagttaaagattcaagttcagctatgataaggaccactctggaaacggagaaagagacacatgattgcattgggacagtttcggccaagcatagatgctggtcatttctgaagggtggatttgttctgaattggccttcaaatttatccattatcttcttccagaacgctgatggtaaagatatcaatatagatgttgctagcccatcactccagccatttactaagcaacaatggagaatcaatcaacagtatataatcaacactcaaagaaagcgtgccgtcactattcatgtgtcagatagtaacggaaggagattggaaggagcttcgatctgtgtagagcaaatctcaaaagacttcccttttggatctgcaatagcaaagaccattcttggcaacgttccctaccagaattggtttgtgaagcggttcaacgcggcagtgtttgaaaatgagctcaaatggtacgccacagaacctgatcaaggcaaggtcaattacaccatttcagaccagatgctgcaatttgttagaacaaacaacatcatagcgagagggcacaacatattttgggaagaccctaaatacactcctccgtgggttcttaaccttacaggcacccagttacaatctgctgtgaattctcgaatacatagtctcatgagccaatacaaagatgagttcgtacactgggacgtcagcaatgaaatgctccattttgatttctacgaggaaaggcttggacctaatgccacattgcatttctttcagacagcacataaatcggatccattggcaactctgtttatgaatgacttcaatgttgtggaaacatgcagtgatgtaaaatccactgttgacgcctatatctcacgggtaagagaactgcaacgaaatggcatctttatggatggaattggcttggagggtcacttcacaatacccaatcctccccttatcagagccatcctagacaagttggcaacacttggccttcccatttggcttaccgaggtggatataagcaagacacttgatagagatgcacaggcaaattattcggaggaagtgctgagggaaggcttctcacatccctctgtgaatgggataatgctttggacggcattacatccaaatgggtgctaccaaatgtgcctgacagacaataatttcaagaacctcccagcaggtgatgcggtggacaaacttcttcaagagtggcaaacgggtcgtgtagagggagtctcagatgtgcacggttcctatagcttttatgggttcttaggagaatacagaattagtgtcaagtatggcaataacactacaaagtcaacattctccctctctcgaggtgatgaaactagacatttcactattacaatatga

SEQ ID NO: 72879 - DNA, 1392 bp, Glycine max
  Peptide Sequence Number=SeqID_189657
atggcatcggagaaagaggttgaaactgtaatagttgggaactacgaggaaatggaaagcgaagggaagcctagggatgcaaaatccaggttattaagtttgttgtggcatggtggttctgtttatgatgcttggtttaactgtgcttccaaccaggtggctcaagttctgctaacgttgccatactcattttcccagctgggaatgctttctggcactctttttcaactcttctacggcttgctgggtggctggactgcttaccttattagcgcactctacgttgaatacagaaccagaaaagagagagagaaatttaatttcaggaaccacgtcatccagtggtttgaggttcttgatgggctcctcgggaagcactggagaaacgtgggcttggccttcaactgcacatttcttctatttggatctgttatccaactcatagcttgtgcaagcaacatatattacataaatgataatttggataagaggagttggacttacatctttggagcatgctgtgccaccactgtatttatcccttccttccacaactacagaatctggtcctttcttggcctcctcatgaccacttacactgcttggtacctcactgttgcctctctccttcacggccagggggttaagcattcgggtccgaccaaattggttctatattttacgggggccacaaacattctctacacatttgggggacatgccgttactgtggagataatgcacgcgatgtggaaacctcaaaaattcaaggccatatacttacttgctaccctgtatgtgatgacattgactcttccatcggcagctgcagtatactgggcatttggagacatgcttctaaatcactccaatgctttttctctccttccaaggtcacccttccgtgacatggctgtcattttaatgctcatccaccagaaagcaatagggatacacgagtgtaggagcctgtgcaagcgtgctttggcgagattgccggtggtgatcccgatatggtttttggccatagttttccccttctttggtcccatcaactccaccgttggatctctacttgtcagcttcaccgtttacatcatccccgccctcgcccacatgttcaccttcaaatcaccctctgcccgacagaatgcggtggagcaacctccgaggttggtgggaagatgggtgggtgcgtacacgatcaacttattcgtggtggtgtgggttctggtggtaggctttggattcggaggatgggcaagtatggtcaacttcattcaccagattgacacattcggtttcttcacaaaatgttaccagtgccccacacccacttccgtggagccaccacacctgaacgccaccgcgctctcccctcgtgctcactga

SEQ ID NO: 72880 - DNA, 363 bp, Glycine max
  Peptide Sequence Number=SeqID_189658
atgaaaattttagagctttgtgcacagggcggagatattgttcatcatgatggtagaggatacgaatctatttatggtggcacctttcctgatgagaatttcaagataaaacattcacatgctggtgtagtctctatggtgaattcaggtcccgattacaatggctcacagttttttattaccacagtgaagaccggttggttagatggagaacatggtgtgtttggcaaggttgtccaaggcatggattctgtgtttgcaattgaaggaggtgctggaacctacaatgggaaacccagaaagaaggtagtgattgcagactctggagagatacccaagagtcagtgggataaggaaagatga

SEQ ID NO: 72881 - DNA, 291 bp, Glycine max
  Peptide Sequence Number=SeqID_189659
atggctatgccaggttccctttacatatggtccattgtggttggcatatgctatgcggtgccgcttgccattactctgccaactgcctcggagttatttggcctcaaatattatggtcttatatacaacattctcatttttaaccttccctttggttctttcctcttttctggtctccttgctggcattctctatgatttggaggcaactaccaccgcaggaggaggcgacacttgtgttggagctcattgttacagactagtattcataatcatggctgcagcttgtgtt

SEQ ID NO: 72882 - DNA, 840 bp, Glycine max
  Peptide Sequence Number=SeqID_189660
atggcttgtgtttacccaggacagcttctcttgttgtgtctgatactgagcgtggttccaatagcagtttccgcaggcaatgacgcagcacccctgaccaaccatgggggacgcttgctgactggaaagttgaacgttggcatcttatggtccctgaacatgaacacccctgcccctgatgctgctaagcaaccccaagtctcatcatggtggaacattgtggagagctatggagctgcatctggcaataataataatatcccggtgaaggtggtaaaccaagttttcgatccaaactactcttatgggaaagtcttgatcaaagatttcattaagcccctccttcctaaggccactggtggaaacaaaaataccctcgctctcatcatagcctccaagggcgtgacagtgcaagatatgtgtgccggatcatgcgcccaacacggtcttattgaaaaccaaccttatgttgcagtggggaacccagaggaggagtgtcccgcatgtgcatggccattcctgccgagcaagggcaagacaggtgcaataatgaaaccgccaaacgggaatgttggagcagatgccatggtcaagttgttggctggtggtttggccggagcagtcaccaacccattcggagatggcttcttcgcaaatgcacacggaggcgatatcttggaagcaactagcaagtgtcctgatgatctttttgcaacaaccaaggtatccgtggatcttaaaactggtggagcctttaatgctgttggtgacaagggtaccaagttcttgctccctgctatttggaacccaaaaacttcttcctgctggactcccctgtaa

SEQ ID NO: 72883 - DNA, 357 bp, Glycine max
  Peptide Sequence Number=SeqID_189661
atggcgatggctttcaagatggcgacgactggaatgtgggttacagatgagtgcaagaactcgttcatggatatgaaatggaagaaggagcacagatacattgttttcaagatcgacgaaggatcaaggctcgtcaccgttgataaactcggtggccccaccgagggctatgatgatctcaccgcctccttgcccaccgatgattgccgatacgcggcatcaaggattagagctaagattctatacgcaacttcgaaggatgggctgagaagagcgctggatggaatcagctatgaactccaggccaccgatccaacggagatgggattcgatgtaattagagacatagccaaatag

SEQ ID NO: 72884 - DNA, 654 bp, Glycine max
  Peptide Sequence Number=SeqID_189662
atgagggggtcgggggagggcatattgttggagagcataggatgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccacagcctccttggcaacaagtattgaccctgccactcacaggcctctcaacgattcttctcatcaagaacctgctgctgtctctgcccctcctaaacatcaagagtcctttcaccatgaacgctgccctgacttgaaccttgagctaaccattagtcctccccatcatcctcaacctgatcatccgcacttgaagacccttgtgacaaactcaaacctttgctttccctgcagtctgggtttgcataatagcaaagattgtagctgtgccctccacactagtactgccaacgctactgctactggctatgatttcttggccttgaaaaccaccgtcgttttggattacagaaccttgcacatgaaatga

SEQ ID NO: 72885 - DNA, 1611 bp, Glycine max
  Peptide Sequence Number=SeqID_189663
atgggtttctttggcaccatatttggtttttttggctttggaattgggatttctattggtttcgttattggctattttctctttatatatgttcaacccactgatgttaaggatcctgaaattcaaccattggcggaggaagactcggaaactttacagagaatgattcctgagataccactttggataaaaaatccagactttgatcgggttgattggcttaacaagcttatcgaatatatgtggccataccttgataaggcaatatgcaaaactgcaaagaatattgcaaaaccaataattgacgagcaaataccgaaatataagattgattctgttgagtttgaagagttcacactaggatctttgccgccaacttttcaaggaatgaaagtttatgagactgatgaaaaagagttaattatggagccttctataaaatgggcgggaaatcctaatgttattgttgctgttaagaaatttgggctgaaagcaatcattcaggtgatggatttgcaagcttttcttgcacctcgtattactttgaaacctttggttccaagttttccatgttttgcaaatatctatgtgtctctcatggaaaagccacatgttgactttggactaaagcttgtaggggttgatcttatgtctattcctggcttctacaagtttgttcaggagtttattaaagatcaagttgcaaatatgtatttatggcctaaaaccttggaagttcaagttatagacccaacaaaagccttgaagaggccggttggaattttaaatgcaaagattttaaaagcgatgaagttaaagaagaaagatcttcttggtgcatctgacccttatgtgaagctaaacttgaccgaggataagttgacgtcaaaaaagactactgtgaagcataaaaacttgaatcctgaatggaatgaggagtttagtttggttgttaaagatcctgagtctcaagctttagagctttatgtctatgattgggagcaggttgggaagcatgacaagatgggtatgaatatggttcctttgaaagaacttttgcctgaagagcctaaagtttttactcttgacctcctaaaaaacatggatcctaatgatgcccaaaatgagaagtctcgtggacaaattgttttggaattgacgtataaaccttttagagaggaagacttagcaggttttgatgaaacacaaccaatacaaaaagctcctgaaggcactccacctggtggtggtctacttgtagtcataatccatgaagctcaagacatagagggaaagtaccatactaatccacatgtacgtcttattttcaggggagaggaaaaaaggactaaggtcatgaagaagaacagagatccaaggtgggaagaagagttccaatttctggtggaagagccccccactaatgacaaattacatgtagaggttgttagcacttcatcacgaaaccttctacgtcaaaaggaatcattgggctatgctgacatcagtcttgcagatgttgttgccaacaatagaattaatgagagacaccatcttattgactccaagaatggtcgcattcaaatagagctacaatggagagcttcataa

SEQ ID NO: 72886 - DNA, 1863 bp, Glycine max
  Peptide Sequence Number=SeqID_189664
atggagcgaaggttgggcagagaaaccaaaggctctctaagcctacaaaaaaagatggcagagacacggctcagggaaaaacctgcgccggacctcacggacttcatgaacgacatgtttttcggggcagcagacatggatcacaaaacctacgacctcacaggtagcacaggtgtggcggtggacgacgacgacgactacgacgaggaagggttcgacgacagcactagaagcaacagtgcaaggttgacacaagaatggttacaagaggcacggcgaatcgtggcttcctctccttcacgctgtgattctcctgctcgctctttagggtccccaaggttcggagctacacaaccaccctcaccccttccttcctcctcggaccgaagagacgccctctctagaactagatctgcccgaagatacagagcagtggaagggatcagtgatgagatactgtcgaaaacagcaaaacacactcgcaacaaatcagacactttcactcagccttcatcagatggggatggatcccctgcaacggcgctgcacaactggttcgccaacattctcaaaccgacctatagcaataacaataacacacaacaaccacctccttctcctcctgattctcctaaaccttctctccctccacgtcagcatcatcctcgaaagtcccgcttcaaaaccgagccctctgctgcacctcacccgcaggggatccatcctcccaattcgagacgaaccttcaagacttctacgccgccgccggagaatcctccgtcggattctgctcctctttcgccgccgaggaacctcgtggaatccgctcagcggagaacgatatcgtcttccacgtgctcgcaggagaggatcgcgccaaggcatgttcttgcaaagggagaggaagcgagcctcaacggcttcctcaaagagcagaggattttgttgaagaaaatctcgagcggagagttacatgcaaatgcgcaaatcgtgctttctgggccttccaacagcacggcgtcgatggtggctgccatttgccacgcgtggctcttgggttataggcagaaggagaaggagggtggaagcgagcgcgcagtggtggtgcctgtgatgaatgtgatgcgaggctccatgtggaagctgaagcaggctgcgtggctctttcaccatgctgctcttgatgccaatgcattgcttttcaccgatgaggtggacatggaaagccttttgatgactggccaactgagcgtcctcgtggttggacaagatgtcttaaacactactggcgaggttggatcccaatgcacagttgttactgataattactgtgaggatgcctatgatttactacaaaactctgcgctaaagaaactactgcttgctggtattctgttagacacacagaatctaaaagcatctgcagcaatatcaatgacaagggatgcagaggcagtccagttgttattggttggctcagccccaaattacagatatgctttatttgatcaattgatgcaagaccaaaaaaccgcttcttttgtcgaagctttgaaccataactacgggaggcctccggttgaaagtgaacaaaacagtgaaggaaatacgaagcataaagttcgtgagagaaagtcaagctctaaatctgaccgtgaacccatcatatcaaattcaaagacaaattccttcgacacaaaaagttctaaagctagcaaggtttcgccaaatccagtcaaacttgttacgccacctttgctatctccttctccagcaccagcaccacaacatgcagaaaaggaggtccctcgtgggaaaaacaagtttttcttgacaaggtggcttggttttggttcaaaatga

SEQ ID NO: 72887 - DNA, 3550 bp, Glycine max
  Peptide Sequence Number=SeqID_189665
atgctctccattggcactgaagattcattaagtacattttcggttgattcatttgttcctgtgctagtgggcttgcttaatcatgagagcaatcccgatgtcatgcttcttgcggccagggcgctaacccatttatgtgatgtgcttccttcatcctgtgctgctgttgtgcattatggtgcagtctctatcttctgtgcgaggctgcttaccatagagtatatggacttggctgagcagtctcttcaagcactaaagaagatttctcaggagcacccaactgcctgtcttcgagctggagctctgatggctgttctttcttacttggacttcttctcgacaggagttcagcgggtggcattgtctactgctgcaaatatgtgcaagaagcttcctcctgatgcagctgactttgtgatggaagctgttccacttttgacaaacctccttcagtaccacgactccaaggtcctggaacatgcctctgtttgtttgacacgaatagctaaagcgtttgcatcatctccagacaaattagatgaattgtgcaatcatggactggtaacacaagctgcctctctcatttctaccagcggttctggaggtgggcaggcttctctcagcaccccaacatatactggtttgatccgccttctttccacatgtgcaagtgggtctcctcttggagctaaaacgttgcttctccatggagctagtggcatacttaaagatatactatccggttccggtgtttcttctaacacctctgtttcgcctgcattgagtaggccagcggatcagatatttgagattgtgaacctggcaaatgaacttctgcctccattgcctcaaggaaccatttctcttcctgtcagctccaacttgtttgtgaaagagtctgttgtgaaaaaatctcctccttctgggaatcccgggatacaagaagacacaaatggaaatgttcatgaaatatcagctcgtgcaaaattattaaatgataagcctgagttacttaagcaatttgggatggatctcctcccagttttaatgcagatatatggtgctagcgtcaatggtccagttcggcacaaatgtctttctgtcattggaaaattgatgtatttcagcacagctgagatgatccagtctttgttgagtgtaacaaatatatcaagtttcttagctggtgtgttagcatggaaagatccacatgttttggttcctgccttgcaaatttcagaaattcttatggaaaagcttcctggaattttctctaaaatgtttgtcagagaaggtgtggttcatgcagttgaccaacttattttggctggaaatgcaactaatatatctacacaaacatcatctgctgagaaggatactgattctgtatctggaacttcatctcgctctagacgctatcgcctgcgcagtggtaattcaaatcccgatgcgaaccgttcggatgatttgaagagtccagttccagtaaatgttggtttgccaccaagttctgtggaaactccaacaactaattctagtatccgtgcatccattagctcagttgctaatgcttttaaagacaagtactttccttctgatcctgggtctgttgaagtgggtgttagtgatgatcttttgcatctgaaaaatctatgctcgaagttgaacactggtgttgatgaccaaagaagtaaggccaagggaaaagttgaagcttctggatttgatctggatgatgattctactaacacagaagagtatttgattggggtgatatctgacatgctaaaggaacttggcaaaggagatagtgtatctacttttgaatttatcggtagtggtgttgttgaagccttgctaaattatttttcttgtgggtatttctctaaagatcgaatatcagaaaccaatctccccaagcttcgccaacaggcacttacaaggttcaagtcatttgttgctgttgcattacctttgagcattgacaatggggctgttgctcctatgactgtcttggttcagaagcttcaaaatgtgttgtcctccttggagcgtttccctgtaatgctgagtaattcatctcggtcatctagtggaagtggacgtctctcctctgggctaagtgcattatctcagcccataaaattacgtttctgtcgagcccagggtgaaaagtcacttaaggattattcatccagtgtggtactgattgatccgttagcaagtctagcagccatcgaggaatttctatgggctcgtgtccagcgtggtgaatctggtctaaagtctactgtaggcactgaaaattctgaatctggaacaactcctgcaggggctggtgtttcatctccttcctcttatattccctccactgcctttcgttattcaaccggatccagatccagatcatctgttaatataggagatacacctagaaaagaaatatttcaagacaatggcacgagctcatctaagagcaagggtaaagctgtattaaaacctgcgcaggaggaagcacggggaccccaaacaaggaatgcagtgcgcagaagagcagctctagataaagacgctcaaatgaaacctgcaaatggcgactcaacttctgaggatgaagaattggatatatctcctgttgaaattgatgaggctttggtgattgaagatgatgatatttctgatgatgaggatgaagaccgtgaagatgtacggagggattattatcttcctgtctacttgcctgacgaagtgcatgatgtgaaattgggtgactcagctgaggagagtactgttgctcctgcaacaagtgatagccagactaatgcagcttcaggttctagcagcaaagcgggtacagccaggggttgtgactctgctgattttaggagtgggtattcatctagctcaaggggtgcaatgtcatttgctgctgctgctatggctggacttggatatgctaatagcagaggtttcaggggtggcagagataggcatgggcgcctgttgtttggtagttctaatgatcctccaaagttgatttttactgctggtgggaagcatcttaataggaatttgactatatatcaggcaattcaaagacagctcatgctagatgaagatgatgatgagagacttgctggcagtgaccgtgtatctagtgatggaagcagcctgtggggtgatatttacaccatcacttatcaaagggcagaaaaccagccagataaggcatccaatggtggatcaagttcaaatacttcaaaatctgccaaatctgggtctgcattaaattccagctcagaagctaaattgcatcagacatctgttctagacagtatattgcagggagacttgccatgtgatctagagaaatctaatcctacctacaatattttggcactcctgcgtgtgctggagggtttgaaccagcttgcgcctcatttgaggacccaaatggtttctgatagcttcgccaagggaaaaatcttggatttagatgagctaggtgttacaactggtgctagggtgcttccagaggaatttgtgagtg

SEQ ID NO: 72888 - DNA, 627 bp, Glycine max
  Peptide Sequence Number=SeqID_189666
atgaaggaattcaattgtatggcttcagagtcagataataattcagtgatccattacacagatgtagataatgatggccgatgtgatttccgatgtccattttgtgattttgaaattgaagttcctgtgctctgcagcaatttcgaagaggagcattgctctgccctaaaaaatgtggtttgtcccgtatgtgaagaaaatatagggaaggatgcaatcatgcaatttacacattcaagctctcgaaggtgggcgtggaagcctgagaaatctagcatctggcctggtaactcagcaatgcttggcaagaagctggccaccaggggaaacaaacaagaatcaataactgatccacttttgtcaccatttatctgcaacgtgccttttccaaagtctaacaatttccatccagatgaaaactccaggtccaacaataaggatatagacattcctaatgcaaaaaggactagcacagatgcacctgataaaggtgatgagaaggatcaacaagagagaaggctgaaggcagcttttgttcaacagttggtgaagactgaaaaagcaaataaaaatagggatactttcgttaatgttaccgaaaaaactgaaaatatcgaagtgtactaa

SEQ ID NO: 72889 - DNA, 1368 bp, Glycine max
  Peptide Sequence Number=SeqID_189667
atgaacaaggatcgtgtgtctcttacccgcttctatagtcagggtattcaggaaaatgcaatgcaaattgttgtcaccaaggtggttgatatcatttcagggtctgaatggggtgatgaggttatgagtaatcttgcaaagcttgaaattcggatgtcggataattttgtaacaagggttttgaaagagcttagaaattgtcctttaaaggcctacgagttctttaattgggttgggaagcaatctggttatgagcatgatacagtgacttacaatgcgattgcaagagttctcgcgagtactgactcaattgagaagttttggagtgtgattgaggagatgaagagtgtgggtcatgaattggatattgatacttacataaagatatcaaagaagcttcaaaagaataagatgatggaggatgctgtcaagctttatgagcttacgatggatggttcatacaagccttcagttaaggattgcagccttcttttgaaaagcatctctgcaagtgatgatccaaacttggatttagttttcagggtttctaagaaatatgagtcaacctggcacactctctccaaggcaatctatgatggaatccacaggtctttgtcaggtgctgggaaacttgatgaagctgagagtattgttaatcatatgagaaatgctggctatgagcctgataacatcacatacaatcaaacaatttttggattttgtaagatgaggaagcttgatgaagcatgtaaagtgctggaggagatggaatcttgtggattcatccctgaaattaagacttggaccatcttgatccaagggcattgtgttgcaaatgaagtagatagggcattactttgtttaaataggatgattgaaaagggctgcaatgcagatgctgctgttttaggtgttctaataggcagttttcttggtcaaaagagaatagatgatgcatacaagttgcttgtagagattgttagtaagcatggtacatctccgaggcacggtacatatgcgaaactgattgataacctactgggaattgggaaacttgaggaggcacttgatcttcattgtctgatgaggaatcacgaattcactccaatcattgaaccctttgtgcagtatatttctaagtttgggtctatagaagatgctataaaattcctgaagagtaagggaactccccggtcccattcggtctactttcgtgtttttaaatctttactcggaaatggtagactctctgatgccaaagatctattgagcaagatcccctatataagtaaacgtaaaaaaatccttgagctctttagttcaatggagaattgcacggtgcacggcctcagtcatatcagccagtaa

SEQ ID NO: 72890 - DNA, 1301 bp, Glycine max
  Peptide Sequence Number=SeqID_189668
caacattcgcctccaatggacgtgaaggctttagcgaaatcaaagagaagccacacgcagcaccacagcaaaaattctcaccatagccacaagcccaacaaagccgcatcatcatcatcgtcttcttcttctgtgggccccaatgacgctgcgaagaagaacccattggggaagcagcaagtgagcgaggagaagaagaagaaaagccaccattccgcgcttccctcgaattgggacaggtacgaggatgaggaagaagaattagattctgggtccggaattgcgagcaaaaccgtcgatgttgtcttgcccaaaagtaaaggtgcggattttcgccacctggttgcggaggctcagtccctagcggagacgagtttagagggattccctgctttcaatgatcttcttcctggggagtttggtgtgggattgagctctatgcttgtggtcaggggagagggcattgtgtcgtgggctggagatgataattttgttgtagaggataagacaaatggaaatctggaggcatcatttttgtccttgaatttgcatgctctagctgaaagttttgccaaagttgacttagcaaagagattgttcattgaggctgacctattacccactgagttgtgtgtggaggagtcggcaatgagcagcagtgaagagcacgaggagttgaaaactaaagatgaaagtgaactagccaataggatgtctgaagaattagatgtagatgatctagctgcagatcagtttatatcatctagttccagtagcagtagccatgctgcttctacatttcccttgtccaacgactttcgcattcccgtgaactatgtcgatgctgaagctcagcaaactagcagttctggtaaaaataaagcatttgttctaagttcagatgctagtttacattctactgaagatacaagagggaaaccttactcaacatttgaggctgctgatgctgaaaaagaactagatatgcttttagattcatttggtgagaccaacattctagattcttcgggctttaagtccaacacctcgattccagtttcatcgggagtagcttctgtgtatcctcctcacatttcaaataaagatccagttccatccaaaactgcaccaattactgctagtctagatgatgtacttgatgacttgctggaaggaacatccacgttgacgaatccaaatgttttattacgaccgcaggaagaaaaacccgtccatcacagcatgcaatcttcttcaaattctggtagcaagtccaaagtggctgatgattttgattcatg

SEQ ID NO: 72891 - DNA, 294 bp, Glycine max
  Peptide Sequence Number=SeqID_189669
atggaatacgaacaagggatgaaatgtcagaatatccttggattgatgacgcttccctacattattaccctacttactcaatatccaagacctacatacagtacaactaggtggagtgcagtgtgttgcctacctcttggaaacctacattccaaatataccttttcaggaaagaaacaagcaaagacctttagaccacatggtgaagaaaatgacatatttagagtaaggcactcccttgagcttcttcaaaaagctccaagtaataaagattctaaccaatttctaaaatga

SEQ ID NO: 72892 - DNA, 129 bp, Glycine max
  Peptide Sequence Number=SeqID_189670
aaagagaaaaagaaattgctggtaaagagaggcaaagtgagcgctggatgcagaggtttatcgaccgattcttgctttgtgttcttccacaaccaaattcaggaagagatcgatgaaccgctgcctcca

SEQ ID NO: 72893 - DNA, 1530 bp, Glycine max
  Peptide Sequence Number=SeqID_189671
atggatgaaggagaaatcatcacacatactgctttccctcagaacctaactgcttctgctgcatctaatgatcataacaaacctccttctgctttgaggaggaaaagaaacctcccaggaaacccaggcatgcttgtttctttcatactaaaatgctttctcatcaagagaaaagaaaaaaaaagttatacaaaagatttaatatgtgaatcttttttccctatctgcacagatcctgaagcagaagtcatagccttatcaccaaagaccctgatggctacgaacagattcttgtgtgaaacttgtgggaagggtttccaaagggatcaaaatctccaactccatcgacgtggacacaaccttccatggaagcttaaacagagaacgggtaaagaagcaagaaaaagggtttatgtgtgtcctgagaagagttgtgtccaccacgacccttcaagggctcttggagacttaactgggattaaaaagcacttctgcagaaagcacggtgaaaagaagtggaagtgcgagaagtgctcgaagcgttatgctgtgcagtcagattggaaagcacactccaagacctgtggcactagagaatataaatgtgattgtggaactatcttttcaaggagagacagcttcatcacacacagggccttctgtgatgcattggcagaagaaacggctagggtaaatgcagcctcagacataaacacatccttagggggcaacaacattggttacaacataatgggaacatccctaggccctaatatggcatcccatttcccttcaattttcaagccagtttcaagcactgatgaaacaagtaaccaaacctcaaggggactacccctttggatgagtcaaataacatcttctcaggctcaagaaagaataatggtcaacacaaatttgcgtgagattcatcaacttggttctgccacaagctcatcatcaggaacaatatatgatggcaactcaattctccaatgcccaaatcttccaccttctaataactatcaactaagttgggtgtttggaactaaaatttccaataacagtaacaaccaagagttaacaactagcactactacttcacttcctctaggaaacacaagtgccattccttcttggtatagttcccaacaccaacctcaacatcaacaagcatgtccatcagcaaacatgtcagccacagctttgttgcaaaaagctgctcaaattggagcaacctcaagtgacccttcatggcttgggagcttaggtttgaaatgtggtaacaatagccaaggtcaagatggtaataataataagtatagtggcatgtacggatcaagcttggtgctcacaaccactcttgggagtgaagcagataactctggatgtgaattgtcacaaatgcaccctcacaaacgaagacacgtgctcaatgaagaaagtggaggggggcaaactagggatttccttggtgttggtgtgcaaaaccattttccacacttcatcaaccaaggggtggacttgatttga

SEQ ID NO: 72894 - DNA, 327 bp, Glycine max
  Peptide Sequence Number=SeqID_189672
atgggagttatggcagtgggatttccaatggaggaggggatgatttgtttgggaagaggagatgtggtgggtacagggagaatgagcttagattttgaggtccatggccttgggtctatcattccctatcccatccgacaacaccttgaaagcaccaagatgatgggtataaggagaatgagcttagattttgaggtccatggccttgggtctatcaagatgttaaagaggtttttagaacttgttgcgacggacttgaagattgatgttgttgatatttggaaatggaagctggaagactcagatgtcccttctatgatgagctag

SEQ ID NO: 72895 - DNA, 1340 bp, Glycine max
  Peptide Sequence Number=SeqID_189673
atggttttcctcaaaactatgcttctagaggaggaagatgaaatcaagttggctttggcagaatgtatgtgtgatgctcttactagtgctatggaaaggaagaaacaagattgggttatgcagtttcttagaggcttatatgaccaatttaacattgttagatccaatgtattgatgatggatccattacctagcatagctaagcatggttatcctcctagacaaaagcttaacaagtattggagttcaaacatcaacaatatcagtaatgttaaagaagaaggtgatagctcagctcaagaaagaaatcaagaaacacaaaatgaggatgtgaagctaaccactcaacagtataaagctttgatggcactgctgcaacagcaaaacacatttcacaacatctcacatgtgaatcaaattggtgcagtcaacaataaaggtagtctattgtccattacttatagtgtaagcaagaccaatcaagatgagtggatccttgattcaggtgccacagaccacatcattgtctttcctcatttcttttctatatgcaagaagataaaccttgtaattgtcaggcctcctaatggtcatagagtcactgcaactcatgcaggcataatccaattctctcaatttctatacctagaggatgatatgcagaacctgcagaggattggtacagttgatatggtggaaggcctttacaaactcaagatggttcctcttaagcctcatggaaagtacaactctaattccattattgtccctgcctgtcctattgttaaacctcaatcatatagtgaagcatctaaggatcataattggattgaggtcatcaatgcagatatcaaagcattagagcataatgatacttggattcttactaatcttcctaagcacaaaactgcaatttgttgtaaatgggtgtacaaaatcaagcataaatatgatggttcaatacagaggtataaagacagtccagtggctaagggctatactcaagtggaaggacaggactacctagaaagtttctctccaatggctaagttaattacagtgagacttttattggccttagctgctatcaatcaatggcatctcaagcaactggatgtgaacaatgatttcttacatggtgatttaaatgaggaagtgtatatgaccgtccctcaaggtatgaaagtggctagaccagggcaagtagccagaagttctactgatataaacctttgccataggaagtatgcattggacattcttagtgatgctggcgtgcttggttctaagccagtgtccaccccttgtgattataccaccaatttgcagcaacacttagg

SEQ ID NO: 72896 - DNA, 1179 bp, Glycine max
  Peptide Sequence Number=SeqID_189674
atgaagaaaatattttattcattggaagacacttataatggctctgcgcctctatggattgaagcaaagagtcatgttcaagtaggaggatatgagtgtggatactatgtcatgcattggatgtggtgcatagtcagcgccagtttggagaacaactggaatgagctgagtggtatccgcattatggcagaatctttgaaggattgtgtaattgacaacaatgaatataagtctactagtgccgatatgtattttatcctttcagctgatgcactggtatcaacggggttggctgatttaggttatgggtatgtcaacatagccaacaatgtatctgcagaaattgcttcttttggtaatgttactcagccaattgctgggagaaacaaagttccttacaaaatttctgaaagtgttactcttcaaacgatggacaatcaagcaaatccacatgagcagaagaataatacagtttccttaagtggtgttgattccttggacactcttgaatcaccagtttcatccattcatgaaccatattcatctctggtagtggatagtcaacaatcttctctgccagaacaagtatttactatcactgatgtatcccctacatgcgtatcttccaccgagaaatcaaaggtcgtggtgactggattttttcttaaggactatatgcacctttcaaattctaatctattatgtgtctgtggtgatgttagtgttcctgcagaaattgttcaggttggggtctaccgttgttgggtatcaccacactctccaggatttgtgaatctctacttcagcattgatggccataagcctattagccaagttgttaattttgtatatcgtactcctgctttgcatgatcatgcagcttgtcattggatttccgtgataggtgtggatggacagctcttcattgggcaacatattgtggaagccaaatttggtccacaaaatcctgatgaatgcactactactgatcttgcttatatgaggggtcatgatggcttagaagcttatctttcagaaaaatctctggaccaacagaacctgaaggatacgttgatagcttaccgaaccgctgctgaggcagcttcccgcatacatgctgcatttagggaacactctctaaaactaagaactaaggcagtatcctactctatagagtag

SEQ ID NO: 72897 - DNA, 612 bp, Glycine max
  Peptide Sequence Number=SeqID_189675
atggcggtttgctatgtttcccatgcagtttacgtagaaaacaaccccccatgtacaaagattcccagtgtcagagatatgccactgatgagaatgatacaccattccgtagtagtaattgctataaggactttccgtgtaccgtgtgcttcatcaattcgggaaaactgttataaattgaaggattggcatagaacccttgttaagaccagtgcttgggattatgtagttgtttggaaatatggggatgacccaacaagtgggagttgcattgatgtggtgaagcctgaagaggaaaaggctgaagtgtgcaacatggctcccatttgcagggatgaccattttcattttcagcatccagttagaacaaaggcttgtgaggctcttgctcagcttccttttgcattgtctctgtattctgggtctctctctctcattctgacttatgtttgtattccaatggatatgaatatcatagagctcataacagcacatggttgtgtctcttcagagcaagaaaccatatctgcacagagctacaccagtctgaacatcaatgaacatctgccattaagggaacaatactcacagtggtgttcaccacacatgtaa

SEQ ID NO: 72898 - DNA, 1614 bp, Glycine max
  Peptide Sequence Number=SeqID_189676
tggccaccaccgttgcaaccattatcgtcgccaccacaattccgtgctccacctccccctgatagaccttcttcgcggcgtaatgcaccctccaatgattcaacccagggaacctctgagaagtcacgatcaggtcaccataagcatggtgttgcttcccatacaaactcaacaggttcttctcccaatcaaacctcttctggtgataattcaggaaaatatgttggttacacactcgctgggatttttgctgttgccttggttgctgtagctgtagctcttgttttcgtgtttaagaagaaaaaatcaagaagggatgcctatactacaccctatatgccaccctttaaaattcatgtaaaatcaggtgctaatgggcattactatgtacagcagcctatcccatcgcctccccttgcaaacaactatggaaatgggaatatgagcatgcaacatttaggcgcttctttcgactcagctcagttcaaaagtgttcagatagtttttacctatgaaatggttatggaaatgaccaatgcattttctactcaaaatgttattggggaaggagggtttgggtgtgtttacaaaggttggctgccagatggaaaaacagttgcagtaaagcagcttaaggctggcagtggacagggagaaagggaattcaaggctgaagtggagatcatcagccgtgttcatcatcgacatttggtggcattagttggttattgcatatgtgagcagcaaagaattcttatctatgagtatgttcctaatggaacactccatcatcacttgcatgaaagtggaatgccggtgttagattgggccaagaggctaaagattgcaataggtgctgcaaagggcctagcatatctgcatgaggactgcagccaaaagattattcacagagatataaagtccgcaaacatacttttggataatgcttatgaggcacaggttgctgactttggacttgcgaggttagctgatgctgccaatacccatgtatcaactagggtcatgggaacctttgggtacatggctccagaatatgcaacaagtggaaaattaacagacagatcagatgttttctcatttggggttgtcctccttgagcttgtaacgggaaggaaacccgttgatcaaactcagcctttgggagatgagagtttggttgagtgggctcgtccacttctccttcgtgcaattgagacacgtgattttagtgatctaacagatccaagactcaaaaaacactttgtggagagtgaaatgttcagaatgattgaggcagctgcagcttgtgttcgccactctgctcttagacggcctcgtatggttcaggtggtaagagccttggactgtggagacgaaagttctgatatatctaatgggatgaaatatggtcatagcacggtttatgattctggccaatatgataaagcaattatgctattcaggaggatggccaatggcaactttgatgattctgattttgatatgggattgagggaaagcacacatagcagcgcaacagagaccaatgagtatagacgcatggcgttagaggctgctgcttttaacccaattagattccccaaattcttctaa

SEQ ID NO: 72899 - DNA, 396 bp, Glycine max
  Peptide Sequence Number=SeqID_189677
atgttgcataagatcacgaaggcctgggggcttagtggtagtgttgggcccaagcctacaccgtcctactatcgctttgcaacacccgtgttggaggtggtcattccattcgagtcccttttgtcgtctactgacattgcaatgtcttttgctgattttgactcctcatccaaggatactgataccgcctctcccactctaatgtatcctcattcgatgttgcctgaggcttgggtactacctgaggtggatcttgtgtcagagaacgagggagaggattcagaggaggatacatcatacgaggaggatccatttatggacaaggaggaccctgccacagagcctgagatcatggaggaggattccttgcaggattcatttgaggagtcttactag

SEQ ID NO: 72900 - DNA, 99 bp, Glycine max
  Peptide Sequence Number=SeqID_189678
gctggtggaattcttaggcttttgttctatgtcttggcttcccctattgttgtcttgctctattacttcatctctgagtccgcaggcattcaaggacag

SEQ ID NO: 72901 - DNA, 336 bp, Glycine max
  Peptide Sequence Number=SeqID_189679
atggggggttcacaatcaaagaaaaataaagcaaggaaggcactgttagagatcgaaagtagattttggttacccgctgtgcgtgtcaatgccttcaatcttgtgcagggctatccagagcgagaaggtgataatgtggccaggaaccatgaggaagtaatcggacttggcggcaaagtagttgaatcagagggtctccgcgaaggtgatgttgcagcccaacaccgccgcgaccttcgagatggaagtgtaggggagcattgtcaccggaaccctaggattgctggcggcattggatgtgatgtgagagaggggaggggccaagggagcgtgtga

SEQ ID NO: 72902 - DNA, 813 bp, Glycine max
  Peptide Sequence Number=SeqID_189680
atgaacaacatgcaaaatgaaacctcaagcgttatgcaattgaaaatgcaagctctatctattctccgaatgcccccttcatttcacaagtctaaagacgttgctcccatttctttgaagctcaaccaaaatttcattggtgaaaatgaaatccaaattgacaacgaagaaaattttgaagaacaacaagagttcatttttgcatgcttcagtactcaaggaatacttacatttgctgatgagatacttgacaatggcaagatccgtttagcatctactacttctgaccattcggttggttttaccatagaagaagacaatgacaccttagctcttcaaccaccattgaagaagctctttgttggtgaacaactcaacaattttttctcacaatcaaaaggtacattggaagaatcgtgcaatgggaattcacaaaaaatggcaacagttgaagttgagacatcaaacaacaaatgcaagaagagcaaatccatgggtttctcaaacacatgtagactgcccaaaagcacgaagcttcgaagcaacagtgatggcaaacacacttttgttctcttgaatcctttggggtcaatgccaatgaagtccattgaggcaaaggaagaaagtaatgtttcaaaaagaggaaaagatgggaaatgcaaaacaaccttgtcacctcacgagaagttttatgtgatgaataaaaagagaaaggaaaccaataagcgaaagtcattcttgccttataggaaaaacttgattgggttcttcaccaacattaatggatttagtaggatccttagccctttttga

SEQ ID NO: 72903 - DNA, 288 bp, Glycine max
  Peptide Sequence Number=SeqID_189681
atgtgtgtacggataacccttgggtatttccgccagccacctgatgcatgggtcaggattagcagatgttgtgtttgtagggataaccacttagggtatttttgtctgcaacctgacacatgggtcaggattagtagatgttgtctttgtgcggataaccgtaaggtgtctccgcatgctaccggactcacagagaaaaaggtgtgcgcggataaccatcgggtgtctccgcatgccaccggactcacgagtcagaacaacaaaacgtggggtggtcaacaaaagtga

SEQ ID NO: 72904 - DNA, 357 bp, Glycine max
  Peptide Sequence Number=SeqID_189682
tctgagacacttgctgatcatataaaattcgaccatgggtacaatgcaaagagccctgccattattaatttacttgaaattatgggagggttcacaccagagcagcaacgtgccttctgtcaatttgttactggtgcacctaggctgccacctggagggctggcagttctaaatccaaaactaacgattgtgaggaagctttcgtcaaccgcagttaatacttcatctaatgggaatggaccttcagaatcagcagatgatgacttgcctagtgtgatgacatgtgctaattacctgaaacttcctccttactctaccaagaagggaaatggtgcaatgaaaatggtgtccaaataa

SEQ ID NO: 72905 - DNA, 3654 bp, Glycine max
  Peptide Sequence Number=SeqID_189683
atggctggtgggagaaggaggaggcaccacttcggcagaatccatgcattcacgtgtggtagagcttctatgaaagaggagcattcactaataggaggccctggcttctcaaggaaagtctattgcaatgaccctgaacgtgccacagcgagtcttctaaactatggtgacaattatgtcagaacaactaagtatacattggccacgttcctccccaagtccctgtttgagcagttcaggagggttgccaatttctacttccttgtttgtgcagttttgtctttctttccggtgtccccttactcaggcatcagtaatgttgtccctctactggttgtggttgctgccacaatggtcaaagagttcattgaggattttaggaggaaaaaacaggatatagagatgaataacagaaaagttaaactgcatcgtggaggtggtgtttttgactattctaaatggagggatttgaaagtaggagatgtagtgagggtggaaaaagatgaattttttcctgctgatctcatcttacttgcatcaaactatgatgatgcaatttgctatgttgagaccatgaatcttgatggagagacaaatctgaagctgaaacaagcacccgaagcaacttcaaagttgcaagaagactcgaacgttcaaaatttcagggctgtcatcaaatgtgaagacccaaatgctaatctgtacacatttgttggtagtatggagctcggggatcaacaataccctcttgcacctcaacagctactgcttagggactctaagctgaggaacacagattttgtttatggcgtggtaatatttactggacatgatacaaaggttatgcagaatgcaacagatcctccatccaagagaagcaaaattgagaaaaggatggataagattatctactgcctcttctttgtactcattttgatttctttcattgggtccatattctttgggattgcaacaaatgatgaccttgaaaatggaagaatgaagagatggtaccttagaccagatgataccgaaatttactatgatccaaatgaaccagtagctgcagcaattctgcatttcttcactgcacttatgttgtatagttacttgattccaatttccttatatgtatccattgaaattgtaaaggttcttcaaagcgtgttcatcaaccaagatgtgcacatgtattatgaggaaactgacaagccggcacatgctcgtacatcaaatttgaatgaagaacttggtcaagttgatactatactttcagataagacaggaactttgacttgcaattctatggaattcatcaagtgttctatagctggggttgcttatggacgaggagttactgaagttgagagagctctatctaggagacatgaatcacatccaggccaagagttgaaaaagattagtgaatcaaagtcatccattaaagggtttaactttatggatgaaagggtcatgaatggaaattggatcaaagaacccaatgccaatgtaatccagaacttcctacggttgctggctgtatgccatactgcaatacctgaagttgatgaagaaactggtaaggtttcatatgaagctgaatcaccagatgaggcagcttttgtgattgcagccagggaacttggatttgaattttatgaaaggacacatacaactatttcactgcgtgaattagacaccatatcaggccagaaaatcaacaggtcctacaaacttttgaatatattagagtttactagtgcgagaaagcggatgtctgtaattgtgaaagatgaggaggggaaactattactacttagcaaaggggctgacagtgtaatgtttgaacaaattgcaaagaatggaagggattttgaagagaagacaaagcagcacattgctgaatatgctgattctggtttgaggaccttgatacttgcatatcgtgaacttaatgatgaagagtacaataaatttaataaagagtttacagaggccaagaacttagtaagtgaagaccaggagcagattgttgaggggataatacaaaatattgagaaggatttaattcttcttggtgctactgcagttgaagacaaactacaagatggggttcctgaatgcattgacaagctagctcaggctgggattaagctatgggttttaactggtgataaaatggagacagcaattaatattggatttgcttgtagtttactcagacaaggaatgaaacaaattataattagctcagatactccagaaactaaatcattggagaaaatggaggacaagtctgctgctgaagcggcaattaagtcaagtgttcttcgtcaactaagggagtcaaaggcattgctttctacagcagatgaaaactatgaggccttagccctgatcattgatgggaagtctcttacttatgcactagaagatgatgtaaaggacttgtttcttgaacttgccattggctgtgcgtctgttatctgctgtcgttcatctcccaaacagaaagcacttgttacaagactggtgaagatgagaactggtagtacaacactagctattggagacggggcaaatgatgttggaatgcttcaagaagcagacattggaattggtatcagtggcgtggaaggaatgcaggcagttatgtcaagtgatattgcaatagcccaatttcggtttctagagcgcttacttcttgtgcatggacattggtgttacagaaggatctcgtcaatgatctgctatttcttttacaagaatattgccttcggcttcactctgttcttctttgagatgtatgcctcattctcagggcaagctgcatacaatgattggttcatgtcactatacaatgtattcttcacttcacttcctgtaattgcattaggagtttttgatcaggacgtatcttctaaattatgtctcaagtttccattattatatcaagaaggcacccaaaacatcctatttagctggaaacgaatcatcggttgggcattgaatggagttgtgacttctgccattgtattcttcttttgcatccgtagtatggaataccaggcattccgtaaaggcggtgaagtcatggggctggaagttcttggtgccaccatgtacacctgtgttgtgtgggtggtgaattgccaaatggcattatctatcagttacttcacttacatacaacatatattcatctggggaagcattctattctggtatatattcctcctggcatatggagcaatagacccttccttctcaaccacagcctataaggtcttcattgaagctcttgcaccagccccatctttctggatcgtaactttcctcattcttattgcttccctccttccatatttcgtctatgcttccatccaattgcgtttcttccctatgtatcatcaaatgattcagtggatgagaaacgacaggcaaacaagtgatccagaatactgtaatgtggtaaggcagcgatcgataagacacacaacagttggattcactgctcgtttggaagcatccaaacgttttgaagcatccagaagagttgaagcatccaacccttttgaagcatccaatcattttgatgcatccaaaagacttgaagcatccaaacgttctgaagggaagtttgaggatagataa

SEQ ID NO: 72906 - DNA, 318 bp, Glycine max
  Peptide Sequence Number=SeqID_189684
atggcaaagtggagtctcacggagatgatcaaagaggctgacacggatggggatggtgtaattagcttcactgagtttgctactatcatgcctcgctctgattctgatttcttaggcctctcgttgtgcttaccatataacatattcattcatttcatccaagttctaattatgtcaaggtatatgctttgtaaagaaatttctactaaacttttccatagcatttggagtgcatatcttaccgtgtgtttggaatggcttacatattatcaagtcagttcagagaaagatgtggaagtgaaagagaatgccttctaa

SEQ ID NO: 72907 - DNA, 1043 bp, Glycine max
  Peptide Sequence Number=SeqID_189685
tggacgggcctgttacttcaaagaaagacatctcatctttgcaacaacctactaataaagacataaccaaaagtattactgaaaatgaaactgaagaggatgtggaagtcgaaaatattgaaaggccagttgacctatacaaggctattttctccgatgattcagatgatgaaggggaagaccctagcaataggagagtagagaatcaagaaaagaaagctgaagtagctaatacagcattgagccgtttgattgctggtgattttcttgaatcattgggcaaggaactaggaattgaggttcctcctgatatgccttaccctacgcaaaagtccaggaatgttgcacatcagaaagacattgttaatgaagatgcaagaaccgacatcctaaagagtgaaaacaacagtgtgatgtccttaaatcatgatttgccatatgatcagcagcacattgctcatgattgtgaaccatcaaaaggtgacaccattgatggaaatatgcttgagagcggtaataacaaaaccaagggaaccaccagccaagacaatgacagcagttcagaagaagaaaggagccaaaaacgatctaatagggaaaaatatgatgagtctaggaaagataaaacccctaggaaaggagccgaaaacggtccagacatcaacggcataagaggcatgatgcaggaagtcattcatccagtgatgatgacagaagagatagacacagttcaaggtcaaaagggagaaggaaaggttcttcccgagaaaaaagcaggagtgaaaaacactcaaaacgtcacaagcacagaaagcatgaatctccaaatagatcctctcgttatagcaatgagaaagacagttcacattccagaaaagagaaaaggcggagggaatgagcgagagacttgtttcctttgttttcaagaacattttggaattatgttgggggatcgctgttgtatacttgtattaaaagatgttactaagttttgggtttgtgatactgaggtgctccctatggatttcatttgctccgattga

SEQ ID NO: 72908 - DNA, 2170 bp, Glycine max
  Peptide Sequence Number=SeqID_189686
atggagtcagatgaagacgattttgttttctacggaacgccgatagagcgtgaggacgattcaatcagtcgcaagaagaaggccattgctgagtcctcaggtcagctccgagctctccctgcttggaagcaagaggttagagatgaggaagggcggagaagattccatggagcatttacaggaggttattctgcgggttactataatacagtgggctcaaaggaagggtgggcacctcagtcatttaaatcatcaaggaagagcagggctgaatttaaagagcagaacatactgaattttcttgatgaagatgagaaaactgaattggaaggttgttttttggggacaacttcacagtttgacacatttggtttcacagctgctgaaattgctcgcaaacaagctgagaaggaacagaaacagaggccatccataattcctggacctgctcctgatgaaatagttgttccagccactgagtctgttggggtaaaactgctcatgaagatgggatggagtcgtggtcgctcaatcaaggattcacattctgaggcactgtatgatgctagaagacaggcccgtagagctttcttagcattttcttctgatgatccaaaattgaagattactgggtctgagcccattgagggtgatgttgaaatttttcctgaggagcctgtgaatggcgatgctcagttttctaagagcacaccggtttacgtactcaacccaaagcaagacctgcatggattaggttttgatccttataagcatgctcctgagtttagagagaaaaaaagatcacgcttagccagcaaggggggaggacctggctatagcaaaaacttctccaccagagacagtctttttggaaaggctgcccctggttttggtattggagctcttgaggagcttgatgtggaggatgaggatgtctatgccactggttatgaatttgaagatgcttatgttcaagaagttgaagaaccttcaacgttgagattagaaaaccagagaacgaaagagcagaaggaccagggtgatctgcgtggttttagagttgcatccaattctgactttaaaatggaaagattcgaggctcctctgattcccaaggattttgtgccccaccatgaattttctggacctctcaacattaaccgcaagagctgtgaagttactccaccagatgttcctcctcctggggatgggaatttaaaactattaattgagggggttgcaaatctggtagctaaatgtggtaaattatatgaggatttatcaagagaaaagaatcaatcaaatccattgtttaattttctttctggaggaactggccatgaatattatgcaaggaaattgtgggaggcacaacagaaacacaagactagtcggcaattggatggaaaaatgcctcccagtgtgcagaggctaacagctgagagtcgaggccagatcctaggggaaaaacctctagaaaaaagttcccaagatctatcctcatctgtttcttctacagatattcatctccaatttaatcttactgatacatttactgagtctgcatcacttattgtgccttcaactcagataattcccttgacacgattcttagattccgttccgtggaatcttaatgataagggtatagctgaacctttgattgccagactctgggcacaatgccagagtgagttagtgaatgtggaaaagcctttcaaagatgatcctacaaagcaagaaagatttgagcagtttcttaaggagaaatataaagggggattacgctctgctagttctagtttagctagtgatatgtcagaagctgctcgtgctcaagagagactaagttttgaggctgcagctgaggcaatagaaaagggacgacaaggcaggggaagcaagcctttaattccatcttccatggattttatcccaggtggtgttatgcagtttacttctggtgaagtaaagccaaagaaagacctgctagctgaagatattttgaagaagaaaatgtaccctaagagggaagagtttcaatggcgcccttctcctcttctgtgcaaacgctttgatcttattgatccatatatggggaagccgccacctgctccacggattaggagtaagatggataccttgatttttacatcagattcagtcaaag

SEQ ID NO: 72909 - DNA, 513 bp, Glycine max
  Peptide Sequence Number=SeqID_189687
atgatattcaaggagggacctgagaattgttgtttgaatgtgtttggaaacaagaataatccttgctggaactatgtgactacagccctgaggaaagaaggattagaatcatcaaatctcatccttggaattgattttacaaagagcaatgaatggactggcagaatctcattcaataaaagaagcctgcatgctattggaagtacacctaacccttacgagaaggccatctctattattggcaagacattggctccctttgatgatgataacttgattccatgttttggatttggtgatgctactacccatgatcaagaagtgtttagctttcacagtgatcattcaccttaccatggctttgaggaagttttggcctgctaccagaaaatagttccaaacttgaaactttcaggaccaacttcttatgccccggtgattgaggctgctatagacattgtggagaaaaatcgtggccaattccatgtgttggttatagttgctgatggccag

SEQ ID NO: 72910 - DNA, 522 bp, Glycine max
  Peptide Sequence Number=SeqID_189688
atgcacgaaatagaggatgagctgcacaaactggaggtggagaatcgtaaaagggaagtgtttaagtgtttgtatctcaatgaatttgagaaagttaaaatgttttttaactcacatgatagtgaatttcgtgttgcatctcttccttacatgctagagtttaaggttatgcctgaggggtgcgatggcattaacgaagatgtggatgatgggcattacgacatacacaaaatggaggatgaaatgctttatcgagagtttgtcgagaaacttcaacaaaaagaaaaaagtgttttttcccatcagcagtttaatgctcaatgtaaaatattctcctattttataacagtggaatctacatcagtggtagaatcaatacatcatcgagtgacgacgaccgttgtgccaaatgttccgtttgatgaagtggggcaagagctattattatgcatttttctcggtgctcactgctcgcagcgtgttctgaacttctctagagtgagggagttgttgagaaaatag

SEQ ID NO: 72911 - DNA, 438 bp, Glycine max
  Peptide Sequence Number=SeqID_189689
atggctccaatgagtctcccacctgggtttaggttccaccccactgatgaagagcttgttgcttactacttggagagaaaaataacaggtcgctccatagagcttgaaatcattgctgaagttgatttatacaagtgtgaaccatgggatttgccagataaatcatttctcccaagcaaggacatggagtggtacttttacagtcctagggacaggaagtacccaaatgggtcaagaactaaccgtgcaacacaagctggatactggaaagctacagggaaagataggccagtgcactctcaaaagaagcaagttggcatgaagaagacattggtgtactatagaggtagagcaccacatgggattagaaccaactgggttatgcatgaataccgtttaattgaatcagttcctggtactgctctctcatctttgaag

SEQ ID NO: 72912 - DNA, 405 bp, Glycine max
  Peptide Sequence Number=SeqID_189690
atgacttcacacaaccttctgcaaccaagtcatcatcactgggaggatcaggatggctccggcccttgtcagaatcaatggcctgagcacgggtcggtttcggtcgaattcggacccgtgaagcccaatctgccgaaaaccgaaggccgatatacgtggaccgaatcgtccaaaacaaacatggagtttgtcggattgcggtttggtggattgacagaagtatggttgtcaaaggcgatgcgggaagctagttgtatagaagtgggtgtggaaagtagaagcatcgaaaggtggaagttatccttggagaagtctattgttgatgctatctttaatgaggagcttgcagctcttgcgttggcggagagccctattgttgatgttgagcagaatgatataagttaa

SEQ ID NO: 72913 - DNA, 1323 bp, Glycine max
  Peptide Sequence Number=SeqID_189691
atgaagaacaaagagaaggaagttatctactccgttattcaagggttagttggaaagtggtggaacggttcatatctttatccagatccttgtggacggactcctatacagggagtttcctgtgagcaatatgatgatggcttctggtatgtgacaactgtaaactttggaccagtttttgacaactctctcaattgcaaccatgaagctcaattccctcaacaactattcaacctcaagcacctaaaagtcctctcactgtccacttgcttcctttctcctaccaaaaatcctgttaaactccctctttcaaactgggaaaagttctcacacagtttggaatctttaacacttagatcaaaccctggtcttgttggcaccattccatcagcaattggcagcctcaagaagcttcaatctcttgtacttctagaaaatggactaacaggtgaactaccactaagtattggaaatttggtcaagttgaggcaactagtccttcaaggaaacaatttggaaggtcaggttccagccaactatggatggctttctgagcttttaatatttgatgcaagcaggaacaatctatcaggggttttgccatcaacacttggactcttggattcacttctaaagcttgatttgagtaacaacatgcttgagggagagttgccaagggagctaggaaggctaaagaatcttactttacttgatataagtcatagcaaacttagaggtgggttggttaggacaatcaaagagcttgtttccttaaagcatttggttttgtccaacaaccctatagggggtgatctcttgggggttaagtgggaaaatttccaaaacatagaagcattggacctttccaacataggtttagaagggagtgtcccagaatccatggcaaaaatgaaaaggcttaggtttctggacctcagcaacaacaacctttgtggaactctctctagaagtttggaaaaactgccatgtcttacagctcttcatgtaaatggaaacaacttgacagggagacttgagttctcagacaggttttacatgaaattgggaatgcgttttgcagcttggaataatgcaaatctctgttgcaatattgccaaaccccagaacgaaatgccttatggagtaaaaccttgtgcgcagaacattactatatctgaaggggtttcaaatgttaagatgagtgaggggaattacgaggattcctttgcctctttgggaggttcaggcttttattatggactttggtgggttttcactgtaaatggggttctcaatgttctcctgtggaatatgttattttag

SEQ ID NO: 72914 - DNA, 1809 bp, Glycine max
  Peptide Sequence Number=SeqID_189692
atggcagaaacagaagacaaaacccttcaagcctcgcccatgaacgaaaccaagaagatgaagaagaataagaataagaagaagagcgacaaaaaaagacctcgggagattgctaccgaggagcgtccagaggaagaggagaatgagaataatacagatagcgatggagaatcctcgaagaagaagaagaagaagaaggtggaaggagaaagtgaagtgaaagagaaaaaggtgaagaacaatggtggctctggaattatgagcactgagtcatttgaatctctcggattgtctgaacctacttataaagccattatggatatgggattccaccacatgactcagattcaagcgagggcaattccaccgcttttgattggaaaagatgttcttggtgctgcaaggactggttctggaaaaactcttgccttcttaattcctgctgtggagctgttgtacaatgttaaatttacgcctcgtaatggagctggtgttattgttatatgccctactagagagcttgcaatacagacacatgctgtggccaaggagctgctcaagtatcattcacaaactcttggattggttattggaggttcagctagaaaaattgaagctgaacgcattgctaaagggataaatttattggtaggaactcctggtcgtcttctagatcatcttcaaaacacaaaaggattcatatataaaaacttgaagtgcctcatgattgatgaagctgacaggattttggaagcaaactttgaggaggaaatgaagcagattatcaagatccttccaaagaataggcaaacagctttattttcggctacacaaacaaagaaggttgaggatcttgcccgtctgtcatttcagacgactcctatctatattgatgtagatgatgggagaaccaaggtcacaaatgagggattgcttcagggttatgttgtggttccctgtgccaagcgatttattgttctctattcctttttgaagagacaccagtcaaaaaaagtgatggtttttttctcttcatgcaactctgtcaaattccacgcagacattcttaatcttattcaattgaattgctcgagtattcatggaaaacaaaagcagcagtcccgaacaactaccttctttgacttctgcaaagcagaaaaggggatcttgctctgtactgatgttgctgctcgtggacttgacatacctgctgtggactggattgtgcagtatgatccacctgatgaaccaaaggaatatattcacagggttggtagaacagctcgtggtgaaggtgggaaaggaaatgctttgcttttcctgattcctgaagaattgcaatttcttcgctatctgaaggcagctaaggtccctgttaaagagtatgcatatgatgaaaagaaggtggcaaacgtacaatctcacctggagaatttggtggtcaacaatttctatttgaacaagatggcaaaagaagcttatagatcatacatattagcatacaattctcattctatgaaggatatattcaacattcaccatcttgatttgcagacatttgccgataagtccatcaattggtacttggtagatagtagaggctggaaaagggtttcagatcccaaaaataataatgctgttgcttcttcgttctgtttttcaaacccaccaaatgtgagtctaaacataaacagcagtaagcaaaggaataaaatgcgtaaagttgatggaagtagacatggattcagtggcgacaatccttatggaaagagaaatgctgatgataagcggcagtttgtgaggtactag

SEQ ID NO: 72915 - DNA, 993 bp, Glycine max
  Peptide Sequence Number=SeqID_189693
atggcaacaccatcactttctccattccaattaatacccacttctccatcttttccaatcctcaaacaacaatgcagattctcacgtagagagctcaccatcttcagcaactcttgcttgctactactcttgggtgctcaggcaagagcagaagagaatttgactttggcagaagaagatgttggtaacacaagtaacagcgatcaaccagaagagaatctgactttagcagaagaagatgttgctaacacaagtaacagtgataagccagaagagaatgtggctgtcactcccagctgcactgaaagaaaacctacaaaacaagtattcttagacatatctattgatggcgaacctgttggtcgcgttactatagggctctatggagatgatgtccctgcaggagttgataggtttagtaagattgcaagtggagctgctggtattagctacagaagaaaggagtttgtcaaaataatgcccaattacgttcaacatggtggcctgagatcgtatggggtggatgctgaacttgcttcgaagacaggtagcaacttgggaactagtagacttggtgaggaatgggaaagggagtatgagagatgtcctgggactaaaaatgtggccggaagtgtaggcattattgtgagaaacccatcaaaaccgcctccaaagttgaagcttattgcaaaacaagggaagctggagattgatgaagaagaagtaggaaatgatcccaatgggacagaatttgtcatagctacgaaggattcgccagaattggatgcatcgactctggtaattggaagagtaataggagggatggaggttgtgcagaggatcggtctagttaaaaccgtacaagagaatacaggatctccatattttagggtggcaaagctaataggagacaagagagctgttgtagcagaaagaggattcaaccgcccttattcaaaggtcattgttacaaattgtggtttaatggagtaa

SEQ ID NO: 72916 - DNA, 225 bp, Glycine max
  Peptide Sequence Number=SeqID_189694
atggctacatattccaactttgtgcaagagtattgcccaatcactgaatctagaattcaagagccagaaaaaggcataagtttgacagaacctcagaaagcaaacttggaggctagaaggcagaaggatctaaaggcaaaaaattatctcttccttgccatcgattggcccatcctagaaactattctttgcaaagaactttcaaggacatttgggattctatga

SEQ ID NO: 72917 - DNA, 2073 bp, Glycine max
  Peptide Sequence Number=SeqID_189695
atggctgtttccacctttcaggcgccgccactgaagccctcattgccttccactcttctccggcgcctcaaacgcgtgcccctctcccactccttctcattattctccgctccaaacacaaacagctttcattcttcttacagagccctccgtattcgcgccatcgacgcggcccagccattcgactacgagtcgagaatggcccaacaattccacgacgcccagaagctgaagatcgccatcgtgggcttcggcaacttcgggcagttcctggcccaaaccctcgtccggcagggccacaccatcctggcccactcccgctccgaccactctctctcggcccaacaactcggcgtcaccttcttccaaaacccccacgacctctgcgaagaacaccccgaagtcatcctcttatgctcctccatcatctccacccagcgcgtgctcctcactctccccctccagcgcctcaaacgcagcacactcttcgtcgacgtcctctccgtcaaggaattccccaaaaaccttctcctccacgcgctcccccccgatttcgacgttctctgcactcaccccatgttcggcccccagagcgccccacgcgcctggaccggcctccccttcgtctacgagaaggtccgaatcggcgcccacgacgaccgccgaatcgcgcgctgcgagaaattcctcggaattttcgccagagaaggttgcaggatggtggagatgagctgcgccgatcacgacaagttggcggccgggtcgcagttcataacgcacaccgttggtagggttttggagatgctgaccgtaaagtcaactccgattaacaccaaaggctacgagtcgttgttgaatttggtggagaacacttgcggggacagctttgatctgttctatggattgtttatgtataataagaactcgctggagatgctggagaggttggatttcgccttcgaggacttgaggaaacagctcatggcgcgtttgcatgatgttgttagagagcacttgtcggataatgctggaattgggaaggtgcagagtttgcctgatgaatatgtccatcaactgctgctcaagaacggtcaaaatggatctgctgctgcacctctgctgtcactgccctccgaagatctgagatctggtgatgttgttaaactcaacaactacaagtcaaatgatgcaaaccagtctgatgacaactccaagctcaagattgcgattgttggttttggcaactttggtcagtttcttgcgaaaacttttgtgcgtcatggtcatcgagtgttggcatactctagatcagattactctctcgtggctcaggaattgggggtttcatatttcaataacattgacgatctttgtgaacaacacccagaagtgattttactttgcacttcaatcctttccaccgagaaagttcttaaatcattgcccgtgcaaagattgaagagaagtactctgtttgttgatgtactttctgtcaaagaatttcctagaaacttgtttcttcagcatttgccgcgtaattttgatattctctgcactcatcctatgtttgggccagagagtggaaaaaatgggtggaatggtcttgcttttgtttttgataaagttagaataggaatagatgaatcaagatcatcacggtgtgatcagtttcttgacatttttgctagtgaagggtgccgaatggttgaaatgtcatgtgctgaacatgattggcatgcagctggatcacaatttatcacgcatactaccggaagatttttagaaaaactggaattggagggaacgccaattgacacaaagggctatgagactttgttgagtttggtggaaaatactgctggagatagttttgatctatactatggtttgttcttgtataatagaaatgccatggagcaactagaaagatttgatctggcttttgagtctgtgaagaagcagctttttgatcgtctgcatggcttctaccgacagcaagtatttaaacatgaagaaaaactccatgactcgccagaaaggcgtatgttgcctaagatatctgaagataaataa

SEQ ID NO: 72918 - DNA, 1308 bp, Glycine max
  Peptide Sequence Number=SeqID_189696
atgagagtgagggagtgggaaaaggaaagtggtgggctatactgctatagtatacactgggctagggaagaggaagaaaagggcccaaatttaaaaaaacaggtgacggttggtgatgctaattacatggactggggtggtgctggtgctggtcttaacaatcactacagaactacttacaaagacgaccaaaaatccatgatggaggtggcactcatttcaaacatggatcctgtaaatattgggctgggctgttcagataagccagctcctgttacttcactgaagccaagaaagaaaacaatgacatcagtgtatttgaagttctttgagacagctgctgatggtaagactcggagatgcaagttttgtggacagagctattccattgcaaccgccacaggcaatttgggaaggcatcttgctaatcgtcatccaggttatgacaagtcaggggaagctgtcagcaatgcagcagcacgacctgtcactgtggttaagaagtcccagcctcatggaaaagcaaaccaggtggattatgatcatctaaattggttgctcattaggtggcttgttttagcttctctccctccttcaactctggaggagaagtggctcgtgaattcctacaagtttctaaatccatcaatacaactgtggccaagtgacaagtatagaactgtacttgatgaagttttcagaagcatgagggaagatgtaagagcgttgttggagcaggtttcttccaaagtatccattacacttgatttctggacctcctttgaacagatctactatatgagtgtaacatgtcagtggatcgacgaaaactggtgcttccagaagttgcttcttgatatctgtcgcataccctatccatgtgggggtgcagagatctatcgttccctcataaaagttcttaaattttacaatattgaaaacagaatcctgtcctgtacccatgataatagtacaagtgccatgcatgcctgccatactctgaaagaggacttggatggtcagaaaatagggccgttctgttatattccctgtgctgctcgaactttgaatgcgataatagatgatgggttgagatccgcaaaacaagtcatttctaagatacgggagtttgcaatagagttaaacgcctcaccagtgatctctgaggattttattcaattatccacagcttatcaagaaggtatttggaaatttcctcttgatgtttcagcaaggtggagtggaaactaccaaatgcttgatcttgttcgcaaggtaggcctttatatttccaatggctttagttaa

SEQ ID NO: 72919 - DNA, 3510 bp, Glycine max
  Peptide Sequence Number=SeqID_189697
atgagtggtggcaggaggaggaagctgcgcttaagcaagatctactcatttgcatgctgcaaggcatcttttgagggagatcatcattcacagattggaggaaaaggttattccagagtggtgttctgcaacgagccagatagctttgttgaggacggtgttaagaattttgcagacaattcagtcagatcaacaaaatatactcttgccactttctttcccaaatctttgtttgaacagtttaggagagcggcaaacttctattttttggtcactggcaccttggccttcacaaaacttgctccatacactgctgtcagtgctatccttccactgattattgttattggggcaaccatggtgaaagaaggtattgaagacttgtgccggaaaaaacaggatattgaggtgaacaatagaagagttaaagtgcataaagctgatggtatttttgaatatactgcatggaagaatgtgagggtggggaatatagtgaaggttgagaaggatgaattcttcccagctgacctcctgttactatcatccagttatgacgatgcagtttgctatgttgagaccatgaacttggatggggagacaaatttaaagttaaaacaagggttagaggtaacttcttccttacaggaggatctccatttcctaaattttaaagctacagtgaaatgtgaagatccaaatgcaaatttgtactcatttgttgggagcatggactttgaagagaaaaataatgccctttctcctcagcaacttcttctccgcgactctaaacttcgtaatacagactatatttttggagctgtcattttcactggtcatgacactaaggttattcaaaattctactgacccaccttcaaaaagaagcagaattgaaaagaagatggacagagtcatctatttcttgttttgcattttattcctaatggcatttgttggatctattttctttggcattgcaactaaagatgactttcaaaatgggttgatgaaaagatggtatttaacaccagatgattctactgttttctttgatccaaaaagaccagctgctgctgctttatttcattgtttgacagccttaatgttatatgggttttttattcccatctctttgtatgtgtcaatagaaattgtcaaagtccttcagagcattttcatcaatcaagatatccatatgtactacagggaagcagacaaaccagctcgagctcgtacttcaaacttgaatgaggagcttggccaagttgatacaatactttctgataagactggaactcttacctgcaactcaatggagttcattaaatgttcaattgctggggtagcttatggccgtggtgctacagaggttgagaaggccatggatagaagaaaaggttcaccatcaattcatgagcatgatattgaatcagaagcagataacattaggggttcgctagataaaagggcactcattaaaggttttaactttgctgatgaaagaataacaaatggaaattgggttaatgagcctcatgcagatgttatccagaagttttttcgcctattggtggtctgtcatacagccataccagaagtggatgaagagacaggtaatgtctcatatgaggctgaatccccagatgaagcagcatttgtgattgcagcaagagaacttggttttgaattttacaaaaggggtcagactagtttattgacatatgagttggatccagtttcttgcaagaaagttgaaaggaagtacaagcttctcaattgtttagaattcaatagctcaaggaagcgaatgtcagtgatagtggaagatgaagaagggaaaattttgcttctctgcaaaggtgcagacagcatcatgtttgaaaggcttgccaagaatgggagggagtttgaagagaaaaccatggagcatgtgcatgagtatgctgatgcaggtctacgaacccttatactagcctatcgtgaacttgatgcagaagaatacaaggagtttgataataaattctctatggcaaagaatttagttagtgctgatcaggatatactgattgaggaagtatcggaaaagattgagaagaacctaattcttcttggtgccactgctgtagaggacaagctccaagatggggttcctgaatgcattgacaagcttgcccgagcaggaattaaaatttgggttttgacaggggataaaatggagactgcaatcaatattggtttgcttagacaaggaatgaagcagattataattcatttggatagtccagaaattcaagcactagagaaggatggagacaagatggctattgcaaaggcatcaaggcaaagtgtactccttcagatatctgatggtgctgcacaactcactgcatacagagggagctctcatcaggcctttgctctgattattgatggaaaatcacttgcttatgcattagaagataatatgaagaacatgtttctggagcttgcgattcgctgtgcatctgttatttgctgtcgctcatcaccaaagcagaaggcaatggtcactagattggtcaaatctggagccaggaaaacaacattagctattggtgatggagctaacgatgtgggaatgcttcaagaagcagatataggggttggtataagtggtgttgaaggaatgcaggcagttatgtctagtgatattgcaattgcacaattccggtatttggaacggttacttctggtgcatggacattggtgttaccggaggatctcatctatgatatgctattttttctacaagaatatcacatttggttttactctattcttatatgaggtgtatgcatcattctctggacaagctgcatacaacgactggtttttgtctctctataatgttttcttttcgtcacttcctgtgattgcacttggggtatttgatcaggatgtatccgctcggtactgcctgaagtttcctttgttatatcaagaaggagtacagaatgttcttttcagttggcgtcgaatactcagctggatgcttaatggatttatcagtgccttaataattttcttcttctgcacaaaagcgatggagctccaggccttcgatgtggaggggagaactgctggaaaggatatactgggagcagcaatgtatacttgtgtagtttgggttgtaaacctgcaaatggcactagctgtaagttacttcaccatgatccaacattttttcatctggggttccattcttttgtggtatctttttctcgtggtatatggagcaatgcccccacacttttccacaaatgcttacaaagtcttcattgaagctcttgctccatccccttcctattggattgtgacactctttgtggtgatctccacccttataccatacttctcatacgcagcaattcggatgcggttctttcccatgtatcatgaaacagtgcaatggataaggtatgaagggaagattaaggatcctgagtttttgtcggttcaacagcacgcatag

SEQ ID NO: 72920 - DNA, 861 bp, Glycine max
  Peptide Sequence Number=SeqID_189698
atgctgctgggatcttctgacaaaagtgcagttagcatcatgcatcaatatcttgaaccattttacaaaaccacaaacaacatctgcacaagtaaggtgccaatggttgggcttgtccttttcttcgtggatcacatttcagaaacaattacttccttcagagaatcacggctcagcccagaatggctaaaaaatgctgcagaagaaatggctaaaaaagccagaaattatattaatcaagtttgcaacatatttacttatatgacagcaattcttgatcctcgaataaagggagacctgatccctgatagtttaaactcagaaaactttctggatgaagcaagaacccattttataagaaattattcagccagccatttctcatccatgagttctggatacaatgctcaagaaattgaagatggaggaagtgtttcctttgctgaggaaatagcacgcaagaagcgaaggacaagcatgagctctgccactgatgagcttacgcagtacctatcagaggctccagctccaataccaacagatgtcttagagtggtggaaggtcaacagtacacgctaccctcgactatctgtgatggctagagatttcctggctgtgcaggcaacttcagttgtgcctgaagaacttttctgtggcaagggtgatgaaattgacaagcaaagaatctgtatgtcacatgatagcacacaagctattctttgtatcaagtcatggattcaggttggcatcaagtttaagtttaaatcaactgagatagattatgagcggttgatggaattggcagctgcagctgctgcaacagacaatagtccttcaagttctgacaagaagcaaagatag

SEQ ID NO: 72921 - DNA, 1599 bp, Glycine max
  Peptide Sequence Number=SeqID_189699
atggatgcaccacgtgtctctcgagcaatcggcgaccccaaaatccgccgcgttggtttcttcgcttcagattcttccgccaccgattctctcatgatcccgtcgccacgtcatcgctccattccggttccgccgacgcacccttccggagatcgccacgtggcatccgggagctacgatcccacggaatacccaaaactcgctactggcattgaaaagagaggggaggaagaggaagagaaagaggttctgcaatcaagcttaaagccgttgaaagcaaaaactaccaaggctgagagacgggccttgcaggaggcacagagagctgctaaagctgcttctaaagacgagggaagtaaagcagttgctgaatctggtcgaggcaccccaggtaaaagtacaaagcagtcttcacaaaagaaaggtggtccttcctgtgtgtctccagtggccactgataagaatgcaggaaatcgtcctctggataaagataggaaaatggatgctccttctccgcgaatgcaatttgatgacaaaagccgattggaaaaggctagaagatgtgcagtagtcaatccaactgaatctagaaacaaagttgaattatttcagcatttgcctcagtatgaatacggaactcagcttcctaatcttgaatcaaagtttttccaaattggttcagtgcatcctgctgtatttgaggttggactgcgttattcagcaggagatatatcagggggtaatgctcgttgtattgcaatgctaagagcatttcaagatgccattagagattactgcacaccacatgaaaaggtccttgttagggatttagcttcaaaaatcagtagttatgtatctttctttactgaatgtagaccactttctatgagcatgggaaatgcaattaggtttgtaaagagtcgtattgtcaatctgactttaaatcattcggagtttgaggcaaaaacaaccctgtgttctgatattgaccggttcataaatgaaaaaataattcttgctgataaggtgattgtccgacatgcttttacaaaggttaaggatggggatgttcttctcacatatggattgtcatgtgttgttgagatgattcttttatatgcctatgagcaaggtaaaaagttccgtgtggtggtggtagattcacgacctaggcttgaaggtcaggccttacttcgtaggctagtggctaagggcctgagttgcacatatactcatataaatgctgtttcttatatcatgcatgaggtcacacgggttcttctgggagcttctgcagttttgtctaatggaactgtatattcaagggttgggacttcttgtgttgcaatggtcgctcatgcctttcatgttcctgtattgatctgttgtgaagcatataaatttcatgaaagggtgcaactggattcaatatgttctaatgaactaggtgacccagatgctattgccagggttcctggacgaatggatgtcagttatcttagcaattgggccagtgaagataatttgaggcttttgaatttgatgtatgatgctactccttcagattatgtctcggttattgtgacagattatggcatg

SEQ ID NO: 72922 - DNA, 270 bp, Glycine max
  Peptide Sequence Number=SeqID_189700
atggagattcttccactatacaaaatgatagtagggttacaaggatgtgtttacaaaattgactcattctatggtggctcacttaagcttgaggatagagaccttccaagctatttatcttctctctcaaagaggctctttctcactctaagaagtggattcactcttttgtcttggattgactcactctacggtggctcactcaaacttgaggatagagacttcccaagctatttatcttctctctcagagaggcttactcatgcttga

SEQ ID NO: 72923 - DNA, 555 bp, Glycine max
  Peptide Sequence Number=SeqID_189701
atggccaaagcagtgatgatgcaaccacaaataatagtcatccaacaaaggtttgttgctgattatccacaatggaagacaattgatcagttgtatccggaatttggaaaggatccaagaaacctaaggcttggtcttgtttcagacggaatgaatccttttgcgggtccaagacagcaaggaaatgatatagatgtgtacttgactctgttgattgaagacttgagaaaattgtgggttgacggggttgatgtgtatgatgggagtcttaaaaaaaccttcaggttacgtacaatgatattttgcaccattaatgactttccagcttatgagaatttaagcagatatagtgtgaaaggacaccacgcatgtcctatttgtgagaaaaacacaagttacatccaactggaacatggaaagaagacagtatatacaagacaccgaagattttttaaaccttatcacccgtatcggcgattgaagaaagcatttaatggagagaatgagattgaaagtgcgcctaaacccttagggggacacgaagtttatgattag

SEQ ID NO: 72924 - DNA, 267 bp, Glycine max
  Peptide Sequence Number=SeqID_189702
atgtctgatttaacatcaaaatgggcacttgcagccgacaaggacaatttcaatgacatagatttgcggaaaaaggaacaggccatccacaagcaaaacacttcctcctacgtgttgcctcgtggaggttatgaatatttagaaaagaagttgatggatgagaagacaaagaaaaaactagagaaagctgctcaatccagaagtactaacaccgtgattgatcctccatctcccatcaaaaaacacgtcaaatggaagatggcttga

SEQ ID NO: 72925 - DNA, 523 bp, Glycine max
  Peptide Sequence Number=SeqID_189703
cgtgttcgcgtttagtgaaagattttcagagactattgcagtctcctttgccatcaagagacaagcaagtctgttggcacgtagagacaaattatggtcatctgcctccttttttaagacttccatgtctttcggtccagactattacaatctcctttgccatccagagacaatcgagtccgttggcacgcagagacaaattatggtcatctgcccccttttcgaagacttccatgcctttcgagacaaattatggtcatctgccccctttttgaagacttccatgtctttcgatcgagactattacagtctcctttgccatccagagataagcgagtctgttggcacccagagacaaattatggtcatttgcccccttttcgaagacttccatgtctttcgatcaagactattgcagtctcctttgccatccagagacaagcgagtccgttggtatgcggtgactatcattgtcatccgattcattgttttcaagactattgcagtctcctttgccatctag

SEQ ID NO: 72926 - DNA, 335 bp, Glycine max
  Peptide Sequence Number=SeqID_189704
gcccttcatacatttgtagcttggcccacagaccttgttaaacttgtattcgatgaggatgaagaaattattccgcacaaagtggatgcacatggagataagccggctaatgtggacacagatgatccaatgcgtgggctgataaagtacaactttgatatttacgacaagccagtggaatgcaaatttgatgggagcaaatttggaatcgcagatgcacctccattgatattcctaacatattctgatgagacatgtggtgaatgcaaaggatatcttgaaagatggctgaaggaatctgaccgagaggtgtacgttggaccttacttccatca

SEQ ID NO: 72927 - DNA, 757 bp, Glycine max
  Peptide Sequence Number=SeqID_189705
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggggattgcggcccgatacatatccatgccgctctgcacggggagatgccggacgctgaaacccgtgatgacggtctcgtaagctacgcctcgcgcggtatgtgcctgcggatcgaagaagacttccgcgtggtggacgttgtcaagatgggcgcgctggaagtatgcccagccgagggcttcgaagtcgtcgggcgtgatgagtacggacatgccgatgaagtagtaatgcaggaagtcgtccagggaggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 72928 - DNA, 762 bp, Glycine max
  Peptide Sequence Number=SeqID_189706
gttaaaagtctagatgtcactagcctcaaggaattgggacgattgatgggacctctccaaaggcaagccttccacaaagtgtacgggaagattctagatttgaccgcagcggaggtatttacggaagctgtcgtatccctcgcccaatactatgaccagccgttgatgtgtttcacgtttggggacttccaaatgattgtagctgtggttggagattcagcaaaagagttggatcgcatgaagcaaactcggaacggcgtagtgggcctgcctcggaaatacttgaaaggcaaggcaagggatatggcgagccaagagaagtggggcccgtttgcagatattttagctttgctgatttttggggttgtcctctttccgaacgttgacggtttggtaaacttagccgccattgatgctttcctcgcatataaccatagcaaggaaagtccagtggtggctatcttggcagatttgtttgacacctttgaccggaggaagagtcgattgggaccaacatttggctgggatagggggcagcgcgatcaattggtttcctcgttggaaggaaggcaaggaaggagttcttttgtcgtgtggggactagggaaggcaagactcgccaaggagaagttcaaagcagctgctacacacatccggaaagagtgcaccgagttacaagagaaaaacgcggccactgcaagagcccttgaacaagaaaccaaaagggtccgcaaggaggaatacggccgagagaaattctga

SEQ ID NO: 72929 - DNA, 192 bp, Glycine max
  Peptide Sequence Number=SeqID_189707
atgggggcatattctaaggacgaaaagctgttaatgcacttcattcaagacagcttagccggagcagtagtggcgtggaaaccacattacaagcgaaacctcaaagagagttgggcttcgtcctcaaaaagaaacaacaccagaaaatctagccttccatggattcaaacagaaaacgcaaatgaaacatga

SEQ ID NO: 72930 - DNA, 1107 bp, Glycine max
  Peptide Sequence Number=SeqID_189708
gtacttcacgccctcgcctttagaggactacacgtcctcaccttcagaggactagacgccaacgccttcaggggactacacgtcctcacctttagagggctacacgccctcgctttcaaacggctacatgccctcgcctttaaaggactagacatcctcgccttcagagggttacacgtcctcgccttcagaggactacacgtcctcgccttcagagggctacacgccctccccatcagagggctacacgtcctcaccttcagaggactacacgtcctcgccttcaaagggttgcccgccctcgccttcagaggactacacgtcctcgccttcagaggactacacgtcctccccatcagagaactgcacgtcctcgccatcagaggactacacatcctcgcctttagaggacttcacgtcgtcaccttcaaagggctacacaccttcgccttcgaagggctacacgccctcaccttcaaagggctacacgtccttgcctttagaggactacacgtcctcgccttcagagggctgcaagacctcacctttagaggactacacgtcctcaccttaagaggactacacgcccttgccttcagaggactagacgtcctcacctttagagggctactcgccctaaccttcaaagggctacatgtcttcgccttcagaggaagggctacttgccctcaccatcagagggctacacgtcctcacgttcagagaactacacgtcctcaccttcaaagggctgcacgcccttgcctttattggactacacgtccacgccttcagaggactacacgtcctcgccttcagaggactacacgtcctccctatcagggaactgcacgtcctcgccatcagaggactacacgccctcgcctacagaggactacacgtccttgccttcatagggctgcacgccctcaccctcaaaggactacacgtcctcgccttctgaggactacacctcctcaccttcagaggactacacatcctcaccttccgacggctacacgcccttgccttcagaggacaacacgtcctcacattcagaggactacacgcccttgccttcagaggactagacgtcctcacctttag

SEQ ID NO: 72931 - DNA, 162 bp, Glycine max
  Peptide Sequence Number=SeqID_189709
atggggatgagattgatgttaatggtgaacaagcaaggtcagactcgacttgcacagtattatgagcacctcatcatccaagaaagccaagcccttgaaggcaaaatccttcataaatgcctcgcccgtaatgacaaccagattttgaatgtttgcacctaa

SEQ ID NO: 72932 - DNA, 249 bp, Glycine max
  Peptide Sequence Number=SeqID_189710
atgatcaaaggcattagattcaagtatccaagtgccaagagtggaggtctaggatacaaaggctacgagatgactagactaggtcatgatagtaacaggcaagacatgtttgttgggttgctcaaaatcagaggaaatttgtatactcaagaggcaaaaatagtcacatttggaggtggagctgaaggacttttgttggttgttttgatcaatttgtcacacgaaattagcaaagcggaacattggtga

SEQ ID NO: 72933 - DNA, 819 bp, Glycine max
  Peptide Sequence Number=SeqID_189711
atggacgggcacattgatgtggccctggtcaaggagttctactcgaacctgtataaccctaaagacaaatcaccaaaacaggttcaagttaggaggaagctgattaagttcgatgcggcatcactgaatgcctttctggagacaccaccactcattcagccaggggagcagagcaccctggaagctcttgaggaaggatctgactacactagcccagacctggagtgtggcgaggttagtctatgggctagttttgaagatggacatggatgtgggcttcctcatatcacaccagatttctcagatggcctagtccaactcctcgcggctcggcttcccagccctcatcaccgccttatgcatcgcccaaggagttatctcggattctctaactttcgagcacgggctcgaggatctgaaggcccatcttcgtctgctcctgctcttgcttctacttctgctcatgcctccagtgatccaactacctctacttctcatccaccatcatcagttccagcaccctctggcacctctgctcagagcttagacctcacagtgccgatgctgcagagcctccaccatggcttacgcctggtgatgcagagtatccacgatttggctcagcatcaacccatcatgagcatggaggagttcacaactcaggtggcctggccaggagtccaaccttctcctttgaggggaggtgaggcctctgcagcccaggagcctcattcacagccagaggtctctgaggaggaggagaatggcgctgctgatttggattatgtagctgatatgaccgcagcacagagcacctag

SEQ ID NO: 72934 - DNA, 300 bp, Glycine max
  Peptide Sequence Number=SeqID_189712
atgagcaagaaaccgaaagatggcagtgaaagtgatggcgtgagagtggtgagagttgtgagtgatgatggtgaccaaggaggacagtcgcgagtcacattggtgagagtcgtgagttgctctggtgaaaggggggttggggagagagccattcttgtgtcaccacctctcaacggtgacaatttccattcatggagccatgctatgcgacgagctctcttaaccaagaataaacacaagttcaaagatgaaaccatcaccacccctattaacaaaggtgaccctctctttgatacttag

SEQ ID NO: 72935 - DNA, 219 bp, Glycine max
  Peptide Sequence Number=SeqID_189713
atgcctgcgacagaactattgctgttgttcttgctaaggctgaggttgaggttgaacttaaggcgatggcagtggcggcagagagtgagagggagaggaagaaacgagagagtcaaaattaaagggagatttcattttgatcaaagcaaggttaggtcagaaataagattgcatgaagggcgtgccagacccatcgatctcaatggctctgatgattag

SEQ ID NO: 72936 - DNA, 249 bp, Glycine max
  Peptide Sequence Number=SeqID_189714
atggttgattatgagggtgatgaggaagactggtgcctattgcatctagggacacttcatgatgtggaattaggtgacaccaatatgaatgtgcctaaatctctagtgattcatttcactagaaatgctaccacctatatgcctcaaggcttctaccctattgttttgaaggccccatcatcattcccgtatgagagtaacaaaatagtgttgtggagatatgatgcgcaagtatcagagggaggatag

SEQ ID NO: 72937 - DNA, 318 bp, Glycine max
  Peptide Sequence Number=SeqID_189715
atggagatagtgaaggattatattgcaacccctaaaccaaatggctaccagagtcttcagaccactgtgattccatttttgtatgagagaatgtttaggctagaagtccagcatttttacattggttctgacatgaccgatgtagaaatgctaaccattctaagacggtcgcgtgtgaaagaccgtcttagaatgctcagcattttacatcggttattcaatgaccgtcgtagaaaacttagcattctacatcagtcttgcaattgtgaccgtcatagaatgctgaattttctacatcggtcacaactgaaggactga

SEQ ID NO: 72938 - DNA, 634 bp, Glycine max
  Peptide Sequence Number=SeqID_189716
tcggtgtgaactcagcgagtggcaccgagtctggaccggagcaagaacagactgagttcctggccggggcactcgtcggggttgatgagatgaaacgattcggagtcggcgttacccaccacgtgctcgaaattggcgcgcatatacatgagctcctcggaggaggcggcggaggcggaggcgaagccggaggggatgacgccggcaccgacggagacgcactgcatggtgcggaggatgttgcggacgcggtctccggcgcggcggcgggcggcgaagccggtcttcttgccgttgcaaaaggcagtccagagggggacggagcggagggggctggcgttggtggctgcggagcactcaagggcgatgcggacgacgccgttccgcatttctcggacgagaaccacacgtggccgcggcggttaccgaagatggttccgatcaccatcgacttcgagggacgcggcggagccgtcgaagcagcggtggaagatgacgtcgaagaagctggcgaggaaggggatggtggattgaggcttggaagggaagaaacatggaagaaagaaccgacggagggcgtcgatggtcattttggtggtgggtgtgatcttgttgatcatgtgagtgcatgctg

SEQ ID NO: 72939 - DNA, 597 bp, Glycine max
  Peptide Sequence Number=SeqID_189717
atgaataatttgtttggtgatgttggggatgataaccaagatgctgaggaggaggatggagaatctgatgatgatgattttgttgttgttgatgatgaaagcgatccagattttggcatcgatgttttatgtgagaatgatggtgacttatttgatacaagtaattacaattatgaatttgagtcaatgaggtctctacctagtagtgatgatgaaggtggcagcattagaaaaatggtgtaccctcaatttgatacatctagccgttttaggcatggaggtcaaatgggtaaaaatataagaggtaaaacatgttgcaaagtcaagggttgtccatgggagatctattgtgcatggaacaaagctacaaaaagctttcaactaaaaacatttgttaaggaacacaattgtggtagcattttcaagaacaaccaagctaataggaaatgggtggcaaaaaatctatctgagaagctaaaaatacatcctactctaactcatcatgagacacatgagtacatgaagattgagtttggtgtcaccatagatgagaggaagatgtgtagggcacttcaaaaagcaaaaaagcatggttga

SEQ ID NO: 72940 - DNA, 162 bp, Glycine max
  Peptide Sequence Number=SeqID_189718
atggaagttatcaagttgattaaactggtttgggttggtgataaggaagagaaccagcagagccagagaagggctgcatcaccttgcatgccacaactaataagattgcttagcttcatggaaacgaaacacttcattccaccaggaatagataccacctga

SEQ ID NO: 72941 - DNA, 1140 bp, Glycine max
  Peptide Sequence Number=SeqID_189719
atggaagcagcacgagtgggtgtggcggttgaaggtgggcatggaaacaaatcaaacaatgtgaaaatgttgcagcagccgaagaatcagcaagcgcaaatgggaaccgtgtctcagcttctagcgggtggattagccggtgctttcgccaagacctgcactgctccacttgcacgcctcacaatcctttttcagtcgtggatgcagaactgcctgcatggtatgcattttgatgtggcggcattgagcaagcctagcatttggggtgaggcttcacgtattgtcaatgaagaaggatttagagcattttggaaaggcaatttggtgaccatagcccatcgtcttccttattcttcagtgagcttctatgcttatgaacgctacaagaatctattgcatatgcttctgagggagaagcatagaggaaatacaagtgcagatcactttgtgcactttgtaggtggtggtttgtctggcataacggctgctacggctacatatcccttggatttagtgagaacacgacttgcagcacagagaagttccatgtactacaggggcatctcacatgcttttactaccatttgcagagacgaagggttcttgggtctctacaaaggacttggagctacattgttgggtgttgggcccaatatagctataagcttttcagtttatgagagcctacgttcttgttggcaatcccgaaggccggatgattctactgtcatgatcagtcttgcttgtggcagtctttcaggagttgcatcatcaacagatagtggtggaggtggttatggtggcaatgacaatagtaatgatggtgatgctggtggtgatggctgcattgaccattgtttgtggtggcggtgggtaaggcagttgaacagtgatggcagtgcaacattccctttggatcttgtaaggcgcaggaagcagttggagggtgctggtggtcgagcacgtgtctacaataccagtttgtttgggacattcaagcacataattcagaatgaaggggtacgaggcttgtatagaggtattttgcctgagtactacaaggttgttccaagcctgggcattgtctttatgacatatgagacattgaagatgcttctatcaagcattccaagagattag

SEQ ID NO: 72942 - DNA, 642 bp, Glycine max
  Peptide Sequence Number=SeqID_189720
atggcagaactagcaaccagtcaaggaaccgatgtgagccaactcattagaccaccaaacatcggggacaaccaaatcaatttcccttcatgggtccacaacaacctcaaccacaaccaattcatgggagcaagcaccaaggaccccatgctcatctcacaagatttctacaattatgctgcaaccgattggctcaacttgcacctacatcattcgctaaccacatgggaggaagtcatggacaaattcttcaatcacttcttccccgagtctagagttaaagctatcaaggaacacattgtcaacttcaaacaagctccaaccgaattgctatttgacacatgggagagatataaagcccttctaaggagaatcaccaacggttgtaggaggatgatcaatgcatcggtcggaggaaactaccccaataaaaccaccactaaagtgaaaaccataattgaagatatggcggctagtgagagaatcgtagaaacaaaccggtcaaatcttccaaaaggtatgtatgaacttaatgctcaagataaccttttagctcttcaacaaaagatgcagcaagttaaggatatagaggaaaggatgaaccttcatgagaaccgctcatgtaaccatcgatgttcgtaa

SEQ ID NO: 72943 - DNA, 350 bp, Glycine max
  Peptide Sequence Number=SeqID_189721
atggcgttgctccatctctgcaatgcaggtttagagttgttggaaagtatcagtatctgtcatggtcgttgggggaggattgaatccttcgaatggggtctcgcatctgaggctagaccatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 72944 - DNA, 381 bp, Glycine max
  Peptide Sequence Number=SeqID_189722
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataaagggtgtcaacgagtagccctcccttcaggacggtgtatgtgggagagactaggatcatcttgggtgttgacgtttgttaggggtgtgatttcccttgattacgctcaaacattgtatgagtag

SEQ ID NO: 72945 - DNA, 198 bp, Glycine max
  Peptide Sequence Number=SeqID_189723
cctgcagagccagggttttacttcctttccatgccctactccggatcagttcatggcaaaggtcacatggcccggagattggctgaggcccgggcaggagaggcaccagcagaggctcccgacgaggcagatgagacccgtgaggacgaggagatgaccgatttgcttgatttcttgggatggagcagagccacatga

SEQ ID NO: 72946 - DNA, 159 bp, Glycine max
  Peptide Sequence Number=SeqID_189724
atggactcatccagtgtagccaaacattatcaagatgcaaccacattggcttgcacctggcacctagcaatgagttcatccatcaataaaggggtcactatgggctggcccgatgagccaccaggcctatatggacttcaaaaaataaggctcatatag

SEQ ID NO: 72947 - DNA, 330 bp, Glycine max
  Peptide Sequence Number=SeqID_189725
atgactgttatgggaaactcatcaaagaaagagtgtgcccccactgttgaagcttctcaaggaaggaagaatggacagtcaggaaaacgctaccagagccatcagggagaacaacttcattggaagcattcctcagagtttggggaaaattggaagaaggggagaaggggaagaaggagaaggagaagggggttggactatgttgtggtggcggttgatggtggaggtggtggtttccgttggagaaggggaagagaagaaggagaaggggttggacagagcggtggtggtgtggcacggttgacggcaatggtagcgtggcgtggttga

SEQ ID NO: 72948 - DNA, 919 bp, Glycine max
  Peptide Sequence Number=SeqID_189726
gtctgtccctgccattgacgggctagctgctgggacaggactaagtcctctaatcgcgtgttcggtagagattggcgatcggggacttttgtcatcgtttgtcgagcggtggcaccgggagacgtctagtttccatctccctacgggagaggtgacgatcatgctggacgacgtctcgtctcttctgcattttcccgggaggctgccagggctgagacagggcagtgtcgtggaccgtacgtatgcctacaatgggtatgtgatatttatgagcgccgatgccatgcaagtcattggacagttgcggctcgtgcgtatcttcttcatcttctgggttggactctgtttgctaacaagagtgcaaccaatgttcatgttgtgcttttggaggcccttcgtgacctcagtcagaccgggagtcgcgaagtccactgctgatccagactacgacgaggggattcaccgcatgcctgtagggagcgcttggaccgactccggattccggatgtctgttggatcctatatggggagcaccgaccgggtcatgcagctgtttggatacacccagactattcctgctctgcctgtcaattcatgggtgtcgtatgatgatatacacgataggtggatgcactattcggatcatatggttgcagcaggtgaggtgtgcgctgtgccagatcctctgccagatggtcatgctttgcagccccgagtcatccctcaggtcccagagacaaatatccctcacgtgccaaagccaggagcaccatcgatatctgcgaggcccgctgtggatgagcctggacatgcagtggaagtttgctatgggattgctgagaggttggagcgccatctgagcctaggggtggtcatgccaggctcatcgaaatttcacagccaattaacacaaatgtag

SEQ ID NO: 72949 - DNA, 2031 bp, Glycine max
  Peptide Sequence Number=SeqID_189727
atggccacattagtcgctgaaaacctggcgaaagcctacaaaggccgtcgcgtagtagaagatgtcagcctgcaggtgaaatccggcgagattgtcggcctgctgggccccaacggggccggtaaaaccaccaccttctatatggtggtcggcatcgtgccgcgtgatgccggccgcatcatcattgatgaagaagatatcagtattctgccgctgcatgcgcgcgcgcggcgcggcatcggttatctgccgcaggaagcgtcgatctttcgccgtctgagcgtctacgacaacctgatggcggtactgcaggtgcgtgacgacctgacggaagagcagcgtcaggatcgcgccaatgagctgatggacgagttccacatcggtcatctgcgcgacagcatgggccaggcgctgtcgggcggtgaacgtcgccgcgtcgagattgcccgtgcgctggccgccaatccaaagtttatcctgctggatgaaccttttgccggcgttgaccccatctccgttatcgatatcaaaaagatcatcgaacacctgcgtgacagcggcctcggcgtgctgatcaccgaccacaacgtgcgtgaaacgctcgcggtgtgtgagcgcgcatatatcgtcagccagggccatctgattgcccacggcacgccagatgaaattcttgcagatgagcagcaaggtttgcaactcaggctcagccaacagctggcgatgaccccccagttgcagcaggcaatccgcttgctgcaactctctacgcttgaactccagcaggaactgcaactggcgctggaaagcaatccgctgcttgaacaaaccgatctgcacgatgaagtcgatgcccgcgaatttcaggagaacgaggcgttagatacccgtgaggcactcgaacagaaagagatgccggaagagctgccgctcgatgccacctgggacgagatctacacggccggtacgccctccggcaccggcaccgattaccaggacgacgagctgccggtgtatcagggtgaaaccacgcagtcgctgcaggactatctgatgtggcaggtagaactgacgccgttcaccgacaccgaccgcgccatcgctacctccatcgtcgatgccatcgacgataccggttatctcaccgtcagcttacaggacatttgtgacagtattggtgacgaagagctgacgctggaagaggtggaagcggtgctgaagcgcgtacagcgtttcgatccggtgggcgtcggcgcacgcgatctgcgtgactgcctgctggtgcagctgtcgcagtatgcggccgatatgccgatgctgaacgaagcacggctgatcgtcagcgagcatctcgacctgctggctaaccacgatttccgcagcctgatgcgcgtgacgcggctgaaagaagaggtgctgaaggaagcgatgctgctgattcagtcgctcgatccgcgccccgggcaatcgatcaataccagcgagcccgagtatgtgattcccgatgtgctggtgcgcaagactggcacgcgctggacggtggagctgaacgctgacagcctgccgcgcctgaagattaatcagcattacgccgcgatgggcggttctgcgcgtaatgacagtgacagtcagtttattcgcagcaacttacaggaagcccgctggctgattaagagcctggagagccgcaacgacacgctgcttaaagtgacgcgctgtattgtcgaacagcagcaggcgttttttgaacagggtgaagagtatatgcgtccgatggtgctggcggatatcgcccaggccgtggatatgcatgaatccaccatttcccgcgtcaccacgcaaaagtatttgcacagcccgcgtggcatttttgaactgaagtattttttctccagtcacgtcagcaccgaaggcggtggcgaagcctcgtcgacggcgatccgtgcactgggcatcatggtggcgcgacgtacggttgctaagtatcgcgagtctttatctataccgccatcaaaccagcgcaagcagctg

SEQ ID NO: 72950 - DNA, 796 bp, Glycine max
  Peptide Sequence Number=SeqID_189728
cagatgctgctgctggccgggttggcgttcgccgcgatggggttgctgccgctggatgtggacgacctgcacgggccggccagccagctgcatgccagcgcctggatgatctgggtgctgggttttgtcgccgggaccttgttgctgggcacgtcgcaggtgcgccaggcgcatgggcgcgcgctgggcgccgtggcgctcgcctgtggcgtgctggccgcgctggcggcgtttgccctgcagggcgtgctgccggcgccgctggcacaacggcttgcgttcgcctgctgggcggcttggctggtcctggccctgccgttgtcgcggccacgctgagactggccgcgggcgctggcggagcctgccttgagccggcaggattggagacgtttgccgcactgcgcaggttgaatccgccgcccagcagtactgggacgccacccgtgcacttcgaagtcgacgagacttcggacaagccgaagtactactgcctgtcgatgcttccgtacccgtccggtgcgctgcacatgggccatgtgcgcaattacacgattggcgacgtgatcagccgctacaagcgcatgacgggtcataacgtgctgcagccgatgggctgggacgcgttcggcttgccggcggaaaacgccgcgatcaagaacaagaccgcgccggcggcgtggacctacaagaacatcgaccacatgcgcagccagctgaagtcgctgggctatgccatcgactggtcgcgcgagttcgccacctgccgcccggactattacgtccacgagcagcgcat

SEQ ID NO: 72951 - DNA, 846 bp, Glycine max
  Peptide Sequence Number=SeqID_189729
atgccgtggccgctgcggcggcctttgtgtcaaggttctaaacagcaaaacggcaaatcagccgctttgttcagatggtcaggtggcgggggcaaggcgcgtgacaacgcccatttcgtcgctttcgcgcacctgcttcagatgttcttcggccgcagttgcctcgcgctggcggttccacatcgaggcgtagaggccgttcttggcaagcagttcgccatgcgtgccgcgctcggcgatctcgccgctcttcagcacgatgatctcgtcggcgccgatgacggtcgacaggcggtgggcgatgaccagcgtggtgcggttcttcgacacggcatcgagcgcggcctggatttcgccttcggtcgtggtgtcgagcgccgatgtcgcctcgtccaggatcaggatcggcggcgccttcaggatggtgcgggcgatcgccacgcgctgcttctcgccgccggagagtttgaggccgcgctcgccgaccttggtctcgaagccttccggcagcagctcgatgaaatgggcgatctgggcgatttcggcggccgtcttcacgtctgcctcgctggccgacgggcggccgtagcggatgttgtaggcgaccgtgtcgttgaaaagcacggtatcctgcggaaccatgccgatcgccgttcgcaggctcttctgcgtcagtccgcggatatcctggccgtcgacggtgatcgccccgctctggatatcgtagaagcggtagagcaggcgcgacagcgtcgacttgccggccccggacgggccgacgacggcgacggtcttgccggcgggcacgtcgaaggagatgccattcaggatcgggcgcgccggatc

SEQ ID NO: 72952 - DNA, 1209 bp, Glycine max
  misc_feature (10)..(10): n is a, c, g, or t
  Peptide Sequence Number=SeqID_189730
tagcagtggncggtaaagttgctttgttacctattccgttaggaactgcggattttttggtccatcatattcaggcatttacaattcatgtaacagtattgatactcctaaagggtgttctatttgctcgtagttcacgattaataccggataaagcaaatctaggttttcgttttccttgtgatggacctggaagaggggggacatgccaagtatccgcttgggatcatgtcttcttaggactattttggatgtacaattccatttcggtagtaatattccatttcagttggaaaatgcagtcagatgtttggggtagtataagtgatcaagggatagtaaatcatatcacaggaggaaattttgcgcagagttccattaccattaatgggtggctccgtgatttcttatgggcacaggcatcccaggtaattcagtcttatggttcttcattatctgcatatggtctttttttcttgggtgcacattttgtatgggcttttagtttaatgtttctattcagcgggcgtggttattggcaagaacttattgaatccattgtttgggctcataataaattaaaagttgctcctgctactcagcctagagccttgagcattgtacaaggacgtgctgtaggagtaacacattaccttctaggcttagctcaagaccccactactcgtcgtatttggtttggtattgctaccgcacatgacttcgaaagtcatgatgatattactgaggaacgtctttatcagaatatttttgcttctcatttcgggcaattagcaataatttttctgtggacttccgggaatctgtttcatgtagcttggcaagggaattttgaagcatgggtacaggatcctttacatgtaagacctatagctcatgcaatttgggatcctcattttggtcaaccggctgtagaagcttttactcgaggaggtgctctaggcccagttaatatagcctattctgggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaa

SEQ ID NO: 72953 - DNA, 2653 bp, Glycine max
  Peptide Sequence Number=SeqID_189731
cgcgggagcaaagtggaaaatcagccggcggaaggcgcaccacaccagcgcataggccagcagggccagcgtcagcttgccccagccaacctgctgataatcgatgcggcgctgctgatcgcgcagccagcggaagctcagcatgccaaacgcggtgagaatcaccagtaccacataaaaaactgcggcagggtaatgagcggcactgcggttaacagcggaatgccgacgcgctccagccgcaccttcagccagcgcaccgtcagccacagtgaggcgtcctggctgttaaccgaccagcgttgggtcgatttacttgccggtttcaccctgaaaccggattatgccggacgaaattctaccggctgtaaacagcgtatactatcagtgaagaataatggcgggctggtgaagatgcgctgggtaggcgcagcagttctgctggcgttgtacgccaacaatagctgggcgttcaacattgatgatgtggcaaagcaagctaaggcgctggcagggaaaggttttgaagcgccaaaaagcaatttaccctctcagtttcgtgaaatgaagtttgctgactatcagcagatccagtttaaccacgacaaagcatactggggcaaactgcgcacgccgtttaagctcgagttctatcatcagggcatgtatttcgacacgccggtgaaaatcaatgaagtcaccgcgtcttcggtacgtgaaatcaaatataaccctgactacttcaatttcggcaacgtgaaacacgatgccgatgcggtgaaaaacctcggttttgccggtttcaaagtgctgtatcctttaaataaaaagggtaaagacgatgagattaccagcttcctgggtgccagctatttccgtgtgattggcgaaggccaggtgtatggcctgtcggcgcgtggtctggcgattgataccgcgctgccttccggtgaggagttcccgcgctttaaagagttctggatcgagcggccgaagccgcaggataaacagctggtgatttatgcgctgctggattctccgcgcgccgccggtgcctatcgctttgtgatccagccgggcaaagagtccaccgtggacgtgcagtctaaagtgtatctgcgtgataacgtcggcaaactcggcgtagccccactcaccagtatgttcctgtttggcgctaaccagccgtcgccggtcagcaacttccgtcaggagctgcatgattcaaacggcctgtcgattcacgccggaaatggcgaatggatctggcgtccgctcaataacccgaaacacctggcggtcagcacctttaccatcgaaaacccgaaaggcttcggtctgctgcagcgtggccgtgacttcagccattaccaggacctggacgaccgctatgatctgcgtccaagcggctgggttgagccgcagggcgactggggcaaaggccgcgtagagctggtagagatcccgacggcggatgaaaccaacgataacatcgtggccttctggacgccggagagcctgccagagccaggcaaagagatgaacttcaaatatcgtctgcactttacgcgtgatgaaaaccagctgcaccaggacgatgtggcctgggtgaaagatacgctgcgttctgcgggcgatgtgaagcagtctaatctggtgcgtcagccggatggttccatcgcctttaccgtggactttgtcggtaaagcgatgagcaagctgccggaaaacacccacgtggcgccgcaggtcagcgtcggtaacaacgccgacgtggtcgagcagaaaagtacgctacaacccggccacacaaaagctggcgtctggtgctgcgtctgcgcttacctgccaatgaataaatcgacttatttacctcaatcttacgtggaggcgctgccgcttgatgcggcagcacgcgccacgctcagcgcctcgctgcagaatgcgcaggcgtttcatgccattcacagcgcgctggggcaggatatcgccgccagcgaacggccggacgatgcgccgctgaaatcggtctcgtcgcgcgtatccatggcgtggccggattcgctcgccgatggccagcagctcagtaaagattatctcgaccgcaccacgctgaaggcgatgccgccggtgaagcgttcgctgatgttcccggaagcctggcgtactaacccgatcgcgcgcgcctgggattccctgcgcgggcagaaaggcaacccacgctatgccacggtggaagagcagaaagcggaagacaaatggcgccacgtaggttccatgcgtcgctacgtgctgctgattctgaccattctgcagaccgtggtcgccacctggtacatgaaaaccattctgccgtatcagggctggacgctgctcgatccggtcgagctgtttaaccagaactggctgcagtcggtggagctgatcctgccgtatattctgcagaccggcatcctgttcctgtttgccatcctgttctgctgggtatcggctggtttctggaccgcgctgatgggcttcctgcagctgctgatcggtcgcgataagtacagcatctcgtactcgaccaccggtgatgagccgctcaatccggaacatcgcaccgcgctgatcatgccaatctgtaacgaagacgtggaacgcgtgttcgccg

SEQ ID NO: 72954 - DNA, 492 bp, Glycine max
  Peptide Sequence Number=SeqID_189732
atgaagggcaccgtgcatgagcctcaagtgaacataggggccgatcaaaagtttcctacatctaatatccagtcgtgtggatttgggatgaccggccctctcgatgagtcgatctcttgctttctcataaggatggatccttgggtacttgtacctatcacctttagaggactacacgtcctcaccatcagagggctgcacgccctcaccttcagaggactacatgactacacgtgcgtcgccttgagaggactacacgtcctcaccatcagagggctgcacgccctcacctccagaggactacatgtccttgccttgagagggctacacgccctcaccttgggtactagttaccctcaccgtcagaggactacacgtcctcgccttgagaggactacacgtcctcaccatcagagggctgcacgccctcacctccagaggactacatgtcctcgccttgagagggctacacgccctcaccttgggtactag

SEQ ID NO: 72955 - DNA, 288 bp, Glycine max
  Peptide Sequence Number=SeqID_189733
atgagggttcactgtaatcaagcaagtcggagacctagcatgaccacagattcacctccactccttatgttcccacaaacccggtggagtcgccaactgtcgcaaccaacacttcggcgggagggcgacgcgagactcacaggtgcatcttccaaagaaggaaaacacacgaagtcaccaccaacgtttattcgaggaaaacgttggaaaaactggaaaaggtgtggtctacgaactttaagtatgaaaggttcgggagttgtacttacgcacggggaaggtctttaa

SEQ ID NO: 72956 - DNA, 331 bp, Glycine max
  Peptide Sequence Number=SeqID_189734
ggaagatgaaggtcccacagcccaggtacctcagcatgtggaggatgaatcatttgaggccaccattctagagacatttgttataagagaagaggtagatgagacacaggtgagacaggtagctgctgccactcccgagagatcccttgaggccacttcagtgcctcctgcaccaatggtggacctaccctcacctcatcatacaatagacccttccactcctatcttagagataccagaggacccgaccacaccagtcctaactatagacacttctcctccagctactccaatacttcatctaacaaatgaggaggatgttcagacatag

SEQ ID NO: 72957 - DNA, 242 bp, Glycine max
  Peptide Sequence Number=SeqID_189735
atgaatgaaaacgcaattcttggggctccgaataaaggtagagaatggagaattgctctaagcaatcactacgcatggctccaaactcgtgggtggaggatgcatgaacgaaaacgcaattcatggggctccgaaaaaggggttgagaatggagaattacactatgcaatcactactcttagctccaaactcgagggtggaggacacatgaacgaaaacgctattcatggggctccgaaaag

SEQ ID NO: 72958 - DNA, 338 bp, Glycine max
  Peptide Sequence Number=SeqID_189736
agactaacatcgtcttctgcaccctttgtcaatcacggtccgagcctgttgacacgcagagactaacgtcatcttctgcactctttgtcaatcgcgacccagagcacgatagcacgcagagactaacgtcatcttctgcactttttgtcaatcgcggtccgagtccgttgacacaggctaacatcgtcttctgcaccctttgtcaattgcggtctgagcccgttgacacccaaggactaacgtcgtcttctgcaccctttgtcaatcgcggcggaaatacccaagtggttatccgtataaacattctttcgctacccatcagacccagagcacgatag

SEQ ID NO: 72959 - DNA, 399 bp, Glycine max
  Peptide Sequence Number=SeqID_189737
atggggtgtaactcgcttagcgagcttgtgtcgctaagcgagacattcatgctaagcaaaagttctcttatggctagaattgcgcttagtgagctggtgatgcaaagcaaattattccctctgaatggaattgcgcttagcgagctggtgttgctaagcgaattgtttcctctgggtggaattacacttagcgagttggtgtcattgagcgagctgttcaacaaatctccaaggtgctctaatatatatcactacttccttgcaaaggtcatatctcacgctcaagatgttattttgcaattcccaatggtcaaaatgtggaggcatgggtttcgagcccacaatccaagtttgaaggcgatccaacggttaatgagtcccaggtcatggttttactga

SEQ ID NO: 72960 - DNA, 177 bp, Glycine max
  Peptide Sequence Number=SeqID_189738
atggtagaagacgtgtgtttcctttacaagagaaggtggaagaacacattaaagttgcgatttttatcccaaaaacttcatgagtacagactaacgacggtgctgaatgtgttgaagaataaagatgctgtgagcaatttgcagaactgcagctatgggataaggatgtgtgggtaa

SEQ ID NO: 72961 - DNA, 345 bp, Glycine max
  Peptide Sequence Number=SeqID_189739
atggaggaatcaatcgggaaaataacaaagatcacatttcccagtcaagagggtccgctcttgacggtgaagcacacattggagaatggaggaatcaatcgggaaaataacaaagatcacatttcccagtcaagaggaacacattggagaatggaggaatcaatcgggaaaataaaaaagatcacatttcccagtcaagagggtccgctcttgacggtgaagaacacattggagaatggaggaatcaatcgggaaaataacaaagatcacatttcccagtcaagagggtccgctcttgacggtgtagcacacattggagaatggaggaatcaatcgggaaaataa

SEQ ID NO: 72962 - DNA, 645 bp, Glycine max
  Peptide Sequence Number=SeqID_189740
atgtctatcgatcgagactactttagtttcccttcgtcatccagagacggcaagtccgatgacatgcagagaccaatatggtcatctactccctttgtcgaagactcttctatcgaccgagactactttagtctcccttcatcatctagagaaggcaagtccgatgacacgcaaaaacccatatggtcatatgcaccctttgtcgaagactcaatgtctatcgaccgagactactttagtctcccttcgtcatccagagacggcaagtccgatgacccgtacaaaccaatatggtcatctgctacctttgtcgaaaactcaatgtctatcgaccgagactactttagtctcccttcatcatccagagatagcaagtccgatgatatgcagagaccaatatggtcatctgctccctttgtcaaagacttgatgtctatcgaccgagactactttagtctcccttcatcatccagagacagcaagtccaatgacacgcagagaccaatatggtcatctgctccctttgtcgaagactcgatgtctatcggccgagactactttagtctcccttcgtcatccagagatggcaagtccaatgacacgcagagacaaatcatggtcattctcacccttttcatcatctag

SEQ ID NO: 72963 - DNA, 276 bp, Glycine max
  Peptide Sequence Number=SeqID_189741
atggcgcgtagtgatgctcgacaagttgtgtcattggaggaagtgcttgttaggtcaagggcctttgcaaatgctggagctgatgttcttttcatcgacgccctcgcttccagggaagtgatgaaggccttctgcaatgtttctccctttgttcccaaaatggccaatatgcttgaaggaggtggcaagacaccgatacttaatcctatggagcttgaagatgttggttttaagattgttgtgtatccactttccttgactggggtttctatatga

SEQ ID NO: 72964 - DNA, 297 bp, Glycine max
  Peptide Sequence Number=SeqID_189742
atggaagtacatgaggagaagcttgccactaaaaatgaaatgaagagaactctagaagacgatgaaaattatgagaatacttctgtagaaatggatggagtcattgtgaccaagagagagaagaccatggtggttcatctcactcagattctgagagttataacaacactagtgtcataccctaatttcgtccgtgaattattacttgatgacatgcaacctttgattggccgcttcgagatacctggcaccctttgttgcacaatatgtgaagtcccgagacgcgtcggaaattaa

SEQ ID NO: 72965 - DNA, 282 bp, Glycine max
  Peptide Sequence Number=SeqID_189743
atggttgatatactcttccttttgaaacaacaaactagtttagagattacgagtgagaagtcagtcgtcaaggtggatgtccacctcgtcccattcgatatctttcctgatcaaaaactctcatgcatggtcatcaaatcgaaagtagaagacaacctcatctccggccatcaatttttttttcatgaaggtactggaatcatgagtcagcaattgatggcacaccaccgtggatggagacttgccattaggtgcgttttcctaggccccgctgaagcataa

SEQ ID NO: 72966 - DNA, 387 bp, Glycine max
  Peptide Sequence Number=SeqID_189744
tttgagagcgttttgtgcgatggtaatatcaggaatgacgacagtagatataccagtgatggttgcgataacagtggtgatagttgtaataatgccgatggtaatggttatgtggtggtggtggtagcagtgctaatggttgtgacagtgacaactaattatgacgataacaacgatgatagtagtgatgatggtattagtggtggtgatgatggaggtggcgttggtggttatggttgtggtggcagtggtgatggtgtcattgtcaaatttatacgtgttcctctatgttcacacccgatcgatattttaggagttcagacagtgtttcttgaagaagatggtaagaagagaatttcaatttctcaccttttagaaggaaattga

SEQ ID NO: 72967 - DNA, 687 bp, Glycine max
  Peptide Sequence Number=SeqID_189745
atgtttgcgagctgcacgcgaggggtgcaaaagcgtgacgatggtcgcgaacgagcacgcgccagtggaggctgcaccggaggatctacagggcaagcctgtacagagacatcatcagtccggtgccggcggcgaggccagtgcggctcgccgggcggcatagacctccggcgtctgcggcttgacgaacagtgccaccagttccggaaactcctgcttcactgcagtttcgatgcgggtgatgcaggcttcgatctgcggcgtgcgccggtcatcctcgaattccgcgctgagcatggccacgacctgttccgggcccatctgcatggtggtcacgccattggcgcggcgcaggtccggatcggtttcggccacggccatgatccgctcagccaccgcaggatgggccggctcgcccaccagcagtcccttggtttcgcgtgcgagaagaaaggcggtggcggcaagcacgccggcgatgcacagcgacgccacaccatcaagcaccggcatgtccaggacctgggcggccacgagcccgatcagtgcgaaacccaggcccagcagggccgcgctatcctccagcagcacggtaaaggtggaaggatccttgctgcggcggaacgcttcgaagtagccgagcttgcccttggtgcgccggaactcgcgcagcgccacccaccatga

SEQ ID NO: 72968 - DNA, 1462 bp, Glycine max
  Peptide Sequence Number=SeqID_189746
aaccacaatattcatcagcttggccactttgatggaccagatcagatttatattggtaatggtgaaggtttgaaaattcttggttctggttctggttcttctaggtcccctaccaatcctaattttcctctttatcttcataatttgttacatgcaaccaatgaagtcttacttcaaggcattgctggtagtgatggcctctattcatttcccaatcttaagcttcaagaattttctgcttctcagccttcattgagagtacctgtttcttttacagcaactgtttcaaaggatgtagtttttaatgagaataggtttccttattctgaactatttcctcaagcctcatattctatgacctctgctcctcaacattttagtcttactccttccttccctccctttactcaaactccacctaccgcatccattcccaacactgtttctgattccatccccttacattcatcatctgacccagcttcaaacactgtctctgcacctaattctgtaacctctcctgttacctcttcggctttttctgatcctagcacacatcagtctgttgcatcaacaaatctgtctcagcaacaacttcaagatgtttctgatcctcctactcagtctagtgtttctgttcctgaatctgagcaccaattacttcttaggcctcctaacgtgcaccctatgcaaacaagatccaagtctggttttcataaccccagaattcacccttcactgtttttaactcattgtgagcccagaggtgtcaaacaagaaatggctgatcctgattggttgtctgctatgaagcaagaatacaatgctttgataaacaatcatacttgggatctggtttccttacccactaacagaaaagcagttggttttaagtgggtatttcgagttaaggaaaatgcagatgggactcttaatatgtacaaggctaggctcgtagctaagggccttatcactattagaattataatcactcttgctttgacaaatggatgggatctactccaattagatgttaataatgcattcctcaatggcattcttgaggaaacagtattatttgttagagccatgtgtgatgattgggcctctgatgtagatgatgacagaaggtccacttttggctttgcacttttccttggtctcaaccttatctcttggtggtccggaagcagcaagtcactgcaaggagtcggatgtcccttttgctactccaattctgctatgataaccaaagtgttgctgccacacaaccctgtcttccactctcggactaagcatgtgaaaattgatgttttctttgttcaagaacaagtgttgtccaagcagttagctatctaccatattccttctctagatcaatgggcagatattctaaccaagcctctttctcctaaccgctttgacttccttaagagcaaactcaatgtgaaggatttcatct

SEQ ID NO: 72969 - DNA, 501 bp, Glycine max
  Peptide Sequence Number=SeqID_189747
atgagtgttgcggaagtggagccatttggcggtgtcgatagtggcatagaaggggagaaggaaggactcctggggcttgcggttatccgggaggtggacggcaacaatgttggcatggtcgtgggtacggtgagcgtgggtgacggagtcggcttaagctacagaggcagccgcggagtccgcggcagaggcggtattggagtgtgggtgaggaatgtctgtgcagaggaagaagatggaggtggaatcgacacaggtgacggaggtggcagtggtgcacggaggaagaagggtagtggtggctggttttcggaagcagttttaggagaaaggcatccagtgagtattcgaggcggcgttgagcaacaagattggccaaggcagtcctcgctagcgggcgaaaattcaaggtgggttagcgttggtatggcagccatggaagctccgtttggtgagtggcagccatggaaggcaaccatagaagctccgtttggcgagtag

SEQ ID NO: 72970 - DNA, 429 bp, Glycine max
  Peptide Sequence Number=SeqID_189748
atgagtggtgcgcaactgcaaagtgcttcccctgccttgatcatacaagggtcacagaaaaatgaaggttcagtggctgtggcaactgctgcagagtcaaagccaaagaagaaaatctgctgtgcttgcccggacactaaaaggttgacagttgaaattttgaataaaagcagggaaattgattgctacaagcaattcataatttttgaaccagcagtaagaatcatctacaggatacagaggagcaaagatgtcgagatcaagatgacacaggggtgtatgaatgacacggggggtctgcaggaagtaaacaccacaaggtccaagaggaagaatgcacctccaacttgcttaaggaacgtacaacatggttggcatcatgcatcatgcatacatgcaccgcacataggaaaagcgcaaaccatatga

SEQ ID NO: 72971 - DNA, 192 bp, Glycine max
  Peptide Sequence Number=SeqID_189749
atgtgcaacttcaggcgcgcatccaccattaagtgcagcttcaacgtgcttagcgcgacagaagaatctggcagggcatcatcatcaaggtcgcacactaagcgtgagataagtgtgctaagcgcagcagttgtcttcagccaggctcagcgtacaactggcgctaagctcaaatgcacttactctcgctaa

SEQ ID NO: 72972 - DNA, 1379 bp, Glycine max
  Peptide Sequence Number=SeqID_189750
atggcattttcctacttaagcaccttggcattatatcatcctaattacacggtcaccccccttatgagagacaatagactctacgaggtagctgtctattctaaaaaaaggctattatttacgttccgagactccttacatctactccccggcaaactagatgaccttgctaagaatctatgccctgagttgggttctaaaggatctatttcctatgaggatgtaagacttgaaagtcttagtattatgaaagagagtttgttagagtatatggagcaggatattcttctgctagggggaattatgcagtccttccaggacatatattataaggcttaccaggcagacatagtaaataagcttacaatagcctcactggctctaagtctatttcgtgaaaaatattacgattacaataagcatcgtatccacatccctaatcagaatgaggatacatttattcggcgtggatattacggtgggcataccgacgcatacttaccatacggtactaatttatactattatgacgttaactctctctatccttttgttatcaaggaattctcaatgcctgggggtacaccagtctggcattctgatttagaatatatgacattagataacatgtttgggttcattgaagcatatgtagaatgcccaaaaagtataaataaaccatttcttccctatggggataataaggatggcactcttatctttcctacaggcacctttgttggggtttactatagtgaggagctcaagtatgctagagacataggctacactataataccaatttgtggatacctcttcgaggagatggaaagtccattcaaggactacattaattctctctttgaaagcagatccaatgctaaaaagaaaggaaataacgccctatcttcatttggcatcaatcctcaaagcacaaaaaccgagatgtgcaataaatctaaacgtgaccgtatatttagacgccctgagtttatagacgatgtctttattagagaggatctatacatggtatcttatctaaccaatccgggtaaggggccttcttattgggaccccccgaagaactccgcggtacaactagccgcagcgatcactgccggctcaaggatctatatgtacaagtatatttcaagagaagactgcttatatacagacaccgactctattgtccttggtaatccacttccggaggaagatgtttcctcttctgtattaggtaaatttaaattagaagataagatcttggagggattctttttagcacctaaatgctatagctataccacagaagagtcagatggcaataagaaggtctataagtacaagggaccgggtagaaatgttataactccagaatg

SEQ ID NO: 72973 - DNA, 864 bp, Glycine max
  Peptide Sequence Number=SeqID_189751
atggccattgagggctttacaatgagaagagggggttttcgagacttgggtcagtctaggggctatgcctggggagttgtcgtgctggttcacatgtatgaccagctaaatgaagcttcgcagacccccacacgacagatgggtgggtacttaacgctattacagtgctggatatatgagtattttcccagtgttcatcagtgtgtcactgatgatggatatgctgagaagaccccacgtgcctccaggtggcttacgatgaaggcgcacatgaaggggatcaagggagcgccgtacagggcacgtttagatgctctgacgatcacggacgggcagctcagatggggtcatgttgtggtctatgtcagaccagagagggtggtacaacagttcgggtacatgcacaccatccctccgctgccggttactagtttgttgtcgtatgaggacataagcgacaggtggatgcatttcggggatcatctagcacctgcgggtgagatttgtgttgtccccagccaggtatcagcagactacatggagtggttttttcagatatctcaccctttcgtcatgtcaacccaggaaggtgatgagcccagacatccacctgccccagatgtggatgcatacgtcgagccacatatcccagaggttccagtcccagctaatctccctagaccttcagtggttgcttatgaaggttgtgaagcaatcgcaaaaaggttggagcgtgtgctcaaccttaggatggtcactgcaagaactgagttacatgagatcatggaagattgtctgcggatcgctaggggtgacacctctgatggaagtcttagggcacgacgtagacagcgcatagattag

SEQ ID NO: 72974 - DNA, 402 bp, Glycine max
  Peptide Sequence Number=SeqID_189752
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggatttgccaactttggcttgcgccccgttggctaaagtctggtgcctcggtggtggatcatcatgtcataacatggcaagacacaagattacccggacctgtcggccaaggctatagactcgttgaatacatcagtgtagcgcgcgtgcggcccagaacatctaagggcatcacagacctgttattgcctcaaacttccgtggcctaa

SEQ ID NO: 72975 - DNA, 177 bp, Glycine max
  Peptide Sequence Number=SeqID_189753
atggcatcaaaagctataaacaagccacaaactcctatcacctatctatatctccctgaaatgaggggtggaggttgcacagcagctcgcccaggcaagctgcttgcttcctctagaagtaaccttgctcgcccaggcaagctggttacttcagccctaagctttctggtagcctag

SEQ ID NO: 72976 - DNA, 180 bp, Glycine max
  Peptide Sequence Number=SeqID_189754
atgctggaataccaagagcggaagagagaggacacattttggggaatttatgatgaccatgccaatttgtctagaggcctcagtgacaaagacattgggtctgaagccaatgcaaggagtgatatctttattcattccacctcagcaaatgaaatacaagacaaagtggactggatttaa

SEQ ID NO: 72977 - DNA, 138 bp, Glycine max
  Peptide Sequence Number=SeqID_189755
atggaggaccttttaatgaaatcaacattggattcaattttccaagttgcatttggaactgaacttgacagcatgtgtggatcaagtcaagaagaagggaagattttcgcagatgcttttgatacttccagtgtctaa

SEQ ID NO: 72978 - DNA, 432 bp, Glycine max
  Peptide Sequence Number=SeqID_189756
atggcacgtagagacaaattatggtcattctgcgcctttggtcatccagaggtggcgagcccgatgacatacggagacaaattatggctcgatcgtgtccgaaggcacgcagagacaaattatggtcaatctgcgcccttttgtcatccagaggcgatcgtgcccaatggtgcgcagagacaaattatggtcattctgcgcctttccatccaggctcaatcgtgttcgatgacacgcagaggaaaattatggcttgatcatgtccgatggcacgcagagacaaattatggtcattctgcgcccttttgtcatccagaggcgatcgtgcccgatggcagcggagacaaattatgcaagtcgagtgataaacacgcagagacaaattatggtcattctgcaccctttgtcattcaggagcagcaagtcgagtga

SEQ ID NO: 72979 - DNA, 429 bp, Glycine max
  Peptide Sequence Number=SeqID_189757
atgttgttttatgtgaaacccgctaagcgactcacgctttgccaagcggggatgtcttcaaggaaaagaaagagtgtcggttcaaggcccactcctcaatatgatacacgaagattccagtcctttgaggcttggaccagatatactgacaatgtgttgggaagatacatattagttgagaggaaagtggaaatctatcacacagagctgggtgaattcaagggtgagatggagaggcgtaactttcacaagcgcctcaccaacttagctgatagtagcattgacctcgcattggtgaaggagttctatgccaacctctatagtcccgagggaccttcacctaaacaagtcagaatccagagccacttaataacgattgatgcagacaacctcaatgcctttttagaaacaccttgtggtgcttgctga

SEQ ID NO: 72980 - DNA, 423 bp, Glycine max
  Peptide Sequence Number=SeqID_189758
gagggtttctttcgttcctttctctctgtggctccccctccgattccggctcctcctctggttcctcttccccctccgactcccgttcctcatgtcgctcgcgctcctttactcggtcctgttctccctcgtgctccaaatcctcttccccctcctgctcctcttcctctccaagctcccgcagcctcagctgtcccccgcagaggagccactgtaagggggttttggagcgccgccagaaccaccgcgtttcatggatctcggctgctcatttgtttctggagaaagtctttcctgatcattgaatttgaaaaattaaaattgaagcctaaaatgtttcaggtttttgctgctgatatattcacctcaaagttatgcaacgatgtttcaaaccagcaagcgggcatgcaattcaagaacaag

SEQ ID NO: 72981 - DNA, 516 bp, Glycine max
  Peptide Sequence Number=SeqID_189759
atgacaattactattggaggggccaggagagcgagggcaaggccagctaaggctccttccacatctgcagctcctcctccagcacgtacctcagcaactccttctacctcaccttctgcatactttcaccgtcttgaagccatgctttggagcatacatcaagggcaaattattttattacaaagtttacaactggtagcacctccagactctattccttctgtagagcagtttaatgaatgggtagcctggcccgggactcagcctccccttcacagggaagacgaaggtcccattgctcaggtaccacaggagatggaggatgggtcatctgagacttctactccagagcccctgatcaaaaggaagagggtagttgaaacacaagaagttgcaaccacttctaagaaatctcttgaggccacttctgagccttcagaaccagtggcagatacggcttcaattcagcaactagcagacccctccactcctgaggatcaaactacagcagtttaa

SEQ ID NO: 72982 - DNA, 106 bp, Glycine max
  Peptide Sequence Number=SeqID_189760
atgggattttacggatacctacaaaaatatctgcaaacaaagagggtaatgatccgtatatgggagctaggtatggaaacaagcatttacctgcgaatttatgcag

SEQ ID NO: 72983 - DNA, 726 bp, Glycine max
  Peptide Sequence Number=SeqID_189761
atggcctctggtaatcgattacaaaggagtaacaagtcactggtaatcgattaccagttatgtgtaatcgattacacagtgcatattgcaggtttccatgttttgaagctatgtaacttgagtttggcctctggtaatcgattaccaatgttgtgtaatcgattaccagagatgaaaagccttgaggcaccccttttaattgcatgtagtggttatgggacgcattgtgttgctaccgtagttagatctcttgtgaaagagtctaccccctttcttttatttcttgtaatcgcgatggcagtgcaattaatccatgaccaagtggagatggagtgcctagagggagtttgggagaccctcgaaggcaatgcaaggtgccgatttcggggcacaattcgattcacggctacttcattggtacatccagaggaaccagcacgcacgcttcagcgcactgtggagtggatattacctacacctactccatatcgactagtggagccagtccaagtgatagaggtgacgtcatctgaggaagaccctgaggaggacccagaggagctacctcctgagcctgctatagatgctcttgactttccagagggtgaggaggacccactccgtgaggtggattctcccgaggatgtcatgtcggcatctgaggcagactctatggagaagagcggtcctgaggggatagcgactagtggagttttttcatcatag

SEQ ID NO: 72984 - DNA, 297 bp, Glycine max
  Peptide Sequence Number=SeqID_189762
atggcttacacccacattccggtgaaagttgaaaatcctggtgagtcattagagacatctaacaacagctttcaaaattgccccatccagcatcaattagacctcgcaccctacacttcagagccctacaatgctcaatggaacgccccggggcttctccgtgacaagcacacgttgcgttcgagtcgtattctcggagaaatggaggttgatgaaccttggctagggttatggctaccattgaattatcaagtggtcttcgtcattggaagtgcggtagacagactttgtggttga

SEQ ID NO: 72985 - DNA, 234 bp, Glycine max
  Peptide Sequence Number=SeqID_189763
atgcggaaattgattaaggaaaggatggaaaataaggtggttaatttcgtgggtcttaataaggtggttcttggcataaaatggatgaatgggatggtaaaacaggtggattttctggaattgtggtttgaaagaacaagggtgaagatgaaaggaaggaaagaatcactctttccagcaagggcaacacacaaaggttgtgaaagtcctttgatacagccagggtgttcttga

SEQ ID NO: 72986 - DNA, 231 bp, Glycine max
  Peptide Sequence Number=SeqID_189764
atgagggaaagaagaggcggtgtcagtgtgaaaattgacctaacactatttatagctagcttacgaaaaatgggatgttacagagaccagcttgttccattttgccttgttgttcgtgaaaccaatgaagagctacgtgccctcaaggcagatccagctgaagcgtttgatgtaggagcaatcctgtccattgccaggaggcaattatctagtgaactggaggctacttga

SEQ ID NO: 72987 - DNA, 834 bp, Glycine max
  Peptide Sequence Number=SeqID_189765
atgctacacgtcatcaccttgagaggactacacaccctcatcttcagaggactacacgtcctcgccttcagagggatacacgtcctcgactgtagaggactacacgccctcaccttcataggacaacacatcctcgcctttagagggctacacgtcctcaccttcagaggactacacgtcttccccttcagaggcctacacgccctcgcctttagaggactacacgtcctcgtcttcagagggctacacagggctatgcgccctcgccttcgaagggctacacgctctcaccttgagaggactacacgtcctcggcttcagagggctacacaccctcgccttcagaggactacatgccctcgccttcatagggctacacgccaccaccttctgaggactacacgtcctctccttgagagggctacactccctcgccttcagaggactacacctcttccccttcagaggtcaaagggctacacgtcctcaccttcagggactacacgccctcaccttcagaggactacttgtccttgccttcagaggactacacgtcctcgccttcagaggactacacgtcctcgccatcagagggctacactacacgtccttgccttcagaggactacacgtcctcatcttcagagagacacacgtcctcgcctttaaagggctacgcatcctactcttcagaggactacacgtcgttgccttcagaggactacacgtcctcatcttcagaggactacacgtcctcaccttcagaaaactacacgccctcacctttataggaccacaaagcctcgccttcagagggctacacgtcctcacctaa

SEQ ID NO: 72988 - DNA, 599 bp, Glycine max
  Peptide Sequence Number=SeqID_189766
atagatgcatttacagatgagcttttcagaggaaatccggcatgtgttgtaccattaaaagaatggcttccggatgaaactcttcttaagattgctatggaaaacgcggttgccgaaacagcattttttatagacctcggttcaagaatacatcttcgctgggatgggctatattatcttgattttccttcgagaatgccttccccgtcctctttaccggatttgatttcaaaatcattgaatatccagcctaaagaggtatttaaatccagggattatgttctggtatatgataatgaagatgatatcagaaacatcaaaatcgacaggcaaatctttgatcagatcaatctggacccgggtggcgtgattgtaactgcaaaaggtgaccacagcgatttcgtttcaagatattttacttcgcaggcaagtattcttgaagatcctgtaacaggctcggctcattgctcattaattcctttctggtctgacagattggggaaaaaagatctttttgcaatgcagctttccgaaagattaggaaagttatattgtgaggatcagggtgatcgggtgatcattgccggaaaagcaaaaac

SEQ ID NO: 72989 - DNA, 833 bp, Glycine max
  Peptide Sequence Number=SeqID_189767
caaaaagtatcagcatctggtgcgtaacaactcggtgttctggctggcctccggttataacctcgactttggcctgattggcggcgtggtgaaaaccggcaccttccagcagttcattcgcggcggcatccacgccaaaagagtggcgcaactggggcacggcgattccgtcgccaaactaagacaacgggcagcctgcgggctgcccgacttatttgcgtcagggatattgcgcacggctgtacctgagccgggctcagcgttacacttcgccctcactttgttagtccgcctggccgacgaggccgaattcgaacgctttctcgccatcagtcagcagccgctgcgccgcagtctgcgcgtcaatacgctgaaaatcagcgtggaggattttctcacgcgcgtggcgggctatggctggcagctgacgccgattccgtggtgtcgggaaggcttctggattgcgcgtgatgacgaatcgctgccgctcggcagcgtcgcggaacacctcagcggtctgttctatattcaggaagccagctcaatgctgccggtcagcgcgctgtttgacgccgcgccggatgcccgccaggtgatggacgtggccgctgcgccgggctctaaaaccacgcagatggccgcactgatgcgcaatcagggcgcgatcctcgccaatgaatactccgccagccgggtgaaagtgctgcatgccaatatcagccgatgcggcgtcagcaatgtggcgctgacccatttcgacgggcgcgtctttggtgccgcgctgccggaacagttcgacgccattctgctggatgcgccctgctccggcgagg

SEQ ID NO: 72990 - DNA, 222 bp, Glycine max
  Peptide Sequence Number=SeqID_189768
atggattgcctagcgctgttcatgtgtcctccaccattaagtgcagagcctccggtgaccggtggaccattcggtcgtgccaacaaatcttatttggagacccatgaattgattgtcattcatgcatcctccaccaacgagtctggagccccgcaaattgattgcctagcgttgttcgcctatcctccattttccacttttattcggagccccatgaattga

SEQ ID NO: 72991 - DNA, 642 bp, Glycine max
  Peptide Sequence Number=SeqID_189769
agtggtacctggagatatgtcgcgggggtcaggagaccttggggacgtcaggcgagctcttggcagtcaacatataaaagaacaaagaccacaaagcaaggaggcttgtgtggtggctggccagctgtgaactttgagtgttatatgggatatggcctctggcttaaaaacgagatcaggaagctaagagggcttctggtaatcgattaccaagggatcgtgatggcggcgcaactaatccatgaccgagtggagatggagtgcctagagggagcttgggagaccctcgaaggcaatgcgaggtgccgatttcggggcacgattcgattcacggctacttcattggtgcatccagatgaacccgcgcgcacgcttcagcgcactgtggagtggatactacccacgcctacaccataccgtctagtggagccagtccaagtgatcgaggtgacgtcatccgaggaagaccctgaggagctacctcctaagcctgctgtggatgctcttgactttctagagggtgatgaggacccactccctgaggtggattctcccgaggacgtcatgtcggcatctgaggcagactctacggaggatagtggccctggagagatggcgattagtggaggctcttcatcatag

SEQ ID NO: 72992 - DNA, 789 bp, Glycine max
  Peptide Sequence Number=SeqID_189770
atggcatcaactgccgtggtggctgatactttcaccggcacttatcgaaccaataaacgccgacgggatatcgccgatctacgcacccgctatggcgaactgactcgccttaacaccatgggcgagctggccgctggtatcgtgcatgagcttaatcaacctttaaccgccattatgagctataaccaggcggcagtgcgcctgattaaaaaaaacgatcccgtaaagatccccgaactgcttgaggcctcagtgttgcagataaaacgcattgacgccctgctcagccagtttcgtctcaagctaaccagcaagcgcgccgaatatcagccggttgaccttccgtcgctgtggctacgcgtgtgcgaattactggataatgagatccgcgccggtaaagttcgtatctccagccattttccgtcggacctacccgcgcttcctgcgccgccgctgtgggtagagcaaatactgcataatatcgttagcaatgccattcaggcacaaagcataaatgttccaggtagtgcgtggattcatctgcaagccgtgcgggtaaataacggtatcgctttaactcttactgatggcggaccagggttatcatctgaagcgctggagcaggtttttataccgttttataccacccgtactgatggtgtgggactcggcatggcccttgcggatacccttgttcagcgtcttaatggcaagatagaagcgagcaatatcaccggacaaggcgcttgcttccggttatggtttccgctgcgcaatgaggagaagtaa

SEQ ID NO: 72993 - DNA, 1116 bp, Glycine max
  Peptide Sequence Number=SeqID_189771
atggccgggctgcacttcttcaacccagcgccgctgatgaaactggtggagatcgtcagcggtctggagaccggtaccgataccctcgccgcgctgcaggccctggcgcagcgctggggtaagcaaagcgtcgtgtgccgctcgacgcccggatttatcgtcaaccgcgtggcgcggccgttctatgccgaaaccctgcgcgcgctggaggaacgggtggccgacgccgccacgctggacgcggtattgcgcgacgccggcggtttcgccatgggcccgctgcagttgaccgatctgatcggccaggacgtcaattacgccgtgaccgaatcggtgtatcaggcctttctatcaggatccgcgcttcacgccctcactggtgcaacaggagctggtggcggccgggcgcctcggccgcaagtccggccgcggttttctaccgctacgacgcaccgcgatccgccgccgcgatcgccttttgcgcctccggcgcaggccgcactgccgcaacgcgttacgctgcacggcgactggtcttcgctggccgatttggcggaactgttgatcgaaaatgcggggccgatcaaacaacccggccagaccagcccacacgtcacgatcgacgacgttacactgatgttaaccaatggtaaaaccgccggccagctggccgacgaacgtggaacgcccgtggtgctgttcgatctctgtgccgactatgcgcacgcctccgccattgccatcagctgcgcggcgcaaaacgatgcgcaacacaatgccaaagcgattcgcctgttgcagtccctcggcaagcaggtcattcaactgccggattaccccggcctgctgacgatgcgcaccctggccatgctggccaacgaagcgctcgacgtggtgaacaaaggcgtcgccagcgccgaagataccgatctggcgatgctgcgcggcgtcaactatccgcgcggcccgctggcctggggcgccgcgctcggctggtgccacattctggcgacgctggaaaacctgcaacgctattacggcgaagcgcgctatcgcccaatgccgctgctgcgccgctacgcttcccccgcctctttcccaggagccgaacgatga

SEQ ID NO: 72994 - DNA, 931 bp, Glycine max
  Peptide Sequence Number=SeqID_189772
atgattttcgcccggccgtatgtgcttgtcggggctaaaccccggcaatatcgactacgtgaccgccgccattctcgacgtcacccgtaccgtctaacttcgctcgggaacccagccatgccacagatgaatgattttgagcatatcgcccgccgtcagggcgggttgaacaagcatcttaccgccgggcagatgtcgatgctggcgatcggcggcgccatcggcaccgggctgtttctcggcagcgcctacgccattcagatggcggggccggcgtctggcggaatgacctccgaacacccgacgcccggctcgttcggcgactatgccgaattctacctcggcccgctgttcggttttctggtgcgttattcctactggtcttgcgtggtactggcggtgggcaccgaagttatcgccatcggcatgtacatgcagttctggttcccggcgacgccgacctggccgtgggtgctgctgttctcggcggcggtgatcgtcgtcaatgtgatcggcgtgaagtcgttcggccaggtggaatacgcgctgtccaccgtcaaagtgacggcgatcgtggcgttcattctgatcggtctcggcatgctggcgttctcgggcaacccggcttacggcctgcgcaacctgaccgccggcggcttcatgccgtttggcgtcaagggcatgtggttcgcaacgatcgtgtccatcttcagctacctgagcattgaaatgatcgcggtggccgccggcgaggcgaaaaatccggtgattgcggtgaaggcggcgttcaagggcaccctcgtgcggctgttcatcttctacatgctgtcgatcgccctgatgctggccatcgtgccctggcgccagtccggcaccggtgaaagcccgttcctgatggcgatgaacgtcatccatctgcccgccgccgccg

SEQ ID NO: 72995 - DNA, 641 bp, Glycine max
  Peptide Sequence Number=SeqID_189773
tgcccttaggaagagacacatcacctcctactatgaaagggagcttatggacaagctccaaaggcttagacaagggagtatgagtgttgaagagtataggcaacaaatggaactactctttttgagtgttgggcttagggaggaggaaagaacaagtattgctaggttccttagtgtacttaatatggaagtgagggataaggttgaactccttccatatagggacctagatgacctagtccaactttgcatacgggtagagcaacaacttaaaaggaagcctacttcaaaatcttatgactcttactcttatctaaagaaagaccaaggtcaaggcatctcaggggctgcactttctaagcccaaagatgataaggggaagataattgaaaaggaatcccctaaggctagtatacaagagaagactagctctataaaaagcaaaggggaagaatctactgaagaaatctacccccaagaagaaggacaacttttaatggttaaggagccgtgtaaggaggcacttgttagcacagccacacctctagggcttgaggttattcctcaagtaaaggagttgttggatgagggtttggttcgtaagagcttaaatccttgtgctttgttggtgcccaaaatag

SEQ ID NO: 72996 - DNA, 168 bp, Glycine max
  Peptide Sequence Number=SeqID_189774
atgacacatcaaattcccccacacttagccttttgcactcctgggaaaaatcaaaaagcagagcaaggaacaaatccagagacattaaagggagacaaacaaacacaaaagcatttacatattcttaatgaatctcaaggaatgaaaggaatgggcaacatccaacac

SEQ ID NO: 72997 - DNA, 900 bp, Glycine max
  Peptide Sequence Number=SeqID_189775
gcgagtgggccccgttcatagatattctcgcactgttgattttcggaggagtcctctttccaaatgtgaatgggttggtggacctggcagcgatcgacgtttttctcgcctatcataaccacaaggaaagtccggttgtcgctatgctagccgacctatatgacaccttcgaccgaagatgtgaagagagcaatgcaaggattgtgaggcatgcttgcccgctagaaagtcaccgttcatgcacagagaaaggaggggcaaattgggaccgactcttagcaagcaaagaaggagcatctgtcaactggttccctcgatggaaggaaggaggaaccggagttcttatttcatggggaggatttccaaatgttcccttgatggggatgaggggttgcatcagctacaatcccgttcttgcaataagacaacttggctaccctatgagaggggcgccactagaggatgagctcgcgcctgtccgcaaggcatggggggtggtacaaaagaaggacaaagagctcagagacaatgggcccattggtggctacagtgagtggttgaaagcccacgtgcaaggtttggattggctcccaagtctgagaactgctaagagggaggaacatgaggcaccggaggaagacgaagaggtgcaggcccttaggacggaactcaagcaagctcaaacagtcaaagaaaggttcaaatcagcagctcttaaaatccgaaaggagaatgccgaactgagagatataaatatagctaccaccaaggctttggaacaagagaccaagagggctcatagggaagagcacggccggaacaaattccgaggggctctgtggggtagtaacaacgagcttaaactccggagggaggaaagagaccaatcgcgagtagaca

SEQ ID NO: 72998 - DNA, 985 bp, Glycine max
  Peptide Sequence Number=SeqID_189776
ttaggtggcaggcagagatacccaaatggttatccatacaaaacgatttttgttaatcctgacccgagaagtcaggatgaagagactaacgtcgtcatctgcaccctttgtcaaccaggggcaagcgagcccgttgacacgcagagactaatatcatcttctgcacctttgtcatccagagatggcatgtccgatgacatgcagagatacccaagtgattatccatacaaaacgatttatgttaatcctgacccgagaagtagagatacccaagtggttatccatataaacactcttttgcgatctatcagactcagagttcggtaccatgcagagactaacatcgtcatctgcaccctttgtcaaccaggggcaagcgagcctgttgacacgcagagactaacgtcatcttttgcagctttgtcatccagagacggtgagtccggtgacatgcggagatacccaagtggggcaagcaagcccgttgacatgcagacactaacatcgtcttctgcacctttgtcatccagagacggcgagtccggtgacatgcggacatacccaagtggttatccgtacaaaatgatttctgttaatcctgacccgagaagtggcaggcggagatacccaagtggttatccgtataaacactcttttgctatccgtcaaactcacagttcgatagcatgcagagacaaacatcatcatctgcaccctttgtcaactagggagacggcgagtccgatgacatgcggagatacccaagtggttttccgtacaaaccaacttctgttaatctcgacccgtgaagtcaggtggcaggcgaaaataccccaagtggttatccgtacaaacgcacttctgttaatcctgacccgtgaagtcaggtggcaagcggaaataccccaagtggttatccgtacacacacagttctgctacctcgacctgtgagaagtcaggtagcatgtggagatgcactatacg

SEQ ID NO: 72999 - DNA, 221 bp, Glycine max
  Peptide Sequence Number=SeqID_189777
gctccgcactctcttgagacactcgaggttgtcttggttgtcgtcggagtcagtggcagtgggaatggtcgagtctctggcgtggaggagcgggtcaaaacgcaacgaatcatcgcatctaagtcgccatttgcgaaatcaaggattaccttggacaacaactataaacatcgaggattaccttggacacgtatgcagtgttttggaggggaaaatggaag

SEQ ID NO: 73000 - DNA, 1680 bp, Glycine max
  Peptide Sequence Number=SeqID_189778
gcgcgccgcgaggcgggattcgtagtggccgatggcctgggcaaggatggcctgaaggttgacgagaatccgttgacgcgtggctggatcaatgcgcgcgacgcgatccagtcgcaggcggccgacgggcgggtgctggtcaacatcgagcagaccgccgaccaggcgatcctgaactgggaaaccttcaacattggtggcaacaccacactgaatttcctgcagaaccccgactgggccgtgttgaaccgggtcaatgatcccgccgcaaggcccagccagatccttggccagctgaaggccaatggcacggtgttcgtggccaaccgcaacggtgtggtgttcggcaacaacagccaggtcaatgtccgcaatctggtggcagcggccgcacgcatcagcgatgcgcagttccgcgagcagggcctgtacagtgccgacgcgaacacctcggcgctgaccgacgccgtgggcaaggtcatggtcgaacgcggtgcgcgcatcaccacgcacgaaccgaccacggctacacggggcggcggttatgtgctgctggctggccacagcgtggaaaacgcgggccagattgaaacccgcaagggacagacccagctggccgccggtgacagtttcgtgatccgtcgcggcgtgggaaccgcccagaacaccgcgtccaccacccgcggcaatgagattgccccgcgcttcgtcgctgacagcacggcgggcagtgttcgcaacagtggtctgatccaggcgcgcgaaggcgatgtcacgctggccggccgcaccgtcgagcaggccggcgttgcggttgcgaccaccacgttgaaccagcgcggtacggtgcacctgttgaactcggcgtccgatgcggccggcagcgtgaccctggccgctggctcgaccacggcagtactgctggaagacgatggcaagagcacggcgctggacagccagcgcaacgcgctcatcaaggaatcggccgagcaggacaagctgcgcggttccagcaacagtggcaccttcgacaatctctcgcgcctgcaggaccgccgtgagcaatcccgcatcgaagtcgtctccggcggcgatgtgaacttccaggccggttcgctggcggtggccaccggcggccaggtgatcgcggacgccagccggcgcagctatctggatgatggcgcgcgcgtggacgtctccggtgcggtgggtgtgcaggtggcgatggaaagcaacaacgtcaaggtgaaggtgcagggcaatgagttgcgcgattcgccggacaaccgtgacagcggcaagctgatcagcagcgaggtgtggatcgaccgccgccagttgaccgaagttgccgccggtaccggcggttatgaaggcacgcgctggtatgccggcggcggcctgctggaagtgggtggctacctggacaatcaggggcattcgatcagcgaatgggcggcgcagggcggcaccgttcagctggcaggcaaggaagtggtcagccacgccggttcgcgcatcaatctggccggtggcagcctggatgtgcagtccggcgtggtgcagcagagccggttgcgtggccgcgacgggcagttgtaccggcttgatgatgcaccggccgagatgctgtacgacggtctgtaccagggctatgaagtgaagcaggagcgatggggg

SEQ ID NO: 73001 - DNA, 804 bp, Glycine max
  Peptide Sequence Number=SeqID_189779
atggcgctgacgaaatgggcgcaggcgctcgtcaatagcgaggggccgttcaaaggcctgttggatagactgtcggcggaccgtcgtctttctgatgggcgcgtcacaggttatggcctcgggctgcgttggaacgaggtggacggaaagcgctttgtcggacatggcggttcgcatcccggttataagagctattttctactcgacccgacagcaaaaaccgggttgatcgtggtttcgaaccgcgaagatgccaatacgtataagatggcgcgggactgcatggccgctctcaacggtttgtcgttgcttgagacgaactgcaccgtcccggacgggctttacgtggcggatagcggaccgttctggttggaaatgcgcaacggcatagccaattggctcgattccgaagacacgctttacgatatcggcgatggctggttctcatcgctgtcgccgtcctcaccggttcggcttcgctggacgggtacggaattggaaggcgaaatcggctatgtgccgcgccgattgaagccggtcaaagtggggccgctcggccacgaactcgacggacattggcaggccccatcctatggtgccagtttcgatatcaaggatggccacctcatcatgggtataggtcctacgcgtcgggccatgccattggaagacctgggccaggggcgggccctgttcacgctgcatgatggcccgtggaccaagcgtgtctgtctgcacaggcttcaggacgatcgcatcgaattggtcctgagccgcgctcggatgattgagtacgtccgttaa

SEQ ID NO: 73002 - DNA, 324 bp, Glycine max
  Peptide Sequence Number=SeqID_189780
atgggcatctctttcatcatcttcctgcagaggatagtcggcatgaggaaggagttgccccttgaaggtaggggattggctcaaatcgtctggagcggtacggggagtgaagtctggaggcaaaccataagggcaggcttgaggactatacctccgattgaaacccgtcgcgcttttgtcccggcccaacatggcttccgtgatggaagccatctgatctttttaaagccgacatgtcggccttcatctgttcttgcactccctcttcgttatccatcttacttttggatcgggtgttataggggtgcctttgcgcttttttag

SEQ ID NO: 73003 - DNA, 870 bp, Glycine max
  Peptide Sequence Number=SeqID_189781
atgattggtacctcaaagccttacactggggcaatgagcggcaccgtacatgatcctcaagcgaacctaggggcagttcaaaatagtaccctcaccttcaaaggactacacgtccttgccatcagagggctgcatgccctcgccttcaaaagactactcgtccttgccttcagaggactacccgtcctcatcttcagagggctacgcgccctcacctttagaggactacacgtcctcgccttcagaggactacccgccctcgccttcagaggactacacgtcctcgcctttagagggctacatgccctcgccttcaaagaactacatgtcctctccttcagagggctacattccctcacctttagagggctgcacgccctcactttcagacgactagacgtcctcgccttgaaagggctacaggccctcgccttcagaggactacatgtcctctccttcacagggctaaatgccctcacttttagagggctggacgccctcaccttcagaggactagacgtcctcgccttcagagggctacaagttctcgccttcagaggactacccgtcctcaccttcagagggctatgggccctcgccttcagaggactacacgtcctttccttcataggactacccatcctcaccttcagagggctacgcgccctcgccttcagagaactacacgtccccaccttcagagggctacacgccctcgccttcagaggactacgcgtccttaccttcagagggctacacgccctcgccttcagaggactgcacgtcctctccttcagagggctacacgccctcggccttcagaggactacatgtcctcttctacagagggctacattccctcacctttag

SEQ ID NO: 73004 - DNA, 2192 bp, Glycine max
  Peptide Sequence Number=SeqID_189782
gttcccgcttagggatcggcaccggctcggcttttggtggctctggcgcgacttccggctcgggttccggttcgggcggcggcggcggggatgaggggcgtctgattgtcgccggtcctctgcctgccgtcgacagtaatgagccgggcccggctggtttcaccggttctgtgattgttgccgagttctcatcgctggaaacggcccagtcgtgggccaatgacgatccatatatcgccgctggcgttgctggtgctgctgctgattggtcgtgcgctgtggctgtggcgccgtcagggctggcgtcaggcacgccagcacatcgtcatgctggtggtactggcggcggccctgcagatagtgaatgtttcactggtattacgcggccactgacgaccgcgttcattgctcagagcgacgctgctgctgcgccacctgatgacgaatcgcatggatgcgcttataacgacgtgactgcccttccagccagcgggcacgacggcgatgcgcctggcttggttgctgctgtttggctactggctgctgattgccggggttacgctgcgcatcctgatgaagcggcgtgcggtgacctcagcgatggcctggctgctgatcatctacattctgccgctggtaaacgtcgcgcagaacgcgcccgcaccatgtggccctcgaccgccaaatggctcaacgacctgaaacagtgtcgtcacatcttcgcgactgaacacagcgacgtggcgcgttccctgttcgagctgtgccgtcatcgtcagggtattgccggcgttaaaggcaatcagctgcagctgctgaccagcgccgatgacgtgatgcaggcgctgatccgcgatatccagctggcgcgccataatattgagatggtgttttacatctggcagccgggtggcctggctgatgatgtggcggaatcgctgatggctgcctcacggcgcggcgtgcactgccgcctgatgctggactccgccggcagcgtggcgttcttccgcagtccgtgggtgggcatgatgcgcaacgccggtattgatgtggtcgaggcattgcaggttagcctgtggcgtgtgttcctgcgccgcatggatttgcgtcagcaccgcaaagtagtgctgatcgataactacattgcctataccggcagcatgaatctggtggatccgcgcttctttaaacaggatgctggcgtgggtcaatggattgatctgatggcgcgcatggagggcccggtggccactaccatgggcatcgtctacgcctgcgactgggaaatcgaaaccggcaaacgcattctgccgccggcgccggacggcaatgtgatgccgtttgagcaggagagcggtcacaccattcaggtgatcgcctcaggtccgggcttcccggaggacctgattcatcaggcgctgctgacggcggtgtattcggcgcgcgagcagctgatcatgaccacgccctacttcgtgccgagcgacgacttactgcacgccatctgtaccgccgcgctgcgtggcgttgaggtgagcattgttgtaccgcgccacaatgactcgctgctggtcggctgggccagccgcgccttcttcactgaactgctggaagccggggtgaaaatctaccagtttgaagatggcctgttgcacacgaagagcgtgctggtggacggtcagctcagtctggtgggcacggtgaacctggatatgcgcagcctgtggctcaacttcgagatcacgctggtggtggatgatgacggctttggtagcgatctcgccacggtccaggatgattatatcgcccccctttactgtaaaacgagcgaaaatattaccgcctcagggcaagcaggaatgaccatggatttaaataatcgccttactgaagatgaaacgctggaacaggcttacgatatttttcttgagctggcaggcgataacctcgatccggcagacatcattctgttcaatctgcaatttgaagagcgcggcggcgccgagctgtttgatccatccgaagactggcaggaacatgtggatttcgatctcaaccctgacttcttctcagaagtggtgatcggcctcggtgaagcggacggcgaaccgattaccgatgtgttcgcgcggatcctgctgtgccgcgagaaagatcataagctgtgtcatattctgtggcgtgaataa

SEQ ID NO: 73005 - DNA, 381 bp, Glycine max
  Peptide Sequence Number=SeqID_189783
atgcggggttaccctatagttacctgcacctttcgtcaaccaggggccaacgagcctgttgacgcgcagagactaacatcgtctcttgcaccttttgtcgtcttgacccgtgaagtcaggattaccttatggttacccgcacctttcgtcaaccagggggcaaacgagcccgttgacgcgaagagacggacatcgtcttttgcaccttttgtcatccagggacaacgagtcaggtggtttttactctcgttgtccggaaacattcaagcccaacgacgcgcgagattcttctctgctaagcagggacgatcgagtgcaatggcaaagggaaatgtcgtggttgtccaactttgtcgttttcaagacactgaagtttgttga

SEQ ID NO: 73006 - DNA, 486 bp, Glycine max
  Peptide Sequence Number=SeqID_189784
atggaggagaagaaaaagaaacaattggaggaaatagcccaatccaggagcactgacacagtcgttgatcccccatctcccactagacaacacatgaagtggaacatggcccggacgaaaaaatcaagtcaaatgacatctgaggcatcaaaggaaattgcaaataggattataaagcaccctagtcgtgtccctgttgttggagtcgatgtcacgatcaaacactactttggaccggattcaaggggctcccgcatctcttcgtccatggctcttgatgacctagaaaagctaacacaaaagatcagagaccgagtttatgaagggtcgacgaccattcacaatgttcctttgggcaatgatcaagtgaagggagttgagggaccggtgaaagctgtagacgtgtcggatcctgacgtcgatcccctatacctaatgacattgatcatcccacaacttttcctcaagccattgcaggtgtcgtga

SEQ ID NO: 73007 - DNA, 528 bp, Glycine max
  Peptide Sequence Number=SeqID_189785
atggaaaaaattggtgttaatattgaagatgatgattcaaccgttgatacttgtcttagtcctttctccagacaaatgccgactaatgtcaacggagaagaagaagtttacgaagtcctcgcaaatccacatggctacactacccagctcccttccttctccgccttagtcagcaacaccttcatcgtctatgtcaaagaagacaagaaaagaaatatgactcagattgataattggaaacaagtccctataggtcacaaggatttgatctgggaggatattcaggttgaatttgatattcctgaatcattcaatgataagcaaagagaagtggaaccattttttgtagaagcaaagcttcatgatgaatcaaagaacaactcaagtgaatcaagaacaattcaagagttcaagatagaatcaagaagaagaaagttaagagtcaagaatcaagattcaaggttcaagatctcaagaatcaagatcaagattcaagactcaagattcaagaatcaagagaaggcttaa

SEQ ID NO: 73008 - DNA, 3357 bp, Glycine max
  Peptide Sequence Number=SeqID_189786
atggctggggatatcaaggaggagagagctttggcaaaagggtattctgttattttactgctattgactttacttgtttgtagcacggaggggttgaacactgagggaaaaatcctcctagagctcaagaaaggacttcatgataaatccaaagttctggaaaattggaggtctactgatgaaaccccatgtgggtgggtaggtgtaaactgcactcatgataatattaatagtaataataataataacaacaacaactctgtggttgtatctcttaatttgagttcaatgaatctttctggaactctaaatgctgctggcattgagggtctgaccaatctaacttatctcaatcttgcttacaataagctgagtggaaatatccccaaggagattggtgagtgcttgaatttggaatatcttaatttgaacaataatcagtttgaggggacaattcctgctgaattgggtaagctgtctgctttgaaaagtttgaatattttcaacaacaaactctctggtgtgcttccagatgaacttgggaacttgtcttcattggttgagttagtggcctttagcaactttcttgttggacccttacctaaatccattggaaatcttaagaatcttgaaaatttcagagctggggcaaataacattaccggtaacttgccaaaggaaattggtggatgtacaagcttaatacgtcttggtcttgctcaaaatcagataggaggggagataccaagggagattgggatgcttgctaagttgaatgaactggttttatggggaaaccagttttcaggacctattcctaaagagattgggaattgtaccaatcttgagaacattgctctgtatgggaataatcttgttggacctatacctaaggaaattgggaacctcagatcattgaggtgtctgtatctttacagaaacaagttgaatggaaccattccaaaggaaattggaaatctttctaaatgtttatgcattgatttctcagagaactctttagtaggtcatatcccttcagagtttggcaaaatacgtggtctaagtttgctctttctctttgagaaccatctaaccggtggtataccaaatgagtttagtaacttgaagaacctgtcaaagctggacctgtcaataaataatctcacaggttcaattccatttggcttccaatatttacctaaaatgtatcagttgcagctctttgacaactccctaagtggtgttattcctcagggactaggacttcatagtcctctttgggtggttgatttttctgacaacaaattgacaggaagaataccgcctcatctatgccgaaattctggcttgatattgttgaatctggcagctaataagctctatggaaatataccagcagggatactaaactgtaaatcattggcacagttgttgttacttgaaaacaggcttactggcagcttcccttctgaattgtgtaagctggagaacttgactgccattgatttgaatgagaacaggttcagtggtacactcccttctgatattgggaactgcaacaaattgcaaaggcttcacattgccaacaattacttcacattggagttgcctaaggaaattggaaatctctctcaattggtgaccttcaatgtttcatcaaatcttttcactggaagaatcccaccggaaattttttcttgtcaaaggctacagcggcttgatctcagccagaataacttttctggttccttgccagatgagattggaacacttgagcatttggaaattctcaagctctcagacaataagctgtctggatatattcctgcagcactaggcaatctgtctcatttgaactggttgttgatggatggcaattatttctttggtgaaatacctccccaattgggttctcttgaaactttgcaaattgcaatggatctcagttacaataacctttctggaagaataccggttcagcttggcaatctcaacatgcttgaatatctctatctcaataacaaccatttggatggtgaaattcccagcacatttgaagagctttcaagcttgttggggtgcaatttctcatacaacaacctctctggtcctattccttccacaaaaattttccgaagtatggctgtaagcagctttattggtggtaacaatggcctctgtggtgcacctctcggtgactgcagtgatccagcttctcgctctgatactcgtgggaaaagttttgattctcctcatgctaaagtagtcatgatcattgcagcttctgttggaggtgtttcactcattttcattttagttattttacattttatgagacgtcctcgggagtcaattgattcctttgaaggcactgagcctccctccccagattcagatatctatttccctccaaaggaaggtttcgctttccatgatctagttgaagccacaaaaggatttcatgaaagctatgttattggtaagggagcatgtggaactgtttataaggccatgatgaaatctggtaagaccattgcagttaagaagttagcatctaatagggaagggaacaacattgagaatagtttcagggctgaaataactactctgggaaggataaggcatcgtaatatagtgaaattgtatggcttttgctatcaacagggttccaatctcctgctttatgagtacatggaaagaggtagcttaggtgaactattacatggtaatgcaagtaatctggagtggccaattcggttcatgattgctcttggagctgctgagggtcttgcctacttgcatcatgactgcaaacccaagattattcaccgcgatataaaatctaacaacattcttctggatgaaaattttgaggcccatgttggtgattttggtttggcaaaagtgattgacatgcctcagtcaaaatcaatgtctgctgttgctggatcttatggctatattgctcctgaatatgcatataccatgaaggtcacagaaaagtgtgacatttacagctatggtgtggtgctcttggaattgctaactggaagaacaccagttcagccactagagcaaggaggtgatcttgtcacatgggtgaggaactgtatccgggagcacaacaacacattgacaccagagatgctagacagtcacgttgatcttgaagaccaaaccactgtgaatcacatgctcactgttttgaagcttgctttactctgcacaagtgtctctcctaccaagaggccatcaatgcgcgaagtcgtgttgatgcttatcgagtcgaatgagcgagaaggaaacttaacactcactcaaacatacaatgatcttccttccaaagatggcatgtga

SEQ ID NO: 73009 - DNA, 645 bp, Glycine max
  Peptide Sequence Number=SeqID_189787
atgtctcttgctactttgtttggaatgttacaggaacatgaaatgaaattaatgagattgaatcagcatgaggagaatgataagaaaaaaaaaggaatttctcttaaagcttcatcatcaatccaagaagaaagtgataaagatgattcaaatgaaatagacgatgatgatgatcttagtctttttgtaaaaagattcaacgaatttttaagaaacaaaggaaatcaaagaaggtcaaatttcaaatcaaagaaaagggcagaagattcgtcctctattccaaaatgttatgaatgcaatcaaccaggacatctgagggttgattgcccaattttcaagaaaatgatagaaagatctgaaaagaaaacttctaatgataagaaagccaagaaggcctacattccttgggatgacaatgatatggactcatctgaagatttagaaaatgaagttgtgaaactaagtctgatgcccaaggattatgaaagcaatgaaaaggtttccttgaagaagagttggtacatagatagcggatgttctaaacacatgacaggagatgcatcaattttcactcatatctctcctaagaaaagcgaacatatgacttatggtgacaacaataaaggtagaattcttagagtctga

SEQ ID NO: 73010 - DNA, 372 bp, Glycine max
  Peptide Sequence Number=SeqID_189788
atgtccacacctcatgtggctggaatagcagcacttataaagcaatacaatccattattgactccagcaatgatagcatctgcaatctccacaacaagctcaaagtatgataatcttggagagcatatgatggctgaaggctttgaggccagcagcttgctgccctccactccttttgaatatggggtaggctttgtgagccccaattgtgccattgatccaggtttggtactatcatcaggagttaaacttgatgggactggccagctcaagaacattttagtaactgctgcttcaggtggtgtaggtcactacactgatcaactagcaaaactaatcctatgctttagagatccggagtataaggcctga

SEQ ID NO: 73011 - DNA, 198 bp, Glycine max
  Peptide Sequence Number=SeqID_189789
atgggtttttcgggggctttccgcgggcttcccgtaaatacttccggtaaaaattttccgaaaaaccttggaaaaatcaagtcgaagtacttccgtaacgcttccgtaagcgattctgtggaaattcttcatcgttctttgtcgttcttcaccgttcttcatccgttcttcgttcgttcttcgttcttcaacgggtaa

SEQ ID NO: 73012 - DNA, 324 bp, Glycine max
  Peptide Sequence Number=SeqID_189790
atgaaggaagaaatccaggaaaaagaagcaaaggaagaatctcagcaaaaggaagaaaagatgctgccaaaccctacctggaaaactcaatcaagtaagaagagaagcaagttgcaacaagtgataattgggagtaaaaaattcaaaaagcaaactcaagaaacatgttctaaatcctatgttaaaccggatagctcattcaagaacttgatttcaaacatgatcaaaggatgctcacaatcaactcacgatgaggacaagtctttggttcttaaccttgaaaatcataatcatcatctgttggatcaagtggtctcaaaataa

SEQ ID NO: 73013 - DNA, 281 bp, Glycine max
  Peptide Sequence Number=SeqID_189791
tcaaggtgaaccttttgagagcaccattgttgatgactggaaatttgattattctagtcatgatgctcgccgtatggtctgcaatgaccaggctgaaatgaccgtcaagcgttcctttgcaattggtgctggtgcagtgacttcctttggttaccgtaaggattggaatggtcaatggctgaagaaagacgtactccctcctcaagatgagcgtactccttcacctcctcctcagcgagatgattcagctctcatgattgaagttctttctgaattacggg

SEQ ID NO: 73014 - DNA, 360 bp, Glycine max
  Peptide Sequence Number=SeqID_189792
atgtctccatttgagtggagcaagaagggcccactttctctttttgactgtgacccatactcagtcacaaaatttctcgcgtttctctgcgtccgtcgaggccagttttcgaaagcaagcaatatatatatcaaaacgctcagaataaaaccccgagcgtggttcagagaggatcttgaagaggacccagaggagttacctcctgaacctgctattgatgcccctgacttaccagaggatggtgaggacccactccctgatgttgattctccagaggatattatgtcagcatctgaggcagactctacagaggagagtggccctggtgggacaacgaatagtgacgactctttagattaa

SEQ ID NO: 73015 - DNA, 357 bp, Glycine max
  Peptide Sequence Number=SeqID_189793
atgggttactcttccatcaacgaagacgtcacccgtttagatgttaaccaagaatctcaacatgcaaagctttatcgacaagctaccgaagaagcggctttcttgaaaagcctatgcgtgaaacaagacagtgatgttattgttccttctctaccttcgtcgatgcgtgatgttattgttccttctcaacctttgtcaatacatcatcaagaatatgcattgtacagacaaaaataccttgttatgtatagccccttcaaagggaagcagaaagacaaggagtttatgaagaagcaaataaagaagttattcaccgtgaatttaaagaagaatacaaaagctactgaaacaaattaa

SEQ ID NO: 73016 - DNA, 891 bp, Glycine max
  Peptide Sequence Number=SeqID_189794
atggcatttggtatcggtggaatggtgcatgtggatcatgtaactgatgaggttcatgaacaatctgaagaggtaggtgttgatgatttcgttgttgatgccttttcaggtgaaccccacgatacatcagttttgatggactatgtttatcatgtggcagtgacaaagcgtcttgagttgaagttatcctcccatggaaggaaggtagagaaatttggcaagcctgctctagagattgaaggcttagtggctgctataggattaagttctcttatcacatgtccgttggacactggagaggtgaccatcaccctggatgatgtggcattgttgctacatctgcccattacaggcaccttccatagttttgagactcttcatgtggacgaaattgtctttctgttagtgaaattgcttgaagttaattcagaagaatgttggatctacgagcattttccttctatttcttcttctatttccgtcgaagattatcatgagaggaaaccacatgtctgccattggaagtctgggaagacattaccagtgttgacgtatagtaagcgtttggatagattgacgtctgatgttatatgtgttgtgcctggacagtgtgcaacagactacatagagtggttctacataatatttcatcccttcatgagtctggcacaacctgagaatcctcgtagacatctaactgttgtggacgatgagacatttgttgaaccaaatattcctcaactgccggtggccgtagcggctatggacgaagcacctgcagatgcacctactgatgtagaacaacctcgacatggactagaggctttccaagcaatagcaaaaaggttggaacggttgatcaatctaagggttgtcactgaaggaacataa

SEQ ID NO: 73017 - DNA, 258 bp, Glycine max
  Peptide Sequence Number=SeqID_189795
atgggtttggacccgttggaacaaggcgtttctcaacaccataacgtggatcaatctcggtttcctttgactccggcacgcgactccggtggtggtggcgccgatgatgaccacgatggtggtggtggagaaacgggacagagagaactgaagttggttgttggtgaagacggcgttgttatcattgttggatttggaaccaaaccagacatattgaaagagtaccaagaagaggaagagccaaagaatgaagcttag

SEQ ID NO: 73018 - DNA, 936 bp, Glycine max
  Peptide Sequence Number=SeqID_189796
atggggaggttaccaacttcaacaaattacaaagaggaaagaaccataaggcagcatccctgttttccaatcttctatacatcattccagtcctgccctaattgggacctgggagatgatcaaaacaatgaatttgctgctagttcaagcttgagtgcagcattttggtgccaaacattagtggataccttggttttggtggtccaatccaatgttcagctcaagcctttaatggaccaactcagtcgggtaaaagacttgcctgttcctgaatttggcagtcttcaagcatgggaagctagagctagtgctgctgttcgtgcagctaatggagatatcaatgctggtgattctaaaatttcgcagctaggatataatggagtgccttacagtggagacactaaggttgtagttgacttcaatactgaaggcaaaggagagggtgttaagtctgaaactgacagtacatctttaaaggttttgcctccatggatgattacatcaggtatgaatcttacaaaggaacaacgtggagaggtgaagcaggaaacaaagatggatgagacttcaacttccacagcagtgcagtacacagatgacaagaagttaacaattggacatgacaataatcaaaatatacaggatgagtatattaaggcttattatgctgctttacttaagcaacacgaattggaagaagctgcaaaaaaacaattgccaaatacacttgctgctgatgatccttctagcagtacttccaatcgccaggttggcatgaaatcaaaacgtgaggaagatgatgattgtactgaatgggaggaggctccaattgcaggcaatggaaatggaggttataaggttgatttgaatgttgaagctgaggaagttgcagcagatgacgacgatgatgacgatgttgactgggaggaaggctga

SEQ ID NO: 73019 - DNA, 174 bp, Glycine max
  Peptide Sequence Number=SeqID_189797
atggtggagatggatgaagatcattggatgcatgagagcgcaacatctaaagaagttgatatgaatgaaggaaataaagaggaacttggtgtgcatcaacacgttaattgttttgatgccttaaatacttctcaggtgtttgctacccgtgatgatgttttgcattgggcttga

SEQ ID NO: 73020 - DNA, 112 bp, Glycine max
  Peptide Sequence Number=SeqID_189798
gtggcagctcttcagatgttggaaaaacaaatgggtcctgaatcttttcgtagagtgagagccattgacatttacattatttgtccttctgaccattttacatatgctggat

SEQ ID NO: 73021 - DNA, 1090 bp, Glycine max
  Peptide Sequence Number=SeqID_189799
atggttgaattggctgtgctgcggggatgtacagcattgcagacttcaaatacatccattcttgatattaatccagatacagaaactcgagatggagatactggatggcctggtatgatgagcatcagggtatatgaacttgatggtatgtatgaccatccaattctaccaatggctggagatgcatggcaactattggaaatacaatgccactcaaagcttgctgctagacgctttcagaagcccaagaaaggtttaaaacttgatgggtctgatgataatggtgatgtgccttccatggatatgcgttcaaataccgagtcccctttattatggattagagcagatcctgatatggagtaccttgctgaggttcattttaaccaaccagttcagatgtgggcacaagcaattgcagcccttgaggcatccccacagctatcattttctattgttaatgccctaaataattttctcagtgactccaaggctttttggagagtacggatcgaagcggcatttgcattggcaaattcagcatctgaggaaactgatttttctggtctactccatctgatgaaattttacaagagtcgaaggtttgatactgacattggactgccaaagccaaacgattttcatgactttgccgagtattttgttcttgaggctattccacatgctgttgctatggttagagctgctgacaagaaaagcccaagagaggctatcgagtttgttttacagctattgaagtacaatgacaacaatgggaacccttactcagatgtattctggcttgctgcattagtccagtcagttggtgagcttgagtttgggcaacagtctcatgccaagctacaatggaatcttgactatcagttgtatccggacattgacccagattgcattaaagctttcagggatcgagtttatggacttgtaaagccttttcgggacataaaggcattgtggcaagttcgaattgaagcaagtagagcactccttgatcttgaattccactgcaagggcatggattcagctttgcttttatttatcaaatacatagaggaggagcattccttaagag

SEQ ID NO: 73022 - DNA, 255 bp, Glycine max
  Peptide Sequence Number=SeqID_189800
atgacggctcgtggcggtcactggtggtcagtggaggtggagaagaagcttgggggtgttgggggatggttcaggggaagagaaggaggaagaaaatggctcttttacgctgctgggcgtatttgtagcctgcaacacttgcccaagcgagttcgagctgatccagctcaaatttttctgcttcggaacctccagacaaaattggaagacaatgcaacggttaacaaatccgggatgatgattttactaaaatag

SEQ ID NO: 73023 - DNA, 974 bp, Glycine max
  Peptide Sequence Number=SeqID_189801
ccaattccaattacgcccttcctcctcctccacctcctcctcctttgtcctttttccaatctccctttgacgaaaatatcttcctagaacaccaccaccatgacttgctcctacttcatcagtactctctgactgactctggagtatcaaaaaaccttgaagttgtggccgaaatctcgccaattccttgccctgaacaaggtggaattgcgatggagcacactccaagaaagagatccagcaagagagaccgccacagcaagatcaacaccgcgagaggcctcagggatcgaagaatgaggctgtccctcgaagtcgcgaagcggtttttcgggttgcaagacatgctaggctttgacaaggccagcaaaaccgtggagtggttactgaaccaagcaaagggtgaaatcaaacaacttgcaagggaaaaaacaagtgttgttggtggtggtggcaagagtgcatcatcaacttcggaatgcgaaggggtgtctagcttggacgaggttgcagtgagtactggaggagttaataacgaggagcaagagagggagacagtaccaaacatgatgaagagaagaaaaagtaaggtttgtagaaagagtgcattcaatgctattgataaggaatcgagggaaaaggcaagagaaagggcaagggaaagaacaagagagaagatgagaactcggagagtacttgtttctgatgcatcaaacctgaaccgtttgagttcttggaacccctttgaaacggttgaagactctgcgggtactacacatcatccctccttggatgtgcaccttcatgaggctgatcaagaaccaattagttctcacaacgtgaaggagcataatttgggagaggacatggcgcatgaagataattctttggcgctcatgaacaagtggagcccaactatgttgttcaattctcttcacaactcaggaatccttcaggaagtaagttcaaattaa

SEQ ID NO: 73024 - DNA, 237 bp, Glycine max
  Peptide Sequence Number=SeqID_189802
atgggatcagaaacatgcttcaaagaaaagaaaacaatccaacaagaaaaagtgagaacaaagaggaaccatgaagacatgaagcttacctcgacaccaacagtgacaatggcagcgagagtggcagtgtggaattgcgagactggcagtgacaatggcagcgagatgcggaggcacggagttgcgatgaagacgatgacgcgggcgacactagagttgcggcagagacttgaatga

SEQ ID NO: 73025 - DNA, 123 bp, Glycine max
  Peptide Sequence Number=SeqID_189803
atggctggtgattggcctttcattagcgacgaaagtgaagttaccgcctctctaacagtcaagataagcttttctatgatagcagctagaggattcaccaacacaagatgtcacaactcataa

SEQ ID NO: 73026 - DNA, 255 bp, Glycine max
  Peptide Sequence Number=SeqID_189804
atgttcaaacaaaatcaatttccagaccatttgaacactgtccaacaagttatatgtgcgaaaaaagagtttgagaaggagaggggaaaatatgagaagagagagaaaggagggttagcgccgccggaaatcgcgtcctgcagcggtgaacggcaacgagccattttttttggttgtgggataggtgcaccatatgcctacgtggagaacatgaatgctaatgtggataaaaatggtccaacaaagatcacttaa

SEQ ID NO: 73027 - DNA, 2778 bp, Glycine max
  Peptide Sequence Number=SeqID_189805
atggggaagcgaatttgcgagaaagaatgtgcattgtctaatggaaatagccatcacactcatccaggacgagtatggggaatgcttcacgttataaggtaccatcattggcgtcaggtcaagagaaggcttacacacaggaggcatggtggtgaaagacttgatgctagtactagagctggaattccaggaacttctgatgattctggggttcactctatgggagaacatgataagccacatacagaactatctaatgttgaagaagagctggtacactcctctcagcctgccaaaaattccatcaaatccagattaaggtcacttcttaatgaagatatatacagaaagaagggtcgacacaagagaagctcaacctgccctgcaaagtcgcaactaactcaagctgtttctgttcacaacatagaggttgatccacttagtgaattgttactgaatgttcagagccctgaaccagtcctagaaacctttcaaaaccgtcttgctgctggcacattggatgtgttgtcaccagttttctccgagaaaccaattgccaacaatgacaaatgtgtagattgtggaacaatgttttctaaagacattttggatcatagcaagattcataagcacttttgctctcctagtcaaggtggtcctgaaaagaagtcgatgaatgcacagatacttacaactgatgcttcaccccatcttttcaaggactttcttgatgcattggatgtgatcaacacaaacaaggacttcctattagaacatatacaggatccaggctctcctttgccattccacactcacaatcaacagtctttcaatggtaaacagagacgatccaaatctctctcatttcctgtatcagcctcatcgtcaggaagccaagattctgttcatggccaactcataaaccaaatggtagatgattggttggattcagaagaagagaagttacaaaatcaaagtaacatgcaaaatacaagcatggatgagtcctcagaagattcttaccaacagaccattccatcaggttcttcaaataattttgatcaatggggtgaaagagattctaattcttcatcagtttcgtctcaggttcccaacaatgtgaaaactaggcatttcaggaatcttagaaagaagatgaggcacataattgatgatggaagaaatgaaaagcatcgcattaccatggatgctatacttgacaaaattcctagcggaaagaggctcaccaaaaatgtgaagaagtttatccatgacaaatccaaaaaccccacaattaaaggggaaggtgaagacagtgcaacaagaggttttggtagccgtctctcgtctaattccttcaacaagcatcaaccaccacccatgaggaattcatctctaaaagattcagctggtagatattctcagttgtatcatcagacttgttttaacagtgaagccaagtatcctaagactgagaacttaagattgagaacagaagagagaaattctatattaaagaccccaaaatcctttaaaaggtttctttcaatgcctaatttaaaatcttactttcaccagaatgaggagctgcctttacctttatccccccagagttcaatcaagaaatctggagatagaaccactaaatttaaatcttactttcaccagaatgaggagatgcctttacttttatccccccagaattcaatcaagaaatctggagatagaaccacaagcacaaatgtcattgatcagcagaaaagttggtttgaccataatgatgattcaaagagtcaaattttgccacctacatttgctgataacacaaatcaagaatgtagtttgaatgctgaccaaaagcaacttcttgtcaggagtgcttcaaaatcaggaatagattttagtaccgaggaaaaggcagataagagcatacgaattgaaggttttggtgacttgagagacagtgaacatgacattggagctgaaacagaatctgtttctgtgccagcggaagcaaactcagtcttctcttctgacaccagctttctagattttacatttgatcttgagaacttaaacatacaggaagaagaatcagacacagaaataaagccagtgcaagatgatggattagatgatatggctgagcaacaagaggctaaggaggatcaccctgaggaggttgagaattttcaaaacattggaactttaagcaagcgtttcaactatgaaattccatgtattgaagtggatccaagtaatgaagctgcatttaattatgtgagaaaggttttagagctctctgggttcactggccatgattcccttgggatatggtattctgataaccaaccacttgatccttcaatgtatgaagaattggaggggtgcttgcttcttgatcctgattgttctggtaatagtggtgaaggtggagaatgtaatcatcatctgcttctgtttgatataatcaatgaagggttgttggagatttttggcagatcatacaactattatccaagacccttgtcttatctctcccatgttcatccacttccagcaggagaaaatgttctctataaagtgtggacactcattagctggtatctgatgaactcaacaacatatgagctttatccgtcattggattattatgtgagcaaagatcttgcaaaatatgatgggtggatgaatctccaatttgattctgaatgtgtggggcttgagctagatgacttgatttttgatgatctattggaggaaataatctccacctaa

SEQ ID NO: 73028 - DNA, 361 bp, Glycine max
  Peptide Sequence Number=SeqID_189806
gagaactgacatccaaacaggaccattcacatgcggatgtggcaaggataatgatcaacctgttctgaggtatagagttgaaatcatggttacccaaaacaatgagagtagcaagtttttgctctgggatcgtgaatgtgttgaattgattggtgagacagctgatgatgtgaatagggtcaagattgaagatggtgatcttgatttgaatgcttcccctcaagcacttgacaaatttttgggtcatgtgcttgcttttaaggtcaggattcaatcaaaattcaaaaatgcagttgttcttagatactcaaatgacctagatttgatcaatgttgttcttgagatgatgtctgatagtgag

SEQ ID NO: 73029 - DNA, 417 bp, Glycine max
  Peptide Sequence Number=SeqID_189807
atgggtatggagtatcggaagattcatgcttgcccaaatgactgcatattgtacagacatcaatttcaagaaatttcaaaatgccctaggtgtggggtatcacggtacaaactcaaggatggtgaggagtgtagtagtgatgaaaactcaaacaagggccctccagcgaaggtgttgtggtatcttccgatcattccaaggtttaagcatctgtttgctaatggagacggcgcaaaagacctcacatggcatgcaaatgggagaaactatgatgaaatgcttcgtcatttggctgattcctcgcagtggaagaagatagatcgtttgtatcaggatttcggcaaaaatcttaggcttggactagccactgatggaatgaatctatatggcagtttaagcacgcaacacagttcgtga

SEQ ID NO: 73030 - DNA, 146 bp, Glycine max
  Peptide Sequence Number=SeqID_189808
gacgccaagtatctcaaagcggctaaccagaggttgcatatcatcaaggtgagttcatcctccccctctgctactgctgctactggctcctcaggagcaggctactgggctgtggaggccccaccccctccagaaggagaaagctg

SEQ ID NO: 73031 - DNA, 278 bp, Glycine max
  Peptide Sequence Number=SeqID_189809
cgtccactaagcgcaacactcacgggctaagcgcgaggaagactttggaagaagatgagctgtacaggagacatcctacaggttataccatctgtggtggggctcatgaaataggccaatgtattcccactaaagaaaacactcaagaaattcattatatgggaaatcaacagcgacaagggtatactcaaggaggatttttaggcttccagcagggtccctataatcaacaaggacagtggaggacacaccctggtaaccagttcaacaaagactag

SEQ ID NO: 73032 - DNA, 363 bp, Glycine max
  Peptide Sequence Number=SeqID_189810
atggattggcgcgatgctactgcctttgccattgctgttaacgcttatggcggcaggacttttactgctctggttcagccgctggcaaaaaagcggcaaaatccttatctcattgagctggctgatgctgttactgctgagtctgcaaccggtggccgatcggctgctggccccgctggaaaaccagtatgccacgtggaatggcagcgagccgtgggcaccgagctccaacctgctgaacaacagcctgccgcgcgtgaccgaaggcgttcgccagtggcgacgctatcctcaggccaaaatgatcttcaccggtgccgctgcgggctacaatccgcgcagcaacgccagcgttgctgctga

SEQ ID NO: 73033 - DNA, 2103 bp, Glycine max
  Peptide Sequence Number=SeqID_189811
atgagtttcgtggcgattattccggcacgctacgcctccacgcgcctgccgggcaaaccgctgctggatattcacggtaaaccgatggtggtgcacgtgatggagcgtgcacgcgagtccggtgctgagcgggtgattgtggccaccgatcatcctgacgtggcggcggcggtgaccgctgccggcggggaagtctgcatgacgcgcgccgaccaccaatctggtaccgagcgtctggccgaggtgattgaaaagtatcagtttgctgacgataccatcattgtgaatgtacagggcgacgagccgatgattccggcggagattgtgcgtcaggtcgcggacaatctggcccaggcggatgccggcatggccacgctggcggtaccgattcacgaggcagaagaggcgttcaatcccaacgcggtaaaagtggtcactgatgccagcggttatgcgctctatttttcacgtgcgaccattccgtgggatcgcgaacgttacgcgcagtcgcgtgagcagattggcgacacgctgctgcgccacatcggtatttatgcctatcgcgccggtttcatccgtcgctatgtggcatggcaaccctgtgcgctggagcagatcgagttgctggagcagctgcgcgtgctgtggtacggcgaaaagattcacgtggcggtagcggcgactgtgccgagcgtcggtgtggatacgccggacgatctgctgcgcttaactccggaggactcttccatggaacaactccgtgcagaactggcgctggtgctgggcgaaggcgttagccggctggaaaccatcagcgaacaggcacaatcgcgtctttacgccctctatgatgaccacggcaagccgatgccgctggtggccaaatattttcgtcatcagggacgcgccgcgctcgaagcgaaaaaactcaccatgctggcgcatgaaggattgattacgctgcccacggtgtatggcctggttttgagtcaacaaccaccggcgcatgaaatgctgctgctggcgcgcttaaatggcgtatcggccgaagcgccggcgcgcacggcagcgcgctgggagcagctgtgtgaacagattgtcgaagggctgctggcgtggcatcgcattgacagccatggcctggtcggcagcgttgacagcgtgcaggaaaatcgctggccggcatggtatcgccagcgggtggaagtgctgtggtccacgctgggctatctgtcgccccccggatttacccacgccgatcgtcagattctgttccgcagccgcgaacagctggcgcagctgtttgctggctttgacgacccgtgcgtgctaatgcacggcaatctgcgtctcgccagtatgctgaaagacccgcacagcgatcagctggtggcgatgacccagccgggcaccattttgtgggcccagcgtgagtatgagctgatgcgcttggcggaaaacggtgctgaagcatcgctgctgcagcactatttacagcgtgcgccggtggatgaaggtttcgtctggcgccgctggctctatcagctgtgggattgcgttgacactctggtcagcagcggccagttcgccactgccgcgcagccgatgccagatcagccccagcgtttcgtacaccgcgcgctggctatggctgagccacagcggcgaggacagcgtgcgatcccagacgctgatcgacgtcaccagcagaaacggatgctgcccgatggtctgcttcaccgccagcgcttcttcgccggtgtcatgtggctgatccagcacgataatggcatcgtcgggcacgccaaggctgcgcgccacgtcagcagcaacgctggcgttgctgcgcggattgtagcccgcagcggcaccggtgaagatcattttggcctgaggatagcgtcgccactggcgaacgccttcggtcacgcgcggcaggctgttgttcagcaggttggagctcggtgcccactgccggttataggtgtaacccccgcccagcaccacgatatagtctaccggctcgctgccattccacgtggcatactggttttccagcggggccagcagccgatcggccaccggttgcagactcagcagtaa

SEQ ID NO: 73034 - DNA, 162 bp, Glycine max
  Peptide Sequence Number=SeqID_189812
atggaggtgaatgaaagttcgggtgaaaaggcaaaaaagacttgggttgggttggtatccgtaatgggagaactgcgaaatggagaaaaggaaaagcgagaaagtgaagcaagagacaagtctaaaaccaaggatcataacaagaatggaatgaagtattga

SEQ ID NO: 73035 - DNA, 513 bp, Glycine max
  Peptide Sequence Number=SeqID_189813
atggagaataagatgaagaataagaaattaaactccattagagcttgtaggccttggatcttcttcatcaatagagtccttcgcttcttgaagatcagggcagtgcaacggagaaggaagaaagttcagacctcaaagttcagacctcttttgaggcacaaaatttcgtgctccttctctctttctccctccactcatcttctcctaccttcaagctcttatccatggcttcctatggtgtggtgtctcctgtcaactctccttcttctccacttcgccaccattaaaattcaagaagcaaaggactccattgatgaagaagatccaaggcctacgtgctccaatggagctacatcaaaagcagagatagaaagtctattgaagactaatttcattcaaactgcaagggatttgaatgcagtaatacctaaagatgaatatcctatgccaatcgcagatatgttagttgattcaatagcaagcaatgagattctaagtttattagacggttaa

SEQ ID NO: 73036 - DNA, 372 bp, Glycine max
  Peptide Sequence Number=SeqID_189814
atggatatatttatggagatgagacatgtgaaagacattgtggagataaaacgaggtgagttttcgggatttcaaagcttgactaaccccagtccatggagtgactcaaaaaaatgcatgatcaccagccttaaatttcaggtctttcctcctcttgtcctaataactcttctgcctactttgagtagtcttcatcctctcttggatcaacttgaccttttcggtggttttttgtaccacttaactgatgcaatcctacccccaagggaattggatagaagactccaagaagattggggcagagatgcaggagaaggtcctagggttctcatgagccttagggtagattttgggcccatgggctatgtatga

SEQ ID NO: 73037 - DNA, 942 bp, Glycine max
  Peptide Sequence Number=SeqID_189815
atgtgggccatcattgaccaatacaaagagaagctaagtctagcttcaaccaatgagcaaaggctagaggacaagtatgcaaaggtattagtcctgcaagtagaaagggaagcaagagagagggtgatcgattcattacacagagaagcaatgatgaggatggataggttcgctttcaccttgaatgggagtcaagagcttcccaaactgctagccaaagccaaggcaatgacggacgtgtacttggctctcaaggaagtgcaagaacaaatgaaggccaatatggaggccttgaaagatcaaatgacctccttgatggaggccatgctaagcatgaagcgaatgatagagagcaacacgaccacaacagccgccactagcgccaccgctgaggcagatctgatccattcctccgccataaaccaagcaaaccaacccatccaagacgtgttgggtcaaggaggagaggtattgggtagcaccggcggtccacacgtagggcataataggaatgcttacccctatggcttaccccccaattatacgccacctaccatgcacatgcccaacgagaacgctaatcacgccgttcccgttaccttggagggtgactttgacccataccccactttcaccattgagagaccgacatttaatgctatgcctcaacccaataccgtaggagctcctcaaccccgtcctctgcaaccgttgtatttctcgataggggtgccgcctccggcagtggaagggagagagaaacttgatctcatcgaggagagattaagggttgtcaaagggtttggtgattaccctttcgctgacatggccgaattgtgtttggtacctgatgttgtcatcccccaaaagttcaaggtacttgatttcgatagatacaaggggaccactttccccaagaatcacctgaagatgtactgttga

SEQ ID NO: 73038 - DNA, 339 bp, Glycine max
  Peptide Sequence Number=SeqID_189816
atgcaaagaaaagataaagagcttaggggaagcaataatgggatcgttggaggctatcacaagtggttgaaagcttggacacaagagttagtttggctcccgaagctaaaggcatcaagtgaggaagaggctaaaacccttgaggagagtgaaaaggtgcaagccttgaaggcagaacttccaagggtgcaagcagtgagggaaaagttcaaggcgacaactatcaaggttcgaaaagaatgtgacaagctgagggatgtcaatgtggccactgccgaagcattggaacgggaaacaaagagggcccaaaaggaagaatggggccgaaacaagttctga

SEQ ID NO: 73039 - DNA, 267 bp, Glycine max
  Peptide Sequence Number=SeqID_189817
atgccactggagaaggatccagtgcggccccataagtggatatggagtttgacgaacatcggttttgaagtgaggaacaccaatgccattttgaagcaatcaagggttggtctttcctcaaggagagacagggatcacgccttccagacacctagtggacctagagaagtccaacagagcactgacgttttcagccttgatcacgggcctctgccagttctatggggtgccagttactccctcaaagcttatccggccccccattaa

SEQ ID NO: 73040 - DNA, 231 bp, Glycine max
  Peptide Sequence Number=SeqID_189818
atggaactgatagccaccaaatgcaaggcattacgaggaaccgagcatacccttctagccagggagagattgaatgacctacatatggatgttgatgtgtggtatctgatgagaatcctgaaactggccaaatacaggctaaaggcccaagtggagaaggacgaaggtccaagtggagaaggacaaagcccccgagtggagaaggatgaaggctcaagtggagaaggatga

SEQ ID NO: 73041 - DNA, 204 bp, Glycine max
  Peptide Sequence Number=SeqID_189819
atggtgctgaaggttacgaggctttgcccatggaagagttgggataggctactaaagaataaagagaaggtggaaaaacacattaactttgcaatttttatctcaagaacttcatgggttcagagaagatggaaaaacacattaaggttgcaatttttatctcaaaaacttcatgggttcaggtttgtaggcacaaaagcttaa

SEQ ID NO: 73042 - DNA, 174 bp, Glycine max
  Peptide Sequence Number=SeqID_189820
atgggtggtttagcctttcattgtcatgagaagcttactaatacaaaaagaaaacaagaggtgtggaagaaaatggaggcaagagtccccaacacaatcatgtttttcaacattaaccatgcgctaagccgacatgtgctcgctaagcacacatgcaaagtccaactgacataa

SEQ ID NO: 73043 - DNA, 739 bp, Glycine max
  Peptide Sequence Number=SeqID_189821
cggtatcgaaattaagctgacggtgatttgcgcatctcctaaaacttctgtccagcttccggtcgaggggctgctcttctggaaactttccggccgggaggcgatgtccgagtcgttcgccctgacgctgaccctgctcggcacggatgcgcgcattgaccgcagcaaattgctcggccagccggtcacggtgaccattccgacgcagaacctgctctcctcccgctacatcaacggcaaagtcacgcgcgtggcagtcagcgccgttgagctgacgggcacccgctatgcggtgtaccagctgacgggccagacggtgccgcagattgtgaaaaccctgctggctgagcatcaggtcaatgtggaggataaactcaccggcagttaccgggtgtgggactactgcgtgcagtatcaggagtcgagcctggacttcatcagccgcctgatggagctggaagggattgcctatcacttcagccacgaggccgacaagcacacgctggtgctcaccgacgccgccacccagcatcagccgttcagcggctatgaggtcattccttaccaccagacgccgtccggcggcagtacggatgaagagggcatcagccagtgggcgcttgaggacagcgtgacgccggggatttacagcctcgacgactatgacttccgcaagccgaacgcgtggctgttccaggcccagcagaacccggcgtcgccgaagccgggcagcattgac

SEQ ID NO: 73044 - DNA, 432 bp, Glycine max
  Peptide Sequence Number=SeqID_189822
atgacagatagagcaaatccaagtcttgacgacgaaaagaatccaaaccaagtgcagatgaatctgatgcttgatggcatcatcgctgagcaagatggtgtcattgccataagggatttcgcggcaatggttgtggcggtaaagacagtgggcaccaagggaggcggaattgacgtgggtgctgctataggtggtggttgtgcggaggaggatggagctgatgttggtgctgctgtaggtggtggttgtgcggaagaggacggagctgatgtgggtgttgttgttgttggcgttataggatccatggaaggtggcacggtttgcagagtggtggtactaaacaagctgaacatacggtgttgggtactcgcaaaatcaatagctggcggcggtagtggtggctgcaccgaagaaggaaaccatggcatccgg

SEQ ID NO: 73045 - DNA, 462 bp, Glycine max
  Peptide Sequence Number=SeqID_189823
atgtcttgcctagtgatcataactccgatctccctctgccgaagtgtcagctggtgtatgccacccactaggcaccctctagacccggataagtctaacagggccctgtgggttcctgtcacccctagtaaggtgatccaactgccgatcacccaggctttcattgagaagtactgcacgcctagacaggtgcagggggatgcacctcaggacccaaacgcaccaccgccacctcatcaggccgatcccactgggcggccaaccaccgggggcaggtacaaatacatgagtgtctctatcgcttcagccttagtcagcaggggcaaggtttcactccttttgcgtgccctacgccagagcagtttagggatgaggtcgcatggccgaagattggcccgaggcccaggtaggggaggcacctgcaagatccccgggcgatgccgaggaggcccgcatggatga

SEQ ID NO: 73046 - DNA, 420 bp, Glycine max
  Peptide Sequence Number=SeqID_189824
atggggatattaaagaatgaggctcaacgtgcttatcctcggattttcggccgtgaagcttccgggattgtggaaagtgtgagagaaggtgtaaatgacatgaaagaagggaatttggtggtgccaattttcaatgaggaatgcggggattgcaaatattgcaagtgcgagaagaccaacatgtgtgagagatttggggtggatcctatgaggaaggtgatggtgccacaagagtacacggtagtggattcagcatgcgttgtcaagattcgcgttgatggcgatggtgacctcaatccctacattaaaagacttaccttactcagttgtggcgtatctacggctagggctggacattcaacaaggcaactaaggccatggtcaaggttatcaaactcgagagtttacgtagactcgtga

SEQ ID NO: 73047 - DNA, 531 bp, Glycine max
  Peptide Sequence Number=SeqID_189825
atggagatgcagcggaagacaaaggagaagaggtatagacttgaggtgatggtcaactacaaggaggaaagcacaaattttttgctctgggactgtgaatgcactgagctaattggacaatcagctaatgaagttaacaagctgaaaatagaagagggtgatgttgatttaaatgtttctcctcaagcccttgataagttgatgggttatgtccttgcatttaaagtcaaagttcaacccaagtttaacaatgttgttgttcttagatactcaaatgacatagaattgatcaatgttgtggtggacatgctgcctaatgctgagtgttttccagattttatgtatgttggcataatcttatttaaaaactccaccgcctctaattccaaatttagtttattgatcagtgtaagtgttatgcaacaatctgtgtctgtcacagcaaatcacgatccacttctaggtctttcattgacacccacaaaacggattacatctgttgactgtgatgatgaaccgaaaagctcttag

SEQ ID NO: 73048 - DNA, 498 bp, Glycine max
  Peptide Sequence Number=SeqID_189826
atgaaggtcttccctgcaacggccgaaggagaagaaggaaggattgtcgtgacgagagtccagcaacctctcaaaaaggaagactcactattggaagttccatggcgtgcctcctctaacgaggaatcgctgattggagcgaccttccgttccacaagggtctcccctcttactctcctagtgaaaggtacccgtagtccgatgcaggagattgtgaaacccatgttggctacgtcgaccctagcgtcagttagctctaggtttcgggtgttagagaggtgcaagaagcaactctattttcatggaattatacaatggtggtcagttagaggccatgcatatagaggctgggccgcatatcttgctcataacaaaaactacgagggttttttttgcgcacccatcaaattgctgcaatttgctgggtgcgcaaaggaaaaaacccaaactacgaccgactttgcttctcatgctattcggcattcacttctacggtga

SEQ ID NO: 73049 - DNA, 207 bp, Glycine max
  Peptide Sequence Number=SeqID_189827
atggcgcttaggatttctgaaggaagagagaagcaaaagcacatcgggagaaggaaaacgtattggaaatgctttagaaacgtattggagaagcttgggcacgtattgcaaaggcttggaatgggaaacgtattggtgcactgtagtagaggtgacatttttgggcggaaaattgagttaaccacaacacgacacgtaggcatctag

SEQ ID NO: 73050 - DNA, 1080 bp, Glycine max
  Peptide Sequence Number=SeqID_189828
atggatggtgacgaagtgtttgaatgctataaagacttgctagaagagaggaataactttgcaagtaaggtggaacatgcagctgaagagaaagaagagcctgttgcgacagtggccaagtttgctaaggtaatcattgacctccaagcccgactacaagaatcaaagtccaagctaaagaagtctaagcttgagtcagaaaaggagagggatacaaacaaagagtttgaagagcagctgttggcattcaagaagaaggatgtgaatgacagtgaactgcttgatgaagaagaaatggttgttgtagaggaggacaccaatgaagagcaagatgatggggccaatgttgaaggttctgccaatcaacctgatgatttccctttttgctttgcggagtttcttaccccaggccgtagggatctacttgaggttttgtaccaaggagccttggagattcatcaaggctcaccaaggatagaccttgggtttgatgagtgtttggagattcatcaaggctcacgaatggcggaccttgggtttgatgctttggagattcgtcgaggctcaccaagggtgaaccttaagtttgacgagcctttggaaatctgctttggagattcgctaaggcttaccaaggacgaaccttgggttttaccaaaggcagaccttgtgtttgacgagcctttagagatttatcgaggctcaccaacggtggaccttgggtttgaattaagtgttgttgtcagtggaaatgacgtaaggaagaccatatctacagatgaggtgttaatagggtctttgtatgtccatcctccacaagaaatcaagaaaatttttagggctatggcttgccttgatgatcaaaaggtgactcttggtacctacatgctcactaaagacactaagtattggtgggagagtacccatcaatgcttagtggcggaggctagactagttacttgggacgtcttcaaagagattttcttggagaagtactttcccgagtattctccctactacaatggtgtgggtggagaaagctcaaagcgtgttagtttatcaatggattactacctgtga

SEQ ID NO: 73051 - DNA, 228 bp, Glycine max
  Peptide Sequence Number=SeqID_189829
atggaggacaaagtttccaagccaattgaccaaaagccactgaaagagtctttgctcttagtggtgttgaagcctcagtgtttgatgacccaatccaagaagttaaacttgcatgtgtcttccttaaagtttgatttggttgttgacatgccaactagtggtcctgttactacttttgatgtttgcttaaattgtcatgtgatgatttttgatatgtttgcctcttag

SEQ ID NO: 73052 - DNA, 207 bp, Glycine max
  Peptide Sequence Number=SeqID_189830
atgaaattagggcatcgcatggaaactcacccagactgtagttgggtccgcgagaaagatcaatggctcaacaccaccaacaacaacaacaacctgcacccaaatatgcttggagtacttcaaaatatttttggaataattctgaaggacaatgagagcggcatgaagaggagtgggagtctcggtcgaggagtgaagaggagctga

SEQ ID NO: 73053 - DNA, 304 bp, Glycine max
  Peptide Sequence Number=SeqID_189831
atgtcgggatttacacgcgattctcctcaaatttcagccagcccacatcaattagaccttgcaccttacgcttcaggcccctacaatgctcaattgaatgccccggggcttctccgtgacaagcacacgttgcattcgagtcgtattctaggagaaatggaggttgatgaaccttggcttgggttatggctaccattgaattatcaagtagatatgggagcaagttttctcgctgcaaaattcatttcttggttggtgttttggtttatgctaaaggtggtgtttgtcattggaagtgcagtag

SEQ ID NO: 73054 - DNA, 327 bp, Glycine max
  Peptide Sequence Number=SeqID_189832
atgcagatgtgtggtaatgcaatgatttatgcaaatgcaatgcacgaatatgataaaggacaaatgcaggaacgatatgtccattgcgatgccatgaagagatgcatgatgcaatcaaggaatatgccaaagaacctaatggaaatgatccaaaggtccacttctagtgataactccaaagggtggtttcaagtaacttcactggcttctagagatatcatcctcttagatgaggtttcactatcatcaagcgagtcagagacccaacatgaccacagattgacctccactccttatggctcacatagacccgggtatagggcctaa

SEQ ID NO: 73055 - DNA, 201 bp, Glycine max
  Peptide Sequence Number=SeqID_189833
atggagaattcatccataacagtcaaccaaatgttcgtaatatacttgcgcagtaacagtaacgattggggggggaaaactgccaggaaaccacattacaagcgaaacctcaaagagagttgggcttcgtcctcaaaaggaaacaacaccagaaaatctagccttccatggattcaaatagaaaatgcaaatgaaacatga

SEQ ID NO: 73056 - DNA, 228 bp, Glycine max
  Peptide Sequence Number=SeqID_189834
aatgtgagccctattttactcgcgctctcttcttctccatttaagcttcttcttcttcgcgatcgtatctgtttgtatttgcaaccttatcgagactgtgacagctcaccaccttaccaaggtgcatccacagtcaagcatagtaaggatttgcaagacatagtgaagctggttgggctctacactatgcaacataatggtgattgtaagttgtgccatgctaattaa

SEQ ID NO: 73057 - DNA, 297 bp, Glycine max
  Peptide Sequence Number=SeqID_189835
atgatgcttaactttctcgttttacttaatgtgggacttcactcacctcacacttgtactccaacaatccccccctcaagtttgagtctctttcacatgccattaccgccaacatactctaatatcttgcatcgtcatgctcttcatcgttccatggccacaggacacatcgctgaccctccatgcatggacttacctgttaggaagactttagatataagggatcccatgttcatggattcatcatcaccatctttctcgtctgagtcggtcattacatcaaatcatcggttttga

SEQ ID NO: 73058 - DNA, 591 bp, Glycine max
  Peptide Sequence Number=SeqID_189836
atgatttgtttcaaaggaataaccgtcggagaactttgtcttaacacattggagggtacatcctttgtggtacaagtagagggtacatctacttgggttattgtgactgagaacaagagagggtacatctcttgtggatcaattctagtggagggtacatccactaggttgatcaaagagaacaagggagggtacatcccttgtggatatttgcttcgagaccgtctacttgttgaactgaaaagcaatttacgaaaggcccaattgcgtatgaaactgaatgttgataggaagcgaactgaggttttagaatggattggtaatgaggcatataaattagagctccctttagacgccaaaattcaccctgttttccatgtttcattgttgaagttgtgccagggtgatcttgtatctcaatatatttccctgcctcttatgttatcatctgcagggtcacaactgcaacccatagctgtgcttgatactcgcaaggttctgttagataacacttggatccctcaattgttgattcagtgggaaggttctaaggcttacacatgggaagctctctcatacattcaagaatag

SEQ ID NO: 73059 - DNA, 2043 bp, Glycine max
  Peptide Sequence Number=SeqID_189837
atgggtcggaactaccatcctcagaggattccatggctcctccaagtcttgtataagagagtgattctactgctttacttcaccatctttcattacaggcttatcaaggttctcctagttgtgccaccatccgctttaagggtttcattgcagcttcctatggaacctgccggagatgtgaaagtgatggtggggaacgagcattatttacatgcagaaggagttgtccgcgacttacctctcactattagtggtcagaccattcattttccgtcatatgttttgcctgtatcaagtgcagaggtggttcttagagcatcttggcttgccacattaggggcccacattgcagattacagctctgctagtatcaagttctatttggattatgcttttgtgaccttacagggagacacttcctattgcccttcggttgtgcaatttcaccatcttaagcgttattatgctaatcatgctattgctgagttatatactttatcttgctccccacatgattcatcggttgctcattccatggacttgtcagctgacttacatcttgacttggtggctattatacgtcaatttttcatggttttttatgttccgaagggtctcccaccaccacacactcaagatcattctattcctttacaagatggtgtctctgcaattcgagtcaagcgctatcgctatcctttctctcagaagactcagatcgaacgtatggatggttcatggcgtttttgtattgactacagggctcttaatgctgtaacgatgaaggattcttttcctattccaacagtagacgaattacttgatgaacttaagggctctaagtttttttcaaagttggatatatgttccgagtatcaccaaattttggttagacctgaagatctccacaaaacagctttcaggactcacaatgcaccggctaccttccaggcattgatgaatgataagtttgtgcttgtcttctttgatgatattctgatttatagccccgcatggacaacacatatggagcacttagctatagtgttggattgtctccgccaacatcagctatttactaaattgtcaaaatgttcatttggacaacacaagctggagtacttgggtcatattgtttctgaccaaggggttgaaatggacccttctaaggtccaagttgtccaagattggccttgtcctaccacagtaactcagttgaaggcttttcttggtctcaccagatactatcgtcgattcattaatcattatgcatctattgctggacccctcattgatcttttgcataaagataattttcgttggacttcagaagcggatgttgcgtttcgtgctttgcagcaagctttgaccacaacttcagtcttatctctatctgattttactcaaccatttattgttgaaacagatgcctcaggccaaggaattgcttatgttcgtgagttgtatgcaattactaaagcagtggctaagtttcgtcattacctttttggtcattatttcatcatccggacaaaccagcgtagtctcaagcacattacggaccaaatcattcaaacaccagagcaagagtccttgttacctaagcttcttggcttcaacttctcgattgagtataaacctggacccactaatcaagttgtcgatgctttatcacgatctttctatatggctctttccagccctcaagcaaaccttctagatgacatcaaggatgtggttgcatcatccccaaccatgcaacaattgatccaacaattccagtctgatcctgcttccatgccgcaacataaattgaggaatgggttactatttttgcgtcaccgtgtttgggaagatgtggctatggattttatcactggtttgccactatcaaatgggtattctgttattttggtagttgttgatcgcttgtctaagtttgctcactttgcttcattacggtcctattttacaacacaacaggtagcagaggtgtttcttcagaatgtggtgaaattgcatggcattcctgtcacaccctga

SEQ ID NO: 73060 - DNA, 379 bp, Glycine max
  Peptide Sequence Number=SeqID_189838
catgcaacagggacaagtagatatcttcatagctaggttccctgaccctgactatggtgttaaaacgggttcctctcagtgtagggttgcaacggagaacaacggcggtttgtggtggctaatggtggatgtgggtgatggagaaagtgcttgggacgttagaaaaggatttggaagaaagaaagaagaagaaatggtgtttttcctaagctacacgaaagcaaaggctgaaaacgctcaagtgagaaatggtctcggacacggaaacgccgcgcacactccagacatcttctcaaagatcccaatggcagctcatgtagcttccttgagaagcttcattaagaggcttcctcaagaagcttcctcgtggcttctttga

SEQ ID NO: 73061 - DNA, 837 bp, Glycine max
  Peptide Sequence Number=SeqID_189839
atggcagaagcaaccagaatgaaggatttggtcgctgacctcaaacaagttaccgatattgtctcgaagcacgacgcacaacaccgcacaactcaacaacaattgatacgcattgaggatactcaagcgtccttccaacacacactcgatactatcacccgttccgtggactgtcttaccacaaacactctgactggagctttgtcgtcaggaacccaatcgcgaccggtgaaattggattttccaaaatttgatggttctaaccctcttcagtggttattccgtgcggtgcaatttttctcatattatgtaactttcgatgcgcaaaagctcatcattactgtggtgcattttgaaggttcagtggtgccatggtttcagatgttgcaaaaatccaatctaattcctacatgggccgctcttgcgcaagctattgaggaacaatttggcccatcccaatttgatagcccaagggcccagttgttcaaattgtcccaaaccaattctgtggcggattactacacccaattcatgacacttgctaatcgggttgagggattgactgagccggccttgcttgattgttttattagtgggttgtgggaccccattcgacgtgacgtcattgcccaatctcctcccaccctattacgggcagtttctctagcctgtctatttgatgaaaagcttctcaaagaaacctctcaagaaagcttctcaaagaagccacgaggaagcttcttgaggaatcctcttagtgaagcttctcaaggaagctacatgaactgcctcggtaaaaacgctgcccagccttcgttaacaattggatcttcttga

SEQ ID NO: 73062 - DNA, 363 bp, Glycine max
  Peptide Sequence Number=SeqID_189840
atgcattcttgtgcaacagcagtagccaagaaagctgaagtaattcgtgagcgaactggttatcaagtaggccactattgtggagaaatagggcaggatttctgggatgctcgaaggtggctgcgagaatttgacaccaagcatgttttagtcatgacagctcaaattcttttgaacattttgaggaatagcataataaaaatggaagcaatcaatctcttgattctggagtgcctccatgccatgaagaaacacccatattcactggtgatgtccgagttctaccatacaacacccaaagagaacaagccatctgtatttggaatgactgcttctcctgttaacttgaagggtagttattaa

SEQ ID NO: 73063 - DNA, 282 bp, Glycine max
  Peptide Sequence Number=SeqID_189841
atgaagggaccactgatggaatggcagcccaaggaacatgagatggaactccaacgtcttaatcaaaatgaagaaaatgacaaaaagaagagaagtatagtccttaaagcctcatcatcaatgcaagaagaaaatgaagaagatgattcagatgatgaaaaagacttttcattctttgtgaagaaatttcagaaatttatcaagaaaagaagaattggcaggcgtcaaaacttcaacaatggaagaaaatcacaagaagattctcaaatccttagatgttaa

SEQ ID NO: 73064 - DNA, 297 bp, Glycine max
  Peptide Sequence Number=SeqID_189842
atggtggtgagcttcttcttgactcatcttttccttgaagtggcatcctctattatctttcttccttatccattccgctgccatgatcttcaagaagcaaaggactccactgatgaagaagatccaaggcctacaagctccccatggagctacatcatgtctaatatgtacaaagataagataagaggccttctcaaagagtcaacctcatgctttctcataaggtcgagccctttggtactagtgcttattggcttgtttcataggactcaacgtccaatgctttatctttcatag

SEQ ID NO: 73065 - DNA, 300 bp, Glycine max
  Peptide Sequence Number=SeqID_189843
atcacgatagcaaagggtggggtggtcgacaaaagcgaggcttttgctcctacgtatcctcaatatgtgatgaggaacttagacctacgtagttcttgcaaaagcggtgtcttcgcatgctaccggactctcgggtcgctagatagcaaagggtgtttgtgggttatcgttgggtgtctccgcatgccatcagactcttgggtcacggtaacaaaaggtagagtggtcgacaaaagcagggcttttgctcctacttatcctcaatttgtgatgaggaactcagacctacgtagttcttga

SEQ ID NO: 73066 - DNA, 186 bp, Glycine max
  Peptide Sequence Number=SeqID_189844
atggggctccggataagatttgagggtggaggatggacgaacagtgctaggcaatcaattcgtggggctccagactcgatggtggaggatgcaatcaattcgtggggctctagactcgatggtggaggatgcatgaatgaccatcaattcatggggctccggataagatttgagggtggaggatag

SEQ ID NO: 73067 - DNA, 231 bp, Glycine max
  Peptide Sequence Number=SeqID_189845
atgtcgctacactatattagtagtaataaacattccaacagggcatgtaaagacatcacagtcaagacaagcatcccaacaacattggcacccccgcctaacttagataggaagagaactatatacaaacaagacttagttcattatagtcaatgggggacttcaacacacccctcttggcccaaggttaccccgccacaactaaggtgggttagaagtcaccacaattaa

SEQ ID NO: 73068 - DNA, 198 bp, Glycine max
  Peptide Sequence Number=SeqID_189846
atgttgagcttcaggtcaagcttttccaactacacggaagtgcccaaccagggggaacagaaatcaaaagggtatttcactaaacctcacatcgtaaagaacttgctgagtcaggacaagagtggttacgaaaatgaagttgcttctgcggtgaagggtgtcttcaagacatcatcggagctcagccagaagagttga

SEQ ID NO: 73069 - DNA, 282 bp, Glycine max
  Peptide Sequence Number=SeqID_189847
atgagtttagaacaacaactcagtaagaattcccaactgagggttttagcctttcatggcaaggaagctccttttacactgaagaagaggaatcaagagaaattgcttgcttacaaaggagtggggatgtctcctctacctctaggaatctcacaatcactcaaaaactcactaatctccctaaaagatgaaaacttggtcccttgctctgctctatgctctctgaaattcacactcttcaggcctctaacggctattcagcacactttggctcccccttaa

SEQ ID NO: 73070 - DNA, 414 bp, Glycine max
  Peptide Sequence Number=SeqID_189848
atgactttactacatatggcattgaagaaaaagcacaggcgagtcatgattgccaaagggattcattccgtcagtggagagtccaagcctaagatttcttgcctcttttccaaattccagatacaaacgattaatcaaccggatgatagagcatttcttcacaatttctcccatctgcatgccatgtgtcgcaacgtgcccttcgcgggcgagcgagggcgaggctcacgggtgcgctttccaaaggaggaaagatgcgcggagttgccaccaacgtttatttgtggaaaacgtcaggaaaaccgaaggaaaccggtcaaaatgaaaattctaagttcgggagttgtatttacgcttgaggaaggtattagcacctctcacgtttgtctcaaaggacaacaacctattttttag

SEQ ID NO: 73071 - DNA, 155 bp, Glycine max
  Peptide Sequence Number=SeqID_189849
atggtgcctacccctacaaaagaacggtgggcgagcaagcgaagccccaggaagagcgctatcctactcaagaagagaagttctccagatatctatggtgaaccgatgttgcttagggtgggtgaccatcttatgattgaagataagcaccgaaa

SEQ ID NO: 73072 - DNA, 1425 bp, Glycine max
  Peptide Sequence Number=SeqID_189850
atggtgccggtgatccgtcgcctggatccggaaaacaacgacgaacgcaagcaggcgattaagcgtcaccttgagttcttcaacacccatccttacgtggccgcgccagtgctcggcgtgaccatggccatggaagagcagcgcgccaacggggcagcgatcgatgacggtgccattaacggcatcaaagtgggcctgatggggccgctggctggcgtgggcgacccgattttctgggggaccgtgcgtccggtgttcgccgcgctgggtgccggtatcgcgatgagcggcagcctgctcggtccgctgctgttcttcttcctgtttaacattgcgcgcatgctgacccgctattacggcgtggcttatggctatcgcaaaggggtggatatcgtcagcgatatgggcggcggcttcctgcaaaaactgaccgagggggcatcgatactcggcctgtttgtcatgggggcgctggtcaataagtggacacacgtcaacgtgccgctggtggtatcccgcatcaccgaccagaccggcaaaaccacggtcaccaccgtgcagtcgattctcgaccagctgatgcccggcctgattccactgctgctgacctttggctgtatgtggctgctgcgccgtaaagttaacgcgctgtggatcatcgttggcttctttgccatcggtatctttggttactggatcggcctgctcggtctcgccaacgctgaggtcacttcggttgaggaagaagcctgtatgtcactgactgacgccctgattgccctgctgatcgccgctctcgccctgtttgcgatttacgacgatcggcatctttatcgtgctgctactgattctgctgtggaacaacgtcagccatcatggcccgcagctcaccaccactttgctgatggtgctcgtgtggatcgattaccggcgtattcagagtatgaacctgtcagaggatggcattctggtgatgcagctggagcagcgtcgcctgctgattgcggtgaaacagctcgacgacctggagaaaatctaccatacgctggtggaggcgcgttaaacgcgctgccacagcgtcagggtgaaatccgcgtcacagctaaaggtggcgctggaggccagctgctgccacaccgcttcacgcgcacgccaggcaaagggggtcatctgcagcaggctcaccgcttccgccccgttcagcgtcatcgtgtagtgaaggttttgctgatcgatctgctcaaatcccgcatagtttttctcttccgccgtatgcagctgcacttcacgatagatcaacgccttaaactgctgcagatggtgcggccccggcgtcaccgtcagcaaatagccgccgggcctgataacgcggctcagctcctgctcgttacagggcgcgtaaatgcgcacgatggcgtccagtga

SEQ ID NO: 73073 - DNA, 360 bp, Glycine max
  Peptide Sequence Number=SeqID_189851
atggatggacgggcagctctgcattttaggccaggattactgcagatcttgtgccacaccattaatttggcctatattaagaagaattgctggaacctggatgacccttcggtcacttttccaaggacccgaaaatccaggcctagaagatctgaggccccatctccttcagttgtccctgctccccctacttctgctctctctacttctgctctcccttcagcgccagcagccccaattcttccaggtccctccgctcatagctcagagcctttcatgtctatgttgcagagcctgcaccagggtcagctcctgattatgagagcttgcaggatgtggtctagcagcgaccagttatga

SEQ ID NO: 73074 - DNA, 168 bp, Glycine max
  Peptide Sequence Number=SeqID_189852
atgttattagtggcggttggtagcaagccaacaatggactatggcagaaacatgaatgctggagtggattgtcttgagtcttgcacattgcgaaaacgtgataagaacttcgggctgcttggaatggatgttgctttagagaacaatgaatcatctataggcatgtag

SEQ ID NO: 73075 - DNA, 309 bp, Glycine max
  Peptide Sequence Number=SeqID_189853
atggaagctctcaagatattcaaatggtcattatttttcactccgatgtccgattcaggcacatcacatatcgagatgctcgaaattgaacaattgaagctctcgagatattcaaatggtcttgacttttcacacggaggttcgattcaggcgcatagtacatcgagatgctcgaaattgaactacggaagctctcaagaaattcaaatggtcgaaagttttcactcgaatgtccaattcaggcgcatcgcatatcgagacgctcgaaatagaacaacggaagctctggagatattcaaatggtcataa

SEQ ID NO: 73076 - DNA, 1134 bp, Glycine max
  Peptide Sequence Number=SeqID_189854
atggcggccgatctgctggcgattgccatggcggagattggtagcattgccgagcgccggctggatcggctggtcaatccgctggtcagcgggctgccgccgtttctggtggcgcagccgggcgtcaactccggcatgatgatcgcgcaatatgtggcggcttccctgtgcgcggagaatcgtcagctggcgcagccggcggtgctggacaattacatcacctcgggactgcaggaggatcacctcagcctcggtaccggcgcggcgctcaagctgctcagactgctgaataacctctggcaggtgctggcgattgagtacctgctggcggcgcaggcgctggattttcacggtgaggcgcagctggccagcggcacgggccgggcgctacgcgcgctgcgcgctgaggttgctacctggcaggaggatcgctggctggcaccggagatagcccgggcgcggcgcaatgtgtcgcgccgccagtgtcctgatttaaccgcggcgcgcgtccgggcgcaccagatcaaaacgctgatcttcgctgatcgcgtaataggcggaaggaccgccggcgcgcagaatcggctgcgctttggcggtctgatagatgccgttctccagcagcgcttcatcgatatgaatcgccaccgcttcgcccagtaccagccagctctccagctcgcctccctgtgcatcctgcaggcgaatcagctgcgtcaggcgacactcaaagttgaccgggctttctgccaccatgctgacgttaacgtgggaagcggccagcggcgtcaggccggcgagggcaaactcgtcgtgatcgggcggcaccgaggcggagctctcattcatggcttctgccagcggacgcgtcgccaggttccagacgaactcgccggtttcactgatattctgcacgctgtctttccagccgctgctggcaaaaccaatgattggcggatggtagttaaaacagttaaagaaactatagggcgccagattgcgctggccgctggcgctttgcgagctgacccagccaatcgggcgcgggccgacgatggcgttgagcggatcgtgaggcagaccgtgtccactgcgtggctgataagtgtaacgttgacgcatttgcgctcctga

SEQ ID NO: 73077 - DNA, 942 bp, Glycine max
  Peptide Sequence Number=SeqID_189855
atgtccggagaatctatgaacaagcctgccgctaccgcgctctttcatccgcgtaaccgccatcagggccgttatgattttgctgccctgactgccgcgcatccgccgctggcggacaaagtgcgccccaacggttacggtgagctgtcggttgatttcgccgatccgcacgcagtgctgctgctgaaccaggcgctgctgaaactgttttataacctgaactggcagctgccggaaggctatctgacgccgccggtaccaggccgcgctgactatatccatgcgctggcggatctgctggccagcgataacggtggcgtgctgccgcgcgatctcgacgtgatggatattggctgcggtgccaactgcatctatccgctgatcggtcacgcggagtatggctggcgctttaccggcaccgacatcagcgcggacgctgttaacgccgccagtcagattgtggccagcaatcccggcctgcagcgcgccattcgcctgcgccgtcagaagcaggagagcgcgatttttgctggcgtggtgcacaagaacgagcgctatcacgcggtactgtgtaatccgccgttccacgcctcggcggccgatgcggcggccggcagtcagcgtaaagtgcgcaatctcggcctgagcaggcaggcgccgcttaatttcggcggtcagcataacgagctgtggtgcgacggcggtgagcgtgcgtttatcggccgaatgatcgatgaaagcgtcgcattaggcgatcgcatcgtctggtttacctcgctggtgtcgcgcaaagagcatctgcctgaactgcgcgaccggctgaaggcgcacgacgcttatcaggtacgcatcgtcgacatggcgcagggccagaagcagagccgctttatcgcctggacatttttaccgcccgccacgcgcgcgcagtggctggcacgctaa

SEQ ID NO: 73078 - DNA, 138 bp, Glycine max
  Peptide Sequence Number=SeqID_189856
atgtatcgtgggccccgtggctcgttcggtgtagaaggtcgatcgaaagtcggcccgtccgggcaggcagaaggaatatacactaatgcaccggatcccatcagaacttcgcagttaagcgtgcttgggcgagagtag

SEQ ID NO: 73079 - DNA, 384 bp, Glycine max
  Peptide Sequence Number=SeqID_189857
atgactttgcaattagctgatcgctccattaccaggccctatggagtgattgaagacgtgttgatcagggtaaagcattttatcttctcagcagactttgtggtcatggatatctctgaagatattgacatccctgtaatcttgggaaggccgttcatgttgactgcaagctggatagttgacatggggaagagaaagctggagttaggttttgaagaccagaaaattgatttcgacttgtttgtggaagacaagcctgctccagaacacaatgtttgcttgcaggtaatgggagaaggtcaagaggttttgaagagtcctttcgctaagcacaagcctcgcgctaagcgcatctctgttcatgcgctaagccacgagtcttga

SEQ ID NO: 73080 - DNA, 303 bp, Glycine max
  Peptide Sequence Number=SeqID_189858
atggaatgctatcaaacgttagagctgcaaggatcgatcagaacaaaacaaggccaaacactaggtgttcctacggatttcttcgagccacacttccaagaacagtgtagggggttttgtgggttcgagcgaggacagtgtgggtttttcggcagtgtagggggttctgtggtttcgagcgaggacaatgtgggtgtcgagggagcggtttccggcgggaggagaaagagaagagcgatttcagacaggaggatgaaaaagagaagagggagggcaaggttttcgagcgcgcgcggcttgtga

SEQ ID NO: 73081 - DNA, 498 bp, Glycine max
  Peptide Sequence Number=SeqID_189859
atggagagaagtttgatagatgctgccagtggtggagcccttggagacatgacccctgctgaagccagaaatttaattgagaagatggcttcaaactcccagcaatttagtgctagaagtgatgctattgtcaatagaggagtgcatgaagtagccacaagttcatcttcatcagccaagactaagaagcttgaaggtaaactagatgccttggttaacctggcaacccaactggccatgaataaaaaatctgcacctgtcgccatactctgtggtttatgctcctctgccgaccaccacacaaacctttgcccttctgtgcaacaatctgaagcaattgaacagcctgaagcttatgctgcaaacatctacaatagacctcctcaacctcaacagcaaaatcagccacaacagaacaattatgacctctccagcaacaaaccatacgttcctccaccaatccagcagcaacaacaacaacaacaacaacaacaatag

SEQ ID NO: 73082 - DNA, 423 bp, Glycine max
  Peptide Sequence Number=SeqID_189860
atgtcatcggactcaccgtctctggatgacaaaggtgcaaatgaccataatttgtctctgcgtgtcagcgggctcgcttgcctcttgttaacaaatggtgcgggaccatatggttcccccagatgtcaccagactcaccgtctctggatgacaaaggctcgctttcctctggttgacaaaaggtgcaggaccatatggtttccccgcatgtcattggactcgccgtctctggatgacaaaggtgcagatgaccataatttgtctcagcgtgctatcaggcgtttgagtcttatagatagcagaaagaatgtttatacggataaccacttgggcatgtcacctgagttcagggtcagtatgacagagattgtggggcggccgacaaaagcgaggctcttgctcctacgtatcctcaatttatga

SEQ ID NO: 73083 - DNA, 249 bp, Glycine max
  Peptide Sequence Number=SeqID_189861
atgatgaaagccctcacaagctcttgttctaaggccatggtcgagactctaggacccttctctcccagagttcccctttgtgtttctgatagacccaaattctgcttcacccttcgttccaaaaatgagaaaaagggatggaatttattgctcctgaaactggttcgaaacaatgatctttaccctgttcatgcagtgccaccaaaggaccagcttggtacgattctttccagcatatttcgggtttga

SEQ ID NO: 73084 - DNA, 243 bp, Glycine max
  Peptide Sequence Number=SeqID_189862
ccagcattggcaaaagtgaccaaaaaagaggaaggcctcacaagtcttcagaagatagtgattggtgatgtgtgttcaattctcacaatgcatggtggaattgattggttgaatgatgacatcaatgctggaaaattggactactattacttcctcatagctgggttagcttcgattaatctaatgtcgaagaaaaagttgtggagaaacttaagccttgaggggtattggaaaaatgattaa

SEQ ID NO: 73085 - DNA, 333 bp, Glycine max
  Peptide Sequence Number=SeqID_189863
atggaggctttggaggcagccatgcttcagtccattgtggaagctccacttaatgagactaaagatgatatgattgaaacagatcatgacactgctaaaatctatcctcgccatatcacaacagttgatgaagaagttgttgatgctcttatcaagctgctacccttaagaccaagctcctcgactcaacaagagacaatcaaagaacctgacacaaatgctacattaaattatggcttcagaggttttagagtcatggagtggccaacttgcaacaaatcttggagggagaaaataggttttggctctcccattctggacccaaatatgtag

SEQ ID NO: 73086 - DNA, 357 bp, Glycine max
  Peptide Sequence Number=SeqID_189864
aggatcccacatcatactgagttcgacgagttcaaggtggagttggagagacgtaatctacacaaacgccttgccaacctccaagatggaagcatagatgtagctgtggtgaaggagttttgtgctaatctatacagcccagaggaccaagcttctaaacaagctagagtaagaggacatctgattaagatcgatgcagacagactgaatgaatttcttcagactccagtggtgttagaggagggggaatctttacccacctactctagattttgcaggttgaggactaaccaccaggagattaaagttaggctttgtattccccgcaaggggtttgttttgaatgctaagggctag

SEQ ID NO: 73087 - DNA, 507 bp, Glycine max
  Peptide Sequence Number=SeqID_189865
atgactcactataatccttaccctcggaagcaaaaaggaaagaaggaaaatttccaatcaagagaaagcaaaaagaaaagaaaggaaattccaatcaaaaagtgggagaaagcaaaaagaaaagaaaggaaattcccaatcaaagagtgggagaaagcaaaaagaaaagaaagaaaattcccaatcaaagaatgggagaaagataaaacacttacctgtgcgagattgatacactttgagtggatttcttctatttttgtcaaacccagtgtttcctctaaatggtcatttagaaacaaaatgctaacatccaaaatctcatataaggttatggggggatttcatcagcagactctccttccccgtggagaaaacaccgagactttttcaagtctcacaagttatccagaactacgtaggtctgagttcctcattggaggatacgtaggagcaaaagcctcgcttttgtcgaccgcgccgctttctgttaccatgacccaagagctg

SEQ ID NO: 73088 - DNA, 463 bp, Glycine max
  Peptide Sequence Number=SeqID_189866
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctgcgtgctcccttccatgagcacgcagagattgggcatgccatggaccactttcacttgcaaagacacctctccacactctcaaagccaagaccagcccatgttctctccaacaacacattcgctcagtcactctcatcagttcctaatgatgttaaggaagaggggttggacttcgaggagagaggttga

SEQ ID NO: 73089 - DNA, 231 bp, Glycine max
  Peptide Sequence Number=SeqID_189867
atggattacacaaccgtcccctctctggcttctagaatgtcacgaaactttgcggattgcgtattaacgcttcctttcgactcccgacatgttgcgaaacttcacggattgcctaacgatgggtgtcaagaacctcgaagtggtcaagcgaaggtcacatcccaccaaacagatggtccccggacgaaattagggtatgacagcgggcccttgctcccgctaagtgcttag

SEQ ID NO: 73090 - DNA, 252 bp, Glycine max
  Peptide Sequence Number=SeqID_189868
atggccttgccgtctccaaatcaaaaatcaatctattcaaaacaaagatttgattccttggtcacaacatacaccaagaaaaattcacctccttggtctgacatacatactcaagttgtcaaagatatcaaactcaaagtccaatctataaatagtttgtatctcccaattccacaggcattcaaaattattgagactgatgcatctgacataggttatggtggtatcctcaaacaaagagtccatacctaa

SEQ ID NO: 73091 - DNA, 357 bp, Glycine max
  Peptide Sequence Number=SeqID_189869
atgacttctacctacaactactttatagacttctttcgcatcacatgtctacgctcttcatcgccctcgaatgatgccaatgctccaccatgcaagctctctctctctctcatactttgtgtgcattctaatccaattgattgcaactatgttcaagtgaagaagaagaagatcaacaatagatggaattctgcggtctgcaaccagaagcaatcggtttgcagagtcttcgcccaggtattcatggccaaggaacttcgcaagttcgtccaaaacatcaacatgtcccgcaagtccttcaacaatggagaatatccccttgccggaaccctaaatttgccgcttgccgccacataa

SEQ ID NO: 73092 - DNA, 135 bp, Glycine max
  Peptide Sequence Number=SeqID_189870
atgtcttgggaaccaagttgtttgcttaatcaaattgtacctcactttgtgagaactcggtgccattgttccagctcgagaaaagcaaaagattgtgagaactgctatcagcaagctatgttctctgagtattaa

SEQ ID NO: 73093 - DNA, 180 bp, Glycine max
  Peptide Sequence Number=SeqID_189871
atggctggacttttgggatatatgagccttccacctaaggcaaagaatttggtagcaattgataagtttgaagctgacaagaacaagaatgcgggtgatgccaacatgccatcaaaggctatacttgattcaacgggttccttagctgagtttgcctgtgaagtggaaataacagagtag

SEQ ID NO: 73094 - DNA, 140 bp, Glycine max
  Peptide Sequence Number=SeqID_189872
aggaagcactgggtccaacaaagataggagaaaatcactcaaagtgtatcaatctcacacagggcaaggattgacattttcaccctgggtcaaggtttatgataatttgggattttggctcaaggcttgtagaacggctg

SEQ ID NO: 73095 - DNA, 141 bp, Glycine max
  Peptide Sequence Number=SeqID_189873
cgggcaacagacacaccgccatcacctctagagttcatctcagctcatccacaaaaagccatcaagcgtccagctcaagacattaaagaagcgctactaggaggcaccctagtaccttttatatctctgcgtgttatttga

SEQ ID NO: 73096 - DNA, 264 bp, Glycine max
  Peptide Sequence Number=SeqID_189874
atggacgcagatttactctatgaaccagagcacaagtcaatgtcagctcatttagactcatttcaagggatcttccttcgcaagagacccgtgcaacgtcgtatgggtcatcaggttttaaagacatatcatcatagagacgtgcatttgaagaaggaagtgcatttaatgcaaacttcatatgcaagctcaagtaaagaaatctatcagtttagaaacaatggatacctgaagatgaaggccaatatataccaggagctttga

SEQ ID NO: 73097 - DNA, 2025 bp, Glycine max
  Peptide Sequence Number=SeqID_189875
atgttaggcactcctcacaccctcatactccttctcttcctcttcctcatcaccaccttctcccactcccttgtcttcaacataaccaacttcgacgaccctgccgccgccaccgccatatcctacgagggcgacggaagaaccaccaacggctccatcgacctcaacaaagtcagctacctcttccgcgtcggaagggccatctactccaaacccctccacctgtgggaccggtcctccgaccttgccatcgacttcgtcacgcgtttcaccttctctattgagaagttgaacttaaccgaagtcgcctatggagacggcttcgcgttttacttggctccgttggggtaccggattccgccgaactccggcggcggaacctttgggcttttcaacgctaccaccaacagcaacctccccgagaatcatgttgtcgcggtggagttcgacactttcatcggctccaccgacccgccgacgaagcacgtcggcgtggacgacaactcccttacctcggctgcgttcggaaacttcgacatcgacgacaacctcggaaagaagtgctacaccttgatcacttacgccgcctccactcaaacactcttcgtttcttggtccttcaaagcaaaaccagcatccactaaccacaacgacaattcttcttctttttcttaccaaattgacctcaagaaaattctcccggagtgggtcaacattggtttctcagcctccacgggactttccaccgaaagaaacactatttattcatgggagttcagttcatctttgaatggttcccctgcggatttcgagaatgtgaaactaaagcaccaaagctcaaagcttgctttgattcttgccgttctttgtccactggttctgctctttgtcttggctagtctggttgctgttttcttgataaggaaaaaacgaagaagccatgatgattgcatgttatatgaagttggtgatgacgagctaggacccacatcggttaagtttgatttggacaaaggaaccattccaagaagattcgagtacaaagaactcgtggacgccacgaacgggttttcagacgatagaaggcttggacaaggagcttcagggcaagtctacaagggtgtcttgagctacctaggaagagttgttgccgtgaagagaatcttcgcggacttcgagaattccgagagagttttcaccaacgaggtcagaataataagccgtttgattcacaagaacttggtccaattcatagggtggtgtcacgaagaaggcgagttcttattagtcttcgagtacatgccaaacgggagcctcgattctcatttgttcgggaacaagagagtactagagtggcatctaaggtacaaaattgtgttgggcgtggtgaacgcgcttcattatcttcacgaagacgcagagcaatgcgtgcttcatagggatataaaatccgcgaacgtgttgctggacacggagttcaacacaaaggtgggggatttcggcatggcgaagttggtggatccgaggctgaggactcagaggacgggagtggtgggaacctatggttatttagcgcctgagtatgttaacgtggggagggcgagtagggaatcggatatctacagttttggagtggtatcgctggagatggcgagtgggaggaggacttaccaggatggagagtttcatgtttctttgatgaattgggtgtggcaactttatgttgaaggggagattatgagggctgctgatgagaaactgaacaatgagtttgaggtggatcaaatgaggagtttgcttgtggtggggctttggtgcaccaatccgaatgataaagagagacctaaggctgcacaagttattaaggttttgaaccttgaggctcctttgcctgttcttccacttgacatgtatgaacgtgctcctcctatggagatcattaggatgccacatcatcccagtggtaagaatcattctgggatgtccacacccattacttctagtcttgtgagtgttggtcgatga

SEQ ID NO: 73098 - DNA, 1520 bp, Glycine max
  Peptide Sequence Number=SeqID_189876
ggtgtttcaaaggtgtgataatgcaagaggaggaaaatcaggaagatccatgtggcgaatctatggaggaaaatgaacccaaaaatggggtttgggactgtttctgcatcccaattaattggtttaggatgctttctagggaaatgcattggagctttgtatttggagttgtggttgtttatggaataagccaaggacttggtggagctcttgcagaagttggcactaagtattacatgaaagatgttcagaaggtgcagccatctgaggcacaggtttacaaaggaatcacttccattccttggattgtgaagcctctttggggtcttctcactgatgttctcccatttttcgggtatcgcaggagaccttacttcatttttgctggtatcttaggagtgattgccatgcttctgttatctttgcatgaaaacctgcatcttatgttggcccttttggcattaacagctgggagtgctgcggtggcaatagcagatgtgaccattgatgcctgtgtggcacagaacagtatctctcaaccctcacttgctgctgacatgcaaagtttatgtgctttcagttcttctgttggatcactatttggttacttcattagtggtatctttgttcaccttctaggccctatgggggtgtttggtttgatgactatcccagctggacttataatttcggttggttttctgctttatgagcctcgtatgcacaacacatcttacacacaggtgaaacaaaattttattgatgctggcaaggctatgtggactacattgaggagtgaagatgtatgggggccttgtttatacatgtatttttcccttgcattgagtttggatatccgtgaaggaatgttttattggtatacagactcaaagggtggaccatctttctctcaggagagtgttggttttatattttcaattagttcagggggggcacttttaggtgcaatactataccagtatgctctaaaggattatgcattcaggaacttactcttctggactcagttgatttatggcttgtcagggatgcttgatctgattctggtctttagattgaaccttaagtttggcataccagattatttctttgttgtgattgttgaaagcatagctcaaatgactaataggctcaagtggatgcctatgcttgtgcttagctcaaagctttgtccctcaggtattgaaggcaccttttttgcactcctaatgtcaattgataatgttggacttctctcagcatcatggggtggaggctttgttctccacattctgaggatcaccagaacaaagtttgataacatttggttggcgattttgatccgcaacattttaaggattgctccactttggctgctgtttttggtgcctagagctgaccccagctcttcaattcttccaagtaaaaacatgaattcaaaggtggctattgacacttcagacatcaaaaatgttgaattggtgtcccttgtacacagtcttgaggttgatgagagttag

SEQ ID NO: 73099 - DNA, 222 bp, Glycine max
  Peptide Sequence Number=SeqID_189877
caatcaggcccacttgggtcttccaagatgttccaacagaaggcggtgccttctggtggaagcaacccagctcgcctgggcgagtttggcggcaaccacaaaatccaagccgaggcacttccgcaacgcttccgagacgtttccgtgggcgattttgtgaagattttccaccgttattcatcgttcttcgttctttcttcgtcgttcttcggtcttcaaccg

SEQ ID NO: 73100 - DNA, 207 bp, Glycine max
  Peptide Sequence Number=SeqID_189878
atggctcccttacagcttaaggtagctccgccctggctggatgactatggaaaccttcatgctttggaaaacggtgctgtctgggcgggaaacaccccccacccaggcgctagcggtggcgccctgcgcgcaggcacgttgacctatggccttccccgaggcaccttggttcgcgccccggccccaagcacgtcccggcgcccttaa

SEQ ID NO: 73101 - DNA, 442 bp, Glycine max
  Peptide Sequence Number=SeqID_189879
gaggaacaaatccattactctagaagaggttcaaaactcaattcagactaaaaagctccaaaagctacaagagttaaaggcggatgataatgaagaaggcttgaatatcttaaaaggaaggagctatgagagaggaccaaaaaggaagaagtccagatcaaaatcaaggagtaaatcaaaactaaagtgcttcaactatcataaaaatggtcatttcaagaaagattatctagagaaatggggcaaggagtttcatgagggtagttggatgcaagtgggtcttcaagaaaaaggaaggtattccaagtgtggagaaggcaagataactttcttacaaggagaccctgaggagaccatccatatgcaacaacctaaggggtttatagaagatcagacgtattggacaagtggtctcaataacttaagaggagaggtgaattaa

SEQ ID NO: 73102 - DNA, 141 bp, Glycine max
  Peptide Sequence Number=SeqID_189880
atgcccagggcacaaaattccacagcacaccatagtgcctatttcgggaaaagagctctggaggtagcaagaggagcagcttttgcagagatacctaggttttctaaacacccttgttggggatttctactgaacagctaa

SEQ ID NO: 73103 - DNA, 246 bp, Glycine max
  Peptide Sequence Number=SeqID_189881
atgaacacccgtctccgtgtgattggtgatcccatgaatggagttcaacggtacaccaaaatgaaatttggcagagttgttccgtttctcattcctatgacgaggggtgagggtcacaactcactctttgaggattcacctagtgagtgtggtgatggggccgccactgtgagatatgggctaatctttaagggacactcacgaaacaagatacaagcgcaaggccgtgtaacgcgctaccactga

SEQ ID NO: 73104 - DNA, 847 bp, Glycine max
  Peptide Sequence Number=SeqID_189882
agggacggtcttgaagcaacagtcttgtttggccattgttgattcaatggagttttttgagttgaatcctatcttccaaaaccccaaatccatgtcttattctgtgcttcccctccaacttggtgtgggattggcgtttggagggctgatttgtaaggacaagtctgagagtggtaatagtatggttttttctttggtgggggtgctggtgagtggtagacatagggagggtgtgggtgtggatgaggatgggggtgagggtgagggtacactggagggattcctaggaggaggtggtagggagtggatgctttttagtagtggggttggagagggctggcttggctatgagcatctatatggatgtgtatacttgtataaactgtttaaggcttcaattcacttactaatcattttgtgggtgagtgtaaactgtggacaaggcttgcaaacggatttcaaggtggatttcaaggataacaggcagcacaacattccaataagtcctaagattgcaaggcagcatgattttggtaaaattttagtggaatcgggctctaagaaagctattggtcctggtaatgctaatccagtagctgttgctgctctagaaaataaggatctagcattcctagtcactcaacttggttcagattcacaccaaagcaacaacaacaacaatagtgatgcaacacgtatccgagacaatagtgagatttcattcaggaaagtagcagaaaatatgccgcagccttcatgtgcttgtattgcaagcaggctaggaaaaggaacagattgtacgaaggctaaaggattcaatcttacttctgatgctgatagaggttga

SEQ ID NO: 73105 - DNA, 375 bp, Glycine max
  Peptide Sequence Number=SeqID_189883
atgtcacgccaaaacaactttgtgggttacgcgttcaccggaataaatccaaaaaaatttgatattccaaaaggatgtagcatagatcaactgaaggatttgatcaagcaagtagcacctaaagggaatcctcctcatgggattcacgaatcccaagttgtaaggcgtttgttttatcgacaacctagtcatttggagtattttgagaaagttttagaatttaaaattgttgagctgaaatgtgatgacgacgtgctgaaggtgctggtagagtctaattactggaaacaatttgtgtcaatagaaattttggctctctttcataaagtggttatggaaaatgaggacgatgtggttacgtccttgcgtgattga

SEQ ID NO: 73106 - DNA, 324 bp, Glycine max
  Peptide Sequence Number=SeqID_189884
atggaaggaatggccgcgccaagtggtgaaggttcatcacatggagcagcaactgctacacaaaacaatgaggcaccttcttttgctggagaactttggcaggatgtgaagtgcaatgttgagatgaaaaaggatatccttcaccttaacttcttaagctcaaatgatttgtctaatcgaataacaccaggagtgttcaaccaatacaaatactttcttggaagaggtggtaagcagcgactaagagaagctagaacacaggctgtggattttttgattttgctattagctggccttttgcttaggaacactttgctaaagtga

SEQ ID NO: 73107 - DNA, 165 bp, Glycine max
  Peptide Sequence Number=SeqID_189885
ggaattggaggtcctatgacaaggtccaagactaagaggatgaagcaagcattgcaaggcctgattctaaagatcaaagagaaagaagaccaatgtgaactaagggttgctcctaactgggtcactcccctacaaattgatgaatatgttttaaggccaatttga

SEQ ID NO: 73108 - DNA, 132 bp, Glycine max
  Peptide Sequence Number=SeqID_189886
aagttgaagaagtcagagaccttaatatgggtggactttgtggagtgtcctaaggttgaagtagtctatggttcaagttggaaaagtggggaccttaaaatggaggaccttgacatagacttgatggagtag

SEQ ID NO: 73109 - DNA, 342 bp, Glycine max
  Peptide Sequence Number=SeqID_189887
atggagcatgaaacattccttgcaacttggttggcagagattgatttctctcccaatggcttggatggtggaagcagtcaatactgtatcatcatcgtgattttgcaaagaatattactcggtgaaagatcagtctatgcaatgatgctggtgtttccacctgaattttctcctttgaaatctattttatttggaaatccttcccaagacaccgttgaaccactgatggaggctttggaggaagattataaagatggaaatgagataaatgaatcaaggcagtttattgaaggagtattggatcttgaaaagagaatcaatagactagatacattgacttag

SEQ ID NO: 73110 - DNA, 293 bp, Glycine max
  Peptide Sequence Number=SeqID_189888
acgcacagctaaggagaatccgatgcgaaaaatattattgctggccgccgttttgctggcatccgcaccgatcgtcacccaggccgaggagattacgcttttaccggctattaaactgcagataggcgaccgggattcctacggtcattactgggatggcggccgttggcgtgacaaagactactggcatcgtcattatgaatatcgtgacaagcactggcgaaagctagagaaaaaacagcgtaaagcctacgagaagggctatcacgacggtcgtaaagacgcgaagaagc

SEQ ID NO: 73111 - DNA, 405 bp, Glycine max
  Peptide Sequence Number=SeqID_189889
atggctagacaggatacatgtcggggtttggtttggctcaaggataaaagggatgccccacattatttccatgacacaaaatgcaaaaatgatgatttggaaactttatgcaaaactggtcgtgcatgcacctatgcggacactcaagtgtcaaatttttatggtattttgctacctaaacacgtgcatatttttgtgaggtatttttgctatatacatgcatatccaaggtggtggcggtgtgtctattgcccgctaccagccatcccaatgctgctgtggtgtttcgccctgcgcctgcctggggacgcagtacttcttgatgaaagctcgatcagtagggggcctgatgcccttgctggaggttacaggtactccgtagaactgatagagacccgtaattag

SEQ ID NO: 73112 - DNA, 210 bp, Glycine max
  Peptide Sequence Number=SeqID_189890
atgaaacaaaaaggaaaaagaaagaaagatcgcgaaggtcgacatgttatagttaagaagtataaatcattcgtaaagagcaaacgtatcttctgggaacaagggactgacgctaagagtttagtttttggaataaccgagataagaatggatgaattcattgaactgatgaaagaacataacttggaaacgttgggtctgtttgtgtaa

SEQ ID NO: 73113 - DNA, 330 bp, Glycine max
  Peptide Sequence Number=SeqID_189891
atgggttttgatatagtgagatgtgatttgtatgggaacaagaatgacgccaacttaaagttacaaaatggtcaccaagaacaatttgaggaggaatcacatggagaaggcccggtattgatgaatatagtaccagggattagcagggatatagagggtttgaaggagaatttggtgaggttgggtgggaatgaagagggtaattttttttttgaggggtgcatgaagcaatcttataaagagattggcaaagaacttgtatttgtatgcaaggggcttggaggtgttaaggggccttggtggaaggctaaaaaaaagatgggtgcaaag

SEQ ID NO: 73114 - DNA, 330 bp, Glycine max
  Peptide Sequence Number=SeqID_189892
atgggtattgtctccccaatcccttaccccgactcctcaacatatccccatacccgtacccgatacccgacgggtttgagtttattgtcccatacccgtacccgtcgggtatcggattttaagtggcggggcgggttcgggttcggggtcgagacgagtctagtaatcccatacccgtacccgtacccgacttttggttatcggggaaaacccgaacccgtacccatacccggtcaactcggatattacccgtcaaagtcgggacggattcgggcgggtacccatgggtacaggttttcttgccatgtctattcaaaatcctgttggtaa

SEQ ID NO: 73115 - DNA, 249 bp, Glycine max
  Peptide Sequence Number=SeqID_189893
atgtacatcaagtatggcccaaaatacatcatgaagcatagccaacaaaacaagttgtccaatgaaacaaaaaccccccacacttattcccaaaacaattccgaagctccaaaattccttaaggatatggacgcatcaacaagaatcaagccaaggctattgtcataccctaatttcgtccgggaacctttgctcgatgacttgcgaccattctttggtccttgtgaggtgcttggcacccatcattag

SEQ ID NO: 73116 - DNA, 461 bp, Glycine max
  Peptide Sequence Number=SeqID_189894
gaattgcgcaaaaaggcacagaccatccagaaacagaacattgcccccccacggtttgtctcgtgggggttatgaatatttggagcagaagctcctggctgagaagacgaagaagaagctggaggaagttgcacagtcaggaagctgcacagtcaagaagcgttgatggcatcatcgaccctccatccccggtcagacgccacgtgaagtggaagatggcccgcacgaagaaaacaggggagatgacgactgaggccgcaaaggaaatcactgagaagatcgattcctttgaggagcaggtgacacagggatccttcgtcccccatggacgtcaggatgttctcaccgctgctattagacgtccagagcaccctagacgtgtccatgttgctggagccggggtcaccatcaaacaatactttggatcggctccacggaggttacagatgcaaatgctctag

SEQ ID NO: 73117 - DNA, 450 bp, Glycine max
  Peptide Sequence Number=SeqID_189895
atggcccgcaccaagaaaactggcaagatgacgtttgaggtagcaaaggaaattgttgagaaggttgtaaaacaccttggtcatgtgcgtattgctggagtcggtgtgaccatcaagcaatactttggaccagctccacggacctcccgcacttcttcctccacggctcccgaagaactagagcagctgactcaacagatcagggaccagctggaggagtcgatcacagaaaaaggacttgcactgcctccagagcctgaggttggtccttcagctgcttgtgtcagcactaaggagagttgtgttgatccctcagggaatgatccagacacgggtgactctgacaaatgcgggttgtacatcgaagaaaatcctccctgcctagttgccctaggaaaagtttatgagggattgacaaccattcacaacatccttttgttgcaagattaa

SEQ ID NO: 73118 - DNA, 240 bp, Glycine max
  Peptide Sequence Number=SeqID_189896
atggaacttgcattatctttggaaaggctgaataatgagaagcttctaaatttacacagcttagcaaatgaaaacaatgatgtgcaatttgttgactttcttgaaagcgagtttttggttggtcaggtggaagacattaaaaagatctcagaatatgtggcccagttaagaagaatgggaaaaggacatggtgtttggcactttgatcagatgctccttaatggaggtgtagctgcatga

SEQ ID NO: 73119 - DNA, 414 bp, Glycine max
  Peptide Sequence Number=SeqID_189897
atgctcttgggaagttcttcatccatctatgtctcgctctcagatagagcaaagcttgtcccttctctgtcttcctctgcaccctttttgaattctcttaatggttcttatggtttgaggttcttctccaagagaaatgtgggttgtggggttgtggctaaggtctctaaggaggctgaaaaccaacccattttgggtatagcgtttgaaccttttgaggaagtgaaaaaagagcttcttgtcatcccttcagtgccccatgcatcactggctcgccaaatgtacactgatcagtgtgaggctgcactcaatgcacagatcaacgtggagtacaatgtctcctacgtgtatcatgccatgtatgcctacttcgacagagacaatgttgctctgaagggattggccaagtattag

SEQ ID NO: 73120 - DNA, 198 bp, Glycine max
  Peptide Sequence Number=SeqID_189898
atgagtatgatgtcggcgatggtaatgcagagtgcagagtgcaaagtgcagaatccgcaacttgaagatgcgagttttgaagatctggaatttaagatcagagtgtgtgcttgtactgatatcgtgaaagagcatttccgatttgcagagttaggtagatctcgtgaagttttgggttttgaaaatatggatttatga

SEQ ID NO: 73121 - DNA, 543 bp, Glycine max
  Peptide Sequence Number=SeqID_189899
atgggtgaagcctttcatagtagcaagtccagtgtcaacactatcccacatgaaactgcacagtttgtgctaaatgcaacccaatttgggaacacgataatgcaatactttttagacttcttcaggctgtgtatcttttctgaagtccaaaagttgattgaacatatactgtctatcttcaaaagagatggcattttaggtgacaagatcgacttcatctcgatcaggggaaaccacaactactctcatcatgcaactatattgatcgggaacaagagccccagcatgcacacagttccaccaaagctggagccttcccataatatctctttagattgttattcagagcaggtccattctgatactctacatgccagacataattgggatcgacaagatcatttaatgttgcctcttgtcatgcatgtaaaccatttcgagactgatgatttgaagccttgcacattctcaacttatgttctttgggaccaacctggacctcaggacaatagccgcaagtattcacagaatacttctccatga

SEQ ID NO: 73122 - DNA, 579 bp, Glycine max
  Peptide Sequence Number=SeqID_189900
atgcgcgccaccgtcacctcttcgaagctttctctcctgaagcaactacctcaccgcttaatcccaaccctctccttcgcatcggagacttggccagttccggcggcgtccgtcgacgatgcattccagtactccgacgtgccgaggcctcggaggcgaaactccgagtggaagccgtacgtgacgccgatgaaggctctgatcgagagagtgaaggcggagaaagaagttcgaaaggcgcaaccacgtagggttttggaagagccaccggagaacgggttgttggtgccggaactggtggaggttgctcgtcgcgtatatgaagcttgcggctcgctcctcttcagtctgagccaactcgtccgagtcattcccgttttacgctgccggcaaatccaacaattgctttggcttgtacttgttggcttcacgtttaatgttggtttcatttttttatcaggctttgtaatgaggtccacattggttatgtgggtcatgaaattcaaacatgtactggaccagagagctttttgcggaatgcaatgcatatttggacaaggggaggtgtttgagatgtga

SEQ ID NO: 73123 - DNA, 408 bp, Glycine max
  Peptide Sequence Number=SeqID_189901
atggcatacaacctttgtttgaccgcttcgaggtacttggcaccctttgttgcacaatacgtgaagttccgagacatgccggaaatcaaaatgaagcattgttacacaatccgtgagactatttttcgaagcgggattgcttctggaggaagcaacccagctcgcctgggcgagcagggtggcaacctcctccccctttttcctataaataggctgaatggtgctcttcttagggtccctgatccccctagtgatgtacttcagctgttttgggtgaaaaaaaaaattcctgaagaaaatccaagccgaggtgcttccgtaacggttccgagaggtttccgtaagcaaatccgtgatggttttcctccgttcttcaccgttctttatccgttcttctttattcaatgg

SEQ ID NO: 73124 - DNA, 321 bp, Glycine max
  Peptide Sequence Number=SeqID_189902
atgttgtgtcgtgacgactcccgcgggacaccgtctccgggcccccgggagtcgcacttaacagatttgagttccttggcgcacgaagcgccggggtttggtgtttgtcgcgaggacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 73125 - DNA, 162 bp, Glycine max
  Peptide Sequence Number=SeqID_189903
atggcctatccttccggttggccttggctttcatggcaagcatccaaccatggtaccggtttcttgctaaagcatttccgtatcacacttccagttctcttgcttagtccacgtgccttcttttccaaccttgataatgattatattgcctctgcaaagtaa

SEQ ID NO: 73126 - DNA, 351 bp, Glycine max
  Peptide Sequence Number=SeqID_189904
atgccgacaaccgatgggaagctcatcctcttcgcctccaactttggtggtggtgatgctagcttccacaccatcggtagaatcgaagctctcacaaaacaacctaataccattgacacaaccttgttttcctcgaagtccaaatacgattacttgtattatggcgacgcagacgacgagggtgacgctcatgacatccatgaggtagaccttgagggtgaaggcagaggtgagttcatgcaatcctcccaaggaggggacccatcaccagagccatggctaggagactccaagaagattgggccagagatgcaagagaaggccctacggttctcattagccttagggtag

SEQ ID NO: 73127 - DNA, 201 bp, Glycine max
  Peptide Sequence Number=SeqID_189905
atgggtgccaagtacctcgaagtggtcaaacgaggttcgcatcccaacaacggatggtccccggacaaaattaggtaccgacacatcatcccgatactgtcgaattcgttcctcttggttgacacaaggcgcaaaatgaccataatttgtctctgcgtgtcttcgggcacgatcgagcttgggtggcaaggcgcagaatga

SEQ ID NO: 73128 - DNA, 411 bp, Glycine max
  Peptide Sequence Number=SeqID_189906
atggtccgtggcggcgatgaccagcaacagtggtggtggaggatgatccctttctcttcttcaatgattctgccatttgaggaagttttagtgaatttcaatcgttggaatcgaaagaggagtgaaaatgaggaagattgggctttacgggacattagggatgaaggaggcacgagaacgagagtgaggctgcgcaacgtgattggtttcgaaggtatttatagaggaggacaaggtgtaatcgattacaaggtatatggtcaagaaggattccatagtcagaaagttgttgcttcatccataagatttgtgcacaacaactgccagcagaaatatattccgcttctgcagtggataaagcaacattattttgtttcttactatgccaagaaactagagcagatccaatga

SEQ ID NO: 73129 - DNA, 327 bp, Glycine max
  Peptide Sequence Number=SeqID_189907
atggggtctggggtgacaataagtcaatactatggaagggcttcacatggctctagcagctcctccacatctgtattaggtgcacgtgtgagcacaaaggggagtaacgctgaaattgcaatcaacccagcaggggaagaagatggtgctcatgtgatgccgagtatggagttgtatgtgcaaggtcataattgtacacacctggtggccttgggaaaaatatacgatggggggggtctaccatacacaacgtggcttatgcagatgatgtggttagggtcagtgttgaaaaaatttatgacgatgacgctcaagttccgttcttga

SEQ ID NO: 73130 - DNA, 219 bp, Glycine max
  Peptide Sequence Number=SeqID_189908
atgaagcttcattgtaagaactgtggaaagcacctgcagcagatgatgagagtgatgagtaaaatgacggcgacagcgacgaattctatttcgttgaagcctttgggaagagacggcaccgtgaggagccatttggtggaggagattccgattgtggtgcctaggtacgccgtcaagcctcaagcgacggtgacattggaaagcacggaccaaaggtga

SEQ ID NO: 73131 - DNA, 282 bp, Glycine max
  Peptide Sequence Number=SeqID_189909
atgggtgccaagtacctcgaagcagtcaagcaaaggttgcatgccatcaaacaatggtccccggacgaaattaggttcctatctttgcataagtgttgcaaaatagtctttccgttaaattttaaagtaacaccgttagtgaggtcaattttagtgccacgtggactatccaacgtggcactaaagaatgacgtggcattaggggttgacggctacagagataaattatgtagacctcgcccattggtgttgacggctacagagataaggttgttgctgtga

SEQ ID NO: 73132 - DNA, 646 bp, Glycine max
  Peptide Sequence Number=SeqID_189910
gactacacatccttgcattcagagggctacacaccctcacctaagaggactacacgtgctcgccttcagaggactacacggcctcacctttagagggctacacgccctctccgtaaaaggactacacgtcgtcgactttagagggctacacaccctcgcctttagaggtgtacacgccctcaccttcagaggactacatgttctgaccttcagaggactacacgtcctgaccttcagagggcaacacgccctcacgctacacgccctcgccttcacagggctcgatgccctcaccttcagaggactacatgtcctcgccttcagaggactacgcgccctcgctttcgtggggcttcacgccctccctttcagaggattacacttcctcaccttcacagggcttcacgccctcacctttagaagactgcacgccctcgccttcggaggactacatgtcctacccttcagaggagtacatttcctcaccttccaaggactacacgtccttgccttcagatggctacacaccatcaccttcagagtgctacacgtcctcgcctttagaggactacacttcctcgccttcaaaggactacacgtcctcacctttagaggactacacatcctcaccttcagaggactacac

SEQ ID NO: 73133 - DNA, 252 bp, Glycine max
  Peptide Sequence Number=SeqID_189911
atgaagctcgaaggccatgcgtttcacgtgaagggaggaggaagtgcggacaagggattcgaattgggagtggtggctgaaattgtggaggagggcgacgagttcagcgacggtggtggggttccaagtgaaccatggggcttgggtgattcctttgtaaagctacgaggtgaggggagagaggtgggggtaggaggtggaaggggagaggaagcgggagagagtgctgagaacgatggcgcttgcaattag

SEQ ID NO: 73134 - DNA, 307 bp, Glycine max
  Peptide Sequence Number=SeqID_189912
ggcaatgctggtgcactcacaaatgttgaggtccttgatttcttacgagctaaaggagcttcaaaggatccaacaagagttattgccaaagtttatgattatttggttgacactgctgcctccactactaaaaaacttgttttttacgacgcacattctaaggcgtgtcaaaatcttcttcttgaactcgctgattactctgtctatcaatgtggtggctgtggtgccgttcttcgagcgaagcataaaggttatgtgagtggtagcttgtcggatgaggggaaggttggacttggaggagattctg

SEQ ID NO: 73135 - DNA, 482 bp, Glycine max
  Peptide Sequence Number=SeqID_189913
atgggtcgggcggttagggctgtggttcttttgacgcgtggtggccgggccgggcggagggcggggctacgattgcggtccggagccttcgctccggactgcccctgcgtcaaccttccggtagccgccggactgccaggacgagagcatcccaccccgcctcacagcgtcgataaggaatctagcggctcaggaccgccgattgatcgcaaggtaacgcccgaggcgaggctaccccagcggactaaacgtatcgcagggagagccatcatgcaaatatctggctgcgttattggggtcgatgtcggtaagttcgagctgcaagtggccggtcatgagaagtcaattgtgtccggagtcctgcccaacaaccgatctagcatcgttggttggctcaagcgcttgccggcgggaagcgtgatcgggatggaagccaccgggggctaccaggagctgttggcccggctggctcacgagcgcgg

SEQ ID NO: 73136 - DNA, 312 bp, Glycine max
  Peptide Sequence Number=SeqID_189914
atgactctaatgtgttacaacttgcctttaattgtaaagacttttgacgtgattgacatatatatggagcattcaattgatgtaccaatgcttgatgatcggctaccaacaaagagagataaaacttttactaaaactaaggaggttgaagttgtagtaattgattatagggttagtgaagaggagcatattaatgttggtgaggtccccggtgatggtaaggtgcctagtgatggtgaggtgcccgatgatgctgaggtccatgatgatggtgaggtagttgatgatagggataatgaagatcttgattaa

SEQ ID NO: 73137 - DNA, 234 bp, Glycine max
  Peptide Sequence Number=SeqID_189915
atggctagcgacgtggacatggttgtggatctcacgcaaggaagatggcgagcaaaaatcacaagcatgtgtattgttctagggtttcttgtttggtgtattacaattaagccatggaagtttcaaaaattgcaagataagtccctattatataggggtgggaataggtcaggccggcctacagaaacctacgacctgacctacataaagcctgacccgaactggcctatttaa

SEQ ID NO: 73138 - DNA, 651 bp, Glycine max
  Peptide Sequence Number=SeqID_189916
atgactcttccccctggccttgttgtgcatgatcccaacctcgtttgccgtcttcaacgttcattatatggactcaaacaagctagccgtcaatggttcacttggctctcttctttcctcatctcccacgacttccgacagtcttcagctaatcattctctttttctacacttccataataatgatatcactgttgttcttgtttatgttgatgacatcattttagcagcttccactcccatggactattccacacgattaacagcttcgatgggcactcctttatcagagacttcttcctcctcatatcgacgtttgattggacgactcatttacctcaccaatactcatcccgacatcactcatgttgttcaacaactcagccaatatatggctcacccaacttctgctcattcacaagcagcctttcgtatcttgcggtacctcaagggatcacctggttctggtatattcctcgctgctcacgatactctacagctcaaggctttcagtgactccgattgggcgggttgtcgtgatacacggcgttccatcaccggattctcggtatatctgggtccctccctcatttcctggcgttcaaagaaacaacccaccgtttcgcgaagctcttctgagacggaatattga

SEQ ID NO: 73139 - DNA, 819 bp, Glycine max
  Peptide Sequence Number=SeqID_189917
atggactcaaacaagctagccgtcaatggttcactcgactctcttcattcctcatctcccacgacttccgacagtcttcagctgatcattcccttttttctgcacttccataataatgatatcactgttcttgtttatgttgatgacatcattttggcaggtaacaacctcgacactattgtgcatatcaccaagctccttgatcaagctttcagcatcaaagaccttggcacgttgaaattctttctcggtcttgaggttgctcggactagccatggtatccacttatctcaacgcaagtacgttttggacatattgtctgactcaggcatgcttgcttctcgaccagcttccactcctatggactattccacacgattaacagcttcgacgggcacccctttatcagagacttcttcttcctcatatcgacgtttgattggacgactcatttacctcaccaatactcgtcccgacatcactcatgttgttcaacaacttagccaatatatggctcacccaacctctgcccattcacaagcagcttttcgcatcttgcgatacctcaaaggatcacctggttctggtatattcctcgctgctcacggtaccctacaactcaaggctttcagtgactccgattgggcgggttgtcgcgatacacaaccttccatcatcgaattcttggtatatctcggtccctccctaatttcctggcgttcaaagaaacaatccacagtttctcgaagctcttctgaggcagaatatcgagccttagcatcgaccacatgtgaacttcagtggctcacgtattgttga

SEQ ID NO: 73140 - DNA, 2676 bp, Glycine max
  Peptide Sequence Number=SeqID_189918
atgaatgaattagcaccaaacacagagagctacctctaccttcatccaagcaaaaacctagttgtagcccttgtctcgccagttttagattcgagcaactatcattcatggagcaggtccatggtaacagcactaagcgccaaaaataaagtggagtttataaatgggaatgcaccagaaccgctgaaaaccaataggacctatggagcatggagccgctgcaacaacatggtggtatcgtggatagtgcattcagtatcagttgcgattaggcaaagcattttgtggatgaacaaagctgaggaaatatggaatgatctgaaatcccgatacacgcaaggagatctcttgagaatctctgatcttcaacaagaagcttcatcaatgaaacaagataccctctctgtcacagagtatttcacaaagctccgcatcatatgggatgaaattgaaaatttcagacccgatcccacttgttcttgcaccatcaaatcaatacagcaatgtacgatctcacgtgttgctcatggaacccatgcccacaataccaaagattttctcttatatggctcaacaagaacgtcagctatcagacaaattggccataccgagagtgtttgttacaagaaacacagtgtgccttcaagctatgaaggaagaagcaaaagctacaatacaagaaacggaaaaacctgtactcattgtgggaaaataggacataccatagatgtatgttataagaagcacggatttcctccgggatacaagtttggcaatggcaaagtggtagcaaataacattgtggcagtagaaggaaaagccacgagtgaccaaatgcagcgccatgagtctcacgatttggttcgcttttcaccagagcagtatctagctttgctcgctttaatacaacagccatcttcaggaagctcagcccctacccaatcccaggttgcatccatatcttcatgttccactaacacctcaccaggtacacttctctctttcaaaacaacagattccatctcttggatattagattcaggagccactgaccacgtctcctcttccttggccaattttcactcatatcatcaagtcagtcccattatggttaagctaccaaacggccaccaagttcacgctacccactcaggaacagtgcaccttaccccttctattatcttgaatgatgataccaacaccaaagcgaagattggtacagttgaaggaatcattcatcaaaccacttgtgtggagacccttgagcaaaacggcattgttgaaccatatttgatcaattgcattcctactcccttcttgaataacaaatctccctacgagcagttatatgcgcgtccttgtgatatctcaaaccttcgagtctttggttgcctatgttacatgagtaccctcaaatcccacagacaaaagcttgacccttgtgcccacccatgcatcttcattggtttcaaaccacacaccaaagggtatctcgtatatgaccttcattcccataacatcactacatcccgtaacattgtcttctatgaagaccattttcctcttttccctgataaccaaactttacccacccttcatacttctatatcaccacttcctttctcaagcaaccccgaaaactttgattctcccattccacccagtgacaatccatcatctcctcataccacataccctcctttacgacgttccacgagaccaaaacaagctcccacctacctccaagattaccaccgtgcactcacttctcaagctgataccactgcgagtaatgcacgcctcgtagcaaaagggtacacacaattagaagggttggacttcctcgatactttttctcccgtggctaagctcactactgtaagattacttcttgctcttgctgcccttcacaactggcacctcaggcaactcgacgtaaacaacgcctttcttcatggggatcttgacaaagaggtctacatgactcttcctccaggacttaatctagccgtcaatggttcactcgactctcttcattcctcatctcccacgacttccgacagtcttcagctgatcattcccttttttctgcacttccataataatgatatcactgttcttgtttatgttgatgacatcattttggcaggtaacaacctcgacactattgtgcatatcaccaagctccttgatcaagctttcagcatcaaagaccttggcacgttgaaattctttctcggtcttgaggttgctcggactagccatggtatccacttatctcaacgcaagtacgttttggacatattgtctgactcaggcatgcttgcttctcgaccagcttccactcctatggactattccacacgattaacagcttcgacgggcacccctttatcagagacttcttcttcctcatatcgacgtttgattggacgactcatttacctcaccaatactcgtcccgacatcactcatgttgttcaacaacttagccaatatatggctcacccaacctctgcccattcacaagcagcttttcgcatcttgcgatacctcaaaggatcacctggttctggtatattcctcgctgctcacggtaccctacaactcaaggctttcagtgactccgattgggcgggttgtcgcgatacacaaccttccatcatcgaattcttg

SEQ ID NO: 73141 - DNA, 249 bp, Glycine max
  Peptide Sequence Number=SeqID_189919
atgcttgagcgacttcagataattttggatgaagaggctgaaatgttcgttctgaagatgtggaggatgcttatctttgaaataaagaaggtagagtcggggctagctttgagctgcttggagagaggtagccgacagctgcctaggtttacaacgtggaattgtaaattcaacacttcaacgtcaaatttggaatatagcatttttttaaaaatatacaagaaaattgcggctttgggtagggactag

SEQ ID NO: 73142 - DNA, 2010 bp, Glycine max
  Peptide Sequence Number=SeqID_189920
atggttcgtcctgtatttcctgcacgccctcctggagcagttaacatacctactatatcacgcccaccagttgcagggatccctgcagttcgcccaattattcctcctgttgtcagacctgtggttgcccctagtgttactccagctgagaagcctcaaaacacagtttacattggcaagattgcaccaactgtggaaaatgagttcatgctctctctccttcaattatgtggaactatcaagacctggaaacgtcctcaggatttatcaactggaactcctacaagttttgggttttatgagtttgagtctgcagaaggggttctccgggccttgcgtctccttactaaactgaatattgatgggcaagaactgaaggtcaacgtgaatcaagctatgaaagaaattctggagctgtatgttaagacaaaaactgagaacttgaagaacaaagaaactcaggaagtaggtgaaaaaaatgaaggtgaacaaccttctaatgcaaacgaggatgcaaaggttgacacagaaccctcaaataaagaggctagtgaatcatcaaacaaggaatcccatgatgtggcaaactttgggattgtcacggatgaagatagagaagctgattgtgaggctttagaaaagattacaaagatgatagaggaaaggttgaagactagacctttgcctacaccacctgcacagccaactggtgatggttctgtaaatttaacttctgaacaacctgttaaagcccgagatggagactctgttgtggatacagagaagaatgaatctgctgaaaataaaaatgagaaagagacgaacaatgataacaaaccaaccagtgaacatgaaaggactgaaagccctgatagaaggcatgatagaaaaagcagagagagggaccgagatagggagctaaaacgagaaaaagatagagaacttgaaagatatgaaagagaagcagagcgggaacgtgttcggaaagagagggaacaaagacgaagggttgaggaggctgagcgtcagtatgaaacatatttgaaggattgggagtatagggaacgagagaaagagaaagagcgtcagtatgaaaaagagaaggagaaggaaagggagcgtaaaaggagaaaggagatactttatgatgaagaggatgaggatgaggattctaggaagagatggcgcagaagtgtgatagaggagaagagaaagaagaggctgcgtgagaaggaagatgacctggttgaccgacaaaaagaagaggaagaaattgctgaggccaaaaagaaggctgaggaggaacaaaagcgacaaagagatgcattaaagcttttatctgagcatgtggtaaatggtggtgacggtaattcaataaatgtcatcattgatgaatcaaccatagcatctgttgctccaactgatgcacagtcaggtggcaatgctcctacaaagaaattggggtttggtctagttggttcagggaaaagaacatctgtcccttctgttttccatgaagaggatgatgatgatgcacacaaggacaaaaaaatgaggccattggttccaattgattactcaactgaagaattgcaggctgttcaacctacagtttctgggccaacaccaccaaatttggctgctgctgcagaatttgcaaagcgtatatccagtacaaatttcaaggaagagaagctggatggagaacgggatagaagtaggcgttcaaatgagaagtctaaccaccgggacaggagtgatgaagatggcacgcacaacagagatgaaaacaaggagagaattcctggccgtgacagggatcgagatcatggatcggagaaactcaaaacttctgataataagaggcttttggatgcaaaacaattgattgatatgataccaaagaccaaggaggagttgttctcatatgagatagactgggcagtgtatgataagaaacataagaatatgaatagtggaggccagataggagtcttctcatctttttag

SEQ ID NO: 73143 - DNA, 1821 bp, Glycine max
  Peptide Sequence Number=SeqID_189921
atggcaacactcgctcccgggattttgttgaagctcctcaacggattgaacaccggcgtgaaacccacgagcgagcaccgtagctcactcctgcaagtcaccgacatcgtccccgccgatctcgacgaaaaaaacctaatccccaaacagggtttttacataaaggtttctgattcctctcactctatctacgcgagtcttccctcggaccaagacgacgtcgttctcagcaacaagatgcagctcgggcagttcatctacgtcgaccggctcgaaccgggctctccggttcccgtcctgaaaggggccaagcccctccccggaagacaccctctggtcggcacgccagaacccttaatgggactcagagaccaaaaccaaaaccaaaaccaaaaccaaaagcttaattctgctcccagaagaggctcttggggaaccagctgtgacggaggctttaattttaagccggtgaatctggactttgagcaatgtacccctgtgaaagtgaggaatggcgggtttcaaccggtgtcgtcgtcgccattgattcgagggaaggttggtagagaggggactactccgggctccggtgtgaggtcctctgttggtggagggcttctagccaaaatcagtgatgctaaagtggaaagtcctgcattgcttagaaaaagctgcgtggttgcaacttctaattcgaaatttactaggagcaggagtgtttctgaaagggaacatagaatccctgctagccccttcaagtcagctgtagaattgtttgtcgcgaagaatttaaaagatgcagtatttgctagtagtagggagaagaaaagtgggactccgccaccgcggttgagaaatgccagagtgataactccttcttcttcttcttctttttcctctggggatgctcagggtcacaacacggacacgagtgtcgcttctcaaccccaatctcagtctactactaattcagcttttgataattgcaacaaccttagcctccccatgaatttaccaggaaagctgagctctctgggaaaggaagctatgcagcagagagaagtggctcaaaagattgcccttcaagctttaagagatgcttcagctactgagacagtagttcgatccctcaagatgttctcgaatttatgcaaatcagctcgaactgatgctcccttggcttgttttgaacggtttctggaattccataacgaaattgtgcaagcagttaatgaaatggtgtccattcaagctgctacttcagcgtcagagttggctcagaaatcagataaaccagaactgcaggttttgcatgaagttatggacaattgtgagaatagtgaatcaaacatgtccaaaagaaggggtgctttgtacaagtcaatggctgctattcctgaaaagcatgagcaaaaagcaaacatgggtaggctcctgagaaccagtaccaaccaaaaggagattttgcagaagaaaggttcaactccacttacaaaaatgcctctggaaccgattgttgaaaatgatgagaataagaaaccagggggatcatgcagcttaagcaacacaatcaaactgggaaagcagattgaaactgaagctggaaattggtttatggaattcattgagaaggcattggaaacaggtttgaagaaaacaaaggatgcatcagatggggatgtcaggaaagttcctcagtctctcatactaaaagtcatgaattgggtggaggtagaacagtgccaaagtaacaagcggcctagtcatcctaaagcagcacaaattgctcgaaagttgagaataaagatgaaaaatccttga

SEQ ID NO: 73144 - DNA, 186 bp, Glycine max
  Peptide Sequence Number=SeqID_189922
atgcgtggcaacaaccatagtgaagaaaggaaggaaagttgtagtattcatcgaaggtcgtccaaggcggttagagaaggcgaaggagaggcaatagttgttgtcgatggagagtctccgacaatggcgaggttcataggggagagagttgggggaggaatgatattgtgtggaaagttcatatga

SEQ ID NO: 73145 - DNA, 672 bp, Glycine max
  Peptide Sequence Number=SeqID_189923
atggaaaatgctgtgtctgtgtttcggtacgatagttcggtaaagtttaggagtgtgatgtgtgacccaccttgcttgctttgctccaccctccaagcttctgcctttcgtccccttcgaccacccctctctctcccgagcttctccctcctccgagcttcttcctttagtctccgaccacccctccttcttcgacaccatctctcttctccgagcttctcccttgtcaaccccaaagacatcggcatccttgtcgtcaactgcagcctcttcaatcccaccctttccctctcctccatgatcgtcaacaagtacaagctttgcggtaacgccaaaagcttcaaccttggcggcatgggctgcagcgccgttgacctcgcaaaagacatgattcaggtttaccccaacacctacgtcatcgtcgtcagtaccaagaacataacccagaattggtacttcgggaacaacaaggtcatgctcatacctaattgtctttttcgcgtttgtggggccgtgattcttctctccaacaaaagtttcgacagagcaagagccaaatacaagctggtgcatgtggttaggactcacaagggggcagatgacaaggcgtttaggtgtgtgtatcaggtacgagccacgttgcggcacgtggaagagttggaccacggatag

SEQ ID NO: 73146 - DNA, 195 bp, Glycine max
  Peptide Sequence Number=SeqID_189924
atgcccttccttccttctctctccacagcaaagcttccggtgctgttggttggtgcgcaagtgtctttgacgccgttgcatagtgctactgcctctgccatgttcacttctctgctttctctgcataacactaactggggttgtctttcagaagcttttggagaagttaaaggagagagcatctataaacgttaa

SEQ ID NO: 73147 - DNA, 117 bp, Glycine max
  Peptide Sequence Number=SeqID_189925
atgctaggttacagtgtctacaacgttggcttagctggcaagaagcctgctaagccaatgcctcgcttagccacaggtactgtaccaggcggaagagtgttcatcctcaagatataa

SEQ ID NO: 73148 - DNA, 381 bp, Glycine max
  Peptide Sequence Number=SeqID_189926
atgacaaatggtggtagtggtggtgataatggtggtggttgtggtagtgacaatgacaatgatagtggttgcatcaacaacaatgacgatgagtgtgacgagaatgatggtcctggaaatgatagcggtgacgacaatagtaatgatgataaggttggtgacaatgttgactacaatgataatggtggtggcatagggtgtggcgcacatggatttgttgacatgaagtttggacggaagaactgccttgtacatgaacaaccagaatcacttccttatctcgggtgtcttcactccaccaattctgtggtatgccatttgcagattcttctgaggtatgaagatcttcgagacgaactgaaacctctacactttgctcag

SEQ ID NO: 73149 - DNA, 792 bp, Glycine max
  Peptide Sequence Number=SeqID_189927
atgagtgccacagtgactctaactctaaacctatgtcgttcttccatcgttgcttcttgtccacattataaccacaaaccaaaccctaatttcaatgccttgtttagcttctctttgtccctgtctctgtctcaccacagacgcatcgctatctgcaagaaaccattttcctcaagacggacgtggcttcatggacatatgaaaagagatcgagattatgaattggagaatgggttagccttatttggttctgatgaagaactagcgactcaaattccaactcaggcccaatcacttgttgaaggatcaggatccattcgcgtagcggagttcaagcctgttcctgatgttgattatctgcaggagttattggccattcaacagcaaggacctagagctattggcttttttggaactcggaacatgggattcatgcaccaagaactaattgagattcttagctatgctatggttataactaaaaatcatatatacacatctggagcatctgggactaatgctgctgttatccgaggtgctttaagggcagagaaaccggagttgcttactgttatattacctcaaagtttaagaaaacagcctccagagagtcaggagctattgtccaaagatagggactgggagcttttgtggcatggttctcttgaggttcttatcacatgcaaaatgaggagagggagaatggtgaaaaatgtcatagaaaagccccataatgatcatctacctctaatagaagccagcaggtgctttggggtcatgataggtgcctag

SEQ ID NO: 73150 - DNA, 711 bp, Glycine max
  Peptide Sequence Number=SeqID_189928
atggtggtatttttcggtgatttcaactatcgcctttttggtatatcttatgatgaagccagggactttgtttctcaaagatgctttgattggcttagagaaaaggatcagctcagggaggagatgaaagctggaaaagttttccagggaatgcgggaggcacttatcaaatttcctccaacatataaatttgagaggcacaaaccaggtttaggagggtatgattctggagagaaaaagcgaattccggcctggtgtgacagaataatataccgcgatactcggtcagctccagtttctgagtgcaatttagactgccctgttgtgtcatcaattttacagtatgatgcttgcatggatgtgactgatagtgatcacaaacctgtccggtgtaaattcaatgtaaaaatttctcatgttgatagatcaataaggagaaaggagtttggggtagtaatgacatcaaatgagaaaatcagatctattcttgaagatttatgtgatgttccagaagccacagtcagcccaaacagtttagtccttcaaaatctggacacttcattgttgcttattacaaacagaagtacaaaggataaggctatatataaaatcacttgtgaaggccagtctatagtaaaaaatgatggacaggcacctgattatagcccaagaggtggctttggctttcctagatggcttgaggtattatga

SEQ ID NO: 73151 - DNA, 1998 bp, Glycine max
  Peptide Sequence Number=SeqID_189929
atggatgaccgaatcgacgaggacgagaaggacaaggaggaggaggagtccttggccggcttgacctctcttccacctcaccgcaaagcccattcctacagccagcagctgcgaggcacctccacacacaaacgccaccatcaagtccggaagcacagtctggacgacagccgtatatccagtaacatcgtcgaggctgcttccttctacgactgcggcgaggacgacgacatactttcccgttcatcctctacaaataaccctgctgctgacgaagtgtacagcgaaggcgccgattccaccacgactcagtatcagccattgcaggaattcattggcagcgggggcggcactggggtctttaagcctcctttcagagcgtccgttcatccagggagaccgccatgcctcgagttaaggccccatcccttgagggagactcaggtcggcaaattcctcaggaacattgcttgtactaaaacacagttgtgggctggccaggaaggcggggtcagggtctgggagatcaaaaacgcatacgaccccggtaagggtcttggtggaacggtcagaaggggcgacgaggacgctgcgcccttttgtgaatcttctgatacctctcccaccttatgtttggttgtcgaccatgggaataggttggtgtggagtggtcacaaggatggcaagattaggtcttggagaatggatcagcgctttgctaccccctttaaggaaggcctttcttggcaggcacaccgaggccccgttctttccattgtcttaagttcctatggcgatctctggtcaggttctgaaggtggtattattaagatctggccttgggaatccgtcgaaaaatctctttccctctctcccgaagaaagacacatggcagccttacttgtcgagaggtctttcatagacctcagagctcaagtcaccgttaacggcgtctgcagcatatcttctcaagaggttaagtgtttgctctgtgatcatgttcgaggtcgtgtctggtgcgctggccctctttccttttctctctgggatgcccgcacaaaggagcttctcaaagtatttaacatcgatggtcaggtggaaaatcgagttgacatttcatccgtgcagcagcaggatcaagcagttgaagacgaaatgaaggtcaagtttgtttccacctctaaaaaggagaaatcccagggtactagctttctacagcgctcacgcaatgccatcatgggagctgctgatgccgtgcgtcgagttgcaaccaagggtgctggggcatttgtcgaagatactaaaagaaccgaagcccttgtgcaaacaggcgatggaatgatttggagtggatgtaccaatggcttacttgtgcaatgggatggcactggaacccgtgtgcaagattttaatcgccatccttgtgctgtccaatgcttctgcacttttggaacacggttatatgtaggctatgtgagtggtattatccaagtactggacctagaaggcaatctaattgcagcatgggttgctcataatggtcctgtgattaaattggctgttggatgtgattatgtttttagcttggctactcatggtggcctacggggatggattattgcatctccaggtcctgttgacaacatgataagatctgagttggccgctaaggaacttatttatacaaggctgcacaatgtcagaattttgattggcacatggaacgtcggtcaaggtagagcttctcaggattcactttcctcatggctgggttccatcgcatcagatgtaggcattgttgtcgttggtttgcaagaagtggagatgggtgctgcaaagatagctgttgtggatactgatcaggctgagattcagaggtggcccttgatgaggtgcctgaattgtgaaagaagagggctcttgttgtggattggttgtgccaatgacatttacattgtgaactgtggaatcagaatttctgaagtaatagcaaggtag

SEQ ID NO: 73152 - DNA, 234 bp, Glycine max
  Peptide Sequence Number=SeqID_189930
atggggcagtggtggctggatacaataggaagggcgttagaagaaggaaaagcttttgagcgtatgggttctaggcagcttgctggcttgcttgtatctctttgggtaagaaagaatcttagaacacatgttggggacattgatgctggggccgtcccgtgtggttttggacgtgcaattggtaataaggagggtaagctcaagtggttaagaactttctctgcagtagcttaa

SEQ ID NO: 73153 - DNA, 264 bp, Glycine max
  Peptide Sequence Number=SeqID_189931
atggaaattctcacacgcacacactgcgacctcactctcgctcgcaaccctagctcccactctcttgctcgcgattctctctcactcttgctcgacgctggttccgcttgcagcccttgctcgcgcctcgcggtggttcagagcaatctctctcgcacgcacggtggtcataactgtggtgtggatttggatgagtttggggtcgagctaggtggtgagcaccatctgtttgtgaatatgcatgaaagggaaagagagaaataa

SEQ ID NO: 73154 - DNA, 279 bp, Glycine max
  Peptide Sequence Number=SeqID_189932
atggcaactgcacctgcacaaattcctacaagctttggtcatgagttgagggcatgtcttcgttgccgccttgtcaaaacctatgatcagttcagagagtcaggctgtgagaactgctcattctttaagatggaagaagatcatgagctagttgttgattgcactactcccaattttaatgggatcatttcagttatggatccaaatcggagttgggctgcccgttggttgcgcattgcttgcggacaagatctcgaaagagaatttgagaactcgtga

SEQ ID NO: 73155 - DNA, 678 bp, Glycine max
  Peptide Sequence Number=SeqID_189933
atggtgtgtcacaagcgtcagatgcattcccgagcctatatagacttcaagtgtcccgatgacgttttcgagttcaccgagttctttgatgggcacgtttttgttaacgagcggggtgcccagtataaagtgatagttgagtatgcaccttctcagcgtgttccaaagccaagtgccaaaaagatggacgtgaagggactatattcaaaggttgatgtcatgacagatccagattatcttgagttcctcaaactaattgcaaaacctcaagagcatcttcctagtgcagagatacaattggaaagaaaagaagctgagcaagctgacaaatttcagtatcattggtctcattcttatattgtatcttttcccggggccagcaaggaaacacctattgtcacacccctgatggaatatattcgtcagaaacctgctgctgacagtggttctcctccaggggtattagaccacggtggtcatctgccctcatatcaaagtagtcaaagatttcttatccaaatcttagtgagagaacccttagctttaatggacaatatcgctactgtctccaccatgaagttgatttgtgacatctcaaggtcagcatgtgacttggtgcaacgagttcctcttcatactcgagatctgaaacctaactatggtgacaaaggcaactag

SEQ ID NO: 73156 - DNA, 348 bp, Glycine max
  Peptide Sequence Number=SeqID_189934
atgaagaagaaagccaacaaaacaagaaatgaattgaaagtctcggattcaaaaacttaccgattgaagaacgaagaacggaaaaagaatggcggaaaatcttcacgaaatcaccccacaaaagtgttacggcagcgttgcggaagcacttcgactcaatttttcttcatgaaaacggaaaaaaggggtggtgcttgccaccctgctcgccccgcattatggaagccccggaagccattttttcacaaaatgggagatgagcttactgcattgctcgcccaggcaagcaggttgcatcctcaggaagcaacccaacttccaaaatgttttggaagagcccagatttga

SEQ ID NO: 73157 - DNA, 396 bp, Glycine max
  Peptide Sequence Number=SeqID_189935
atgtttccacaggctgattgttggaattttgaaaataacaactttgggtctctcactaagcgcgaatggcgcactaagcgcaattccaacagagagggaatggcactgagcgcccaaaggtgcgctaagcccaattcttaccaagaggaagttgcgctgagtgcccaaagcgtgaaaaacatgatttttcactctattcttctccaaaatgtcacccaaaccctaaaatctcatttttcatcacccaagaccactggtggccgccgtgagttgccattgcttgctgttgaacccccacaccaagaggaacactttaatcagagcggaatcctcagaatcctcctcaaggattcggtggagaaaattctccaatcctccgtttcaaagcttctctga

SEQ ID NO: 73158 - DNA, 706 bp, Glycine max
  Peptide Sequence Number=SeqID_189936
gcttgaaaacgagatcaggaagctaggagggcttctggtaatctattaccaagggaggaacaagccactggtaatcaattaccagtcatgtgtaatcgattacacagtgcattttgctggttttcacgtcctgaagctatgtaattcgaatttggcctctggtaatcgattaccaatgaggtgtaatcgattaccagagatgaaaagccttgagataccccttttacttgcatgtagtggttatgggacgcattgtgttgctaccgcaatcgcgatggcggcgcaactaatccatgatcgagtggagatggagtgcctagagggagcttgggagaccctcgaaggcaatgcgaggtgccgatttcgaggcacgattcgattcacggctacttcattggtgcatccagatgaacccgcgcgcacgcttcagcgcactgtggagtggatactacccacgcctacaccataccgtctagtggagccagtccaagtgatcgaggtgacgtcatccgaggaagaccctgaggaggatcctgaggagctacctcctgagcctgctgtggatgcccttgactttctagagggtgatgaggacccactccctgaggtggattcttccgaggacgtcatgtcggcatctgaggcagactctacggaggatagtggcctcggagagatggcgattagtggaggctcttcatcatag

SEQ ID NO: 73159 - DNA, 378 bp, Glycine max
  Peptide Sequence Number=SeqID_189937
atggagttagagaaactcaatatcaaaactacttttctccatgacagactggaggaaggcattgtgatgctacaacttgaaggttttgaaatggaaggaaaggaaaattttgtttgtagattgaagaggtctttttatgagttgaagcaatcaccaaggcaatggtataaaagattcaatgagttcattatctctcatgggtacatcagaagttcctatgactcatgtgtttatcatagcaaggtggaagatggctctcacatctatctactactctatgttgacgacatgctcatagcatctcaaaattttgaatttgagatgaagaagatgggagctgctaaaaagattctagccacggatatcaagagggattga

SEQ ID NO: 73160 - DNA, 245 bp, Glycine max
  Peptide Sequence Number=SeqID_189938
ttgtgtccttagacaaatacctttttgtgttcctagttgagaaaaatgtcaccttggaggatgtgatggtgttggagggttttgcaactgttggtgatcctgtctttaccccatttcaaagcaaggaaatgatgaaggtggagaagaaattgatacatagaataggacaacaacaatctccaaggagtaaaaagagtggggacaacaacaatctccaaggagtaaaaagagtggggtttatataa

SEQ ID NO: 73161 - DNA, 1145 bp, Glycine max
  Peptide Sequence Number=SeqID_189939
gtgcaggatttacgcatttgccctcatccagacccggcgcaatctttccgaagcggccaaacactacggcccgcagcatccgaaatatctgcaggcccaggcgcagctgcaggcggtgaatgcccagctcggccaggtattgggcgagctgtttaacggcctgcgccagcagtatcaaatcgccctcgacgatgagcagcactaccaaaaaatgctcaacgatcagaaggccgatttccaggcactcggcgccaagcgcgaccagtacaacaccatgaccaccgcgctgaataaaaccgaagagctttataaatcactgtaccagcgcgctaatgagcagaaattgtcagagaccttctcggtaccggatgaagtcatttacgacgccgccgtaccgccggatcgtccatctaaaccccagcgcggcctgttgatcgtgatgattaccctgatggcgctggcgctgtatatcatgtatctgatcgtcagtaccgcgctggataaaacggtgaatagcctcagcgagctcaaagcgaaaacctccctcgaggccagcggcgaatttccgctactggcgcatctggaaaacgcgcagcagattttccataacgtgctctacgccgatatgatccacagcctgcggctggcgttgctcaatcagcgcgataaacccgccaccatcctggtgacttcggtacaatcccgctccggcagttcgtatattgccgaactgctggcctgctcagccagcaaatcgcgtaaaacgctgctgattgacctcgactacctggccactcaggggttatcggcgaaatttccgcaacataaacagggcttcagtcaattgctgaacggcgagtgcatgccggagcagtccgtcgtcaaactggatgatcaactggactttataccccgcggcaagctcaacgactcttcgctgctgttgctcacctctgaacgcctgccggcgctgctggcaacgttgcatcaaacttacgatacgctaatcatcgacgccccggcgctgaaccacgctcaggatagcctgctgttggcggcacaaagcgatattactctgctggtggtgaaggccggcgagcaggctccgcggatccgcaaagcggaacaacgtctgcagagcgcgg

SEQ ID NO: 73162 - DNA, 462 bp, Glycine max
  Peptide Sequence Number=SeqID_189940
atgtgggacatcccctttatccctgaaccaaaccaaaccctgacatatgtcatgtccagccgttctacaagccttgagccaaaatcccaacttaccataaaccttgccctcggaagaaaacaaagaaaagaaagttcccaatcaaagaatcggaagaaagcaaaaagagaaaattcccaatcaaagagtgggagaaagcaaaaacataaaagaaagaaaattcccgatcaaggatcagaagaaaacataagaaatatgcagaaagaattgtcaccaaatagacaagaaaagaaaggaaaccacgacctaaagtggtcctctccctttgattgccaaccaaagtcctgtgcgtcggtgacttgttcacctcacactaaacaagaaaagaaaggaaaaggccaagaatactcaaaaccaaatttcccaaagaaacaaaccattcccaagaaaaagtcctattga

SEQ ID NO: 73163 - DNA, 1857 bp, Glycine max
  Peptide Sequence Number=SeqID_189941
atggtggctgtggataaagacaagaacagtggctatgccttccgttggacaattaaacacattgataacccagtcatcattgcagtccatgtcaagcacaaaaacattcctcatcatgagggcaccaacgtttttcctcccgacgaagacgatatagcacatgttttcaaacccctacgtcacatgtgtcatggcaacatcgttatgttgaaagaagccgtaatcgatgatagtgatgttgtcaaaggaattgtggaatatgcacagagaaatcgcgtcaatactatagtcgttggtgcaactcactcgttttcttggtggttaagttgtctcagaaaatgtaaaggccatcacgatgtgtcaacaggcgtgatgaaatcagcaccagattatagttcagtgtacgtaatttcaaaagggaagatagtgggagctcgaccagcaatacgcccaatgataaacgtggttgcgccaccaaaagaaaatgtagtaaggacacattcacatagaagagggagcaccaatggaagatcagaaagatcaactctacttgaaatgccaaggtgttcttcagctggtcagtcaacgaatcagaggtcactatttagccccagctcggttgaaagtgattctccatcagattccttaggagatttggaagctgcgatgaaaatgttgaggctcaaattgaagcaaactatggacatgtacagctcagcccaaaacaaggctaaggagattaaccaatggaaggaggaacgtatatctgaggaagctactaagttgcctaaagaggcagctctagaaccggtagaaatggagaaagttaaagctcaagctgccttggaagcagctgaggaagccattaagatggttgaaaaggaagcacaaaaaagatttcagttagaggtcaaggctaggagagaggcacaagagaaggatagaacattaaatcggttgatcaacaacgatactaggtacagaaaatacagcataaaggatattgaagaggctactcaaaagttctctccatcattgaaagtaggtgaaggtggatatggacctgtgtttagaggccaacttgatcacactccggttgcaatcaaaattttaaaccctgaagcttcgcatggaaggaggcagttccaacaagaggttgagatattatgcagcataaggcatcctaacatggtcctcctccttggtgcgtgtcctgagtacggatgcttagtgtatgagtacttggagaatggcagcttagaagatagattgttgatgaaaaataatagccctccaattccatggtggaaacgttttgaaatagctgctgaaattgcaactgcactccttttccttcaccaaacaaagccagagccaattgtgcaccgggaccttaaaccctccaacattctgttggacaagaactttgtgagcaaaataagtgatgtaggccttgcaagattagttccaccttctgtggctgattctgtcacacaatatcacttgactgcagctgctggaaccttttgttacattgatcctgagtaccaacaaacaggaaggttaacaaaaaaatcagacatttattccttggggataatgctactacaaatcatcacagccaagcctccaatggggcttgcacaccacgttaagagggcaattgagaaggaaacattctcagaaatgcttgatattatgatcagtgatgtgccactggaagaggctctagcatttgccaaactctcattgagttgtgcagagctcagcaaaaaggacaggcctgatcttgcaacagttgtggtgccggagcttaaccgtttaagggactttggattgacatttcagaaaaattag

SEQ ID NO: 73164 - DNA, 375 bp, Glycine max
  Peptide Sequence Number=SeqID_189942
atgaaggaaggacaccaagaggaagaaaggtataacatgaacagaaaaggaagatgctgtcctgaacctgatgaagaagggttgttggatttcaaaggtggaggaggagcagttcctaatggaggagtttgtgaaggctttgatggtggtggtagcactagtgatggtggaggttgtgaaggctttgttggtggtggtagcacaagtgagggtggaggtggaggagggggtggatttgatgtcaagagtgaagaaggaggggaagggtatgatgttaagagtggaggagggggtggaactgatgatgttgttgtgtgttgtggaggagagggaatgtgtgattctggtgttagaggtgaagaaggaggtggatga

SEQ ID NO: 73165 - DNA, 1677 bp, Glycine max
  Peptide Sequence Number=SeqID_189943
atgataaaaaatgtagtgattacgcctgcgcgtcttaccctattgctcagcgcggcgctgctgagcgcgtctgctgtgcacgctgaggataacagccgcatgctcagcgcccagccgcagccgccggatgtgcgactcggcccactattcagtgccgtgcagcaggccagattttatccggaccagaaaacctttgccgatgcggtccccaaatatgacccggcgtcgattctcgccgactggcagatgcagaaaaatcagcgtaatttcgatctcaggcgcttcgtggacaccaacttcaccctgcccaaagcgcaggataaatacgtgccgcccgccggccagagcctgcgcgcgcacatcaatggcctgtggccggtgctgacgcgcagcacgccaacggccagccagtacgattcgctgctgccactgccgaaaccgtacgtggtgccgggcgggcgtttccgcgaagtctattactgggacagctacttcaccatgctcgggctggcagagagcggccactgggatcgggtgcaggatatggtggacaacttcgccagcgagctggacaagtacggccacatccctaacggcaaccgcagctactatctcagccgctcgcagccgccgttcttcagcctgatggtggatttgctggccagccacaagggagatgatgtctaccgccagtatctgccacagctgcaaaaagagtatgactactggatggcggacagcgacaaggtggctgccggccaggcgagcaagcgcgtggtgaagctgagcgacggcaccctgctcaatcgctactgggatgaccgtgacgtgccgcgcaccgaatcctggctggacgatgtcaacaccgcgaaaaaagcgcctgagcgcaataaacaacaggtgtatcgcgatctgcgcgcgggcgccgcctcgggctgggacttcagctcacgctggttcaccgatgcgcacaatctggcctcgattcgcaccacccagctggccccggtggacctcaacagcctgctgttccacctggagcagacgctggcgaaagccgcgaagctggcaaaacagaatgacaaagcgcagcagtttgcggcggatgcagagaagcgccaggcggcgatcaatcgttacctgtgggatgacaaacagggctggtatgccgactacgatttccagaaaaagcaggtgcacaaccagctgaccgccgccacgctgttcccgctgtatatgcagctggcgggcgacaagcaggcggaacgcaccgccgccgccgtagaaaaacagctgctgaaaccgggcgggctggtcaccacgacggtaaacaacggccagcagtgggatgcgcctaacggctgggccccgctgcagtgggtagcggtcgaaggtctggagcactacaagcagaaccagctggcgcagcagattggtcagcgcttcctgcaaaatgtccagcaaacttacgatcgcgagcacaagctggttgagaagtatgtggtcgacggcgcccagctgggcggtggtggtggtggcgagtatccgctgcaggacggctttggctggaccaacggcgtaacgctgaagctgctggataagtattgtccgaaagataaaacctgtaacagcacgcgcgacatcccctcaatgccgacgctaaacgcggcgaaataa

SEQ ID NO: 73166 - DNA, 2260 bp, Glycine max
  Peptide Sequence Number=SeqID_189944
atgactctttttctcatcattaaccgccgcgctggtgtggtgcggcttttgttctcagccaaaggaatcattatgaccgcgctgttccccctcaaccgtggccggctgctgtgcgcgctggcgctggcgtttccggcactcggcgtagccgaaccctctctggtggtcaccgcacagccgcaggagagcgccacctcgcccacggcggactatctcgccacccgcagcggcgccacgaaaagcgatcgtccactcctcaccacgccgcagtccatttccgtggtgacgcgtcagcagattgacgatcagggcgcgcaggatctgaaccaggcgctgggctataccccgggggttttcaccaactttggtggcgcggccacgcgttacgacaccatttcgctgcgcggtttccacggcggtgatgtcgacaacaccttccttgacggtctgcgcgtgatgagcgacggcggcagcttcaacatcctgcaggtggataactggttccttgaccgcatcgacgtaattaaaggcccctcttctgccctttatggtcagacggtgccgggcgggctggtgaacatggtcacgaagcggccgcagtttgcttcacagggccatttacgcttcgccaccggcagcaatgccagcaacagcgccgcctttgattacaccgatgcgattaacgatcaatgggcgtaccgcctgaccggcatcacgcgcaacagcgatacccagtacgaccacacgcgcgaagagaaatacgcgctgtcaccccagctgctatggcagccggatgaagacaccagcctgctgctgcgtgcttatctgcaaaaagatccctcaggcggctatcacggctcggtgccggcggaaggcacgctttacagccacaatggccgctggctgagcgacggtttttatgagggcgacagcgcgctggatcagttcaaacgtcatgagcagatttacggctacgacttctcgcaccgtttcgatgaggtatggtcggtgcacagcaccggcagctacagccattccagcgtggcgctcgaccaggtgtaccagattggctggaacagcgacaatccggacctgctcaaccgctactactccggtgagcgctcttcgctcagcgcatgggcgactgataatcagctgcaggcggagtttgccagcggtgcgctgcagcatcgcgtcacgctcggcgcggagtatcaccgctacaaaaatgatctgagcgacgccagcggcgctgcctcaccgctgaatgcctggagcggcgaggccatcggcagccagccggattacctctggacagcgcagacgcgccgctactatcagagcggcctctatctgcaggatgaggtggcgtggcagcgctggcatctggatttgtctggtcgctatgaccgcatcgtgtcagagaatggcaatagtcgtcgtcaggacgatcacgtcagcggccgcgccgcgctgctgtacgcctttgataacggcgtgtcgccgtacgtcagctggagccaggcgattaccccggcttcgctgaccgatcccgacggaaatcagctaaaaccgaccacctcagaacagtatgaagccggggtgaaataccagccgaacggcacgcgcgatctctacagcgtggccctgtacgatctgacacagaacgatgtggccaaccgtaacgtgcaggacggcacctacaccccgtccggcaaagtgcatgcacagggcattgaactggaggcgcgcagccagctgaccgaacggttcagcaccattgccggttatacgctcaaccatctgcgctttaaggattccgtggacggcaacgatggccatacgccgtacgtcacgccaaatagcatggcgtcgctgtgggggcattatcagtttgattacggcctgagcgcgggtgccggggtgcgctacattggccgccagtgggccgataacgaaaacaccacccgtttgccgtcggtgaccctgtttgacgcctcgctgcgcgccgatctgggcgcgtggcagtcgagtttgaaaggtgcctggctgcagctgaatgccctcaatctgacggatagaaagtatctggcagcctgctacggcaccgctgcggactttacggtagatccacagcaccacaatggcaccgatcaccgcgaccacgaagctgccaaagttgaagccgtcaacccggccaaagccgaacagggtactgatccagccgcccaccaccgcaccgacaatcccgagtaccacg

SEQ ID NO: 73167 - DNA, 468 bp, Glycine max
  Peptide Sequence Number=SeqID_189945
atgacacagacccgcaccttaccccttgctctgattcaactcgaaacgccgccgccgcaggtggtggcaaaaattggtgaacaaccacagtggtttattgcagccctggcgctacagccggatgattatgtcattgtgcggccgcatctcggggaagagctgccggctttctctggcatcagcggtgcgattttcagcggttcgtgggcgatggtgaccgatcacgccgactggagcgagcgcaccgccgcctggattcgtgcggccatcgacgcgcaactgccgctgctcggcgtttgctatggtcatcagctgatggcctatgcgctgggcggtaaagtgggcgataaccccaacggctgggagcgcggactgaaaaccctgacgcgcactccgcatcgcgatccgtggctggcacagttgccggaggccttcccggcgtggttgtcgcaccggcagtcagtgctg

SEQ ID NO: 73168 - DNA, 1176 bp, Glycine max
  Peptide Sequence Number=SeqID_189946
atgcggtgcgttggtgtgcaggcggatccagccatcctcgcacggatagtcaccggccagcgcatcccactgggcggctggcggacggttcagcggcgtcaggctgtgctgaaaccagcgcgaggccaggcggacgttgacgctgaccggggccggaggccccagcagatcgctcagcgcctggctggcgaggccgatgctggtggcggcgagttcgctaacggcaaaagccgaggggaagctgtcggtctgaagaaagtggatcgtcggcgcgtgttccgcaccccgcaatccctgccacagttgctgccacaatgcggcagcgcgttgagaatccatgctaaacctccggaaaacacgcaagcttcaagcatagcagagtggatcagcggcggcgcaggcgcggaaagcgggcatgcatgcgcaggttacgcagctgttcatgctgtcgcccagcaccagcacgcccatcagtaccgccagcaccggcgtcagcagcgagtagggcatgatcaggatgccaaaccagccgcgccagccggcgtggctcagcgcggtaaactgctgcgattcggtcagccacgaggccgcgccgacaatcggcaccgcaaggaaggagatccagccggtcagcgtcagcggtttaatcggcggcgactttttcacaatcatattgctcaccgcccagccggtggcgctgcacagcagaatacacagcacccaccacgccggaattgtcgggctgccggagagcaccaccaccccggccagcgagatggcgataccgcacagctgcaccagccgcagtttctccttcagcaccaccatcgccagcaacatggcaatcggcgtacccagctggaccacaatggcgccggtgccggcatcggtatagcgcatgccgacaaacagcagcgaaaagtgcatgaagccaaaggtaaacgccagcgtcagcagccacggcagctgggcgcgcgtgatgcggcaaaacggcaccagcacgatggccaccacgacaaagcgcatccaggtgagaaacagcggcggaagctccagcaatccccatttcaccgccacgttattgaaggcccagatgcaaactaccatcagaaccagaaaaaaatgccgcaccgccacgctgctgtccttggtttgagaaaggttgtcaccgtctaa

SEQ ID NO: 73169 - DNA, 1011 bp, Glycine max
  Peptide Sequence Number=SeqID_189947
atggcacgcgtgctgggcgagcacgccgatcggtcatcgctggcggcggtggtggcacgctggcagggacacgcgctggagcaggccgtggtcgacgctggcggctgtgccgcctggatgcgcagcgcacagcagtggcagcagcacgcgcaggggctggcggtaagcgatgaagcgctgattgcccaacgggcaaccggcgaagcgcccacgccgggctgggcgctgctgccggcgcgaccgctgctgggcgtgcgggtgctggatctgacgcgcatcattgccggaccggtagcgacccgctttctggccagcctcggcgcgcaggtgctgcgcatcgatccgcccggctggcgtgaaccaacgctggaagaggagatcaactgcggcaaacgctgcgcgcagctggatatcaaaacccgcgccgggcgcgatcggctgattacgctgctacagcatgcggatgtgctggtgcacggctaccgcgcggacgcactggaaaagctggggctggatgcggagagccgtcagcggctggcgccggggctggtggatgtcagcctcaacgcctggggctggcacgggccgtggcgcaaccggcgcggttttgacagcctggtgcagatggcctgcggcatcgccgaacagggcatgcgctggcaggccggcgttaaaccgacgccgctgccggtgcaggcgctggatcacgccaccggctatatgatggcggccgccgtgctggaaggactacgccagcgccgcgttaacggcaccggctggcaggcgcgtttgtcgctggcgcgtaccgcgctgctgcttcagcagcacggcgcagcgccacaaggcgaacagcgtggcattacgccgcagccgcacgatgcgctgagcgcgctggagatcaatcgctgggggattggcgagcgcctgcgcgccgcggcttatctgcccggtacgccgatgctgtgcgcggcaccggcgcagctgcccggcagcagccatccctgctggtga

SEQ ID NO: 73170 - DNA, 1227 bp, Glycine max
  Peptide Sequence Number=SeqID_189948
atgtcgtcggtttacgttctagagcctccgacgaaggggaaggtggtggtgaacactacgcgcggtcctttggacattgagctgtggccgaaagaggctccgaaggccgcgaggaacttcgttcagctctgcctcgaaaactattacgacaacaccatcttccaccgcatcatcaaggacttcctcgtccaaagcggcgaccccaccggcaccggcaccggtggtgaaagcatttatggtggtgtttttgctgatgagtttcattcacgtctgaaattcaagcacagaggaatagttgcaatggccaatgccggaactctgaattccaatggaagtcagtttttcatcactctcgaccgctgtgattggcttgatcgcaagcataccatttttggaaaagtgacgggagatacaatgtataatcttttgaggctgggtgaacttgaaactgataagaatgaccggcctttagatccgccgaagatattatcagttgaggtgttatggaatccatttgaagatattgttccaagaacacttcaaaaacttcagattgaagctaaagctgatacaaaaaataaagagtcagggaaaaaaggcgtaaaaaaattgaacttgctttcatttggggaagaagctgaagaagaggaaaaggaattggcatcggtgaagcaaaagattaagagcagtcacgatgtcttgaacgatcctcgtcttctaaaggaagatactcttaataatgaactgagttcatcaagaagagatatgcaattatctgtaagggatgcacttaactcaaagaaagacgagcctcagaaagattcagatgctggtagcatggcatgtcttaatttcagtgatgacgatgaagcagattttgatgcaagaatgcgcatgcaaatactcaaaaagaggaaggagttgggtgatctccctcccaagccaaagttgcgaaatgtttgttacatctcaacctctgatctagggaatgtttctggttctacctatgcaagtttcaatgatcttataaccatgacattgtgctatcagagtcactgtcaggctgccttgtttattccctcttcatccccaacagaagataaatcttttagaaattattgtggccacttgatactaatcccatctgtcaatttgaaaactaaacataaaaatgatgtacttttgaagtatcaacattatgaaattcaattctcactcttatggtaa

SEQ ID NO: 73171 - DNA, 597 bp, Glycine max
  Peptide Sequence Number=SeqID_189949
atgatacgtcgtctgcagccaggctcgttatgggtagcctttggccaatacttactccatgtttctgcactagcatatttgggaacaaagctatttgaacttgtggccaaggacccaaggtccaatgctgtaagtgttgatgaggatcaaccaaaggtggaaaaattgtccttgaagaaaaagggagttggatctgaagcaagagctgaacgaatgtctaatgcagatgcagatttgcaactattgaatcaagctgagagaggaagacaattgcagaagcagaagaaacgcagacttcaagggcgtgaagatgaagttctggctaaacttgaaaaatttaagaattctttatcagcaaaggcgacacccccaactgatgaatctgaagacgttagtaatgaggaattgtcagactggaaaggtgttagtttaaagtttgccccacagactggcaaggaccgcatgtctcgcaatgaagacccaaacgactatgttgtgcatgaccctcttctggagaaggggaaagagaagttcaataggatgatagccaaacaaaagagacgagaacgagagtgggctgggagttcccttacttga

SEQ ID NO: 73172 - DNA, 333 bp, Glycine max
  Peptide Sequence Number=SeqID_189950
atgtcttggctattgttgtttaatgatgctttgttcctttttttccccaatacaagcgtttcaggtgtcaaagtgagacgaagtaagatagagaaaaagaaaagagagagtgagagacaaagagagagaagggaagcaaccaccataccctacaccgttgacaaaattagtactagagagtgcgcgggcgcctgtgatgcgttgcgttgcctcagatccaggcaactcatggtgggctttttctctctctcactagagttgacaaaggtagacgaagttggtaatgctcgagaagggtgttgtgtgacacttggtatagctatttatgattaa

SEQ ID NO: 73173 - DNA, 1677 bp, Glycine max
  Peptide Sequence Number=SeqID_189951
atggaggagatgtcctttgcggttgcagtgccattaagagtaggtaattgtaattgcaattcagtctgtgataacccaaccacagtagttccccacatggatgtatccagatttaagctgatgggggatacagggttgttatctaattctgtaactaagattttcaccgaaacggtcgcaggttcagatgattgtcatgatagtggcaatttggaggatgaagttggtattgcggaagtcataccaccaattcaagatagggaaggagagagtcctatgttggatatgatatcacaaaatagaagcactttggttgctggtgatgaagagttaaccatggaaattgaggaggattcgttgtcgtttgaaggtgaccagtttgttgatagctcgtgttctctttcggtagtcagtgagaacagtagtgtgtgtggagaggagtcattctgttttgatgctacttcagatgttgggacaccgtgttccacagatgtagagaagagcatctgtgctgtcaatattgttgccgaggctgttgatttaggggagtcaaatgtcgacactgatattatgactgatcctcttgctgtggcagtgagccttgaagaagagtctggagttagatctggtccaaagtcttctgctgttgatcttcatcagttgcctcaggaaaaaggggtgagtggaacagttggtcggagtgtttttgaattggattataccccactttatggattcatatctttgtgtggaagaagacctgagatggaagatgcagttgcaactgtacctcggtttctgaaaattcctattcaaatgctaattggtgatcgggtaattgatggaataaacaagtgttttaatcagcagatgacccatttctttggagtctatgatggtcatggtggctctcaggttgcaaactattgtcgtgatcgtacccattgggccttggctgaggaaatagaatttgtgaaggaaggtctaatcagtggaagtatgaaggatggttgtcaaaatcagtggaaaaaggttttcaccaattgtttcttaaaggtcgatgctgaagttggtgggaaagttaataatgaacctgttgccccagaaactgttggctccactgctgttgttgctgttatttgtgcttctcatatcatagttgcaaattgtggtgattcacgagcagttctatgtcgtggcaaagaacccatggcattatcagtggaccataaacctaaccgagatgatgaatatgcaagaattgaggcagctggaggaaaggtgattcaatggaatggccatcgtgtatttggtgttcttgcaatgtcaaggtctattggcgatagatatttgaagccatggattattccagaaccagaagttacgttcgttccccgtacaaaagacgatgagtgtctcattctggccagcgatggtctgtgggatgttatgacaaacgaggaggtgtgtgacctcgctcggaaacgaataattctctggtacaagaaaaatggcttggaacaaccctcttcagaaaggggagagggaattgatcctgctgcacaagcagcagcagaatacctatcaaaccgcgcccttcagaaaggaagcaaagataacatcagtgtgattgtggttgatttgaaacctcaaagaaaatataagagcaagacatga

SEQ ID NO: 73174 - DNA, 603 bp, Glycine max
  Peptide Sequence Number=SeqID_189952
atggaggacttgaaagatattgttcattctattggaatggatgctcgggacattgatgtcgcgtgccaggagaacggaatcctactcctcattcgatgcctctggatgttgttccttggtgatatgaacaagaagaagaaaacaaggcgagatgtcgaggaggagagtcatccaagagagttgcaacaaccaactcgataccaattcaacactccactgcccagctttactaaagctctctctatggtattaggaaaagagttttccaatttcgcataccaccttcaaaatcagatgttgagcagtgttgtatttgattatggcaaagatatattacaaggtgccaatgtggacttccaagcttttatgtgcaatgcctgggaaaaaatattggagaagcatcgtgttggtttcgacaaggcaattcgacaaggaacttggtctctattcaagacattcctagaaggactccccgattctcgtcctccgacccccggtacctttcatcttgctatgcctcataccgataccctaatgacgaatactgatagcgttgaggatgatactaggaatcaaaatgagggtgaagagaacaatagatag

SEQ ID NO: 73175 - DNA, 234 bp, Glycine max
  Peptide Sequence Number=SeqID_189953
atggtcaaccgcctcatgctctgtagccacaactaccatgccagcaacaccattctccgtgaagccaaggacattgccgagaacaatctcaggtggtgtacattggcaaatccaaaagagtatgtctcgcttcaactgattcagcaagcaaggcagaagggtatatacgagaattcgattagtccacatacccgtacggtgtacaagccccccaagcctcgaggaacacagtga

SEQ ID NO: 73176 - DNA, 573 bp, Glycine max
  Peptide Sequence Number=SeqID_189954
atgatgccttttgactccaccttcgatgtagcccacgacgccttcaacaccttcagcaaaactggatctggcaagcacgtcccccgtgctgtctttgtcgacctagaacccaccgtcatcggcgaggtccgctatggcacctaccgccaactcttccacctcgaacaactcatctctggcagggaagacgccgctgacaacttcgccagcgaccactacaccattggcaaagagatcgtagatctgtgcttggattgcatccgcaagctcgttgacaactgcaccggcctacaaggcttcctcgtcttcaacgccgtcgacggtggcaagtaccctaggatccacttcatgctttcatcctatgctccggttatctctgctgctatgttctaccatgagcagttgtcggtgccgaagatcaccaatgccgtgttcgagcccaccagcatgatggccaagtgtgatccaaggcaagacaagtacatggcttgctgcttgatgtactgtggtgatgttgtccctaaggatgtcaatactgctgttgccaccatcaagactaagaggactgcctaa

SEQ ID NO: 73177 - DNA, 321 bp, Glycine max
  Peptide Sequence Number=SeqID_189955
atggctttgcaagtgactttcaaggaggttgaggctgccaagaaggcttgtgaggattcaacaactctcattatcaatggccgtcgagcgaattacaatcttgctttcctaggtgctcatcgcccaaggtcttcttccaatgtttcaccacctccaccgcaaccacaagggggatccaatggtggaatagtgaagaatgttaacaatgcatcaggtccaccaccagccattaatcatgtgcagccatatcattatccagtgaggacaactgctctgccattccataatcacactcttcctttctatgggtatgccatgtga

SEQ ID NO: 73178 - DNA, 462 bp, Glycine max
  Peptide Sequence Number=SeqID_189956
atggaaaatagagtggagatgccagacataaccgtcactagtgtagatttcaagggagtgcatcctgaacaagatgaacctatggtcattaccatcgaagttgtcggttgcctaccttgtgacaatccactcttcggattcatgggggaaaggctccccacaaggggatctattaaactaatgacaagtgcatcttacaacattctactcgatcgcccatcaatcaacgcaattgaggccattgtatcaaccccacatttagccatgaagttcccatcatactacaaaactatcataacattccatgcaaatcaaaaggaggctcgagaatgttatatggctagcctaaagctcaccctcattcaggagatacctaagtctcaagccgttaatatggtaactatggtaaaattgggtgtacatgaagacttggatttagatccaaggaccaaggatgattaa

SEQ ID NO: 73179 - DNA, 1417 bp, Glycine max
  Peptide Sequence Number=SeqID_189957
atggaggcactacctgttaggccacaccttcaccattttgacggaccaccggagcttgaaaaaccttatgtcccaaggtctcagaacatagtcgccgacgcattatcccgaattctgatacctaacgatgcaaagctttactcattaccaatgcctactttcgtcttcttggacgaactccaagacactcttttacaggacattcaatacaaggacctattggatgatgtccgtcaaaatcctagcaaacaccctgatcttaaggtccaccgtgatctcatctttcgaaatggcaagatatggttgcccatcaaaacacccattaacagcttacaattgcaagagtttcattcttccccaattggcggccacatcggtgttgccaagaccttccaccgtctacaccagaacttcgattggccacgcattcttgaagatgtttgtcgttatgtcttacagtgtgttgtttgtcaacaaacaaaatatgaaactaagaaacccgttggccttcaacagttgttgcctattccttcagctgtctgggaagatatgtcattggacttcatcactgggctattgtcgtcacacgaatttaccactatcttagttttcatggactgtttttcaaaatgcgcccatttcggggcactcccgccacacaattccgcatacaagactgccctgttatttctcgacatggaactcttccgccttagtggaaccaagctcaggatgagaacgacgtatcatccacagacgaacgaccaaacagaggtcatgaatcacattttggaacaatatctccacacctttgttcatgataggccatctcaatggtatcacttcttgtcgttggctgaatggtcatataatacttccacacactccggtacagtaatctctccttttgaggcaatatatggaaaactgtcaccgtcgataccacattatattctgggtgacacaacggtagaagtcgttgactctttgttgaccacgcgcaccgccattctcatcaggctctgctgtcgtttgatcaaagctcaaaccaacatgaaaaccatcgtggacgctcatcaccatgatgttgaatttgtagtagcttaccgactccagttgccatcctcttttaagattcacccaacatttcatgcttcactattgaaactctaccatggcccaccacccactcgacctgcagttcttcctccgtccaacactaagaatcatcccatcattgaaccttttcatattctggactggaaatgggatttctccttttccacgccaaataagctcattctggttcaatggaatgatctggcacaggaggacactacatgggagcaactagatacattgcgtcagtcttacaaccttggggacaaggttgctttggttgaagggggtgatgaca

SEQ ID NO: 73180 - DNA, 891 bp, Glycine max
  Peptide Sequence Number=SeqID_189958
atggccatggtgtgtcctgaaggttgtcttatggatatcagaacccgctatgcatatctggtgaaagccctatctgaggttgtgattgggttgtatcaatccggcattgagcatcgaggcaacctgttgctcgagtttagttttttggaaatgtgggtagcggtatggttttacgttgatgaggttggtgttagggacgaggtgaatatggtgttggatggttcaggtagtggtgactcatggaggtgtgatgaggaagatgaaggactgggttgggttggtattggggaggccatacaggcaaaaggtgttgggcgttgcggtgccatccatagcatgcaaaataatatgaggaagtgggtctgggagatgcaatcgaggcttacagtggtggctagtaatccatttgtcatcacagtgataacaaagtccccagacgcgccagagagtcatttcctcataggcttgtgtttggtctgggtatggggaaagttggggttggtgataattgggaacgaggctatggtgaggggtaagggctacgatggcggccgtggagttttgtttcctgaagcttggcctgggccacggcctgtgtcaatgatgagggttgcagagcctgcacctcacgatgcaagtccggggtcaagccgaagacgaaggcgtcagaaggatcatcgtaataagttggggcaaaacgcgactcaagggcctcgagcattcctgtctaggatgtcaggaaatcgttccttgacatccattggtaccggcagagaaggtgaaagtgaaattgttatcgaagaagaagaagaggaggtgggaatggtggttataacggctaatcgctcaagaatagagtcgaacttagcgttcgtggtggcttggatttga

SEQ ID NO: 73181 - DNA, 897 bp, Glycine max
  Peptide Sequence Number=SeqID_189959
atgaaatatgtccaccccggtttgcctggctcgctggtttcgttccgcaaacgctatggcaactacattggcggcaaattcgtcgaaccggtatccggcaactacttcaccaacacctcgccggtgaccggccagccgatcgccgaattcccgcgttccgacgccaaggacatcgagctggcgctcgacgcggcgcacgcggcggcggacgcctggggcaaaaccagcgtgcaggcgcgttccaacgtgctattggcgatcgccgatcgcatcgaatcgcggctggagatgctggcgctgaccgaaacctgggacaacggcaaaccgatccgcgaaaccctgaatgccgatctgccgctggcggtcgaccatttccgttacttcgccggctgcctgcgcgcgcaggaaggcaccgcggcggagatcgaccagaacaccgtggcctaccatatctatgaaccgctgggcgtggtcggccagatcatcccgtggaatttcccgctgctgatggccgcctggaaactggcgccggcgctggcgggcggtaactgcgtggtgctgaaaccggcggaacagaccccgctcggcatcagcgtgctgatggaagagatcggcgatctgctgccgccgggcgtgctcaacgtggtgcaaggcttcggcgccgaggccggcgaagcgctggctcgcagcaaacgcatcgagaagatcgcgttcaccggctccacgccgatcggccgccacatcctcgcctgcgcggcggaaaacatcatccccagcaccgtcgagctgggcggtaaatcgcccaacatctatttcgccgacatcatgcaggcggagccggagttcatcgacaaggcgattgaggggctggtgctcggtttcttcaaccagggggag

SEQ ID NO: 73182 - DNA, 253 bp, Glycine max
  Peptide Sequence Number=SeqID_189960
ccgcattcaggtcgccgggctggcgctgtttttcgcccataccccccccgctggacgcgctgaccacgctggtgagcgcgcactacctgcattatgccgagcagggcgtgttcgccacgccgctgcaggcgttggcgcaggggctgcgggcgcctggagacgtatcggcggcggtggcggcggtgctgagcctggggcacttttcgggagcggacacgctgctgggcgtgtggctgggggtgacgacgattaa

SEQ ID NO: 73183 - DNA, 216 bp, Glycine max
  Peptide Sequence Number=SeqID_189961
atgttgctaaatagcaacgtcatccacgtaagagttgtcatgttggtgcgcatgatccacactcgtctttttgcagtggcacgggggaaatcttgccccggtatgcatagtagatgtgtgatagcctccctctctggatgtgctcgcacagttggtcgccctccaatatcagggggtggcccaggaactgataaaaggaaactactggccccttaa

SEQ ID NO: 73184 - DNA, 191 bp, Glycine max
  Peptide Sequence Number=SeqID_189962
ttgatgccctgatagagatcaagaatagtttgattgatcctaagaacaatcttaagaactggaataaaggagatccatgtgcagcaaactggactggtgtttggtgttttgatcagaagggggatgatgggtacttccatgttcgtgagatgtatggcttctttttccttctactttctctttgttcttaa

SEQ ID NO: 73185 - DNA, 734 bp, Glycine max
  misc_feature (606)..(606): n is a, c, g, or t
  Peptide Sequence Number=SeqID_189963
atgacagagtcactgctgttgttattcatgatgctaatgatatatttctccattagcttacctatcaatacagatgaacaaaaaacaatttatcacagaattatccaagctatcaacaacaatgaaggtggaatgtttttcctatacggatttggaggcacaggaaaaacattcatatggagaacattagcaagttcattgagagcagagaatcaaattgttattattgttgcttctagcggaatagcctctctattattaccaggaggcagaactgcacattctagatttaaaattcctgtaccaatttttgaagactcaacatgtaatatccatcaagggaccaaattagcagaattactgaaccagacaagtctaataatttgggatgaagcactaatggcccacaaattttgttttgaagcacttgatcaaagtttaagagacattatcacaaataaatcaagctcaaatcaaatatttggaggcaaagttatagtattcggtggagattttcgccaaatactaccagtcatcccaagaggaacccactcagacattgtaaatgcagcaatcaattcatcctatctatgggattcgtgtganatattgaccttgacaaaaaacatgcgcttacacagcaatctagaattagttgatgaacaagaaactgccacatttgctaaatggattctagacattggagatgggattatagattatgaaaacgatgg

SEQ ID NO: 73186 - DNA, 393 bp, Glycine max
  Peptide Sequence Number=SeqID_189964
atggacgaagacgtgcgggaggtccttggagccggtccaaagtattgcttgatcgtgacaccggctctagtagcatgcaccagaccaagttttcttggtgttggccatcttctacttcacgtgtcgtctgatgggagatggaggatcaatcacgatattagatgcttcagggatatcaaatttagtctgacaagcgaaaaattacattttattgttacttgtcgcaacgtgccctttcgcgggtgggcgaaggcgaggctcacgggtgcactttccaaaggaggaaaggtgcgcggagtcgccaccaacgtttatttgtggaaaacgtcgggaaaaccaaaggaaaccggtcaaaatgaaaattctaagttcgggagttgtatttacgtttga

SEQ ID NO: 73187 - DNA, 729 bp, Glycine max
  Peptide Sequence Number=SeqID_189965
atggaaagttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatctttgatggaagaacagggaattcttttaaacagcctgctataatgggaaaccttatattttga

SEQ ID NO: 73188 - DNA, 159 bp, Glycine max
  Peptide Sequence Number=SeqID_189966
atggaggattggggaattttctccaccaaatccttgaggaggattctgctccggctaaaatgttcctcttggtgtggggcttcggcgatctcgcttagcgagctcgtcttgctaagccgaagtccacttttcattcttagtgcgacaattcaggcttag

SEQ ID NO: 73189 - DNA, 854 bp, Glycine max
  Peptide Sequence Number=SeqID_189967
tcttcaactggagtctggttacagaatcatcttagctttgagactctcttccctgctaattttgttttcttcggttctgagtgctcatgggtatccttcaagagctcatatcttcatttatgcagcctgttctcaagaaaaataccaaccaaactcaccctttgaaggcaaccttaacagctttctgtcttcagttgtcagttcattctcggatgtaacttacaatagttttgctattggaaatggaagctcaacaccacaagagggaaacgtatacggcttgtatcagtgcagaggtgatttgcatccagttgactgctcaaagtgtgtaggaagacttgttaaccaaataggcttggtttgtccttatgcccttggggcttctttgcaacttgaaggctgccttgtaagatatgagcatgctggtgatttcctgggcaaactggacaccagtctcaggtataagaaatgtagcaaagccgtgactagtgacgttgagttcttccgtcgtagagatgatgttctggctgatttgcaaacggctaatggatttagagtcagtagttcaggcctagttgaagggtttgcacaatgcttgggggatttaagtgtatcagattgctcctcttgtctagcagatgcagttggaaagctaaaaagcttatgtggatcagcagcaacagctgatgtgttcttgggacaatgttatgctcggtactgggcatctggctattatgatgaatcagattcctccaacaatgaccaagtgggaaaatcggttgccattattgtgggagtatttgcaggtcttgccgttctagttgtactcctctcaatttgcaaaaaagcagcgg

SEQ ID NO: 73190 - DNA, 162 bp, Glycine max
  Peptide Sequence Number=SeqID_189968
atggcctttggaaccatgacagctcgcccaggcgagctgatgcttcatcctgaagtatctttggcattcttgatcaaaacattgaatgatcatctgtttcgcattgtaactgacgttcaacaccatcagtcaattagcaaggatcaaaagatcagcaaatga

SEQ ID NO: 73191 - DNA, 240 bp, Glycine max
  Peptide Sequence Number=SeqID_189969
atggcttctagagatatcatcctcttaggtaacaacattgtggcgatgaggcttcactatcctcaagcgagtcggagacccaacatgaccacagatcgatctcctctccctatgtctcacacggacccgggtatagggcctaacatctcaacgtgtgtgcaaaagtgtaagtgccatgtgtgtatggagaaatctaagaattaccccaccctacttgccaagcaaacagataactcctag

SEQ ID NO: 73192 - DNA, 804 bp, Glycine max
  Peptide Sequence Number=SeqID_189970
atgggtgaaatagaggaggtgcaaaaagagatgaaggccgacatggaggccatgaaagagcaaatgaccacaatgatgagtatgagaaaaatgatggaggtcaacatggttatagttgttgccgcaagtgctgccattgaggtggacccgactcacccatctagcatcaatcaagcaagttgtccagtcccggatatggtccagagcaagcatcccttaccactgtatggctttcctcccaactatacaccacccaatgttgcacacactcccgatgagaatgatgaagcaccccaagaccacaatttagccgactttgagcctcacctcaaatatgccgctaaagggcaggcattttgcggcatacccctgccaaacactttgggggcccctcaagtccctcttgctatggtggaaagggagaaatttgatcatatagaggaaaggctgagggctattgaaggaggcggagattatgcctttgctgacatggcagagttgtgcctagtgcccaacatggtcattcctctaaagttcaaggtgccacattttgataagtacaaggggactacttgccccaagaatcacttgaagatgaaagtcttacttagggcagccgtcacctggtatactaatctggaaccttcccgagtacattcttggaaggacctaatggttgccttcattaggcagtatcagtacaattctgatatgactctggatagaatgcaaacatgtgtaagaaaaagcatgaatctttccaagaatacgcccaaaggtggagggatctggcagcttaagtag

SEQ ID NO: 73193 - DNA, 1174 bp, Glycine max
  Peptide Sequence Number=SeqID_189971
caggcggcctacatcgccgaacgggaagcgcgttttaacgcccagctggacgtgctggcgctggccgccggtcaggattttcacgtggtggatctggcctgcggcccgggctcgctgagcctgcgcattttgcagcgctttccgcaggccagggtgaccgccatcgatctcgatccgctgctgctggcggtggcgcgcggcgcgctggcggcgtacggcgatcggatccgcattctgcaggccgatctggcggatccggcctgtttttccgcactgtccggcctcgcgccgcaggcggcggtgtccagcacggcgctgcactggctgatgcccgagcagcagctggcgctgtaccgcaacgtcgccgggctgctggccgacggcggcgtgttcctgaacgccgatcatcagcgctatgaccagcgccagccgcggctgaaagcgttggcggagcggcacgacgagcagacccaacagcgcgcctgggacaacggcgttgaggattgggatcgctggtttgcgggcgcgctgcaatcgccggcgttggccgcttatcaggccgagcgtgaagcgctgttcgccggccgcccggtgccgccgccgacgccggtggatttccagctcgcggccctcaggcaggccggccggctggctgctgttgctggcggcggcgctgccgctggccctgctgggcgccaccctgtcggggcccgcgccgatcgcgtggcacgacgcctggcgcatcgtgcttggcgtcagcggcggtgcggcgaccgacgccgatgtgtatcagcgcatcatctggtcgctgcggatgccgcgcgcgctgttggcggcgctggccggcgccggattggcgttggcgggcaccgtgctgcagtcgctgacccgcaacccgctggccgatccctgggggctgggcatctcctccggcgccggcgtgggggcggtaacggtgctggtattggggctgggcggcggcctgttgtcggtgtccggcggcgcgtttatcggcgcgctgggggcgtttgcgttggtgatgctgctggccgggcgttcgctgcagggggagtccacgctgtttatcctggccggggtggcggtgacgcagttgctctccgcgctgacttcgctgatcaccctctggcaggcggacgccaacgccacgcgcggc

SEQ ID NO: 73194 - DNA, 411 bp, Glycine max
  Peptide Sequence Number=SeqID_189972
atgcgccggatcgcccagctgcagcgtgctgccgggcatctccacgccgttatacagccaggcgatcggccggaaaccgcgcgcggaaaagttgttggacagcgtcggcgaagcgacgccggacaggccagtggcgtgctcgacggcggcggccagcgagcgatcgccccgctgttggatcgctcttgcgctgatgatatcgacgctgcgcggcgtctcccgagcggtcagcccaagctgcgaagcgctgcggctcacggcgctcaacgcatcgtagcgcccggcgggggccgccgcctccacggtgagctgttcttcgcatcccgtggcattgcgggatttatcgcagtcggcggcgaaagccaacggcgccgtcagtgcgccgccgacccaggcggcggcaaggcataa

SEQ ID NO: 73195 - DNA, 1364 bp, Glycine max
  Peptide Sequence Number=SeqID_189973
tgcacgtccagcccatcgaagggttcgtcgaggatcagcaggtcaggctcgggcatcagcgcccggcacagcagggttttgcgcgtttcgccggtggagaggtatttgaagcggcgcgtcagcagggcggtgatgccgaactgcgcggccagccgctcacagcgcgcggcgtcttgcacctcttcctgaatgatttccgccgcggtgcggccggtgtcgtcctcgtccgcgctgagcagatcggtgttgttacgttgccactcgtcgctgaccattttttgcagctgttcgaaggagatgcgcaccgcgtgctgaaagtcgctgcggcgctcaccgctcagcagaaccagttcgtcggccagcgcgcgcgccagggcggatttgccgctgccgttggcgccgacgaaggcccagctgtcgccggcctggatttccagcgcgtccagcgtcagggtgcgggcgtattgcagggtgatgtcaatcaacaaaaacgcaacgttacgttgcgcttaacacaacgtggcgacaatcacgcgatcggcgttgaacagggcgtgtacggcggtgccgacgctcagctgcaggcgctgcagctccgccgtcgtcagggtggcgcacagggtttcgccacccgccagcgtcaccagcacctcgctgtgttcggcgcccggctgaatgccggccaccacgcccgccagcgcgttatccgcgccggcatgctccgcgggcgccttgatcagcgccagcacctctttgcccggcgtcagctgcagccggtcggcgctttgctgggtgacggccgccgtcaggcgagtggtgccgtcattcaacaaaatcgccaggtgctgctgcacctgctgatgatcgcgttcgatgacggtaccgaagaactgattgcgcgcgctggtttgcagcgagaagcgcgagatggccgccagcaggctgtcgagcggcagatcgtcctgctgcaacacgtcgaaagctttttgctgcacctggcccagcaggtcatacagctggatcaaccgctggccatagtgcgtcagctgtgcgccgccgccgcctttaccgccggtggcgcgttccaccaccgtgtgttccgccaactggttcatctcattgatggcgtcccaggcgcttttgtagctgatgcccgccagtttggcgccctggctgatggagccggtgtgctgcacctgtttcagcagcgcgatgcggcgcggatcggcgaacagcttttgctggagtttgagagtcagaagaatttcggcctgcatagcgcatcctgtcggcggcaaaaatcttattgtcgccgatttggcggcaaagcgccaagcgcagtgcgctggagggcggggcaataa

SEQ ID NO: 73196 - DNA, 285 bp, Glycine max
  Peptide Sequence Number=SeqID_189974
atggctggcgctgctcgggctcgacggcgcgcgcggcgacgccccgttccacagcctttcctggggccaacagcggctggcgctgatcgcccgcgcgctggtgaaacacccggcgctgctgatcctcgacgagccgctgcaagggttggatccgctcaatcgccagctggtgcgccgcttcatcgacgtgctgatcggccagggcgccacccagctgctgttcgtctcgcaccatgccgaagacgcgccgcagtgcatcacacaccgcctcagcttcgtgcctga

SEQ ID NO: 73197 - DNA, 1692 bp, Glycine max
  Peptide Sequence Number=SeqID_189975
atgtccgctgcgttgattatcatcgacctgatcgaggatctgatcgggcccaaagggcgcgccaaccactgccgcgaacaggtgacggcaagccacctgctcgccaacgtcaatgccgccgcggcctacgcccgggtgcgaaaaatcccggtgatttgggtgcggacgggatttgccgacgattatcatgacatcccgctccactcaccgctgttcaaccatttgaaacagataggcgcgctgcggctaaacggcccgggctgccgctgggcgcccgatctgcatcaggaggagaccgatctgcagtttgataaaacggcgcacgtcgctcgccatcgagagcaccgcgcgtcaggcgcacgacgccggcttccaggtgaccgtgctgcacgatctgtgcgcggcccccacgcaggagctccaccagcagagcctggacaccctgcaaaacctggcggaaatcgcccgttcgcaggcctggatgcaaggctgacctcaataccgccggtcgtgtgggccggcaccctgcacggatgcgtcactgccccgacctttagcgtcatcttgggacatatcatgtggggcgtactggctgcttcgttatttttcttaccgtttaaccggctgatagcctgggttatcctggccgcctcggcgggcatggggctttatcatggggtgttgacgccgctcagcctgggttgcctgttggccatcgtggcgctggcggggctgcgtcaccattttcgcgagcggcgtagtctggcgatcgcgttcgaagggttggtggtcgccggctgcgtggcgctgttcttgcacctggtgccgggcatccacaatcagctgatgatcgacggtgaaaaagccggcccgctcagcgcgccgttcaccatcgggctggattgcgctgctgctggccgtgccggcgctgttgctgctggccgtggcgctgggcggcttaaaaatcgagctgcatgcgcccgcctggatcctgcctttcgtgatggcgaacctgttcttcgtctgtatggccgaagaagcgctgtttcgcggctacctgcagcagcgcctcagccagtggctgggcgcctggccggcgctgatcgtcgcttctctggtgttcggcgccgcgcatttggccggcggcatgctgatggtgatcttcgcgacgctggccggggtgatctacggcctggcgtggatgtggagcggccgcctgtggcatccttaacggctgacgccggcagagagcccttctctgccggcaggtcgggtgaaaacgctatcatcggtagcgcaccgcaatgccctcaatcacgttgccaccggcttttctccgcccatcaggcgcttttcattacacgccgcgggcgtgctatctttttgcgcaatgacctctccctgttcagcaacgggcgtattaagacggtaattggaagcgattacaccctcgtcgacgccaagaaaggaaccggccagcaggaggccgtcccgacggaaacgctgccggcgcacgatcccgactgtttcctgtgcccgggcaacgcgcgcatcaccggcgatcgcaatccggattatcgcggcacctacgtcttcgccaatgatttcgccgcgctgctgagcgatacgccgccggcgcccgacagccaggatccgctgatgcgcagccagagcgcgcgcggcgtcagccgg

SEQ ID NO: 73198 - DNA, 1130 bp, Glycine max
  Peptide Sequence Number=SeqID_189976
gctgggctcgatggcgtgttgcagcgggctatcggggtggtgatcgctgccggtgcggcgctcgcggccgccgcggtgtggttgctgaccgggctcgccgtgctctcggtgctggccggcatctgcggcgcggcgtccccgatcctgttcctgcgcgcacgacggctgcggctgcgacggcttcgtcgacagctgtggccggatgtgtgcgaccttctggtcgcgtcgattcgcgtcgggctgtcgctcccggacgcggtcgccggcctcgccgaatccgcgccggcgatgctccggccggcgttcggtgtcttcgccagagatctgcaggccagcggcaggttcgagacgagcctcgatcggttgaagtcggcgctggcggatcccatcgccgaccggatcctggagacgctgcgcatggcgcgtcaggtcggcgggaccgagctggtcggtgtgctgcgcgctctctccgcgtcggtccgtgcggatgcggccctgcgcggcgaggtcgaggcacgacagtcgtggatccgaggtgcggcggtcctgggggccatcgcgccgtgggtcatcctcggtctgctcgcactgcgtccggagggagcctctgcctacggctcgccggaaggcgtgctcgtcatctgcgtcggagcggcggtgtccgtgctcgccttccagatcatgccggggcggtggttcggatgaacgcggtgacggcgctcgccgccgcggtgctgatcggtggagcgttctcggtgggggcgctgagcatcctctgggttcttccccgatggcgagcggcctccctgaccgttcgtatcggcgcgtacgtgcgcgacgtggtggccgacgaccggctgccgccggcggccctgcccacggtcggtgtgcttcctgccagtgcacggaccctgtgggagcgcgccgaagctcgcttcgcgcggatgctgggcggaggagaggcgcttcgtctgcgtctcgcgcaggcgggggtgcgcctcgatgcatcggtgttccgcggcagacaactggggtgggcgctcgccgggatcggcgcgggtcgccgtcgcgttgatcgcgctcgctctcaccggccggatgtcggtgccgaccagcgtgctgccgctgct

SEQ ID NO: 73199 - DNA, 816 bp, Glycine max
  Peptide Sequence Number=SeqID_189977
agggctacacgccctcgccttcaaagaactgcacgtcctcgccttttaaaggactgaacgtccttgccttcagaagactacacgtcctccccttcagagggctacacgccctcgccttcaaaggactacacgtcctccccttcaaaggactacaagtcctcaccttcagaggattacacatcctcaccttcagagggctacacgccctccctttcaaaggactacacgtcctcgcctttagagggctacacgccctcgcgttcagagggctacacgccctcaccttcaaaaggttgcacgccctcgcctttagaggactacacgtcctcaccttcatagggctacacgccctcacctttagagggctacacgcccacgccttgagagggctacacttcctcgccttgagagggctgcacgccttcgtcttcagagggctacaagtcctcgccttcagagggcttcacgccctcgccttcagaggactatacatccttgccttcagagggctgcacgccctcgccttcagaggactacacgacctcgccttcagagggctgcacaccctcgcctttagagaactacacgtcctcaacttcagaggactacacgtcctcgccttcacaggactacatgtccttgccttcagaggacagcacgtcctcgccttcagaggactgcacgtcctagtctttagaggactacatgccctcgccttgagagggctacatgccctcgtcttcagaggactacacatcctcgccttcaaaaggctacacgccctcgcctttagagggctacgtgtcctcactttca

SEQ ID NO: 73200 - DNA, 753 bp, Glycine max
  Peptide Sequence Number=SeqID_189978
atgaacacgtacgacgccttcctcgagggctcacgcgcaatcgtcgcctccggtgtgcagagcgccatctggccggcgccgaccagcgagttctatcagccctggttcgacttctacccgctctacctcgccgagaccgacggcaccatgctggtcgaagacgggaagtccacgttcgactcggacgacggacgcaccgtcgccgagttctggaagaccttctacgacgagaagctctccccgaacgaggcatcgaccgacgacgcgatgtcggcggggaccaccgcgatgcagctcgccgggccctgggcgatcccgtcctacgcggacacggtcgacgtcggcttcatgccggtgccgaccagcgacggtcgcgagaacccgacgaccttcgccgactccaagagcgtgtcgatgttcaccgcctgcgagaaccagggcaccgcgtgggagttcctgaagttctccacgagcgtcgacagcgacggccagctgctcgagctcaccggccagatgccgatgcgcaccggcctcaccgacacctacgccgactacttcgaagcgaacccgaactacgtcgccttcgccgagcaggccgagaacacggcggacgtgcccagcatccccaactcggtggaggcgtggcaggcgttccgtgacgagtactcctcggcggtgatcttcggcaaggagtccatcgacgacttcctcggcaacgccgcgacgaagatcgacgagctcgtcgccgagtga

SEQ ID NO: 73201 - DNA, 393 bp, Glycine max
  Peptide Sequence Number=SeqID_189979
agaaagaagtgaggaatcctcttttcgactctgactctcccactccagtcgttgcttttctttctgttacttcgaaagtagctgcttcagcttcagccactcgaattttcgatatccctttttatttctcatcaaacgaatggcatcttcttctggaaatcctagctattcttagcatgatattggggaatctcattgctattacccaaacaagcatgaaacgtatgcttgcgtattcgtccataggaacttttgcttgcaatgtatcatttggtctacgtaccggaactgataacattcgagattatgcaggattatacacgaaagatccttatttggctctctctttagccctatgtctcttatccttaggaggtcttcctccactatcag

SEQ ID NO: 73202 - DNA, 540 bp, Glycine max
  Peptide Sequence Number=SeqID_189980
atggtgcacatggtggggatggcattggcatcattgccaccaatgacaaggatgctagtggtttccctccatgatgtttgtgttctcttgcacctctttctctgtggcattgccatggcagacaaagatggacatccagacctcacactaactagatcgatgtgttcctccggattatccttggtccagtcgtacaacaaatgtttctttcggaaaagccttctttcggaaaagttcggtaagaaggatcttccggaaaaaggttcttccggtagaacacaaattgttcttccggaaactttctggaagaaccttcttccggaagatttccggaagaaccttcttccggaagaagaaattattttttttaatgcaaggacaattttgcccattcacctaattgctgggtgcaccagcaatgttgctggtgcacctagcatgtcccaaatagccgtgggtctcttatccaaaggttgcaatagatttcatgaagcatatcccttagtccgatcccttaagaaacttttggatttgggatga

SEQ ID NO: 73203 - DNA, 237 bp, Glycine max
  Peptide Sequence Number=SeqID_189981
atggcacatagagataaattatggtcattctgcgccttgccacccaggcttgatcatgtccgagggcacgcagagacaaattatggtcattctgcgccttgtgtcaaccaaaaggaacgaactcggcagtatcaagatgatgttgctcgttcggtgctgatcattttcaaaatttttgcaggttccgctggcagggagattcaccggccgaatggtgtttcgctcgaacgaaattag

SEQ ID NO: 73204 - DNA, 671 bp, Glycine max
  Peptide Sequence Number=SeqID_189982
atggggattccaactcagcaccttttgagatttgagaagagttgcttctttggagagcacagtacgatgaaagttgtgagctgttgttcggggggggagttattgtctattcgtttggcctctaatggtagaatcagtcggggcctgagaggcggtggtttaccctgtggccggattttgatctatgctatgaatttatcattcatggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggcgcacgtggaatcccgtgtgaatcagcaaggaccaccttgcaaggctaaatactcctgggtgaccgatagtgaagtagtacc

SEQ ID NO: 73205 - DNA, 243 bp, Glycine max
  Peptide Sequence Number=SeqID_189983
atgtatattgttgtggtaaaacaggggcaggatcaccttgggctaccttctggagtggagacaaaacatgaacggcaaaaaccaatcaaggtagggtacttaaggatgaacgcaagcggggatgggatcacgaccgaccgatcgttgcccttgctctgtgcgaaacaagcagggaatgtcgttgccaggcagccccgtatcctttgtattttgcagctttcttttactatttgcttgttttaa

SEQ ID NO: 73206 - DNA, 747 bp, Glycine max
  Peptide Sequence Number=SeqID_189984
atgccgggaatctcaccgttcgcggcatgcggcgtaccgggagcaaggaaatggaaaaagacttcaagccaaaaaccgaatagacaggatatcaaatccattctgctggttcgcaatgaaggtaaaatcggcgatgccatcgtttctacgtgttttctcagagcgctgtttgaagccgggtatcgtgtagatattctggcggtaaaggagaatgagagcctttttcggcataacccgtatatccacaacatctatctctcggagagtttcagtgattgtcatcagcgcgataaatatgacaccgccatcgggagtgaggtcgttaccctcctgagagacaatgcttacgatttattgatcgatacggctatctggcaaaccgcgctgtatatgcccaaaatgattgccgatatcaatcctaaaatgacgctgggtttcaacaagcctggctggcttaaaccctacgatatcaacattcagttcgatcaccttaataaccacgttaaaaatatctatcgtgcggttcttgactatcttcaggttgagacggttgatggactgaattatgaaatattttaccctgagcgaattgatgccgaaattcaccagtccggcatgttttccgctgatgagcacaatattttaatcaatatttatgccagtcatgccgatcgtgacctctctgagcagcagctgaatgagctaatcggggcgattgtcaggcacaatgcggccaccaatatcgtg

SEQ ID NO: 73207 - DNA, 432 bp, Glycine max
  Peptide Sequence Number=SeqID_189985
atgacccaagagctggtagcccgcggagacaccttacggttatccgcacctcgtcattcagtgaccccaagtgtgattgatgagcagaggccaatgtggtcatctgcgccctttccggagatgtcagcatcttccggtggagactttttcaagtctcacaagttatctagaactacaggcggcgggcccgatgacatgcggagacaaaatttggtcactccgcacccctttgacattcagacacagtcgtgtccgatggcacgcagagacaaaatttggtcattctgtaccctttgtcatccagaggcggcgggcccgatgacatgcggagacaaaatttggtcattccgcacccctttgccattcagacacagtcatgtccgatggcacgcagagacaaaatttggtaattctgcaccctttgtcatctag

SEQ ID NO: 73208 - DNA, 415 bp, Glycine max
  Peptide Sequence Number=SeqID_189986
tcattcctaattgggatgatattgttgacctatgtgcaaaggatagagctactggactcggagcagaaaatgcattagatgtagatgatatcatgagcaaagaaacaaatgaagaggaagcaattcatagtgcgagttttgacttagagggatcaagttccgccacaagaaaaaacattcgtccaagtaagagtggagagaaagaagggatgatttcctcaatgaaagaagtagttgagtcattgaaagaatttgttgaactagataatatacctaattttaatggtgcacttcgacatagagaaattgattggttgatagaaaatctcattaagtttgcgattataaaagctcttccattggatgagaaggaggattgcatctttgtcttttatgccttgatgccaaattacag

SEQ ID NO: 73209 - DNA, 426 bp, Glycine max
  Peptide Sequence Number=SeqID_189987
atggcgtgtctgatccaaagaaaacaagcagtcgggctcgcggagaagaagagaagcagcaacaaagaagagaagctcgcggagaagaagagaagcaatagcgtgaatgggcaaaatgacccattcaataaattgctgggtgcaccagcaatattgctgggtgcacctagcatatcccatattcgggtctccattggatcaagctcaatggttaaagaactttatttgggtgttgctaggtgcaccagcactattgtattgctgtttctctcattggtggttgtttttgcaagtgttgagataggtagcagttcgttggaggagaaaatcttaccagtggtggttttatttcggtggagcttacgaatgaagttcatcggtataaagcttacggatgaactacatctgtatgattcttacggatga

SEQ ID NO: 73210 - DNA, 258 bp, Glycine max
  Peptide Sequence Number=SeqID_189988
atgacaattgaggaatcaaaacatgtttcttttgatgaaaccaatgttacctctccgagaaaggagtttcttgatgacattgctgattctttggaagatatgcacaatcaagaaagagatctaaaaagaaagagaaatgaagaaaacaaggatgttcaggatgacataactcagaaaattattatcttcccaaagaatggaaaacttcaagaaatcatcctcttgacaacatcatcgaagatatctcaaaaggggtaa

SEQ ID NO: 73211 - DNA, 331 bp, Glycine max
  Peptide Sequence Number=SeqID_189989
aactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgtgtccg

SEQ ID NO: 73212 - DNA, 979 bp, Glycine max
  Peptide Sequence Number=SeqID_189990
gctcgcggtcttccagatcggcgcgcgtcagcagcatctgcccgacgtggatgccgtaaatggagaacagctgttcccacagctggatcagccggctctgccccaccgccgccagcagctgcttggaagcgatagtagcgggcagctcggggtagcccaggtgttcgcgcccggcggcgatggcgccggaggtgacgatgacgatgcggtggcccgcggcgtgttgctgcgcgcactggcgcaccaattcgacgatgtgggcgcggttcagacgcagcgatccgccggtcaacacgctggtgcccaatttcacaaccaatgtctggctgccgttcatagtatttctgccgtgtgtaatgatgagaagaagagtgcaaaggcacaacgcgaaatcagcacaatacgtggtcaaacggggtcaggcggagagtttgatcagtttttctttgaaatcgtcggcgggttccagccccagttccatggtcgccagcagctcgcccaggcggcgatggaagtcgcgcagggtgtcttccagcttggcgttcacttcatcatccttaatgttttgcgccgtccagtcgccttctttgtcgaacaggccgaattggtacgaataggtgaagcgcgcctcttccgcctgcagctccatccaccagccccagaactcgcgcttctccggagcgggctttacattgacgcagacagccaaacaatcaaagaaaaaacggtcgttttcacattgcccttcacgcagccagccggacatttgcagcaacgcccggtggaaactgtcgtaaaccggggtgcgcgggatggcgaccagcttgccgctcaccgaggaggtgacaatcagctgcgactcctctttcgggctgagcgtatcgcgctcccagtagccggagatcatcggcgtcgggcagcggcgccccagcagcccctgcattttcagcgagtagctgttcagctccaccttcagcac

SEQ ID NO: 73213 - DNA, 576 bp, Glycine max
  Peptide Sequence Number=SeqID_189991
ggccaaggaaggcccaggggtaagagatcagaggcccccactacttcagcaccaccagagacaccaactccttcttcttccacatcttcattacctcctattctgactccaattattcttccctcgtccactcagagaccacttccagctcctatatctgcaggaccatcagattctatttttacacctcagatgctttattccatgctccagagcatccacaaggggcagtccatcatcatgcagagccttcagggcttgggcttgccatccattatgagcatggatgagtttgatgcacaggtggcttggccaggagcccagccttctccttctggaaggggtggggcctccgcaacccaggagcctattcctgagcatacagcagcagcaacagtagtagagggggaggatgagctcacccctcctaagcctttttattttgatgcaggtgtatacatggctcaggaggaggagacttctacagaccacattcatgagccatcttctacacctgtacctgatgatgccataccatctgcaccagcatctgagctagagcagcctatcccttag

SEQ ID NO: 73214 - DNA, 207 bp, Glycine max
  Peptide Sequence Number=SeqID_189992
atggatacctcagagccctacactggagcaataagaggcaccatgcatgagcctcaagcaaaccttggggcagatcaaaagttctcacccgaaaaaggaaaagagaatcctcgaggtttcgcacttgcacatttgagaaagaaactcattcgaccaggagctcatggaaaatgcccaaagataattgtgataatagggtacatttga

SEQ ID NO: 73215 - DNA, 1302 bp, Glycine max
  Peptide Sequence Number=SeqID_189993
atgctgattgttctgctctccggcggcatgcgggaaaacaccgcgcgcatcattctggccggtattgccgggacgcaattatttaatgcgctgaccgcttacattgtcagcacggcggccaatgctgagcagtcgcgcggcgtgatgttctggctgctcggcagcctgagcggcgtgcgctgggcagatgcattactgtgttttgccgtaaccctcgccggtctgctgactgtgctctaccatgcgcgcgcgctggataccttctcgtttggcgcggaagtttccgcgacgctgggcacgcagcgcgattggcgcggtcggttttgtcgggctggtgatcccgcatatcacccgcatgattgccgggccgcgtcatctggtgacgatcccgctcgcattcctgggcggctgccatttcatggtgattgccgacctggtatcgcgcacgttaatcacccatcaggtgctgccaataggcgtggtgacggcgctagtcggcgctccggtgttcgccctgattctgtatcgcaaccgggagaaatcatgaagtatgtcgcggtggataaactgagcgtgacgctacaggcgcgcagcgtgttatctgacatcagttttgcggcgcagcggggacaaacggtcgggttgctcggccctaatggctcgggaaaatcgacgctcatccgtgcgctggcgggcgttcagccttgtgcttataacgggctggagatgggcggcacgcggctgaaccaactcagccggcggcagcgtgcccgtacgctggccttcgtgccgcagcatgccgaaatggaagctgagatgtgcgtcagcgacatcgtgcgtctggggcgggcgccgcatcgcaacgcgttcagcccgtggcggacggcagatgaaacggcggtgcagcacgcgctgtcgctgatgaaactggatgcgctggccgggcggtcgtggcagcggctttccggtggcgaacgccagcgctgccagatcgcgcgtgcgctcgcgcagcagccggatattctgttgctggatgaaccgattaaccatctggatattcaatttcagctcgagctgatgcggctgattgccgcactgccggtcacggtgattgtggccctgcacgacctgaatctggcggcaaaattttgccagcatctggtggtactgcagcaagggcaagtggtggcgagcggtgagcccgccgccgtgctgacgcctgccctgattcagcggacgtggcaggtcgaggccatcgtcaaccgcagcgagcgcggcaccatgaatattcagtacgcctga

SEQ ID NO: 73216 - DNA, 762 bp, Glycine max
  Peptide Sequence Number=SeqID_189994
atgcggccgacattggatatcgatctcttgcgcacttttcacgccattgcgcgtttggggcaatttcgcgcggcggcggcatttgtcaatcgcagccccgccgccgtgagcgtgcatatccagcgcttggaacagctggcgggcgggcgcctgctggagcgtgacaatcagtccgtggcgctgacgccgctgggaaacaggctgctggcctcgacgctcgtgctgctgaacgcccatgacgatattctgcgggagctgcagggcgcgccgctgagcggccatatcaaattgggattgctcgatgagtacgcttctcatgtgatacgccatattttgccgcggtttgccgacagttttcccgcagtggagctggaagtctctaccgccgccagccaggcgctggcggaacaaattggccgtaatcggctgcatcttgcgctggtggttcaaccctcggggagacggtgccagacaccgcttgcggtgactgcgccggtgtgggccggaggccgttcgctggcgctgcaggctaaccggccgttgccgctggcgttgcatgccgccgactgcccttatcgcgaagcgatgctcgaggcgttgacggccgcggggcggccatggcgggtcattttaagcagtccctcggccagcgtggtggcctcgtgcgtagaggcggggctggccgtcacgttgctcgatcgggcgcggctctctggcgcgatgcggatactcgaagagttgccaccggtcgcgccgtatgag

SEQ ID NO: 73217 - DNA, 191 bp, Glycine max
  Peptide Sequence Number=SeqID_189995
atggaacacttacttgttggtgatgaacaaaagcgcaaaacggaatcaaaaaatgcgaaaaaggatgaccctagggctgcaaactcgtcaatcccgtgggggtggctcgcccaggcgagcccagctcgcccattaaccatgtcccctcccttctcatggattagcattttgcctaacttgaacttacttag

SEQ ID NO: 73218 - DNA, 736 bp, Glycine max
  Peptide Sequence Number=SeqID_189996
atggtgaggagtgtcacttgtaaggactccaacgctcaagcatattttgttaataggcttacaactgttccatcactaatgaggactattcttcctggattgcaaacccatgctaacatgctggttgaaaattcactgaaattgcttgtgcttagtggtgaaacttttcctttgaccttatgggagatgctttcaactatattaccaaagacatcaatcttaaatttatatggaagtactgaggtttctggtgactgtacatattttgattgcaagaggatgccattgattttgaaggaagaaaagctatttagtgttccaataggtttacccataactaactgtgatgtgatgatgcttcttaatgaaaatggtgcatcaaatgagggagaactatatgttggtggctcttgcatctttagggattactataatgaacctaataatataatgtctgatgcatttgcaaagttgcctcgaagttacgcttgccaaggccaattatactttagaactggtgatttagtcaaacagttgccaagtggtgactttgtatttctgggaagaaaagaccgcattataaaaatcaatggacagcgtattgccctagaagaagttgaagaattactaagggaacatccgtatataaatgatgctgctgtagtttgtcgaaataatgaagcagaacttgtgcttcttgaagcttttatcatattaaagaaaaaggaaagatcag

SEQ ID NO: 73219 - DNA, 234 bp, Glycine max
  Peptide Sequence Number=SeqID_189997
atgaaaaggaaaggtagtgggggagataggagttggactgacagcgacgaccccatggcagcggcgacgagcaccggcacgaagcgcggcaacgagcaccggcacgaagcgcggcaacgagcaccggcacgaacggcggtgacaagcaccggcacgaacggcagtgacaacgcgcacgaaggcagtttcgcacttccgcgaccaattggccttgtgcgaggtcaccctttctaa

SEQ ID NO: 73220 - DNA, 921 bp, Glycine max
  Peptide Sequence Number=SeqID_189998
atggttgaaaaggtttgtaatgatgatgatttctttatgatgggcggtaactctctttctgctgcacatgttgcttatggtttggggattgacatgaaatttctttactattatccaactccttttaagctttgtatggctcttctccagaaaaaaggatcatgctctttgcataacaggctggattgttgtaggcaaataaacacagacaggcaagataaccatatttctatgaatcatgctgaaaattctagacctcttgagtcaaggatgattttgaaagataatgatcatgattcttttccttctaaacgcttaaagaggggtttgatagatgttacatcatggggtgatgaatccttcccgtggtattccccttcactattatcattctcatttagccgatgcaacaaggtgttgtataaagggaagcaggcagtaattgatacaaaccaaacaacttggtctgcaaatgttccaagaggcagcagaggtcacatgaacaacttttggaaagtttacatggaatcttgtgttgatgcttccccaatacttgtgtttaaaggcacagacatttatttgttcattggatctcactctcataaatttctctgcataaatgccagaagcactactaaagtaaagctgctacctaataattggtttagtggttctgtccagtgggagatcaaactaaaaggacgcattgaatgtacagcagcaattgtttctgatttttcccaggttgttgttggatgttacatgggaaaaatacattttcttgattttttgaatggacgcatctgttggattttccaaacttctggcgaggttactggggttgaggaagtttcagtcttagaaacacgttcgacattccaacacctcaagcatgattgtccatgtttcattgtttgttag

SEQ ID NO: 73221 - DNA, 561 bp, Glycine max
  Peptide Sequence Number=SeqID_189999
atggcagatattggtgcacaaacccccttcttctatattttcagagaaagagaattaatatatgatctatttgaagctgcgacgggacccatgcttcgggcttccggaatacaatgggatctccgtaaagtggataattatgaatgttacgaagaatttgattgggaagttcaatggcaaaaagaaggagattccttagctcgttatttagttcgaattggtgaaatgatggaatccataaaaattattcaacaggctttggaaggaattcccggcggaccatatgaaaatttagaaattcgctgctttgatagagaaaaagagccagaatggaatgagtttgagtatcgatttattagtaaaaaaccgtctccgacttttgaattgccaaaacaagaactttatgtaagaattgaagcccccaagggagaattgggaatttttctaataggggatcaaatggttttcccctggagatggaaaattcgtccgccaggttttatcaatttgcaaattcttcctcaattagttaaaagaatggaaattggcccgatattatga

SEQ ID NO: 73222 - DNA, 170 bp, Glycine max
  misc_feature (4)..(4): n is a, c, g, or t
  Peptide Sequence Number=SeqID_190000
atgnccatgttcttgcattggacccaaatggatccattgtttggaagaaaacaactgatggtccaatatttgctgggccatgcataccttctgttcttcctcatgaggtgcttgtatgctccagaagcggaggtgtgtactcattcaaactggtgagaactgacagataa

SEQ ID NO: 73223 - DNA, 402 bp, Glycine max
  Peptide Sequence Number=SeqID_190001
atggccggttcagaacctgttagggcagagggagagactatggctgtggatgctgccccaaggaagccccggattctacttgctgcgagtgggagtgttgctgctgtcaaatttgcaaatctttgtcactgtttctctgaatgggcagatgtaagagcagtttccacaagtgcatctttgcatttcattgatagagcagcaatgcccaaggatgtaattctatacacggatgacaatgaatggtctagttggaagaaattaggtgatagcgtgcttcacattgagcttcgcaaatgggctgatatcatggtcatcgctccattatcagcaaacacccttggcaagtctccccctcgagcagaagccattttcaatccacgagtattcaacggtgacccttag

SEQ ID NO: 73224 - DNA, 447 bp, Glycine max
  misc_feature (436)..(436): n is a, c, g, or t
  Peptide Sequence Number=SeqID_190002
atggaggccatgaaagagcaaataaccacaatgatggaagccatgataagtatgagaaaaatgatggaggtctacacggctacagttgttcccgcaagtaccaccatagaagtgggcccgactcacccatctagccttaatcaagtaaatcatccaacctcggatatggtaggtcagggtggcaaagcattaggaagtacaggcagcctccattttgtgcaggttcaaaacaaacattccttcccaccatatggcttgcctcccaactatacaccacccaatattgctgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaanagtccaaggtt

SEQ ID NO: 73225 - DNA, 123 bp, Glycine max
  Peptide Sequence Number=SeqID_190003
atggcggtggaacttgttccaccaccaagaagaattgtggtaaaactaggaaaaggaaagtgctttatgtgttggaatttttgctggagcagccaatatcatgttaagtgggctaatgtttaa

SEQ ID NO: 73226 - DNA, 750 bp, Glycine max
  Peptide Sequence Number=SeqID_190004
tgaacgagctgagagattcgaagcaattggtgaagaaactgagcgtactcgaaggcacgaagcaattcctgttcgcactgcgccatccccaaacccaatccctaattcacattctctccgccctcaacttatcggagcgatcagccttcgacgccacgtgtctcatcgcggagatcaaacccgacgccgttttggtgcaagccgccgccgtcgccgctgtttcccccttctctcagcttcagtccgaagaagaagaagaagactccattccgttaccgacctccactctcagggtaatcaaacgctgtcttctcgataaaattggcgcggacatgttcgagaatgttgcaggtaaccttgtgctgagggagattttcgggaccggttttcatggtcccttgttggcggctaagagggctgctgaggatgttggatcgtcgtttcttcagcagcatgctgcttcttgggctccttcggctttgaagaggttttctcttgataaggaacttaggatgatgttggctaaggctttatcggggaattcggatccacttttgcttagtagttctgttttggagaggggtagtgttgaggaaatttacccgtcgattagttacgagacaccgggttttgccagaggggaggttcttgataaaagaactgtttctgaggtctatactttccgggttgctgtcgaggggcttagaattgctctgaataataaggggttgagacctgttaacaggaaag

SEQ ID NO: 73227 - DNA, 108 bp, Glycine max
  Peptide Sequence Number=SeqID_190005
atgggtactccagttattatttggccaccaaagaatccccctactttaaaagctctcgtctctgacaatgttcagagagctgttgctaggcctctaaggctgccttag

SEQ ID NO: 73228 - DNA, 291 bp, Glycine max
  Peptide Sequence Number=SeqID_190006
atgagaggcaccatgcatgagcctcaacaatacctaggggcaaatcagaagttctcacccaaaagaaagagaatccttgaggtttcgcacttgcacttcaaggagaagatgagtctagaagataccacttcaaggagataccacttcaaggagaagatgagtctagaagaagctcaccaccataggaggccatggataagagcttggaggaggaaggagatgaatgaagggagaggaagagaagagcacgaaattttatgctctaaaagagctccgaaatctgaagtttaa

SEQ ID NO: 73229 - DNA, 225 bp, Glycine max
  Peptide Sequence Number=SeqID_190007
atggggagtggaagtaactgtattccaatcggtatcgtgtctagtaaaacaccttatgttcccaaggtgcttgaccagaaaagatggtcacgagctgaagctagagctgcagagctgattgcacaaattcagccaaactatgcatcagaagcacatcgaaatgctgtcgtatttaacctacaatgcctgatcatgaattctgtcccttgtcaggttattgattga

SEQ ID NO: 73230 - DNA, 2646 bp, Glycine max
  Peptide Sequence Number=SeqID_190008
gtattcacatttgggtccgtaccattgaagacctacttacctgatggggatattgatctagcagtgtttgctgaaaaccaacattcggaagaccgtctgatccaagatgtacggaatattttggaaaatcaaggaacgaatgaggattcggagtttcatgtgaaagaggttcagtatatccagggagaggtgaagattataaagtgtttaatcgaaaactttgtagttgacatatctttcaatcagattgatggtttaggtacactttgttttcttgaggaggttgacaatttaataagaaaagaacatttattcaaagaaagtattatactgatcaaagcttggtcatattatgagagtcgcatcttgggatctcagcacggactcctttcaacctatgggttggaaatcttaatcatatatttattcaatatctatagtcacacgcttgcaggaccccttgaggtactttttcaatttctgaacttcttcagtaaatttgactggaacaagtattgcattagcttgagagggccggtgcctattaggtcactgcctaaaatgaaagctgagcctccacgatatgcacgaaagaattgcccagaattactactgagtgaaaaattccttgattcatgcgagtccaactatggcgttaagcttagctaccgagaaatcagagacaaaccttttgtctgtaaacacctgaatattgtagatccgctgcgtgctaacaataacctgggacgtagcattagtcgaggtaacttctgtaggataaaaggtgcattttctttgggtgctaagcggatagagaggttgctgtcttgcacagaagataacatcatagctgaatttgatttgttcttcacgaattcgtgggacagaaacggcaatggttactgggtcgataccgaaacctataatctgcttataaggaataaaagtgttgaaactagccatgaatatgcggttgagcagcctcatggtgtttcccaaaatcctgataatcattcagaagaatcaaagcaaatgtctggaacttctgatgtaattgttgctaataccatgaacaataaggtacttgctaatagaggccaaagtcctacatattcatcaaatgaagctcatgacatgcatcactttcctgagttttatttcagttcagaattttctcatttgtatggtgaagctccatcccatcatcaccacaacaccggattttcgtccgaaattcagcaatcatatgggcagatttcagatgattggagaagtgaacatgcatttgacccagaaaatacttcaagtggttattattatgattatgaatatgactttggtgtcaattatgaaaatgtctttcctactgatgaggcaatgctgatgcatcagcatcaggaggagtttggatttcctaatttgaatgaatatcagcaagcagcagtgaatgtgaattcaagtgatgtaccttttccaccaccaccaccccatgttttagcttcaggatacatgcatgaaaactcattcggggtgctttatggaaactggattgatcaatcaactataggcactgacttgcgtgagaacacaagtactgaatcaaccacttcaagagttcaagctcttcaattaggttcaagtcagagagatgtaattgataacaaaaattttccaccagttgaaggtggttcctctggaccatcatttcaagttcctaccatgttcccattctacaatcttcctactgaaactacttttgcagccaccaattatgatatattggatggtgactttgaaacacattatatgaatcttcaatatggaaggctttgtaagaatccaaaatcactgccaatgcatttaagggaacaatttccatggtatgggaaacctaaaggtgtcttcaacattgaggagcatgctcatcccccagttcgagtgatgctgcctcaacgtgcttctcgcttgcgtgggaatactaatcaaagtgttggtttttggcttccaagatttagtgacgggactgggactttctttccaaagccttcaagttcttatcacgagctgtggttttggaggagaaatcgtcttcaacaagatcgttacatcgaatatcagagatatgaaaggaaggataacaatggtgaaagggaacacaatttgttttctaattcagaggcaaggttggctgaccttggtcagtacaaattagagaatccaggttcaaatgaatcatcacagaaagatgaaaggaaggataaagacggtgaaagggaacaaaatttgtttttgaattcagagagaatgtttcctagtcttggccggtacaaatttgagaatccaggttcaaacgaatcatcaaatcaaggtgaaagctcacacagtggtactagtaaggtgccaaatattggaactggaagagattctaaaaggttcaaaaagagggacattcggtcattaaacggagatgctgattacttgcttggccagaaatattttcctttccttgtctgtgcctcccttactagggtgaagcttgaaaaagtgaaccatttatacaaagagagtgtgataatagtgagattactcatatgtcctccctacatgtgtgtcattcaaagatggcatgaagagggattcatgtag

SEQ ID NO: 73231 - DNA, 1170 bp, Glycine max
  Peptide Sequence Number=SeqID_190009
atggaaaacaagaaattagcgactgaaagagttgaaaggaattaccgccggagatatcaatcaaatatgaaatatttatttattctccttgtcactttcaagattatcaagaggaagttcacacagctacgggaggccatggggtttcaaacatcacatagcactaaacggatacagcagtcaattttcaaagcaaaggaggactcaattgatgctcatgaaaattcattaattcgaaggactacactgaacttcactgatcatacccaaaccaattccatgttcactctctctagctataattcatgggtggtaaggcacccctctgcattgaacacgtttgataggttgatgaaaggcgccaatgggaagaggatcattgtttttttggactacgatggtaccttatcaccaattgtaaatgaccctgatcgcgctttcatgtctgatgagatgcgtgcagcagtgtatgaaattgctacttactttccaacagcaatcattagtggaagaagcagagataaggtaaaagattttgtgaagttaaataatttatattatgctgggagccatggcatggacataatggcaccttcaatgccagttacatcttctgacggcaagcattttggcattgcccgtaacacaaatggcattgaggttccctttcaacctgcgaagaagtttttgcctgcaattcgagagataataagagtactaaagaatgaagtaaaggaaataaaaggagcaatgatagaggacaacggattctgcctctctgtacatttccggcaggtccaagaaaaggattatgatgttttggaagagaaagtgaagtccgtgcttgaaaataatccacaattttgcttgacagagggtaaaaaggttatggaaataaggccatctataaagtggaacaaaggaaatgctgtagagtattttcttgacacattaggattaagcagttgcagtgatatccttcctgtgtatattggcgatgatagaactgatgaagatgcttttaaggtcatacagagtagagagcaaggttatccaattatagtgtcttcaattccaagagaaactaacgctttatactctttgcgtgacccatctgaagtactaatctttttgtcgcggttggcaaaatggaggagaacctcttactaa

SEQ ID NO: 73232 - DNA, 462 bp, Glycine max
  Peptide Sequence Number=SeqID_190010
atgcattatcttcatgcagcattgacagagaccttgagactttaccctgcagtccccgcggttttagttcttgacaaggatgggaggtctgcagaggcacatgatatacttcctgatggccacaaactgaaaaagggggatggagtgtactatttggcctatggtatgggtcgaatgtgttccatttggggtgaagatgctgaggaatttcgtcctgaaagatggctcaacaatggaattttccaacctgaatcgccattcaaattcgtagctttccatgctggacctcgaatctgcttagggaaggactttgcatacagacagatgaaaatagtagcaatggctcttgttcgtttcttcaggtttaaactgtcaaatagaacacaaaatgtgacttacaaggtcatgtttacgcttcacatcgacaagggtcttcttctatgtgcaattccaaggtcatga

SEQ ID NO: 73233 - DNA, 270 bp, Glycine max
  Peptide Sequence Number=SeqID_190011
atgtctagtcctacaacctttacgcatgatatgtctagtcctcggtgtaaggggagtgttggagatcccacattatctagagatatagccgaaatagagtatacaaaggggggacaaccctcacttcttgatctagcagcaaccttggtgatcagagaatctgttgaaccactgctagaagagtacagacctccaggaattacttcattgaagttcagcaagctgtcacttggaaatgtggctccgaaaattgaaggtatcaaccaatag

SEQ ID NO: 73234 - DNA, 2334 bp, Glycine max
  Peptide Sequence Number=SeqID_190012
atgactaaccagtttcagataagtaattttgagtatctaatgcaactcaatacattggctgggcgtagttataatgacataacccagtatcccgttttcccttggattctttctgattatagttcagagaacttggatctttctaatccttcttcttaccgggacctttcaaagcctgttggagcactgaacccagatcgtctgcaaaaatttcaagagagatacactagctttgatgaccctgtcatccctaagttccactatggatcacactactcaagtgcaggaacagttttatattatcttgttagggttgaaccattcactacccttgcaatcaaactacatggtggaaaatttgatcatgctgatcgaatgttttctgatatttctgctacatggaatggagttcttgaggacatgagtgatgtgaaggaattggttcctgagctattttatctccctgaggtcctcacaaatgaaaattcaattgattttggcacaacaaaattgggagaaaagcttgatactgtaaaacttcctgcttgggctgagaatccagttgattttgtgcacaagcataggatggctctggagagtgagtatgtatctgctcatttgcatgagtggattgacctcatatttgggtataagcaacagggcaaagaggccattgcagcaaataatgttttcttttatactacctatgaagggacagtgaacattgataaaatatctgacccaccaaaaatctggggtgattttgcatataacaaacctttagggacggaaagcgcacgagtaaaggtgcaacaacgtgccacacaagatcagattgcttattttggacaaacaccatcccaacttctgactgttcctcacttgaagaggaagccactatcagaagttctgcatttgcagcaaagtatggagtttactgttattttgacaaatctcaagacaatattccgcaacccaaaagcaatcaaaccatatgctgttccatcccctgagaactgcaatctaccagcggccgctatccacgcttcttcagatatggttgtggttgttggtttgaatgcaccagcagctcaggttgcacagcacaagtggcaacccaatacacctgatggccagggtacaccattcttctttcaacacggaaaagctacatctggctctgcgggtgggaatcttatacgcatgttcaaaggtcctgctgggactggcgaagagtggcaatatccccaggcattggcttttgctgtttctggaattagaagccaagctattgtttctataacatgtgacaaagaaattattactggtgggcatgctgacaatagtattaggttaatatcctcagatggagctaaaaccttggaaacagcccatgcacactgtgcacctgtaacttgcgttgctctttcagccaatagtgactacctggtaacaggatcccgagatacaacagtattactctggagaatacacagggcacttgcatctcactcaagtgtcgtcggagaatcttctactgtgtctggcacgatgccttcaaccagcagtagctctgcatcacctctgttgttagaaaagaatcatagacgtcgtattgagggacctattcaggtacttagggggcaccacagtgaaatactcagttgttgtgtcagctcagatcttcgaatggttgtttcgtgctcccactcatcagatgttctcctgcactctataagaaagggacgtttaatcagaaggctggatggcgtggtggccgatactgtttgcctttcctctgatggggttgtcatgacttggaatgaatcgcagcatattcttagtacctttactcttaatggtattctgattgcaaaaacagaattacctttctctagcagcattagttgcatggaaatttctgttgatgggaggagtgctttgattggaattaattctcaagaaaatggtagagcctataacaatagttgtaattcgcaatcgagtaagtcgggtattgaagctttttattcagaatcagaagaaactcacgattgcaacaaaataaatgctccatcaccatcaatttgcttcctggatttgcacactttggaggtatttcatgtattgaggctgaaagaaggacaggatatcacagctcttgctctaaataaggataacacaaatcttttggtttcaacttgggataaacaattgattatctttactgatccggctgtttctgataaagccgatatgttgagcttgaaagtggttgatcaaatgctcaagcttggttgggaaggtgatgggcttaagcacctcataaaatga

SEQ ID NO: 73235 - DNA, 495 bp, Glycine max
  Peptide Sequence Number=SeqID_190013
atggagggtgagcatgaacaattgcttgatatgcatttcttcgcccctcgctactctgaagaggaaattttgacaacatcaagtatactaaaacctcaattaagtagcgaagtaaaaagggaagaagatgcttatagagaggaaagcagagcaaattccgaaacagtatctttgcttcttcctcatcgcctcgacagcggtgatgatctctccctgctggccatcaagcttgaccatcatgtgctggtttccatcactttgcctataacccaagagttacgcatgacaaatgaagccaccaccgcggtttcatatctggtgcctgtcaacagcgaggactgcgccttcctccatgggttttttcatccccggcaaaacctcatatctgaaagtcgttacaccattgtccttgttggcgtcatcttcttcgctggagccacagcatgccatgattccgaacacaacgtggtggatctccttctgctgttgggttaa

SEQ ID NO: 73236 - DNA, 630 bp, Glycine max
  Peptide Sequence Number=SeqID_190014
atgggtgcaagattcggtccaagcaaatcatctgattcgacaagccttggggacatagaggaccttatatataaattccttgttttcatgctggaacattcaatgcgcgaaaaagatggatggaaggatactgaagcaacaattcattgtgcagaatggctttctattataggtggatctagcacaggagaacagcgaattagacgtgaagaatctttacctatatttaagagaagactcttcagtggcttgctggaatttgctgctagagaattgcaggtccagactcaaattattgctatggctgctgctggggttgcagccgagggtttgtctccaaatgctgccaaggcagaggctgagaatgctactcacctgtctgtagctttggtggagaatgccattgtgatacttatgcttgctgaggaacatttacggtcacagagcaagcaatcctcttctttacgccctacagacggctctccatctcccctctctctcttttatccagtccattataacttaaagccattgaccaacacaagtgcagaatcagcagaactcaggggtgatcgcacatcatcatctagcaactctgggggagtctctcttgatgtatgcatagagtaa

SEQ ID NO: 73237 - DNA, 516 bp, Glycine max
  Peptide Sequence Number=SeqID_190015
atgttggagggacatcaagttttggggtttggcttctttgtaattggtttatggcacttgttcaaccacatcaagctccatgccctttgctccatgtcctacacatcaaccctatggtttcccaccacaaaatctagatacttggagctcaaattcataataacaagcagcacaatcttcattgccttggagctcttcatctcgccggctcgtcaccaaccattcaaccctgatggatccattccctcagatcatctccacaactttgaacactcctccatggccatgtccttcttggtctatgccacctttgccctagttcttgacaaaatatgctccaaagctcaatatgagttaacccatttcttaggagccatagcttttgcacaacaatttcttctcatccaccttcactctagggatcacatgggactagaaggccaataccactacttttttgcaacttctcatccttgtttctttgtccacgaccctaatgggtattggttaccctaa

SEQ ID NO: 73238 - DNA, 561 bp, Glycine max
  Peptide Sequence Number=SeqID_190016
atgctgtacgtgccgctggaaagcgtggtggcggtgttctcggtcggttatgtggtggtctgcggttcggtggtgctgtcgatggggctggtcagtttcctgattgcgccttacctgaagatgttcccggtggaagcggcgatcgtcacctgttgccacagcggcctgggcggcaccggtgacgtggcgatcctgtcggcatcgaaccgcatggggctgatgccgttcgcccaaatcgccacgcgcatcggcggcgcttccacggtcattggcgcgacgctgctgctcggttgccggggttggattgccccggttttttatttcgaggacagccgcacccacagcgtgatgagctatttcagcgaaagcaacatcgggcaggactttaaaggcgcgtactcatccgggccattgctcaacgacatcacggcgatcccgcatttctacggcgccaacatgcacacccacatcggcgatacgatctacggtttcaattccaataccgatcgcgacttcctcaccgccaccggcggattggatccgcgacttcgtgcgcgctga

SEQ ID NO: 73239 - DNA, 165 bp, Glycine max
  Peptide Sequence Number=SeqID_190017
atggtggaggaaggttcatggaaaaatcttggcggatcaaattcaaggaatttgaagaaagctattgaccgcattcaccgactctgcattctgcatgattctcagaccactctgcttttcctatttgacctcggattcaattcaaacatgtggttcttcttctaa

SEQ ID NO: 73240 - DNA, 1610 bp, Glycine max
  Peptide Sequence Number=SeqID_190018
aaatcgtggccggcatccagctcgcagaagggttgggtcaccctaaagtcgctgtcaggccgccagtggccgagcagatagccgctctggaagcgattgcggtagcggtagccctgtgccgccagcccctgcggagagaacaacaacaggcgcacctggccgagaccgttttctttggcgccgaccaccagccaccattcgccgttctcgcgccagactttcggatcgcgaaaatgctgaatgccgtccggcgcggccagcaccggcccgtgcttgacgaagcgtatgccatcttcgctggtggccagacattgcacttcccgcacctggctgtcgtcgccgggctcgcccagccacacgtggccggtgtaaagcaacgtcagcacgccgttgtcatccacggcgcaaccggaaaaacaaccgtctttgtcatagggcgcatcgggcgccagggcgatgggctggtgctgccagcggatcagatcgcggctggtcgcgtgcccccagtgcatgggcccccagtgttcgctgtaggggtgatgctggaagaaggcatgatagacgccgtcaatacagatcaggccgttgggatcgttgatccagccggcgggcggcgcgagatggaactgcgggtagtattcgtctcggcgctctgcgcgcagggcctcgaccgcatggaaacaggagacaagcgtcgtggcggcgaccgcgcaccccatcagcagataggtgtcggcaaagccgatgcggtcataaccgtagcccgccagcggcgacaggaagctggccatcacctgggtgatgaactgaaagcccaccaggatcggcaactctacggcgtgcagcagtttcatggcggagatcatcaatgcgccgctgaccaagccggagccgaacatgcgcagcgccatcacgccaccggccagcaacaacccctgtttggcgccgatgcggttcaccagcagcggcgccaggaacatgccgccggcttcgaggaagacctgcagcgagttgaggaagcccacaaacaccaccagcgcccagaagcccggcatacgcagcagcgcgagcgcatcctgcagccgcagattttccggtttgccgaacgccaggccggccatggcgttcggcttcagctcgcgcacctggctgagcagcaacaggaataccacggcggcggcggaggccagccagaaattgatgttcggatcgatattgaagataaaaccggccaaaaaggtggcgctggcccagccgagcgatccccacatgcgggcgcggccgaattcgaaaccgctgatgcggctgactcgctcggtataagattccagcgcgccgatgccggcgaagaaggtggcgccgataaataccccgccgaccagcgcgccgagcggcaggctgctggccagcagcggggcgtaaacgtagataaagaacgggccggtcagcagcagcatcacgccgagaaactgcagcaggtgcttgcgcagcccaagtttgtcctgaataaacccgtacagcggctgggcgcacagcgccaccaacgagatagcggagaagatcaggccggtctcggcgcctttcaggccgatcttctgattcagccatag

SEQ ID NO: 73241 - DNA, 231 bp, Glycine max
  Peptide Sequence Number=SeqID_190019
atgccttgtgatcgaggtcacgggttggcaagggggcgatgcgcccccggaggattaacgttcgttcagcgagcgcagatgatcgtcgcggcgcagcgtcatcagcgcaaacaggctgaccaccgaggtggcgaccacgtagtaggcgggaatgtcgatattgccggtctgtttgatgaggccggtgataatcagcccggccgagccggaaaacaccgcattggacagcga

SEQ ID NO: 73242 - DNA, 2076 bp, Glycine max
  Peptide Sequence Number=SeqID_190020
atggagtgcaacaaagatgaggcagttagggccaaagaaatagcagagaggaaattttcagaaagagaatatgttggtgcaaagaagtttgctctcaaggctcaaaatctgtatcctgagttggaggatattacccagcttttgacaacaattgatatttacatatccgctgagaataaagtaagtggagaaatggattggtatggtatacttggagtgagcccctttgctgatgaggagactgttagaaagcaatacagaaagctggctctcactcttcatcctgacaaaaacaagtctttgggtgctgagggtgcatttaagctggtttcagaggcatggagtttgttatcagataagaccaagagactagaatataaccagaagaggagtttgaaaggattccaacataataatcccaaccatgttggatctcaatcggatgcacccagttcaaatggttattataatctaaagaagaatgcaacttcaaatgtcagggcaggaaagaataatggtcgggcaccttcagctccggttaaaaaggttgaaaccttttggactatctgtaataggtgcaggacacattatgaatatctcagggtttatttgaatcacacccttttatgtccaaactgtaatgaagcttttgttgccgtagagaggggtccaccaccaaatgtttttaagccaccaaattggtcttctcatcaacggcatcagaattctcaacaccatgctggaagtaataatacaaattttcagtggggttctcactctagaatggctggttttggtagcacagatggatcaacatctgttgcagctcaagctgcaagtgttgtgcagcaggcaagtgagagagtaaggagggaaggttcttttcacaaagctgaaaaacctatgaagaaaaggaagacagatgatatttgcattaatggttatcaaggatacatggcaaatcatatggctacaggacatggagcggctggtttgggcaccttttctgaaccaggaaaggctaacttggaaacagaaaggaattatggtttttcaggtcttcctggcaagcattacagcacaagagaattgtcaatgtttgaaatacgaaacatgttgatggataagtcacgcattgaaattcgtgagaaacttcaagaatggaaattgatggctgaagctaagattaacaaggacaaagagaataaaagacagaaaagcacatttaatggcaaaccaactggttcagagaagctgagagagactgctgttaatggtaacaggcatctggacattgattctttccctgtcagaactgatgatacagttaagaagagccaaacttatgttacaatcaatgttccagaccctgattttcataattttgacttggatagagatgaaaattcctttgcagaggaccaggtctgggctgcttatgatgacgatgatggaatgcctcgttattatgctaaaattcacaaggtgatctccatgaagccatttaaaatgcggatcagttggcttaactctcgaagcaacagtgaattgggcccaatagattgggtaggctctggtttttataaaacttgcggggatttcagaactggcaagcatgaaataactgaatcattaaattcattctctcacaaggttaggtggacaaaaggcacaagaggtgttgttcgaatctttcctggaaaaggggaggtctgggctctttacagaaactggtctcctgattggaatgaacataccccagatgaagtgatacacaagtatgatatggtggaggtgcttgaagatttcgatgaagagcaaggcatattagttaccccccttgttaaggttgctggttttaggactgtgtttcaaaggcacatggactgtgatcaggagaggaggattcttaaagaggaaatgtttcaattctctcatcaggttcctaattacttgcttactggccaagaagctgataatgctccaaagggttgtcgagagttggatccagccgctactcctttagacctcctccagatagcaacagaagctaacgagacaacggataatgcttag

SEQ ID NO: 73243 - DNA, 1026 bp, Glycine max
  Peptide Sequence Number=SeqID_190021
atgtgcttcattcaaaagactccagaaggaggttttttggagatgattttaatggatgagaggttgttctttacaaaaggaacaattgtaaaagaacatgagcttcttgaaattcctgaacatgtatatgactttactacatttgaagaaatattgagtggacaagcttcatctgatgtgttagtagatgtgattggtcagtttgttgacatagagcaagaacgctatgataatccaaagatggtcattcatatgaaggacccacggttatcaaattttatggagaaacatgaaactggacctatcattataatcctaacactagccaagataaaggacccaaaaggtgaatgtcctattattatccaaggctctcatgattcaaagcttctcatcaatgaaaatattgtagagatccaacaatataggaacagattggactcagtccctgtttgtgagtcattaagtcaagccatctctcagatttcatcagtttttgaagcttctactatagacaagttttttgtgaatactccagtcaagagtgtgatggaaataaatgaatttgatcgggaattgttttgtgtcacacttgcaaaaatagagaaattttttgttgcaaatgggtggagctacgaaggatgctctaggtgcaatgttaaaggtgatcccgaaacaacatatatttgctcaggttgtgggaaaagtaacacaggaacagttgcaaggtttagaatagagattctagtttctcaagaaaaagagtgtgcagagtttgtgttatgggacaaagagtgtgtacaattgttgaatgtaactgctgctgagctaaaaaagcaattgatagatgatggtgaggtcgatccattggcttttcctgaagctatagagtgtattttgggaaagatgttagctttcaagataaaagtgcagccaagatgtcgaaaatcatttgtcatccaaatatcagatgatgaacaaattatcgattccatcaagttaaaattaccatctgatgaggtttga

SEQ ID NO: 73244 - DNA, 207 bp, Glycine max
  Peptide Sequence Number=SeqID_190022
atggctcgtagaattaatttaattgaggagattaatgatacaaaagagacatggaaactagcggtcagaattacaaatatgtggttctttcaaaatccttcaaaaggaggttttctagagatgattttaatggatgacaagggactcaagatgggagctgcagtgaaacattttgactttgaaaaatggaaaaatccactcaaatag

SEQ ID NO: 73245 - DNA, 291 bp, Glycine max
  Peptide Sequence Number=SeqID_190023
atggatgttatggactggtgtgagcagaattttgcacaagtgcagaaaaatgcttgtgtgtggttggctgtggaaagtctagtgcagaatgagtctggatgtttgctagtagatcccaacggtcacaatcttgagaggattgatggggacccggtgttgagagaaacgaggatatgggctacgtgggagtacgtgagctcagttggaggtgggcaacaggggatggtgggtttatgcgcgcattgtggatgtggaaaacttgttgtgcaccatcgcccgaccgccacctag

SEQ ID NO: 73246 - DNA, 210 bp, Glycine max
  Peptide Sequence Number=SeqID_190024
atggagcaaacaagtaaaaacttcgtaccccattgtccagaggctcttcgctatgcgaaggtcaacctgaaaagcttcgaggtgggcatgttcattccgatctttgatttttgttatggtctatcagacagagggagccagggaacactggaaatacctcggacaataattgctgtgaacgtccaactgcattcacaactggaatcttaa

SEQ ID NO: 73247 - DNA, 252 bp, Glycine max
  Peptide Sequence Number=SeqID_190025
atggacacagaaaaactatgtagtgttgccataagcatcaaacacaagtatgtgtatgccattgggaaaaacccaactcccacattgactagagataaggcaaagatggagtatacaagtggaaggcaaccctcatcctatgagctaacttttagggttcattttaagatggtcacccaccatattatccacgtaccaagcccaaaagtgtctgggcgtgagggagggtgtagagggaagaaaaggagataa

SEQ ID NO: 73248 - DNA, 249 bp, Glycine max
  Peptide Sequence Number=SeqID_190026
atgtcagcattcctgaatgcttcttgcccaatacaggatcaaaatacaaccctctttaattttggaatatttcttgatgcccttcaatctggagttgtggagtcaagagatttcccacaaaataaccgtacattgcaatgtgttcattattttggtgacaactttgttgagttgatgtcagctatgagtgtggtgctaggaacctgtagctgtgcttggactccatatgtctgcatgctcatgtcatag

SEQ ID NO: 73249 - DNA, 225 bp, Glycine max
  Peptide Sequence Number=SeqID_190027
atggtggttcttcgagcatctcatgtcaatctcatgtttacatttgccatgcatagcataatattgacaatcaagatttctattccttggattatgggtttgaaccaagcacatgtttttaaggttcatcaagtcaaggtcaagtatggaagtaaccagcttgcaaaagttggggtagaagatggatcgagttacatcgcttctttgtttacttccaacacatga

SEQ ID NO: 73250 - DNA, 171 bp, Glycine max
  Peptide Sequence Number=SeqID_190028
atgcatgatgcgatcaaggaacaagccagaggactatcagcgacaatgcatcaccaaaagaggaaaactctagaagaggcttcactgttatcaagcgagtcagagacccaacatgaccacagatcgacctccactccttatggctcacaaagaccaaggtatagtgcctaa

SEQ ID NO: 73251 - DNA, 117 bp, Glycine max
  Peptide Sequence Number=SeqID_190029
atgccgactgttgatctattggttttcccattctgtgtgtggagtctgattagctatgttaatcttagtcgatttcggatggctttctcttgtaagacgcgtattgccaattattaa

SEQ ID NO: 73252 - DNA, 942 bp, Glycine max
  Peptide Sequence Number=SeqID_190030
atggaggacggcgcaggaagaggtttggaatgcccgaagactatggatgggaaggcgagtaacgggaatgggttagagaaggaaattccttcttgttgtctgaaggctaaggcttcaatccctgagtctgaggcgaagtgccattctactgttgtttctgggtggttctcagcttctcaaacttgctctgggaaatctgggaaagctgtttatttcaacaacccaatgtggccaggagaagcccattcaatcaaagtagaaaagatcttatacaaggaaaagtcggagtaccaagaggtcttggtttttgagtcatcaatgtatgggaatgtgcttgtacttgatggaatagttcaattgactgagagggatgaatgtgcttaccaggagatgatagctcatcttcccctctgttcaattcattcgcccaaaaatgttttagttgttggtggtggagatggcggtgtactaagggaagtagcccgccatagctctgtggaacatattgatatttgtgagatagataagatggttattgatgtttctaggaagttttttccacagttagctgttgggtttgaagattctcgagtgcatctgcatgttggtgatgctgttgattttcttaaatccgctcctgaagggaagtatgatgccataattgttgattcctcagatccagtgggtcctgcccaggaacttgttgagaagcctttctttgatacaatagctagggcattaaggcccggtggagttctttgtaatatggcagaaaaaattcattatcttctttcctcttccttggcatgcagtggcatgataggctttattctctgtgcaacggaagggccgcctgttgattttgtaaaccctatcaatcccattgaaaagttggaaggtgctaatgagcacaaaagagaacttcaattctacaattcagag

SEQ ID NO: 73253 - DNA, 348 bp, Glycine max
  Peptide Sequence Number=SeqID_190031
atgagtcaaccgacacagcagcgcctctatgatttcgccaaaatggctctcatcaacatcttcgttcacccctacgccacggtgtgcgacttgtactgtggagatgccgacgctgataaatgggcccacgcacaaattggccactatattggaattgatgcgccttcgtctgggatagaccaaatgcgagaaacttgggagactcacaggaaatcctacactgccgagttctttgagcttgacccttgcacggtgaccaatctaatatttcaatatatgcaatttttcatagagtttcttttggaggactccacaccctttatctctctgaatcaaccatgcctttaa

SEQ ID NO: 73254 - DNA, 816 bp, Glycine max
  Peptide Sequence Number=SeqID_190032
atgactgatgttgtctgctgtttgcagcatttgcagttgtgttttgagactgaagagaaagcacggaaactgctgcataatgtgtcttctctgctgaaacctgggggttattttcttggtattactcctgactcatctaccatatgggccaagtaccagaggaatgttgaagcctatcacaacaaaagcagcagcatgaagccaaacattgttcccaactgcatccggacagagaattacatgattacttttgaagttgaagaagaaaagtttcctttatttggaaagaaataccagctaaaatttgctaatgatgtctctgctgaaacctattgcttggttcattttccaagtttcatcaggttggccagggaagctggtcttgagtacgtggagattcaaaatttgaccgagttttatgatgacaacagagcacaattagcaggcctgttaacacactatgttccaaacctcttggatcctagggggagacttcttcctcgttcatatgatgcactaggtctctacaccacgtttatatttcaaaaacctgacccggaaattgcacccccgattcctactccgttattgccagatgttagttataatcttgatgagaatacgattttagggactgttgaagaggagaaaactgagcatatggacgagtcagtaatagaggtaaccatttggcgagatgatgaagtgataaatgggcatgtagtagaacctgctattgggctgggcaaaataagcgaacaaaaagggatattgggcccaggtcctgcagatttacgttttccggaagcactttga

SEQ ID NO: 73255 - DNA, 213 bp, Glycine max
  Peptide Sequence Number=SeqID_190033
atggcttcagcctataggaggaccattagcggtcctaaaaagaagatattgcgaaataacattcaccatagcgtgatagaactatacaatttaatatgtaataatgctcataaatatgcacactctaaacatcacgtacgaagtaggaactcatcaaggaaagaaggccaacattgcacagatgagatcagctatccaagttctagcagctag

SEQ ID NO: 73256 - DNA, 1827 bp, Glycine max
  Peptide Sequence Number=SeqID_190034
atggttgcagaatcatggtttcgtagtctgtggaaggctcctcggaagcatgatgctaattctgagaaggtggtcattgaagtattagcatttgaaatagcaagcttgatgtccaagctagttaatttatggcagtctttgagtgataaacagattgttagattcagggaggaaatcacaaattcagtgggcataagaaagcttgtctcagatgatgatcatttcattgaacgtttgatctgtttggagatacttgagaatatggcacatgtggctgagtctgtggctaggcttgctaagaaatgcagtgatccaattttcaaaggttttgggaatgccttttacgagtttatcactacgggaagtgatccatatgggtgggaattcactggcaagaaaatggaaaagaagattaaaaggatggaaaagtttatatcaactaatgcaagtttgtatcaagagatggaagtgcttgctgatcttgagcaaacttttacaagagtgaaggctaatggtgagtcagatggtgtaactttaatggagtatcagaagaaggttgcatggaagaggatggaggtgaagcacttacaggatatttctttgtggaacaggacatatgattacacaatacttcttttagcaagatccttattcacaatattctgcaagatcaaccatgtatttggacttacagagatggtggatgttggcagaaccactaattcaagtgtcttgaattcggatttcatttacagaagtcaatcggtttctacaatattgcaatcttcataccaaccatcacagaataatattcccaggttttcttcaggaccccttaatgctattactgctagatcaggcccaattggtcaaacaacaaataaaacaagcatttctcattcaggtcctcttggtgactcatccacgaagtcaggccccattttagaaaagcattcaacaaacgtcaatttttactcaggtcctcttggaaggaaattcaatccatcagtcccagttaccggaagaaaaaaaaagagtaagatttggaagttttatggacactctgctgccataagtgggaaggaaactagcacaagatccagtcgactgacccaagtaggacctttcaaaggttgtatggcttgggacagttccatattcactgactgccagtcaagtgcaaatggtgttcattatggaacgcagaatctcaaagatattaattcaaaccctcttggtcctggaaaagtagttcatcatactcaatcagtcttcaaacctctttgcaagctatttaatcctccacctgaaacccttggtgctgctgctctagcactgcactatgcaaatgttatcattgtgattgagaagctagcagcttcttcacacttgattggtctggatgcaagagatgacctgtataacatgttaccaagacgtgtgagagcttcccttaaggccaagctaaaaccatataccaagaccctggcatcatcatcatcatcatcaatctatgacccaagtctagcagaagaatggaatgaagcaatgtcaagcatacttgaatggctggcaccacttgctcataacatgataagatggcagtctgagagaagttatgaacagcagagctttatttcccggacaaacgtgctgctagtacagaccctttactttgcaaatcaagaaaagacagaagaagtaattactgagcttcttgtgggtctaaattatgtctggaaatatggtagggagctcaatgcaaaagctctggctgagtgtggcagttttagggtagacaatgaatatcctaatctgaatggatga

SEQ ID NO: 73257 - DNA, 216 bp, Glycine max
  Peptide Sequence Number=SeqID_190035
atggctcaatcccttttctggattggcatgaaagggaccatcactaattttgtagcagcctgtcatgtgtgccaacggagtaaatatcaggcttcttctccagcaggggatagaaatcccccagctgctggtccattggcaaggaaagcttatggaggaaggtacttgggaagacatcttctccatcagaaatcagtttctagatttcaaccttga

SEQ ID NO: 73258 - DNA, 459 bp, Glycine max
  Peptide Sequence Number=SeqID_190036
atgggtaaagtagaggtggcgcaagagcagatgaaggctgacatggaggccgtgaaggagcaaatggccacaatgatggaggccatgatgagcatgaaaaagataatggaagccatgcgatatggtaggcaaagatttgggagtacgggcgacccccattatgtgaaaattcaaaacaagcacaccttcccgccatatgacttgcctcccaactgtataccacccaatgtggcgtacgctcctggtgaggatgtcaataactccgctgctatactcattaagagccgacaacctcatcatgcacatgtctctcaacccataggggagacatatgaaataccccaccacaatctagctaactttgagccttgcctcggatatgccattgaagggcaagcagttggtggtatacccctgcaaaacactttggaggaccctcaattttgcccccaaccataa

SEQ ID NO: 73259 - DNA, 327 bp, Glycine max
  Peptide Sequence Number=SeqID_190037
atgggggcatacgcaaaagatgaaaaactgttgatacatttcttccaagaaagtcttattggggcagctgccacccggtatactaacttggaaccttcccgagtccattcttggaatgacctaatggttgtcttcgttaggcagtatcagtacaattctgatatgactccagttggatgcaactatagaacatgggtaaaaaggggcatgaatccccaaagaatatgcccgaaggtggaaggatatggaagcccaagtggcacccccaatgacggaaaaagagatgataacagtgatagtagacacattaccagtgttttactatga

SEQ ID NO: 73260 - DNA, 168 bp, Glycine max
  Peptide Sequence Number=SeqID_190038
atggacaaagtggaagatgaaaagaacatagagttcgtgaatgaagaagatggacagacaaagtatggtgataagaatgtgtactttgatttggaggatctaggcaacactattggtcagtgggacttgtatggcttcgatgcaccttcaccccacaaccctttttag

SEQ ID NO: 73261 - DNA, 291 bp, Glycine max
  Peptide Sequence Number=SeqID_190039
atgaaaaagaaggctacaatagaggacgttgaattactgacaaagagttgggcagcattggcggagaaagttagattggtgctcaatgagtatccacaactcaggctaacccaagggagaaaagtgctagagatctgtctaaccattaaatgggacaatggcaaggctcttgaatttttgttagaatcattggggtacgagaattcgaatgatgtatttccaatctatattggtgatgatcgaactgatgaggatgcttttaggttaacaaatgctgccacgcctagttag

SEQ ID NO: 73262 - DNA, 698 bp, Glycine max
  Peptide Sequence Number=SeqID_190040
atggaggagttgatcacattcagagcacaaatgcacggggaacccttaaagaaacaagtggagcgagagacaaggacccctcacatgatcaagattgagagcaagaaaggagtcaagaacgtagtcggactcaataaaccactaaggcacaacgcgacaagaataccacatccagaactcagttatgaggaagaagaacatgaggctaaaccagaaaagtgcatattcgaggtacaaggagggaagttccttggtttcatgcttactcataggggaattgaggccaacctggaaaagtgcacaatcattattgcaatgagaattcctaacactttgaaagaaatgcaaagactcactgctcagttacgaaccaagggtccaatgcaggctcaatgcctagcagacttcactatagatctagagtccaagtggtggaagttgtatgtagtttgttcatccaatgaaaaagggattgatgttggaatcatcctagaaagcctatatgaagtaatcctagagcaatccctgaggtttgagttcaagaagacaaacaaacaagccgagtatgaagctctcttagtcggcctgagattagttaaggaagtagaagccaagtacttaaagtgttggagcaactctaagcttgtcactggtcaactgaatggagaatatcataccaaagatccccaaatgacaag

SEQ ID NO: 73263 - DNA, 411 bp, Glycine max
  Peptide Sequence Number=SeqID_190041
atggcgaaaagacccccacaaccaactaagaaagaccacccaagggataggtgcccaccacatttggggtgcctaccacatgagcccctaaaaatgggagtcccacaacctagggaaatgaacacacttaagcaaaagtacacccaagagatggagaacctccaaaaggagaatgtcgtccttagggaacaataccaaaagcttcaagaagatcacgagacacatttggtctccatagctattattcatcggactcaccaggctgggaccgatgaagttgaaaagacgtggagagaaggaatatctttgatcactcacaattccaaagagcagcaaatgcaaagaaccgacttcatccctttgtcgatggggtcatggaagcacaactaccacccagatggaagatgctaa

SEQ ID NO: 73264 - DNA, 252 bp, Glycine max
  Peptide Sequence Number=SeqID_190042
ggattaagagaccgagggtctcttgttgtaaagcaatctaaacacaaaggaagggttgtccttgtgtggttcagaacttgtaaagggattttgcaagatagtggaactctcaagcgggttgcttgtggactggacggaggcacaaggtatttcaatgatgctagaccattggaaccagagagattgaaggcgcttcggatccaatgggcaacctattatttgaaagttaaaaatgaaacaattagtgtttaa

SEQ ID NO: 73265 - DNA, 181 bp, Glycine max
  Peptide Sequence Number=SeqID_190043
atggtggttgagggccaaagcaaaggatatgtttgccataaggtacctcccttatcccatgagagagaagtgagcacaaagagcacgtacgcggaagcacaaagttacaatgaagacatgaagcttaccttgaacccaacaccgacaatggcagcgagactggcagtgaaacgtacctcag

SEQ ID NO: 73266 - DNA, 474 bp, Glycine max
  Peptide Sequence Number=SeqID_190044
atgttaaggcagacaagagttgctcttggaatagaagttgatgacaaaatgccacaacacgagtattatgaatattttggtccagattataccgttcatgttgccccaagtaacatggaaaataagaattctcgtcatttacttgaagaaattagatctaaactacttgaaaatctttccaagctgcagcatgctcctagtgcccaatttcaggaaaggcctcctgattctgagcttggagagttcatgaggcttcttattgtcatcataggcacaaggatggctatgttcctagttcctactcagcctatggattataccagccaatatcctaatcagaatcagtctcagacctctggttcttctccagattctgtttcaactagtgtaaatagaatcagtcctagtatgtctcatgccaatactctttctaatagtgatctttcttttgccacacatggcattccatattag

SEQ ID NO: 73267 - DNA, 381 bp, Glycine max
  Peptide Sequence Number=SeqID_190045
atgactcatcaggattttcaagtttattcctcagttacagcgctaaataaatggataaatttgacatctttgtccctcatcctctctgtcgcaacctaccctacggcgggagggcgatgcgagactcgcgggatgcgtgttccacgaaaggaatacgtgcggagtcgccaccaacgtttatttgaggaaaacgtcggaaaaactggaaaagatgcgatctacgaacttttaagtgaaaggctcgggagttgtatttacgcgcggggaaggagagaaacgttaaggtgttggaccattaacgatctctcggggtggtcgacaaaagcggggcttttgctcctacgtatcctcaattgcgatgaggaaatcagacctacgtag

SEQ ID NO: 73268 - DNA, 234 bp, Glycine max
  Peptide Sequence Number=SeqID_190046
tgggttgacagtaataccagtgtgcggaccaatgatgtaggatttacgttggtggatcttaagaaactcgcttaccagaattatcctttcatcatggcagaacaagttaaacaggcaaatgactacaccacccaactctcctcctcctcatcctcctactggtgtagcatctcattcgtcgtctaccttgaaatagacaagaaaggccacactcctaagatcattggcgactag

SEQ ID NO: 73269 - DNA, 366 bp, Glycine max
  Peptide Sequence Number=SeqID_190047
atgcatacattaaaacacgcatacaacatcaaagaagtttatacaagaacacaaaggaaaagggaaatcgatgaaagggaaaacacaacttttgcacaaaagattaataggcctaactctctaaaaatagtccccagcggagtcgccaactgtcgcaacctacctttcagtgggagggcgacgcggggctcacgagtgcgtcttccaagggaggaaggcgcgcggagtcgccaccaacgtttattcgaggaaaacgtcgaaaaaactagaacgtgtggtctacgaactttaagtgtgaaaggagagaaaacgttaaggcgtgggaccattaacgatctcttgtttttgaaaggagagaaacgttaa

SEQ ID NO: 73270 - DNA, 141 bp, Glycine max
  Peptide Sequence Number=SeqID_190048
atggtggtggttgggcttggtgagaaggtggtgcacgatgatgcagagaatagctactttgaaaacgaatcctactctgaaatagtcattccgaagaggaataagatacttttccagaatagctattatgaaatagaataa

SEQ ID NO: 73271 - DNA, 1581 bp, Glycine max
  Peptide Sequence Number=SeqID_190049
atgacccgcaaggtcctcttcctctgcaccggcaacagcgcccgcagcgtgcttgctgaagccaccctgcgcgcctggggcggcgatcgcttcagcgcattcagtgcgggcagccagcccactggccagatcaaccccttcgcgctggcccagttgcaggccgaaggaatgcccattgaagggctgcgcagcaagtcgtgggatgagttcgtggatgcagccccgatggacctggtgatcaccgtatgcgattcagccgcagcggaggcctgcccggtggtgttcggtgacttcatccgcagccactggggcctgcccgatccggcggccgtcgcgggtagcgatgccgacaaggccgcagcattcgcgcaggcccatgccatcgtgaagctgcgactgcgtgcattgctcgcgctgcccgaatcgttgtggtccgaccgcacgacgctgcagcacgcgctggaccggatcggccggctgctgccgaccgacggcgcacaaggtcgccaaggtcaacctgccggttgcggtgctgatctggctgatgatcatcccgatgctgctgaaggtcgacttcactgcgatgcgccagttgcagcagcactggaagggcatcggcgtgacgctgttcatcaactgggcggtgaagccgttctcaatggcgctgctgggctggctgttcctgcgccatgccttcgccgactggttgcccgcagcacagatcgacagctacatcgccgggctgatcctgctggcggccgcgccctgcaccgccatggtgttcgtgtggagcaacctgtgccgtggcgatgccaacttcaccctgagccaggtggcgttgaacgacgcgatcatggtggttgcctacgcgccggtggttgcactgctgctgggcctgtcggcgatcaccgtgccgtgggataccctgctgctgtcggtgggcctctacatcgcggtgccggtgctggtggcggcgttgctgcggcgctggatactgatgcgtcgtggcgaggcggcattgcagcgggtgcttcgcaagcttgggcccgtctcgctgtgtgcgctgctgctcacactggtcctgctgttcggcttccagggccagcagatcgtgaagcaaccgctggtgatcgcactgattgcggtgccgatcctgatccaggtctatttcacttccggcctggcctacctgctcaatcgtcgcctgggcgtggcgcattgcgtggccggcccttcggcgttgattggtgccagcaatttcttcgaactggcggtagccaccgcggtgggactgttcggcgtgcattcgggggctgcgctggcgacggtggttggtgtactgatcgaggtgccggtcatgttgtctgtggtgcggatcgtgaaccgtactcaagcctggtacgagagacgcgaagagcactgacacaccggagtgcgtcgaagtctatttacgtccttcgccccgcactgtcgtcatcggcctggtggggtacccgtacgccacgtcatcaacttcgacccatgtcgcatattccccatgccgctacggacgttgcggcgcctgcgtctgcgacggcttaa

SEQ ID NO: 73272 - DNA, 311 bp, Glycine max
  Peptide Sequence Number=SeqID_190050
atggccgggcttcgaaaacccgtgcgcttgtttgacaacgcttgcccgccggcgtcacccctcgtggcgccggcgggcaatccgtctgccggtcatggcgggcggagcgtggaggccttgtgcctgccggtttcaacaagcgcccggttttcgaaccacgtctccgcccgccacctttgcgtggcggctgccgtctgtcctgcacggagcccttgccatgagcacacccgaatcctcccgcctgcgcgcgcagtacgtgcccgccaacgcggacgcgctctcggaaacaccgcacccgcacgatccgcacg

SEQ ID NO: 73273 - DNA, 1235 bp, Glycine max
  Peptide Sequence Number=SeqID_190051
tggttgtggctgaggatcaccgccgccgcgttgtgcagcagggcgcgccgcaccacttcgcgggggtagaccggtgcggcgttgatggtgccgtggaacagttcctcgcaggcgatcaggcggtggcgattgtccaggaacagggccatgaagatctcccgtgcctgcccccgcaggcggtgctgcagatagcgtccgaccgcggccgggttgttgccgaccgcttcgccgtgttccagctcggcggccagctgcgcgccggacccagaccgggcaggcgcgccagctcccgcgcggggcgatcgagcagcacccgtaacgggccatgcgcctgcagcaggtcgcgcgcggtctgcacggcatcgcggccaccgaacccggagccgagaaacagggccagcagttcggcgtcggaaagtgacgtgggcccgcgcgcgatcagcttctcgcgggggcgttcctgttcgggccagtcgtggatgggcatgcctgcatcatcgccagcttcggcggcatctcccatcggggcttgccgcgggtccgggtcggtcgatgcctcagtcgcgccgggtctgcaggtagtcgaacagttcctggttgttctgcaggcccagcttgcgcttggcttcggccttctgccggctgatggtcttcgggctgcgcccacagcgctcggcgacctggttcacattgagaccggccgccagcagctccagcacttcctgctcgcgtgccgacagcggcgccggctcgcgcggaaacagcaggtcgcgtgcctgcaggtggtggcgcagctgctgggagacgaatacctgccccgccatcgcggcgttcagcgcctggggcagttcggcgaaatcggcgcacttgtcgaccaggccactgatgccctcccgcagcagtccgtccagcaggccgggatgacgggcgccggtcagcaccaccaccggcaggccagggcggcgcatgcgcagcgcgtcgatcagctccggaccgtccgggccggcacccggcatcgagaggtcggtcagcaccgcatcgcagtcgtgctggtccaccagctccagcagctgggcgccgtcacgcgcactgccgacgatgtccatcaggtgggtctgcagcacgacacggatgccatgcaggaccacgggatggtcgtcggcgatgatgatgcgtggatgcacgaggctcctcaaaggtcgaacaggccacggcgggcggcagccaatgcctga

SEQ ID NO: 73274 - DNA, 1542 bp, Glycine max
  Peptide Sequence Number=SeqID_190052
gcgccgcgccgccgagccgatcagttcgtccacgccgatccagtcgcggttgatcttcaatccttcgtggccgaggcgggtcatgtccagcaggttctggatgtagcggtccagccgttcgccctcgaccaggatggtgtccagcagggcacggcgatcggctgtatccatcgccgtaccgtagctggccaggctgtcggccgaaccgatcatcgccgccagcggcgagcgcagatcgtgcgataccgaagagagcagggccgagcgcaatcgctcggtctcgttgctgacgtgggcctgttccagttcggccaccagccgcgtgcgcagcgcggcctgcgcgatgtcatccaccatcgcttcggccagctgccgctgctcgggcagcaggcgcgcctgcgcgccgggcaggtacaggccggccacgccgatcgcgcggtcttcgccatccagcagcggcaggaaccaccattgcgcgccggccagagtgtcggtgaagcggccgctgggctggccgtggcgcagcgcccagtcggcggcggccagatcggtatcgccaggctggctgcggccaccggttgcggtatcggcgccgatccgcagccacgccggcacgtccatggcctgttccagtgcatgccgacccgcctgcgccacctctccgttgccggcggcactggccagctggcggcccaactgctggcgcgcacgcgcatggcggttggcggcacgcagcgcgatcacctgcatgcgcaggcgcgaggccaggcgtccggccaccagcgcggcggccaggaacaggaacacggtgatcacgccctggcgcgcgccgatggcgaaggtgaagcgtggcgcgatgaacaggaagttgtaggccaggaagcacaggatcgccgccatcaccgccacgctggcgcgggtgcgcgccgccaccagcaccaccgcgacgatgaacaccatcgacaggtcggccatgcccacccaacgttcggccagccaggccaccgcacaggccagtgcagtggcgatcagtgcctgtgccggctcgtagctgatgccacgcatcggcggcagcaggccctcgcggcgcgagcgcgcccgcgcctgcggggtgctgatgatggtgatctcgtagtgcgcgccgcgctggatcagctgctgggtcagggtgcggttgaacatccgcgccagcggccgttcgcgggtccggcccagcaccagggtcgacacgccattgtgcgcggcgtggtcgagcagggcatcggcgatgctcgatccgtgcagcagttcggcgtcgccgcccaggcgccgtgccagcgcgaaggctgcatcgatctcacgccgggtcgcctcgtcctggcgtcgcccctgcacggtcaccaccgtccacggtgcgtcgcggcgctcggcgatgcgcctcgccacgcgcaccaggtattcactctgaccgccgccatcaatggccaccagcacgccgcgacgcagcggcaggttgctctcgccgcgtgcggcgcgtgcttcgcgcaggctgctgtcgacgcg

SEQ ID NO: 73275 - DNA, 315 bp, Glycine max
  Peptide Sequence Number=SeqID_190053
atggaagagttggtcttcctacttttgtttgttgaccacaaagtggtacctggagatatgtcgtgggggtcaggagaccttggggacgtcaggtggggtgttattgcccaaaaccaagcttggctaatcccgactcaatccgggcgagctcctggcagtcaaccaataaaagaacaaagtccacgaagcaaggaggcttgtgtggcggctggccagctatgtatcttgggtggtatctggaaattagcctctggtaatcgattaccattcgtgggtaatcgattacaggggttaaaaatggagacaggatgttaa

SEQ ID NO: 73276 - DNA, 1002 bp, Glycine max
  Peptide Sequence Number=SeqID_190054
atgcgcgccggccggggtcacccagatcaccttgccggccaccggcaggcgctcgctggaattgggcagggtcagcagcaggaacaccttgttgcccaggaagtagcgtatgggcgtgggcaagaagaagccgccattcttcacaaacggcatcaggtcgcgggtgcggttggccgcatcgaaccaggctgcaagcttgtgcaatcgctccggcgtggtcaaggcatcggtgctggcctgggccagcgccaggtcggcagcgaagcgcaggcgcagcgccgcgttttcatcgccgcaccacttctgcgccagttccaccgcaccggtcttgccggcagccagctgttccagctcacggcctacttctcggcgcaggctcaggccatcttcgcgcagccagttgtcggcctggccgggatggccgcgggcggcgtccagcgcttcgcgcgccaacgcctcgctatggccctgctgctgcagccaggccagtgcctcgtgctgcggcggcagcttgaactccaggcgctggcagcggctgcggatggtctgcggcaggcgtgccgggtcgctgctgatcagccacaggtagcggccgggctgcggctcttccagcgtcttcagcagcgcattggccgccgagcggttgatcgcatcggccgggtcgacgattaccacctgcgccacgccgtactgcggggtcagcgccagcttgtcggtgatctcgcgcacctgctcgatgacgatctcggtacgcagcttgtcgccgctcttgttcggaatgaagctgaccagctgcaggtccgggtgtgtgcccgctgcgatcagctggcgcgtgcgcgttgcgtgggctgcatcgccctgcgccagcacatggtcagccagcgccagcgcgacctcgtgcttgcccagcccggccgggccgcaaatcagcaggccatgaccgaggcgaccggcgtcgagcgcggcaaccgtctggtcgaacgcgcgctgctgccacggtga

SEQ ID NO: 73277 - DNA, 411 bp, Glycine max
  Peptide Sequence Number=SeqID_190055
atgtggattattagtgatgggaggaagatgaggttttggctagataaatggttgtcgccaggtgtggttctgtcctcggtgttggtggttccaatatcccaagtaaccattaatgtgaccgtgttggatttgtctgatgggatgggacgaagatatttgtgcaaaaatccatttaatccctatggcaagataaagtttttgggggtcgatagcggccatgaggtcacagagcttcttggagaggcggagggcacatatggagtgctagaagagctcagtgagttagggggttttggcggtgacggagtggtgagggttgaagagcggaggtggtggacagaggactggagcaaggatagcgtgaatctgaggatggattacactttaactttattgtttttaataaaatag

SEQ ID NO: 73278 - DNA, 387 bp, Glycine max
  Peptide Sequence Number=SeqID_190056
atggatatcatcttaacaaaagtattaagtgaagacaacataagaagctttgaggctatctatggaccattaacttctaataatattgcagattcccaagagggtctggaacggaggaatttgatacaagccaatgcaaaaacgattagactatcaactatctttgcaactcttgatagacgtctgataggggagaatgaacaacaagctattaagtggctacttccttcaagatcattgccttcctttattccttttcaaaatgaaggattccaagagattgatcctttctcttatccaacctgggacactttacctgaagaggaacaacatgctcttaatgtctatggtgctgatggaccagccattcatacacttcctccttga

SEQ ID NO: 73279 - DNA, 390 bp, Glycine max
  Peptide Sequence Number=SeqID_190057
atgttgactccaccttacctagttgttgaaaaagatgatggaactcacaaactaagtgtcgcaacctacccttcggcgggagggcgacgcgtgactcgcgggatgcgtgttccacgaaaggaatacgcgcggagtcgccaccaatgtttatttgaggaaaatgtcggaaaaaccggaaaagacgcgatctacgaacttttaagtgaaaggctcgggagttgtatttacgcacggggaagggtgtttccctttgctcctacgtattcctcaattgtgatgaggaaatcagacctacgtagttctttcttatgcttgaatcaagtgattctttttactttgaaaggtgatcattttaaggcgttggaccttaaaaatgatccattttacttg

SEQ ID NO: 73280 - DNA, 333 bp, Glycine max
  Peptide Sequence Number=SeqID_190058
atgattacagcttctatctatagggcacctttcctctcgagctggtttactaccttagtttttcttctagaatatgctagagataatctagttgccttggcaagagtaatgaccttcttcttgcttgtaatgggagaggtgcataatcgtgaaggtggtttcgatggtgagataggcaaagggttggaaggtttaggttcagaaggtggttttttcttggatcgcttggataggtcagagggttttgggtcaaatgatagagatgatgcccaaactctggatctacaaattgtggttgaacttgctccaactgctgctcccccgcagactgtg

SEQ ID NO: 73281 - DNA, 222 bp, Glycine max
  Peptide Sequence Number=SeqID_190059
atggctcagagattcaacattcaatttcgagcgtctcgatatattacgggactcaatcagacatccggagcttcaacattcattttcgagcgtctcgatatattacgggactcaatcagacatccgagtaaaaagttattgtcgtttgaatttgctcagagattcaacattcaatttcgagcgtctcgatatatgacgggactcaatcagagatccgagtaa

SEQ ID NO: 73282 - DNA, 153 bp, Glycine max
  Peptide Sequence Number=SeqID_190060
atggggcactgtgcccctgaatgcgcaactcatgcttttacgaaaaaggttcatcaagtcaagttgaagtatggaagtaaccaccatgcaaaaattagggcaaaagatggatcgagttacatcgctgcttcgtctactgccaaacacatttag

SEQ ID NO: 73283 - DNA, 207 bp, Glycine max
  Peptide Sequence Number=SeqID_190061
atggagcgttatctacagcacttggttcgccagcaagcggccaaccactgcggacagtttgcggctgaggtcgcatggccgggagactggcccgatgcccaggcaggggaggagcctacaggatcccccggtaggatggacgagccccgcatggacgaggatatgactgacctattcaatttcttgggaggaagcggagccacatga

SEQ ID NO: 73284 - DNA, 553 bp, Glycine max
  Peptide Sequence Number=SeqID_190062
gctgccgtcccttgggacgggcgtgtggggtgctaataccttccccgtgcgtaaatacaactcccgaacctttcaccaaaaagttcgtagatcgcgtcttttccggtttttccgacgttttcctcaaataaacgttggtggcgactccgcgcgtattcctttcgtggaacacgcatcccgcgagtctcgcgtcgccctcccgccgaagggtaggttgcgacaaggcccaaatgttaaaaccaacccgctagctagtcatggaggtgctagcgtgaacgccgtcgtagaggacgggccatcacggacaaagaggttgggagacgtggctacttctagatgcttcatctatcaatcactgcaagcggcgtgcatggtctcccgagatggagatgaaagggatgaatgtttgtttcacctcggggagtcgcatgacatggaaacctgtcccgtggtggaagaattgcttcagcggctcatggattgcgggcagcttgaagtgttcataggagggaaggaagaaccacaaatttgcatgcagtcggaagagaagaag

SEQ ID NO: 73285 - DNA, 617 bp, Glycine max
  Peptide Sequence Number=SeqID_190063
atgggggagacacatgaagtacctcgagaccatactctagctgactctgagccttgccttggatatgctattgaggggcaagcatttggtggcgtacccctgccaaacactttggggggccctcagtatcgcccacaatcacaacccttgaattttgcggtgggaagagtccctcttgctatggtggaaaaggagaaattggatgatatagaggaaaggctaagggtcattgtaggaggcggaaattatgcctttgctgacatggcagagttgtgcctagtgcccgatgtggtaattcctccgaagttcaaggtgtcggacttcaataagtacaagggaactacttgccccaagaatcacttaaagatgtactgcaagaaaattggggaatacgcaaaagatgaaaattttttgatgcatttcttccaggaaagtcttatttgggcagccatcacctggtacaccaatctggagtcttctcgggtccgttcctggaaagacctaatggttgccttcattgggcagtatcagtacaattctgatatggttccagataaaatgcaactacagaacatgtttaagagggagcatgaatctttcaaagaatacgcccaaag

SEQ ID NO: 73286 - DNA, 315 bp, Glycine max
  Peptide Sequence Number=SeqID_190064
atgatgaaagagggtgctactgtgaccctgcgcaatgccaaaattgacatgttcaaaggatcaatgaggcttgctgcggacaagtggggccgtgtggaagtcacagaacctgctagtttcactgtgaaggaagataataacttgtctctcattgagtatgaactgagatttgagaagccagtagtaccaacagttgcttcttactgttgcaacagactctgtggatcttgtagcttatccactgaacagatggtggatttaagtgcaaatgggaattggcttccagatcatgcgttttgttatgctatctattga

SEQ ID NO: 73287 - DNA, 318 bp, Glycine max
  Peptide Sequence Number=SeqID_190065
atggcagattccaaaccaggattgaggaagccagtgttcaccaaggtcgatcagcttcgtccagggaccagcgggcacactttaactgtgaaggtggtcgatgctaagatggtgatgcagaaaggtcgttctgatggtcctcaatcccgccaaatgcgaattgctgaatgtttggttggtgatgagactggaatgatcatattcactgccagaaatgatcaaggatccaattgcaaggtatgggacttgagtcccacattggaagtatgggattccaatatgggatttataaggccttgggctctccaactacaatag

SEQ ID NO: 73288 - DNA, 708 bp, Glycine max
  Peptide Sequence Number=SeqID_190066
atggatgactggaacattccagaaatccctcaggatcaactacacgttcctgaaacaataaaagacaaacacaactttgattacataatcaaaacagtagaaaacaatattcctctaggacaagatataggggaagaatttcatttactttcaaaaaattcaatttatgaacatagccgtaagtataaatatctacacatcggttgtgtacaagtagccatcaagcccttaattgatatgggcatagatgcagcagttttaatgtgtctaagagacattaggcataatcaatttgaagactccctaattggaacagtcgaaaccagcctaggacaaggtccaatatattttaactgttatccaaacaaaacagtgagtctgatggacagaaacattcttgactctctgttcttaaacatccattttcatggccttgacatgaatgaaggatcaatcccagtagccttaatctataggatccagtacaaggtcatgaacacttgtgcatctagagtcctgttaaaacctcaaaaaggagaaacaaccttgtttatcactgatatgacaaaggctaacgtttctctcccgagaaaaataaaatgcgatgaggtaactcttcccgaaagatgggttatggataaggcaacaccgtctattccccgacccgctccaaccatagaacatatcaagcaagataactccggaaag

SEQ ID NO: 73289 - DNA, 630 bp, Glycine max
  Peptide Sequence Number=SeqID_190067
atggcatcgcacgacgaaggaagagacaaaatggcttatcttcatctagaagaaatacaagaaaattggcacattgagccagatgttgaagaaggggcacaaaatctcaaagaccctcaccatggcccaattgtttgggtggagttggaagacgccatgttcaagtgctcaagcatagcacgttggaatgtagtcatgggaagaacgagacccaagacctcaaacagacacttatacataaaaaaggtgggcgtattgcctaacgccgcccttagaaacgaaaagtcatcactcctgcaagcctcgacgattattttgcacgagtccttagggtttgccaactttagctggcgttgcagagcaaaaatactcattgtagaggggaaaaatcccaataactgggacagggtccccgaccggggaaaccacagaaagttgcacccttcagtaaaagctagaggtgcctctcttaatatgacgcgataccctcaatctctgaggaagaggattcattgtcaaaggcaccatgacgagtgtcctctgaggaggaaccgccaatggatatcacctttcagtccatcaggggttgctaaatcaaacccccataattgttgtcacccatgccaatag

SEQ ID NO: 73290 - DNA, 604 bp, Glycine max
  Peptide Sequence Number=SeqID_190068
atgtcttcatttttgtttgactccactattggcatgggtgacaacaattatggggaggacactcgtcatggtgcctttgacaatgaatcctcttcctcagagattgaggcaaggcgaagtggaagagacgtaagggtgtccccccgtgtgcatcgcaaccatagtgtttggtcgttgttgcctctacctgtcattgttgactttgagtgggtgatggacaatgttatcaagtataagtcctccttcacctctacaatgagtatttttgctctgcaacgccagctaaagttggcaaaccctaaggactcgtgcaaaataatcgtcgaggcttgcaggagtgatgacttttcgtttctaagggcggcgttaggcaatacgcccaccttttttatgtataagtgtctgtttgaggtcttgggtctcgttcttcccatgactacattccaacgtgctatgcttgagcacttgaacatggcgtcttccaactccacccaaacaattgggccatgtgtgtccaagaagttttttgagttcgactcaaacgtctttcatcgcttcaaagactatttcttcaaggttctgtctactgatgtcgtggctgatg

SEQ ID NO: 73291 - DNA, 852 bp, Glycine max
  Peptide Sequence Number=SeqID_190069
atgggacactttatgagattatcaatgttcagcaacttcaactcattgaagttgctttttgttgcttcgacaagattttcttcaaccatagtaatgcttaagaggtttagaagtttgaaaaaaggactccaagagatggttattagtgacaaatggtcttcttacaaggaggatgatgttgataaggcaaaatttgtgaaagaaactttgttgaaagatatttggtgggacaaggttgattacatacttactttcactgctcctatctatgatgttattagaaaaacaaatacgaatttggcttctcttcacatgagtagcacacctcttcattgtctagttcattctttaaacccaagatattatagtcttgaatggctaagtgaagattcatatagacttcccccacatcaagatgtagaacttactcttgaaagaaataaatgctttaaaaggtttgcaaatttttcttatggaagaaaaggctttgatgatgttgactgtctaagggataaaggtatactggatgcaaaatcttggtggctagttcatggtgttcatgcaccaactcttcaaaagatttcccttaagctacttggacaaccatactcatactcttgttgtgaaagaaattggagcacatactctttcatatattctttgaaaagaaataagatgacacctcaaaagtttcttgcttctgaagatggacaaacttcaaacataggaagccttcaagataaaatacttagtgaactagtacatcaagaaggcaacatgcttggcaagattgagaggtatgaggccaagtttggacaatcgatggaaatcttgctaattgatagtctttga

SEQ ID NO: 73292 - DNA, 462 bp, Glycine max
  Peptide Sequence Number=SeqID_190070
atgggctttgcacaaggtggcatcctaggaggcggaggttgccaaatggagggctattgctcgcactgtgttggcagtgcattggccaagttgttgtgccccaggttggatggtgataaactatttgaaggttgcaaagtctttcaggaagagaaaaaggacttggctggcctggtggagggcattacgatggagaaggatgagcttttccaggcggttgctgacttaaaggcccaactaaaagagttagagtccagacttgaggagtctaagctttgggtagctaaggagagggaggccagcaatgagctggaagatgagctgataatgtataagaagaggttatggagcagcatgagacggacttcaataaagccatcaagtaggccagataccacgattgaagggaagaccgacgaggagcagggtgctgaggagcatggcagtgatgccactgtttaa

SEQ ID NO: 73293 - DNA, 177 bp, Glycine max
  Peptide Sequence Number=SeqID_190071
acgaagtattcaggagctggggctgccattgaatatgcagtattgcatttaaaggtggagaatattgtagttattggacacagttgctgtggaggtataaaggggctcatgtctatcccagatgacgggaccactgcaaggcaagtcttatacgttgctattgcttgtgtctcttaa

SEQ ID NO: 73294 - DNA, 558 bp, Glycine max
  Peptide Sequence Number=SeqID_190072
atgagtgctcccgagatgtcgcctcttccttctttagttcctcgggttctaccctctggtgtgttggcggctatgtcaccttcctcgtcttctcgctcctatgtctctttggattatttgtacacctctgccgaagctgattcattgtgggggtgcaaattttccaaggtctttcttcagagaagtttgacaattatggagaagaatagacaagaacacatagaggctttgtacaaggtgagagtgtatcaccttaaggtagctagtgccattgttgccttcgctgaagctgtgaagttgaaccaccaactgtcttccaaggttggcaatgctttggccaagttgttgtgccctaggttggatggtggccaactatttgaacgatgcaaggtggttgctgacttagaggcccaactaaaagagtcggagtccaaactagaggagttcgagctgcgggctgctagggagagggagggcggcaaggaacttgaagagaagctgataatgaacaataaggaggattgtagaagcaagcttcaggatgatgaatcaagttga

SEQ ID NO: 73295 - DNA, 450 bp, Glycine max
  Peptide Sequence Number=SeqID_190073
atgtctttacaagttcagccacagacacagccacagccactgatgcagcagcaacagcaacctgtccaggtctatcctaccagtgtcacatatgagtcaccaccccaccattcaaatggctcttttgggtcagtttttgttgttttggctataattatagtcatttctgcagttgcttgctgccttggaaggctttgcaaccgtcgtggtggccacagccacaaccagaaacatgttaagccacaaaagaagcagcagcagcagcagaaccaccacaacttccgtccaaaagaagtggacatcgaattcgggtttgacaagagaatcgcagcttccaagcctaatggacatggagcaggcaggggaatcaagccacttcctcatcatggtgacgtgaaaactttcgaaatgaagcttggccaccaaggaaaaataagaccaggtccatga

SEQ ID NO: 73296 - DNA, 2061 bp, Glycine max
  Peptide Sequence Number=SeqID_190074
atggctaagaatacatcgtcaaatgagtcgtcttcattgaattccgacaaggacaaggcttccgctccgttgccgtcatcggatgactcagagtctccgaaaagcacaccaccaaagtctccgccaccatcgccgccgctgccaccatcaccgccgaaaaaatctgctcctccgccaacagaatctccgccggcgccggcgcattcttcaccgccaactccgtcacaatccccgccaccaactccgcctcattctccaccaccttccccttctccgccaactccaccgccggaaaaatcaccaccgtctccgtctaattctccgccgcctccatcaactcccccgccgtcaaaagattcagctcctccaccctctccgtcagaaccaccaccttcgccaccaccgtcgcctccaccgccacccccacaaaattctcctccgtcaccacaatctctcacccctcctccacattcactttcgcctccaactgcaatttcaaccccaccttcacctgcttcccatgttactccgccgccggcgccgttgggttcagggccaaaccacccttcaccaccgcgaccaccgccgtctacccaaccgaaaccaagaggtactcccccgaaaagcgatcctccgtcctcatcacctagctccggtaataatacaggagaaattgttggtcttgctctcgccggggttttcatcatcgcgtttcttgctctagttattttctttatgttcgggaggaagcaaaagcgtgcgagtgtctatgccatgccaccccctaggaaatctcatatgaaaggaggagacgtgcattactatgtagaggagcctggttttgggagtggtgcactaggtgccatgaatttaagaactccttcagaaacgactcagcacatgaacactggccagttagtttttacctacgaaaaggttgcagagatcacgaacgggtttgctagtgaaaacataataggggaggggggatttgggtatgtttacaaggcttccatgcctgatggcagagtgggagcactcaaattattgaaggctggaagtgggcaaggagaaagggagttcagggcggaggtggacatcatcagccgaatccatcatcgccatttggtgtcattaattggttattgcatatctgaacagcaaagagtgcttatctatgaattcgttcctaatgggaatctcagtcagcacttgcatggaagtaaatggccaattttggattggccaaagaggatgaagatagcaattggctctgcaaggggcctggcatatctccatgatggctgcaacccaaagattattcacagagatattaaatcagcaaacatacttttggataatgcttatgaggcacaggttgcagactttggacttgccaggctaaccgatgatgctaatacccacgtatcaactagggtgatggggacctttgggtacatggctccagaatatgcaacaagtggaaaattaacagatagatcagatgttttctcttttggagttgtcctccttgagcttataactggaaggaaacctgttgatccaatgcagcccataggagaggagagtttggttgagtgggctcgtccacttctccttcgtgcagttgagacaggtgactatggtaaactagtagaccccaggcttgagcggcaatatgtggacagtgaaatgttcagaatgattgagacagctgcagcatgtgttcgccattctgctccaaaacgacctcgtatggttcaggtggctagatccttagatagcggcaaccaactatatgatctatcaaatggggtgaaatatggccagagcactgtttatgattctggccagtataatgaagacattgagatattcaaaaggatggttaatggcagctttgatgattctgagtttgatatgaacagcatggaataccgttcaactgtttcaagagaaatgtctggatccagacattcaaggatgccatatagtgaaggtagtgattcagattttagagttttccacggccaacgaagcaatacgcagaacatgtcttga

SEQ ID NO: 73297 - DNA, 171 bp, Glycine max
  Peptide Sequence Number=SeqID_190075
atggcgtttgttgcttacaatgtctacaaaattcaaaagctagggacaatcattgattctgaaagtaaccgacacaattttttgaggtctcaaaaagatttatctataaagggttctgaccagcaaggatctggagtaaaatgctatcatctaaagtttcataagccataa

SEQ ID NO: 73298 - DNA, 1071 bp, Glycine max
  Peptide Sequence Number=SeqID_190076
atgtacaaaaggtctaatgaagaaaaggatgtaagtagtaagaaggttagaaattgtgatacagcagaaagcaatattcaaagcgcgattgtcgatggcgaggacacatctgagattccatcattcccattaggaaatttgagtactagttggtgctcactggtttgtaaaccggctgctattaagacagccaacagatacttcttgcttcaaaaagtaactcagtcctggccttcccctgccttgtgttttgtggagacagtgcctcaagatgcacaaagttctcatgttacagcttttaattcaggtgatggatcctcaaagtcggacaacgaacgggatgttcatatttcaatgcggttaatggaggactttcttgatcttgctaaagaaaatacagaaaaggatttggaaacttgtggtatacttggtgcctatcttgagaagggaaccctctatttgactaccctgatcataccaaagcaggaatcagcttccaattcttgtcaagctacaaatgaggaggaagtttttaaaattctaaatgaaagatccctttatcctgtgggatggatccatatcagggatgaaacccaacaattaacagcgtgttttgatcatatctatgtcacttcatattggtggtctaaaaccacaattcttataaggaagacaaatgttccgttacatacatgtgaggttgcagtaggaaacatcctaagcatatatcttagggttggatgggttaggcccaggggattagattcagggctgattggtgaagcttatccaaacaggccctcactgtgttgggaacatgtgttgggaacaggttgcgatattaaaaattcaaaactgaccattgaccttgttttggttgggttgtcattaaaccatgtttggactcacagtttggtgttattttatcaggtgatgattcctgaggcatttgccattgtcttggcaccaaatgatacctcaaggagacaggatttcacccacacaaagaaccagacaatggcagccccgtatatgagcactgctccaatgtgtacaaaaactccaatctaa

SEQ ID NO: 73299 - DNA, 225 bp, Glycine max
  Peptide Sequence Number=SeqID_190077
atggcagatattcagtcaaaacaagaagcatcgtcatcaacaacatttgtcagcaatagcatatttgtctgcaaaaggatttcatacttgcttgtctttgcgagtgcaagaagtcagaaatttcagtgtaacgtccgaatcgtatcagagatgccgattatcggagcagatttgcagactcgcggttattctcactcgttcttcatcttcgcatccttctcttaa

SEQ ID NO: 73300 - DNA, 720 bp, Glycine max
  Peptide Sequence Number=SeqID_190078
atggttgaggctgcacttaaaggtgtgtttgaaaatttgagttctctcattggaaaagagctgggactatttctgggttttgatcaagacttgaaaaaaaggcttgctagcttactcactgctatcttggctatgcatgaagatgccgaggagaaacaattctcagacatatctttaaaggattggctgctaaagctaagagatgcagctcatgagctggatgacatcatggacgagtatgcctatgaaaaactgcagttggaatatgaaggagtcaactcttgtctatcagaatttgtaaaaatctcttgcttatcctcttttcatcctatgcacgttttttcctattacaaaactgttaagaaaatgaaaagtataagtgagagattagaaaaaattgctcaagaaaggattaagtttcatttgactgttatggttcatgagagaagtcttggcagacttagaaaaacaacacttgtccaactaatcttcaatcatgagaaggtagtcaaccactctgagctaagaatatggatgttggaaatgctggtgcctggtggtgtgtggaatgaattatattggagatcattttttcaagatattgagactcacacgtttggcaaaattacacgtttcaaaatgcatgatcttattcatgatcttgcacaatttgttgtgaaggagagggttgttgttgcatttcgaatgacaatggtgtaa

SEQ ID NO: 73301 - DNA, 159 bp, Glycine max
  Peptide Sequence Number=SeqID_190079
atggagtgctttctctcaaaaccaccgtctttggacattgtaggcatcggcgataccgagatacataattttcagataaacctgaaaggaagtggttcctctagaataactcgactaactccaaacacaaaaaatggggcaaaattcaggcattggtag

SEQ ID NO: 73302 - DNA, 426 bp, Glycine max
  Peptide Sequence Number=SeqID_190080
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagtctggagaagcgtcctcagtggcggaccgggcccaagtcccctggaagggggcgccagagagggtgagagccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaagtaccgcgagggaaagatgaaaaggacttga

SEQ ID NO: 73303 - DNA, 390 bp, Glycine max
  Peptide Sequence Number=SeqID_190081
atgtctccacttgtcagaaaccttgttaagaaagcagttaaactttcactggatgacttgaaggcgaatcatccccaggcttttttaagttcacgtgccgtcgagattcgcagttatgcccctgatctcgcaaagacaattgctgggttgatcttgtcttccagtgacttggatttccagggagaatgtttttctcttcttggattacagtcccaagaagttggaactgaaattgtggaaaactgtattgaggaaaggattgtttcggttatagagatgaacgacaagaagtcctacaattctcaagaacccgcacctttccttttcgaagaagacccagttgaggaattagagtttcaagaaaacgattccagccccttggacttttaa

SEQ ID NO: 73304 - DNA, 3279 bp, Glycine max
  Peptide Sequence Number=SeqID_190082
atgaattcctcctccatttatattcttgtctttgtccagctttggttgttgagcttaccatgcagagagagtgtgtgcatcccaagtgagcgtgagacacttttgaagtttaagaataatctcatagatccttcaaataggctttggtcttggaatcagaataataccaactgttgccactggtatggagtcctctgccacagcgtcacttcccacgttcttcagcttcacctcaactcttcacattctcctttcaatgacgaccacgattgggaatcttatcggagatggagctttggtggagagataagtccttgtttggctgatttaaaacatttgaattacttggacttgagcggcaatatattttttggagctggtatgtcaattccttctttccttgggacaatgacttccttgactcacctcgacctctctcttactggattcatggggaagattcctcctcagatcgggaatctctctaagcttcgatatcttgacttgagcttcaatgatttacttggagaaggtatggcaatttcttctttcctttgtgcaatgagctccttgactcacctagacctctctgatactggaatccacgggaagattcctcctcagattgggaatctctcaaatttggtgtatcttgacctgagttctgttgttgccaacggaacagtaccctctcagatcgggaatctctctaagcttcgatatcttgacttgagcggcaatgaattccttggagaaggtatgtcaattccttctttcctttgtgcaatgacctccttgactcacctcgacctctctggtaatggattcatggggaagattccatctcagattgggaatctctccaatttggtctatcttggccttggaggtcattctgttgtcgaacctctgtttgctgaaaatgtagaatgggtatcaagtatgtggaagcttgaatatcttcatttgagtaatgcaaacctatccaaagcatttcattggctacacactctccaatctcttccttctttgacccgcctatatttgtcaaactgcacactccctcactataatgaaccatccttgctcaacttctcatctctgcaaactctccatctttccgttactagttattcccctgccatttcttttgtccccaagtggatattcaaattgaagaaacttgtttctcttcaattaccgggtaatgaaatccaaggtccgattcctggtggtattcgaaacctcacacttcttcaaaatcttgacttgtctgaaaattcattctcatcttctatacctgattgcttatacggtcttcatcgtctcaagtctttggacctaagttccagcaacttgcatgggactatttctgatgccctggaaaatttgacttctcttgttgaacttgatttgtcatataatcaacttgaaggaaccattccaacttctttgggaaatttgacttctcttgttgaacttgatttatcacataatcaacttgaaggaacaattccgacttttttgggtaatctccgcaacttaagggagataaatttaaaatatctctatctctcttttaataaattcagtggaaatccatttgaaagtcttggatcactctctaaattgtcatatctttatattgatggcaataattttcaaggagttgtcaaggaagatgatcttgcaaatcttacaagcttggagagattctttgcatcagagaacaatttaactttaaaagttggttccaattggcttcctagttttcagcttaccaatttggatgtgagatcatggcagttaggtcccagctttccatcgtggattcagtcacaaaacaaacttacatatttagacatgtctaacacagggattattgattctattccaacacagatgtgggaagcactttctcaggttttgcattttaacctctctcataatcatatccatggggagcttgtgactacattaaaaaatccaatatctaaccaaattgttgatctaagcacaaatcacttacgtggtaaattgccctatctttcaaatgctgtgtatgggttagacctttcaaccaattcattctctgaatccatgcaagattttttatgtaacaatcaggacaagccaatgcaattacaatttctcaatcttgcatcaaataatctgtcaggagaaatacctgattgttggattaattggccatttctagtggaagtgaatttacaaagcaaccattttgttgggaacttccccccatccatgggttccttggcagacctgcagtctttacaaattcgtaacaacacactctcaggaatatttcctaccagtttgaagaagactggccaattgatatccttggatcttggagaaaataatctttcaggaagtattccaccatgggttggagaaaaactctcaaatatgaaaatcctccgccttatatcaaacagtttttccggtcacattccaaatgaaatatgtcagatgagtcttcttcaggttttagaccttgcaaaaaacaatttgtctggcaatataccgagctgtttcagtaacttgagtgccatgacactagtgaatcgaagtacatatccccgtatctattctcaaccaccgaattatacagaatacatttcgggattaggtatggttagtgtgctactatggctgaaaggaagaggagatgagtaccgaaacattctgggtttggtaacaagcattgatctgtcaagtaacaaattattaggacaaatacctagagaaatcacagatctaaatggattgcactttttgaacttgtcccacaaccaattgattggtcctattccagaaggtattggtaatatgggatcgttacagtccattgatttttcgaggaatcaactttctggtgaaatccctccaaccatttcaaatttgagctttctaagcatgctggacttgtcttataatcatttgaaaggaaaaattccaacaggaactcaattgcaaacctttgaagcctccaactttattggcaacaatctatgtggtccaccactgcccataaattgcagctccaatgggaaaactcatagttatgaaggaagtgatgagcatgaagtgaattggttttatgtcagtgcatcaattggatttgttgtgggattcttgatagtgattgctcctttgctgatttgtagatcatggcggtatgcctattttcatttccttgatcatgtgtggttcaaacttcaatcttttcgctcaggtattatcactgtttag

SEQ ID NO: 73305 - DNA, 912 bp, Glycine max
  Peptide Sequence Number=SeqID_190083
atgcgaactcactttctcaacaacgactacttcgctctccctccacctcaaaccttccccttcctccacttcccaatccctcgcctccctccgcctcctccctccgccgtccaccacctcctccgcttcgatcctccgatccacctccccctccacctcgaccccttcccggtccacgccacgctctccaccttcctccccgccatcctccctcaccgaatccgcatcaactctcacgatctcgccactccgtcaaatcccgcaatagaggcggaggttatcttcgaagatcgtgtatccgaagctgatatcaaattttcgaatgagagtaaaattattgctttcaatgataagaacgatgatgtttatgagacaattcagttcgaaataccagagcttggcacgttcttggaaaacgtatgtgtcactgagacggagaggatgcaaatgctgtctctaactccagaagttgaaaatactctggaaatgctcaagcctgaaccatcaaggcaatatccttatgaggctctggaatcagtattgttggttgaagatgtaatttcagagtacttgatgggggaaaatgcatattctctagaaggtcatatttctgttcagcaccagccacactctgataaaaacaaatttcttattttggaagtggatgaggaaagtttgggaactcccacgtgcttgtctttggtagacattgttgactcatattttgaaaatatcagatctcaaaattttgatgaacaatatcaatctgttatagagggcaaggaacttttgggttctatgaagcataacatgatggagtttttctcagatgagtgtgtatcaaagaagagcctggagttatcagatctgtttcctgaaagggattttatgaatatgctggaaactgaacat

SEQ ID NO: 73306 - DNA, 2547 bp, Glycine max
  Peptide Sequence Number=SeqID_190084
atgttcaagtcacggagcaagaagaacaagattaaagctgtattcaaactgcaatttcaggcaactcaggtgccaaatatgaaaaagtcagtactgatggtagctttggtgccggataatgttgggaagccgacggtgaaattagagaaagttgctgtccaggatggaacctgtttatgggagaatccaatctttgaatcagttaaactcgttaaggacacaaaatctggaaaacttcaggagaaaatctaccattttgttgtctcaactgtaagcagtagatttaattgcatactatcttttacctgtctaggatatgttgctggaaagtctaatctctataggttcttgcagggatcttcaaaatctggctttcttggagaatcctcgattgactttgcggattttgctgcagaaactgagccactgactgtttccctacctctgaagtttgcaaattcaggcgcaatcctacatgtgacaattcagaatgtggaaggggtacatagagatcaaagcagtttcagaaatggggaagataattggaatggaagctcaagacacctactgagcatttgcagtacagatgaaggttctcataatgctgataaagattttccccagctattaccacccttgagacaaaattcaatgccatcaagaggaactattgaaaccattgcaacaagagctcaaatgcctcatatggggccaatgggttcagcatcagataggagtttaggtgactactggagaaaaagcctggaagatactcttcctcgagaaagattacaagagccttcagataatgtcactgagaacctcaaaagtgaagttgcttctcttaagaggaaagtggaagaatcagaacatgagttacaatcgcttcagaagctgatggagaaggaatgcagtcgaggacaaagtatgtcaagacagataatcagcctcagagatgagagaaatatgatcaaaactaaatatgagcaactcctgtcccagcaaaatgagaccaaatcttcaaaagccttacagactgagattgcagatgctagacagcagttagaagcaacaaaagaagagtttctttatgaaaaagagtttagttctaatcttcaattgcaactccagaagacacaaaactcaaactctgaactgcttttggcagtgagagaacttgaagcaatgctggaacaaaagaataaggaattgttggaaaataataaagagaatgaggatgccacagaattagatcacttgaagcagaaaattgcagaccagaatggtgaaatagacaattattacaagcaatgtgaagagctaaatgggcacataaaagagctcaattttgaatgtgaggttctgaagaaagaaaacctgaatatctctttgagattaaaacacggagaagaacaacaagttgtgttgcaaaataaacattcagcttctttggcaactatagaacaacttgaatcacaagtacagagattagaagagaagataaagaatcaggcagatgatttttcagagactttgatttacatcaatgaacttgaaaatcaagtcagtgatttggagagagaactgaaaacgcaagcagaaaaatttgaaaaagatttccatgctatgaaatgtgcaaaacttgagcaggaagaacgggccacccaagcagaggagacattgataaagacaagacacaacaatgatctcagatgtcagcgtttgcaggatgaatatagaagtctttctgttgaaatggcattgaaagtagaagaaaatgaaaagaagaccatggaagcttatgcagaagctgatgaatttcggaagcagaacaaacttatggaaaaaatgctccagaaatgcaatcaagagctcaggcttattacaaatcagaatgaatcaaaactgcaacagctcttgaaccaaatagattcaaaacaaaaggcaatagaaatgatgtcacaagaactagagattaagtccaaacaacttgaagatctacaaaggcacagggatgaacaggatgaggcattatcgaagcaaattcaattgctcagaattgaaattagaaagctgatggcagaggagcatgcattgtctaaaactgagtcaaaagagaacatgacaacgatgttaatgctagagaacaatgatgaggaggagataaggcttggcaccctaatgtcagaagtagaaatccttaagacccagcacaatgaattgaaacataacttgcacacggaacaagcagagaaagaaaatatgaagaaaaaaatatctcaattagaaggagagctgaagaagaaggaagaagaactaagtgctgtagaaaagaggctcaagaatagcaaaggacaagcaacagccacaaatatgaatttggcttcatggcactacgagagtgctgcatcttcttcttccactaaggatcgcaatagtatgtcaaaatcagaaatgcacaagatgaatcatcattttcagggaatgtcaaaaattttaatacctactgtaaagcgaacatttgacatgaacacaacaaatacttaa

SEQ ID NO: 73307 - DNA, 3444 bp, Glycine max
  Peptide Sequence Number=SeqID_190085
aacatattggccaagatagatctgaacaaccaagattttggaggaacatcttttgatgatggaaaattggcatttgatctagttttctgtgatgacaccatagatgaatgtgacattaaacaaaatgaagagttcaagaagttgctttctgatggcatgcctctagttgacaatcatccagtagaagttgcttcaggcaaagttatagaacatgtatcttctaaacaaggaagtcaagaacaattacctgaacaaaaggctgagagggcttcattgttatttaaatctctgtcagaaatcagcaatcttgattatttcttaaaccctaaagaagcgactggtaaggggaattgtaattatgcagtagagtccactaatgctaatgtttgcattccaaaagtttcatccaatgaattgaaggttggtgcacagtcacaagtgttccatactgttctgcatagagttagattgtccgataatattgtggcccttgctggatattttgaaaaaagctatctagccattctgcacagtgatacagagatgacaaaaatgcataactcggatgcagattatttaaaattgttgggtcttcaaaagcacaagctgattaaataccatgtaaatggaaacaatatggcttttgctgtgttatgtgctattaaacaggctgcttggtacttgtgtttctatggtctccatccagcattcttgtatttagacaaattatgtcaaaacttggagtatttgaaatcaaagttaggcttcctccaatctttgatcaaagatgaaaaggggaaggtggacagcaatgttactatggcacacccatcattaacaattgtcaagaagattttacagtcatacaccaaacagaatagttcaaaaactttaattgtggctgaagaagtattctggtattcattgaaaaatatcctcctttccctagggttatcattcattgaactaaatgattcttatagaaatcagccatatgccaatactgtgcctaaggacacagatactaaaacgaaagaacttctgatttcagactgcttgttggtttcacacaagcatgtttttcccttgtttcctttgaacaaatttgacattatcttggaatatggaggcccatatgactcatctaggatatctgagctttcacaaaacttggttgaattgcctcatcttcactttttgagggttgaattggatggtcatgctgctctcgaagcactctgcgaaggtgttgaaatgcccccaaacattgaaatgttaatggaaagtgagactcgtctcattttcaatcataaggaaagtatgaaccagaacttggagagactactgaacttttgtcctgtggagcaaagctatgataaaaaatcttcaaaggttgcacctgaagcagataatcatgcgccactaattcctgctgtgaaaactgagcatgatcataaaagcatggaggtttttcctggaacagttatgatcgtaaatactcaaaatgtagataaggaaatgataatgtctagaagaagctcttaccaattaattcttgcaatggagaaagaaggaattcaagttgttgaacgtgatttagatttgcctgtggatattatattaagttctgctatttgcttggcacagtatgatagtagaaaccttgggaagaaagcaactcctgcgactgaagcatcctcaagcttgcctttatgtattgagaatattgccacagatgttctgacattgcttagtttttacttccgtggttgctttctggtgtttgaaggagagcttaactttctttcaactgtaatggaatcctcagataggctctatgctgcagcaacaagcctgggaattgatttgcagatattcttctcttactcacctgagttgacaaatgaagttattgtaagctgcattaagagtgctaccaatatgacaaggggtctgtatcctaaaatgcctgactcagtaacttttgccgagtcatttcttacagaatttcctggaataaatcctttaactgcacactatatactatcttcaggggtcatgcttaatgagtttcttgcatggtcacatgagcaaaggatgcatgttttagaaaagtatcatgttccagaagaaagtatttctctattcagtgttttctgcagatatggggaaccggaggattcaaaatccataatgacagattgctcctcttcagtatcttctggtctggactcagatagatgttgtttatatgaagttgaaaatgaaagaaaaagaaaaaatcctataagtagtgatcagatagatgaaccatctttggatgaattgttgcaatttgagacattaaatcaagtagttgaggctgtcccggattcctctaccttgccaaaaccttttgattttggtatgtcaaaaaatgcagggagatctagtgacttcgcaaacgcaagtttttccatgagtgagtttttcagtcaaaagcaaagcaccggtgcagttacaatgagaaacctttctggagtctcttattcaccagggaactgcaaagctccccacaaatcagagaaactgaaacaacccagtttatccttgaaaaataaagagttggctcaaaatgaaatactgggcactgctttgatgggcaaaggtgtgaattggcataactttagtaattctgagaagctgcatggagacattagaggtgaggtggtggacttgacagataaccccttatttgataaaagctttgccactcctgattccatgtacttcacaagtttgatggcagagacagatcagatgagaaagaataaaattgcaaggaaattgtcatttgataatagtagtcacccagcatccagctcatcgaaaatatggagatcctttaaagatacacgaggacaagttgacaactaccctgaaccagattttcgagaagatgtttttcctcctgatttcaagccccgcaaaaacattgttgtaactcaggcatcgatgagaaacttagaatcaccattcaaggaggaaatctcacatttgggcataactccattctcatttgcccgccagtcagctattatattaaagaattcaccttggacaactgagtttattaataaagtaaaagaaaagagcggattgcgtcaaaaatcattatcaagtgagaactctggcccttattttgggtacccagggagcatgtccaagacttctaagagaataaatccttccgtaattgatttgtttaagtaccaacctaatagagcatctagaaatgttccggaacagaaaagacagaagcaatcagagggtaattctcagactggtgatgaaaatggagttcgagatcagaacaggaagttagatagcgtactggataatctatctttgaagccaatggggatttcacatgatgattcatttaagatctacgatcctgcttag

SEQ ID NO: 73308 - DNA, 578 bp, Glycine max
  Peptide Sequence Number=SeqID_190086
agttggagaggcgtaaccttcacaaacgcctcggcaaccttcaggagggaagcatagatgtggcggtggttaaggaattttatgccaatttatatagcccagaagaccaagctcccaagtatgccagagtaagacgtcgtatgatcaagatagatgcagacagcctgaacgaattgcttcaaaccccagtgttaatagaggagggggaaccgttacccacctactctagattttgcagattaaggtataatcccaaagagatggaggctagcctgtgcattcccggcaagggctttgttctgaaagctgagggccaaccatggaagctcctcagaaaggatcttactaccttggcccagacatggagtatcttctctttcaccaacctagctcctacctcccacacctcagtcacagggacggacatgaacattggcggcttgatctttggacagataaccattatggctcagtgcaactcttctcgcctaggcttcccagctttaatcacagccttgtgcaggtcgagggtgatgcaatcctaccccgcaagggcattggatagagaagactcctag

SEQ ID NO: 73309 - DNA, 648 bp, Glycine max
  Peptide Sequence Number=SeqID_190087
atgacagaagaacaaaccaaaacggctgagtcagaatcagtgacaccaccacctgctgctgctccttcacaggctcctccagctgctgaggctgaacatgttcctgaggctccaaaggatgtggctgaggagaaatctgtaattccagtgccttcttctgatgacaaacctgatgagtccaaggctcttgtcttagttgagaagactcaagaagttgccgaagtgaaaccaactgagggctctgtcaaccgagattatgtcattaagcctcatttgtcttcagatgcagtgcttgcaagagttgcaactgagaagagattgtcactaatcaaagcatgggaagaaagtgaaaaatcaaaagctgaaaacaaggctcacaaaaagctttcatccgtttctgcatgggaaaacagcaagaaagctgctgtggaggctgacctgaaaaagattgaagaagaactggagaagaaaaaggcagaagctgcagaaaagataaaaaacaaaattgctgcaatccacaaggaagctgaagaaagaagagcaataattgaggcaaagaaaggggaagatcttcttaaggcagaggaacaagctgcaaagtatagagcaactggaacagctccaaagaaactccttggttgtttctaa

SEQ ID NO: 73310 - DNA, 573 bp, Glycine max
  Peptide Sequence Number=SeqID_190088
atggcacaagttataagcaagccaaggtatgccgaagcttctggtcaggtcataaacagagccaaattccctttttattctggctcaatatctcagcaccgattcccctgttccaagggaagccaaggaacgaaaattcatcttcaacctattgtgaacatcatcaagaacaagctcttagcctggaaagggaaattgctttctttcatgggaagaattttgctcgacaaatcggttatccacaacatgctcacatacatcttccatgtttatctttggcctaagtatctcttgaaagatagtggccaatggatgaagaactttatttggagtggagatgtcaaacttagaaagacaaccactgtggcttggaaagctccaccatctccttggataaaaatcaatacatatgaggcagccaaggggaatcctgggagagcatgttgtgacggtttatttatgagcccaatatgcaattcttgggagcttttgttgcaaatattggcattaattgtgctttcatggctgagattatggcagccattattgctgtggaaaagaccatctctgtaa

SEQ ID NO: 73311 - DNA, 372 bp, Glycine max
  Peptide Sequence Number=SeqID_190089
gctttactaataagttatgagaaagtaaagaacataaacaataacttagacataagtaaaggagaaataaaaagtgcactgcggaaaagtaaagagcgtagggaagaagaaagcaaacacaagttttatactggttcggcaacgacccgtgcctacatccagtccttaagcaacctcttgagatttcctttccttgtaaaaatcctttacaagcaaagagccacaaaggatgtaccctcccctgttctctttgaacaaccaagtagatgtaccctctacttgaagcgaaccacaaaggatgtaccctcccttgtgttcactattacaaccaagaagttacccgcttcttacacaaaattctcaaacggttag

SEQ ID NO: 73312 - DNA, 321 bp, Glycine max
  Peptide Sequence Number=SeqID_190090
atgattcatttggttgatgccgaatggggacgtcggttcaccttagcaacaacgctggtagcggcaattgcaaccgcattggcttcaattatcttcttcacgctcatcatggcctccatcattgtggccatttgctctttcatggcctccatgtcgacctccatctactcttgtacctcctccgctttaccatttactctagctctagcacagattttcaacatggtccatgacatctccgtcaaggtgaaactggaagtaacagggacatcgacagccctaaatgtgtttggcagtagacgaaggagcgatgtaacatga

SEQ ID NO: 73313 - DNA, 1128 bp, Glycine max
  Peptide Sequence Number=SeqID_190091
atgttgggaggcaacaatggaaatcgcttgcttcctgttttcttggacgaaactcaatttcggcatcaaactaatgtgtcaaatcagttgcagttgtttggaaattatttgtactcaattgctactttcctccatgctgtactttcaacaattttattctctagctcctgctgctataggcatgattatggcatctcctttccttttttgaatagggatgtacaagctggatgtagtgttgacccagttaattactttggaaatgagcatatcagctccatgattcagcctaataaacaaagcaaggaaatggaagatatatcgaaacaaaggcttcagatttccttaaactacaatgttcatcaagatgatgctgatcaattagcaagtattccaaatcctaaccctgtgtcaacaggattgaggctttcatatgatgatgatgagcgtaactcatctgttacttctgcaagtggcagcatgtctgccacaccgtctatcatattgtcttttggtgacaatatcagaactgagcttgataggcagcaagaagagttggaccagtatgttaaacttcagaaggaacaactgtcaaagggagtgagagacatgaagcaaaagcacgtggcagctctccttacctccattgagaaaggtattaacacaaagcttaaggaaaaagacgtggagatagaaaacatgaaccgaaaaaacagggagctggcagaaagaattaagcaggtggctgttgaagcacaaagctggcattacagagcaaagtataatgagtcagttgtcaatactttaaggaacaaccttcagcaggcaatctcacaaggagctgaacaagggaaggaagggtttggagagagtgaggttgatgatgatgcctcatatatagatcctaataacttcctgaacattccggccgcacctataaactctactcacaagagctaccaagatatggagaatctgacctgcagagcatgcaagacaaagactgtttccatgttgttgatgccttgtaggcacctgtgcttgtgtaaggattgtgagggatttatcaatgtttgccctgtatgccaattgataaaaactgctagtgttgaggtatatctgtcttaa

SEQ ID NO: 73314 - DNA, 135 bp, Glycine max
  Peptide Sequence Number=SeqID_190092
atggagcacaaggtggatttcaaggataacaggtcagtagacccagagagatacacttttagcctaacaggaaggaagcctattagtttggaagacaaaaggatgcttggtgaagggtataatccattgctgtaa

SEQ ID NO: 73315 - DNA, 996 bp, Glycine max
  Peptide Sequence Number=SeqID_190093
atgaggccgattctgatgaaaggccacgagaggccactgacgttcctcaagaccacaaccccaccgtctggttcgccgacaacggcgaacgcctcggcacctaccgcggccacaacggcgccgtttggtgctgcgacgtctcaagcaagctcttcatcactgttttcaattcatctttttaataatattgatactgatagagattcgggtcggctcataacgggaagtgcggatcagaccgccaagctatggaacgtgcagaccggtcagcagttgttcaccttcaatttcgattccccggcgaggtccgtggatttcgcggtcggcgataagcttgccgttataaccactgatccctttatggaattgccctctgcaatccatgtcaaacgcattgctaacgatcctgctgaacagactggggaatctgtgcttctcattaagggtcctcagggaagaataaatagggctatttggggacctctcaacagaaccattattagtgccggtgaagatgctgttattcgtatttgggattctgagacgggaaaactgcttaaagagtcagacaaggaatctggccataaaaagaccgtgacatcacttgctaagtctgcggatggttcgcatttccttactggctcccttgacaagtctgctaggctttgggatactagaacattgactcttatcaagacatatgtcacagaacggccggtcaatgcagttgcaatgtcacctctacttgatcatgtggtacttggaggtggtcaggatgcatcagctgttactactactgatcatcgtgctggcaaatttgaagccaaattctatgacaagattcttcaagaagaaattgggggtgtaaaagggcattttggaccaattaatgcattggcttttaaccctgatggaaaaagtttttcaagtggaggtgaagatggttatgtacggttgcaccactttgacccagattatttcaacatcaaaatatag

SEQ ID NO: 73316 - DNA, 585 bp, Glycine max
  Peptide Sequence Number=SeqID_190094
atggtgccattagaggcgtttgctgatggtgcccgcatcagagaagagggggctggtggtggtgtagggatatttgtgtccattcaagtctttgggggtgcaagaattgcacttagcctaaatggaattgagcttagcactggattacctgataatgcttttggtgaagatttgatctcacgttgggcacttagcacgattactcttgtgcttagcacagtaatctggaacataaagaagtcatttttaggaactacgattagcacagaagtagttgttgcacttagcacgtcacttatgagttccactgagaaaaccatcacaaccaccaacaataacaacaaaaacacaaacatatatggtttggtgggatttggtgcactggggatccggtttgctaaacgtgccaacgatcccgctagccaaaaaccgatgcagcatcctaagcatcaacgattggcacaaaacatcaacgatttcttctccccagaggttgtgattgagttgttcaaggtaatggctaaactgcgtattgtggcggcaaatcgaatactggtggacacttatttcgatgctcgatgttag

SEQ ID NO: 73317 - DNA, 885 bp, Glycine max
  Peptide Sequence Number=SeqID_190095
atgggttgttgtctgagtaaaaaagggtcagagccagaagaacacattggttacagacatgttgctggtgctggaggtgctggtgtgtacaacaatcacaagagccatgaaccctttgccacccaaaccaaaccccctcctcaccaaccttaccaattacctgagaaacatgctcctcctcaggcaccttggaggcctccaccaagcccaaaacatgtccacaaccatgacacaatcactgggaagccatttgaggatgttaagcagcactacacacttgggaaggaattggggagaggccaatttggggtgacttatctctgcactgagaattcaactggcctgcagtatgcctgcaagtccatttcaaggaggaagcttgtgagcagagctgacaaggaggacatgaagagggagattcaaatcatgcagcatttgagtggacagtccaacattgtggagttcaaaggcgcttttgaggataaacaatcagttcatgtggttatggagctgtgtgctggtggtgaactttttgacaggattattgccaagggccactacagtgaaagggctgctgcttcaatatgtagacagattgttaaggttgttaacacctgccattttatgggtgtcattcatagggatctcaagccagagaatttcttgctatctagtaaggatgacaagggacttctcaaggccacagattttggcttgtcagttttcattgaagaaggaaaggtgtatcgaaatatagttggcagtgcttactatgttgctccagaagttctacgtcgtagctatgggaaggaagcagatatatggagtgcaggagttatattgtatatcttacttagcggtgtaccaccattttgggcaggataa

SEQ ID NO: 73318 - DNA, 144 bp, Glycine max
  Peptide Sequence Number=SeqID_190096
atgaaatattaccgagtttttgcaaagaaaaatgaaaaggtcattggaaacaaatgggatacctatttggaccttctgcagtcagattacagtgaagggtcgtttttctctccagatatggggttgctgagacagaacagttga

SEQ ID NO: 73319 - DNA, 555 bp, Glycine max
  Peptide Sequence Number=SeqID_190097
atggagatggctagatgtatgatgcatgagaaaggacttccaaagaaattttgggttgaagctgttaatacagccgtatttctgttaaacaggcttcctgccatggaggcacaagggaaaactccttttgaatcatggtacggccataagccttttgttcaaaacttcacagtttttggtttatttgttttccttatgtgccaaagaaccaaaatcaacgcagatggttctattaataaacacaaggccagacttgcagagaagaggtatgctcaagaggagatatatgttgaacaacttgagggttttgcaattaaagggcaagaaaacaagattttggagaaatggctttctttctcaaaatggaagtcaaacataaaagaaacttttgtcagccaaaagaaatatgccaaagagagtttgaagaagttcctaatggaaaactataaagttggaggatcattggatgatacgaaaagttcttcagactattattttacatttggttttggagtgttttgttggacttcaaagaagcaggatattttggcatag

SEQ ID NO: 73320 - DNA, 543 bp, Glycine max
  Peptide Sequence Number=SeqID_190098
atggtggtgacagtaaaatgcggacactgcacaagcgtcctttctgttaacatgatgaaagcttcttttgtccctttccaccttttagcatctcttagccatcttgagccaaaagaaagtagttcagaacaagatgctaacaagactttgaagagacataatgcatccatgatgacctattctgattgtgaggaagaggatgccattccaatgagtaatgttgtcaataaacccccagagaagagacagagaacaccatcagcttataactgcttcatcaaagaagagattaaaaggctaaaggctgagaaccctgacatggcccacagggaagcttttagtacagcagcaaaaaactgggccaatttccccccaactcagtgcaaagaagatgaagagagctgtagcagccagacagatcaacatgtggatcttgactcccaagtggaccctaatgctgtggtcaatgaagaagaaggtcaaggtttacgtggaagaaaggtcccaaagaattccatattggaaaggacaccgtttgaatga

SEQ ID NO: 73321 - DNA, 642 bp, Glycine max
  Peptide Sequence Number=SeqID_190099
atggagttggaggctcattttaaggaagctgagaaagaagggaatcctgaggtcgagttgcgtagtcgtccacttgttgctggttacaagtgccctaagaaaaacctcaagtttcttattttggaagaggatgaatggattaataatgagggggagattacaagattggagggggagcttgagaatacatttgacaatatagagaaaaataggttgagtgtcaatggatggacttatcagtttgctcagctggtggatttactcaaccacaaataccacgactttatttctcaagaattagtgcagcaactgggtttgaaagtgactcctactcaaacctatggactgagattgagtgatggaaacaagaaaaatgctcaaggctgttgtgagcagatggaggttcagctgggacaaatgaccataacagagaaattatttctatttgatttaggtggtgtatatgtcatattagggatagcagggcttaaaaagttaggagatgtaaagcaaggacaattagtcaaaattcaagtgcaatatggaggttctattgatgtagctccatttggagcttgtaggccttggatcttcttcatcaatggagtcctttgcttcttgaagatcatggcagcggaatag

SEQ ID NO: 73322 - DNA, 552 bp, Glycine max
  Peptide Sequence Number=SeqID_190100
atgatccctatttggtcttccattatcaaaagcaagtatgggtgtggctttcttttgtctccatctgttaacatcaatgggtctggtagtaatttttggagggatcttttctctacaagggacttgttttgtaataacactatttgcatattgggagatggcacatttatcaagttttggcatgatctttgggtccaaaactatggctctttgatgagtaactccttgatggatattctagaggaaatgctggatgaacccgtggctgactatgttaatcatgagatagaaagaagcatggattgtgaagaggctcaattcactgcactagaatcttcggttgcagcattgaaaacaacaaccagggaattgaaggtgacgaccactaagtttcagaaattgtccaagaaacaaactgaggtgattgcgaaggtgtcgaaacagtgtgatgacattaaagatttgcgcaagatgatgaagatgctcatggaacagaaaggcatcatgtataatgacaccaagaatgcatctatggagcagaacaatgggtag

SEQ ID NO: 73323 - DNA, 474 bp, Glycine max
  Peptide Sequence Number=SeqID_190101
atgggcccgaaatctaccctaaggctcatgagaaccctagggtcttctcttgcatctctggcccaatctacttggagtcttctatcaaatgcccttgcgggtgcatcatgggaagatcatttgcaaaatttgagaactattttagcaaccctggttcaacatgagtttactgccaacctaaagaagtgcagttttggacagcaagagattgaatatctaggtcacattatttctgcaaagggagtggctatggatacaaggaaaattaaggtagaactccaatggtcgttacccaaatcagtcaagagtttgagaggatttttagggttggcagggagggaaagctcacaagccttctaccaattaaagcaagcgctaactacagctctggtgctggcaatgctacacttttctcaacctttagccattaagtgtgatgcttccggcaaggggataagagttgttttatcttag

SEQ ID NO: 73324 - DNA, 702 bp, Glycine max
  Peptide Sequence Number=SeqID_190102
atgcctacaagattaaatcctaagctatcaactagatactatggcccttatcgggtagttaaaaaggttggagcagtgtgggagaacagcagattgaggcagaattgccaaaggaactacaagctgaataacaagggatacaaccgaaacaagttttgggaacaagaatgtttggtccagcaggaacaaaaattccacaagcaagaggaatcatctactgtacctaagcagctgctacggtacaataggaagaataagagagaacctgagaagtgtcacggagttgtaagggaagacagtgctcttccttgtgtaaagagtgaaagaactagcaataatagcgaatcatttatctctgcatgtactatcatgtgtgggttcttgtatgcttctattctacctctagttgcagttcaatacaacatcaattctttcataaccaattgtcgcaacctacccttttgcgggtgtcgcaacatgcccttttgcgggcgagcgaaggcgaggctcacgggtgcgctttccaaaggaggaaagatgcgcggagtcgccaccaacgaaggtattagcacctcttacgtcgacaaaagcggggctcttgctcctacgtaccctccatcgaagaggaaaccagacctacgtagttctttcttaagggtgaatcacacgatttctttttacttgaaaggtgatcatttaaag

SEQ ID NO: 73325 - DNA, 468 bp, Glycine max
  Peptide Sequence Number=SeqID_190103
atgggacagaaggtagtcaagaggaagatcaaggacaaaggagatggaacgtcttcaccaattgtggacttgtcaggcatggaagctacaatcagggaagaaattgttgccaccaaaaagttagcaaagaaaaaagagatgaagaacgtaacactattgtacgaaatactaatgaaggacacatctaccatgtctaaagaacaatacaaaaaacacaaaatcactttcgttataaaagcggtaattacaaaactagttgttttcaatgtagttgttgtgatattagccatcataaagctccattcattggcaaaatggatagaaactcttacttcaatagactttggagataaaaatattgatggaacacttgaagacaatgataaagaagaaatcatgagagaggcagtttcgacgaaggtttcaaatgaagaagcagtggttccttcgaattgtagatgctcttaa

SEQ ID NO: 73326 - DNA, 369 bp, Glycine max
  Peptide Sequence Number=SeqID_190104
atggcaccagatactactgccttaagttattggttgaattggaggttcttcctctgtgcactatttattttattaactatgggcctagcgtcatttttgatatggaagtatgaagaattcaataaatcaaggaatgagagaagagaaaggcagcgagaaacggctggatcgctttatgagtatgaagcatggaatacatgtcttaaaggaattcatcctgcttggctgcttgcttacaggataatttcttttcttgtgcttttttctttgctgactgccaatgtggttgctgatggaggtggcatattttatttctacactcaatccattgttagggttgttgaagaacattttctttgtagtttgtag

SEQ ID NO: 73327 - DNA, 618 bp, Glycine max
  Peptide Sequence Number=SeqID_190105
cttagggatggctctactcatcagggtactgttacatcaatggagcctaatgaaggcacttttattcttcacaacgagaaaacaaggaagggcaagataaaacctgttcatgttgttgatgttcctgggcattctcggcttcgacccaaactggatgagtacttgcctcaagcagctgggatagtttttgtggtagatgctttggactttttaccaaactgccgtgctgcttcagagtacctttatgatctattgactaaaggaagtgttgtgaggaagaagattccagtgcttattctctgcaacaaaacagacaaagtcactgctcatactaaagagtttatccgaaaacagatggagaaggaaatagacaaattacgggcatcaaggagtgcaatatcagcagctgacattgcaaatgagttcaccctgggggtacccggtgagccatttttttttacccagtgctctaacaaagtgacaactgcagatgcttctggtttaactggggaaatatctcagctggaagagtttatcagagaacataactgtctggataagaagaggcaaaaaagagaaaaaggtgttttggggtggggcttggggtgttcggagtag

SEQ ID NO: 73328 - DNA, 276 bp, Glycine max
  Peptide Sequence Number=SeqID_190106
atgggtctctctggagcttgtatcaccacatatggagcatttcacgcaatcttggtgcactgctttgtcaatattaacaagggttgtgatcaagtcttctgtatagaccctctttttgttcggagacagagagtcatagcttgtagagtaatgtatgcaaacagagtctgtgaccctgggttagttgtttgtcgtcaatgtcccaaacgggctttggtagttcaagtccatggtcgttacaacactgtgaaatcatgttttggagcaagtaattag

SEQ ID NO: 73329 - DNA, 370 bp, Glycine max
  Peptide Sequence Number=SeqID_190107
atggcttcatcaaagtttccagccatcataatagcaatgttggagtctgcatgcgacaagctgaatctcgagcttgacggcatcgacgaagcacttgacctggtcaatgaggggatgggcattgtggcggacgtagtggtggaggccactgcggactgcaacgcaggcgagcttctcggtgctaatgttggcggcacggagggcggagaactggccgggatcgagatcagggtaagcgagaaacaagtggttgtgcatccactcatgatggcgagactcaaaactcgtgcacttcgtactcatccttgcacgccgcggagagttgcgagtgacaacgagagtgagatccaggagtggaagcaccatgaga

SEQ ID NO: 73330 - DNA, 267 bp, Glycine max
  Peptide Sequence Number=SeqID_190108
atgaagcccttttttggtgcaattgttatgccagaattgctgaagcaccaggatagtgatatcaagcttatagttgcagcatgtctctatgagataactcaaatcactgcacctgaagctccttacaatgatgattttctaaaggacatttttcagttgattgtgggcacttttagtggtctgagtaatacaagtggttcatcctttgaccagagagttgctatactggaaagagttatattgaatgaagttatattgtttacttga

SEQ ID NO: 73331 - DNA, 957 bp, Glycine max
  Peptide Sequence Number=SeqID_190109
atgaatcaagctatgttgatgaaggttagctggaatatgtgtacgagacccaacaatttatgggtcagaatgatgccttcaaagtataaatgtgaggatgacgtactccctgttattgaccagcatagacaagggacaaatttatggcaagggattgtaaagaattgggaacattttaagccaaacttaatttggaggattggcaatggtaggcaagttcggtttcgggaagattattgggtcccagggagctcagcacaccatgattatgtggagtgggataaggttgttgatggcaagttctcaacgctttttaaaggagtgtggcattgggatgggcctgatctcataaagttccatctctggaagatctgtcaagaaattctccctacaaatgcattgagagtgcatcagcatatggcaatggatgataagtgtcccgtgtgtaatcttcacccagaatcactacatcatgctcttagggactgcaagtggatgtgggtaactgggttgctacaaacctggttaaaactcagtctgcataatataatgtggaacactgtttttggtgttattttggaccgcttatggtggaggcgcaatgaatgggtatttcgcaataaattgagggacactaatgcagtggtcatgaatgttaagagctttctttgtgactggaataacaacaagaagctccagcaaaaccttactccagattatatcaatgtcagtattgaggaagcagagcggtggaaaagacctttggagggatttgcaaaagttaactgtgatggagcacttcatcatatagctgctatagcttcgtgtggtgcagtgcttcataatgacgatggtgttttcatgcaagcgtactcgaggagactaggacattgctcaatcttagaagttgaactttgggcgatttttcatggtctaaatatggtggggaactattag

SEQ ID NO: 73332 - DNA, 582 bp, Glycine max
  Peptide Sequence Number=SeqID_190110
atgtccttgcctccagagggctacacgtcctcgcctccagagggttgtacgtcctcgccttcagaaggcttcacatcctcgactttagagggcttcacatcctcgcctttagagtgttgtacgtcctcaactttagagggctgcatgtcctcgccttcagagggctgcacgtcctcgccttcagagggctgcatgtcctcgcctttagagggctgcacgtccttgccttcaaagggctgcacatcctcgcctttagagggctctaggtcctcgccttctgagggctacacatcgtcgctttcagagggctccacacccgcgccttccgagaactcaagggatcgtgcccacaagacacctagtggacccgaagaagtccaacagggtcctaagttctacaaagtgcccgtcgcccccagcaaggtcatcatgcctcctattaacagggctttcatcgaaaagtattgcacccccaagcaggcgcaggcgaggcaccgaagcagcctggggatggccagcaatggacaacagacgcatcgccaccatctccagagtccacctcagctcatctacaatggctaa

SEQ ID NO: 73333 - DNA, 552 bp, Glycine max
  Peptide Sequence Number=SeqID_190111
atggctccaaagaaactctccacgaagaggtctagaagggacgccacaggagaaggatccagtgctgccttagagtttgatagtcaccatttccggagtgccaagcaccagcagcgcttcgacgccaacaggggatggtcattccacagggagaggcgtgtccagctcagggaagatgagtacacggacttccaggaggagatagctcgcaggaattggacatctctactgactcccatgaccaagttcgaccctaagatagtcctcgagttctatgctaatgtctggcccacagaggagggagttcgggacatgcgctcatgggtgaggggtcattggattcccttcgatccagatgccctcagccagttcctgggcgacccgctgattttggaggaaggccagcagtgtgagttcagccagaggaggagccaggcagacggttacgatgaggaaggattttgcccggaccactgtagggaggcgagtgcggatcatgcgcaccagcatgactaccttgacccagatatgtgtagatgcaattggctttga

SEQ ID NO: 73334 - DNA, 280 bp, Glycine max
  Peptide Sequence Number=SeqID_190112
atgcacactcgcaaagcacttggctacctactctatatacccatgtacatgggggatgggggcaatgtgatgtgcccaaccatttcaaaacccacattaggcttgaggccatctcacaaaaccctcctgtcgcaacgtgcccttcgcgggcgagcgagggcgaggctcacgggtgcactttccaaaggaggaaagatgtgcggagtcgccaccaacgtcgacaaaagcggggcttttgctcctacgtaccctcctttggagaggaaatcagacctacgta

SEQ ID NO: 73335 - DNA, 129 bp, Glycine max
  Peptide Sequence Number=SeqID_190113
atggagatgaggatgtgtgctaccatttttatcttgcgaggtaaatcagctgaaaagcaacccaagcgctctgatatgaaccctcatagcacaaaggctgacttaggatcgtctaggattaaaccttga

SEQ ID NO: 73336 - DNA, 231 bp, Glycine max
  Peptide Sequence Number=SeqID_190114
atggctgaagaaatctttggccctgtacttccaattatcaccgtggagaagattgaagagagtgttgagttcataagctcaaggcctaaagctttagctatttatgccttcacgaaaaaccagactctgcagagaagattggtatctgaaacatcatccggaagtcttgtattcaacgatgcaattctacaatatataagtggaggaggagatataaggtgtgttagatga

SEQ ID NO: 73337 - DNA, 636 bp, Glycine max
  Peptide Sequence Number=SeqID_190115
atgggttatcattactggaaaacccgcatgcaaatcttcatagaggctatagatttaaacatctgggaagccattgaaatcggtccttacatccctacaatggtagtaggaaatgcaactatagaaaaacctagggaacaatgggatgaagaggaaagaagaaagaaaaataaaggaattgcacttaaagcctcatcttctattcaagaagaaagtgacaaagaggacttgaatgaaataaaagaagatgatggtttcaatttctttgtaaacagattcaataagtttctaaggaacaaaggaaatcaaagaagaataaacttcaattcaaagaaaagaggagaagattcatcttctgttccaaagtgctatgaatgtaatcaacctgaacatctgagagttaattgccctagtttcaagaaaagaatggaaaaaactgacaggaaaaccttcaaagataagaaagcaaagaaagcttacatcacttgggaagataacgatatggattcattcaaagaatcagaaaatgaagtcgtgaatctaagtctcatgaccaaaaactataaaagcgaagaagagaacttcaagatgcattcaatgacttacataaagaatcaatcaaacttgccaaactag

SEQ ID NO: 73338 - DNA, 777 bp, Glycine max
  Peptide Sequence Number=SeqID_190116
atggaaattctaccaacgtttgggcataaccatggcttcgtacaacaacaaatccatatgttttccatatgttcacctcttgaacttgaagctttaaaggtgggaactctcattaatcatgaacaaggttgttggagactagatatcattgaccaaattctcaacgaggatgataagcaagttgttatatcccacgccctattccaagtttttgaatataatgagtacaagcttgtttggcatctgacaagctctggtgagtacacgatcaagttagcttaccatcacctattggagaagatgattcaaaaccaaggcttaaggattagtggaaattggatgcacatttggaaacttcaaatcccacctaaagtcaagtataaacttcaaaaccaagctcttgtgcctactcaagctcgtttccaaacaaaagttcatcctcaacaatctatctcacgtgcacttcagtttttacacaagtggaagcatgctcgaaaatctcagttacattctactccacacacaccccaacatgctcccaacatgaagaaaccgcaaattggattttggaaatgtaatgttgacgctgcaatcttcacctcaagcaacaaatttggtgttgccctatgcttgagtgatcaccatggtcaattcatccaagcaaaatgcatatgtactgatggcacactagaaccgaaagaggtagaggcttggggccttcttcatgcactatccaagacagggaaattgagaaaggagaatattatcatagcttga

SEQ ID NO: 73339 - DNA, 2961 bp, Glycine max
  Peptide Sequence Number=SeqID_190117
atggagaatgattgtataaaggacatggacattgaggtcgttccttcaatgtggcctgaagatattggaatggaggttgggaagcaatttaacatagaaaagcctggaagggaccaagacatgttagaggaggttacaatcatagaggagccaactatagttgatttcaagcgcctcatggagcttacaaattttacagaaaagggctcttctcagttggcctacctaatgaaacaatgggagtacaaacaggccaatgttgtgcgtctcctcagggaagaacttgacaatctaagcaagcaaaggcaggatgttgagctcaggaagttggagatattggaagagcatcgattcgaggaagaacgacatggggcagataaacgtccagtttctatattggatgatgtttatgatggtatatggcaagacataccttgcaggagaagtgatgttgtggttgaaaacaagaggagtgagattgatgctgagtatgacactgtcatgtgctggaaacagcgagcgttgcattcagagaagcagctggaggcaagtatccaaagagaacagatactcgaagaaaagttgcaagaaagaatagcaaacattgaaaggcagtcctcacctgtggaagaactctcccagatactgaagagggcagataatttcttgcattttatactccaaaatgcacctattgttattggccatcaggacaaagaattgcgctattgctttatctataatcattttccaagtttacaagaggaggacatcatcggaaaaaccgatgttgaaatattcacgggagctggtgttaaggaagctcaagagtttaagagagaggttttggaaaaaggattacctgcaaaaagggaaatcacttttgagacagaactatttgggtcaaagacatttttgatatatgtagaacctgtgtttagcaaagcaggggagacaataggaataaattacatgggaatggatataacagatcaggtgagaaaaagagaaaggatggcaaagattcgggaagagattgctgttcagaaagccaaggaaacagaactgaataaaaccattcacattacagaggaaactatgcgagcaaaacaaatgctggcaacaatgtctcatgagataagatctccattgtctggggttgttagcatggctgaaattctttctaacacgaaactcgattgggagcaaagacaactcctggatgtcatgctatcttctggagatttggttcttcaacttataaatgacatactcgatctttccaaggttgagtcaggagtgatgaaattggaagctacaaagttcaggccaagagaggtagtcaggcatgtactccagatcgctgcggcctcattgcaaaaaatactaaccttagaaggacatgtagcagatgatgtgcctattgaggtcattggtgatgttttaagaatgcggcaaattctcacaaatttaattagcaatgccatcaagttcacccatgaaggcaaagttggaataaatctttatgttgtgtcagagcctacttttgcaaaagcagaatgcatccaaaagatgacttcaagccattcaactatttcagtgaatggtgtaaaggaagagaaatatctctcaaaacctcaaagtgacagtgatagaaatcttcttgatggttgtcaaaaacatgatgaccatcccagccaaaaccatgcattccatgaagaatgtagatctcctgtcaaaagtgaatgctcaatgaatggagacactgaggagcaacctaattcagctgaaacaacagtgtggatacgttgtgatgtatatgacacaggcataggaataccagaagatgctataccaaccttgtttaaaaggtacatgcaagtcagtgcagaccacactcgaaagtatggtggtacagggctaggactagcaatatgcaaacaactggttgagttgatggggggtcaactaacagtttctagcaaagaacactatggttctactttcactttcatacttccatacaaggtttcaatcgcttgtgatcattctgatgatctggatgagctctctgacgtggagaataatgatgctgcatctgatgatacaatagagagtttcttccaattccaaccacgcactttgggctctcttttctcatctaatggatctagcaggacacataagttattaacacacaaaattggctacaccagctcacataagcttggtggattttctgagagtttgtattcattcccctccaatgatatcatgtcaaaagggacatgttcagctgatgatgcatcttctgtggttgaggttccagagatgtctgaatcggctagttcatctggtcacagccaaaaaactaagtcaaatggagaaatgtctgaagcaaagtcaaatgaactacaacaaacaacatgtcagggtcatgggaagacaaacacaactttccaatgcgttacaaacagcagtgtatctgaagtaaccaaatccacaataatacctaagatccttcttgttgaagataacaagattaatgtcatggtgacacagtccatgatgaaacaattaggccatagcatagatgttgtgaacaatggagtggaagccgtacgtgcagttcagcgtcacacttatgacctgattctgatggatgtctgcatgccagttatgaatggtcttcaggcaacaaaactgattcggacttttgaggaaacaggcaattgggatgctgcaagaaatgctggaatcgagcaaagtgtacaagatccagattgtgaatgttctgtaccatctacaaagcggatccccattgttgcgatgacagcaaatgctttgtcagagagtgctgaagagtgttttgcaaatggtatggactcgtttgtgtcaaaacctgtggcattccaaaaactgaaagaatgtattgaacaataccttgtaaatttcagctag

SEQ ID NO: 73340 - DNA, 198 bp, Glycine max
  Peptide Sequence Number=SeqID_190118
atgttgtcatactactcttggcacatcgaaaacgtccttagagttgtcaagcattgcaaggagaaattttatgaggttcaaggttatctgcacatgtttttgtgccacgatgatctctacctcgcaggtcttgtagttgttgaagcagaggctgtagatgcgggttgtggaggaggagggagaagagggaaacactga

SEQ ID NO: 73341 - DNA, 1116 bp, Glycine max
  Peptide Sequence Number=SeqID_190119
atgtcatcgacagcagaagcacccatccatggggatatcttagaggccatattctcgcacgtgccactcatccaccttgtgccggcctctcacgtgtcaaattcctggaagcgtgcggtctcctcctccctcgctcacgtcagacccatcaagccatggctcatagtcctcacccagagcctccgccactcgcacgtgacaactctccacgcctacgacccccgctcgcacgtgtggctccaaataaaaaacaccgcacgttcccacgcttcccccgtgcgatcctcccactcgacgctgttctacgcgctcaccccatccgagttcagcttctccctcgacgcgctgcacctgaaatggcactacgcgccctccccgcgcgtgtggcgcaccaatcccgtggttgcgcgcgtgggatcgcgcgtggtggtggctggcggcgcgtgcgagttcgaggacgatccgctcgcggtggagatgtacgacgtaaatagccaagcctgggaggcgtgtccctccatgccggcgctgctgaaaagctcgacggcgtcctcgtggctgtcggtggcagtcgccggagaaatcatgcacgtgacggagaaacactccggagtgacctactcgttcgaaactatttcaaaaacgtggaaaggaccgtttagtttgaggcctcatgagagtgttttccactgtgtcaccggaaccctaggagagaggttgatggtggcggggctgatagggaaagttgggaacgtgaaaggcgtgaagctgtgggaggttcgggttcgggggggattaggttcggggatggaggaagtgggggagatgccgaaggagatggttcggaagctattcagtggttcggagttaggttcggtggaggtgacgtggattggggactttgtttacgtgaggaacacttccgaaccggaggagctggtgttgtgtgaagtattgaatcatttgaatggggttgggtgcgagtggcggagtgtacggaacgccgccgttagatgcggtgcgaggatggtgttttgcggcggtagtgtgtgcatggaggatctgcagagggcggtgatgtcggagaatccgacattttccatgaaacatgtgtga

SEQ ID NO: 73342 - DNA, 570 bp, Glycine max
  Peptide Sequence Number=SeqID_190120
atggtgtctaggttgctagttgggttgcttctgggagaacaaccttatccccaaggttgtaggagccccagagctcttcccaacgttcccacatggtgccctcaggtggatgcccaaaccattgaaccagtgccagcttggtcgggggagtggttgttttgtcccatttcctgtctagaatcatcatggttatcgcaagctacagggggtagagaatgtttcggccgtcggcatccccgagagagcattgaagttgatttgaggaagtggtgttgtgtcatcaacacaagctggtggcttcacatttgggtggtccaagttcgagggttcgtcgttgtcggtgatgagaagatggaggcgaggcttgcatttgtggcctacgatccacttctcgtcacattgggttgggtgaggtggaagcaactggtggagaagatgaagggtgaacaagggtgcgaaagtaacagcaatggtcctataatttgtcttcctgaagcatggcgagagccaccgcctgaggcaaagaaagaggttggaacatttgaacttcctagcgcagttccgggttga

SEQ ID NO: 73343 - DNA, 395 bp, Glycine max
  Peptide Sequence Number=SeqID_190121
atgttggaacaggcttgggcttacctggttgggcctggtttccattccaagttggattctgtgttctgggcgaaggctaagtcacgtggctctcttagaataaagtatgctattattaccgggccggtgagggaggttgaggttggaatagagccacacatagggcgaagaggtgtcagcgggaagagtgccacggtagtgtcaatcagcgggagaaatctctgcacagattctaacaaagttgatgggccattcaaagttgaagaagcagagactgtaaatgtgcctccactcccaacagaaaagttgcttgtgttgggagggaatgggtttgttggatcacacatttgtagagaagccttagaccgtgatttgtctgttgcgagtcttagcag

SEQ ID NO: 73344 - DNA, 330 bp, Glycine max
  Peptide Sequence Number=SeqID_190122
atgttctttcatcacgggcacttcgtggaattgcagggcgagaatgccaccacttcgggtcttcttccccaacaccagttctgccacctttgtcggaacaacgaggatgtttcgtacttccatattgctggatttcctgaagctcctcctgactcactacccattgactcacctgggagtgatagggaagcatacaacaacagaagacaaagagtagatggtgccattagcagaagtccaagcacaaatagatcaaacacaagcaaagggggtgcagggggtgcaaacaacaacaaacaagaggagaatggtgaggcctgcttaccttag

SEQ ID NO: 73345 - DNA, 363 bp, Glycine max
  Peptide Sequence Number=SeqID_190123
atgaggcgcaaagttttcggtgctaaattacctgataaggagttcaaacgaatttgggccaaatgggtcaagtccgggtcgggtgtggggtttgggtccagggttgggtcaattgggtctatattagggcaattgggatctttgtcttcagcaacaagaaggaaagctttagaggtgcagcaatgcccgctagggtatcgttcgtcacaagtgaaacacaacccacgctcccggtggaaaatgggttcctctaacgtcaagggtttcaccatgggtggtggagatggcggtggtgatggcaaaagaggcgaaagtgtcatgggacgagggggtggagggatgataggtgggggttccagatga

SEQ ID NO: 73346 - DNA, 786 bp, Glycine max
  Peptide Sequence Number=SeqID_190124
atggaatacttaagctctgattatatagagaagtcagaaaccattggtagttggcattttcaatcaatcacaactgaatttctcaattcactaaacacatctggtctgccaaatcatcgcatcaagctaaaaatcggtagtcctataatgttgctaagaaacttagaccaaacgcaaggactctgtaatggtactagattaatagttactagactagccaaacatgtcattgcagctgaaatcatttctggcaaaaatcttggtgataatgtttacattccgagaatgtcaatgtcaccttcacaatcatcatggcctttcaagcttttaagaagaaaatttccaatcaagctatcttatgcaatgacgattaacaagtctcagggccaatcactttctatggttggactttatttgccaaaaccagtctttagccatggacaattatacgttgcattatcaagggtcaattcaaggcaaggattaaaagttcttattcatgataaagaccaaaaaaatatgacttctactactaatgtagtcttcaaagaggttttcaaaaatcttacaagacatggtatcattaaaaaataccatatcataccccctctgcaatacattaaaaaccaaatcctaacaagcaattctagaagttggcccaatgctcataaccaggcccaagataaatctacacggttactgccctacaataccaacgaacttaagcttctatttcgaacaaaaactcttcatctacttcgcacctcttcaattcacaattattga

SEQ ID NO: 73347 - DNA, 237 bp, Glycine max
  Peptide Sequence Number=SeqID_190125
atgtcatcatgcgctcagcgtgtcattagctcattgagcgagaagattgtctcttctgcgcttagcgcaataatggcgctaagccaaatttcacttactcgtgctaagcgcaaagttggcgctaagggtgcctttgcaaaaaaaaatccctttttaagcctgaattgcagagaatggagggaggaggtactcccttgtaatggagggctagaatcctttgttgggaaattccgctga

SEQ ID NO: 73348 - DNA, 1563 bp, Glycine max
  Peptide Sequence Number=SeqID_190126
atggactcttctaagagacttacattttcggaaccctttatgtcacaggggagaaaggtgatttctgggttcagtttgggcgttggagtttctctccttttcctcactcttatcttgctcaacagcacttccctctccgttcccaaggttcaagtgtttctccaaggatccgattccaattccacttcttcgttctcgtggcgttttcccttcacaaccgctctttcttccaacggttccgtgagttctctgcatagggttgacgtgagggtgtcgtcaagtgagggttcggagaaaacccttttgggaaatctcactggggatcagaaaaacgcaagcttgtatgatgggcatgaggaagatgaacattgttgttctttgaagaatgttactttggcagggaaggaaaatgcgcacgtgggaaattcgtcatgcaatggtgatggtgtgggaaagtgtgaagatgggttgttgtttaaggaaagtaataatgatagtgttagtgttggtggtttgcttggggaatgtgacatctttgatgggaaatgggtgagggatgaattcaagccttactatccattggggtcttgtccaaatgttgatagggattttgattgccatcttaatggaaggcctgatagtgattatgtcaagtggaaatggcagccaaatgggtgtgacattccaagtttgaatgcaactgattttctggaaaagttgcgagggcagaagctggtttttgtgggggattcactgaacagaaacatgtgggagtccatggattataattgttcagtagattttgttagttcaccattcattgttcaagagtcaactttcaaaggcataaatgggtcctttgagacattaagattggatttgatggaccagacaagtaccacctatcatgatgctgatatcatagtcttcaatacaggccattggtggacccacgagaaaacatcgaggggagaagactattatcaagtaggcaaccatgtataccccagactcaaagttctggatgcatatacaagggcattgaccacttgggctagatgggttgacaaaaatattgatgccaaccgaactcaggttttcttcagaggatactcagtaacccatttcaggggtgggcaatggaattcaggcggaaagtgccacaaagaaactgagccaatatctaatggaaagcacttacgcaagtatccctcaaaaatgagggcttttgagcatgtggtcatcccaaagatgaaaaccccagtgatatatatgaacattagtaggcttacagattacagaaaagatgggcatccttctatatacagaatggagtacaagacagcagaagaacggaccgctgctgaacaacaccaagattgcagtcattggtgtttgcctggagtacctgatacttggaatgaattactgccattggaaaagctgagcaaaactccacacccgatttctgattctttatacatattcaacaaatgtatattcattgatttcccacatctagatgtccatctcaaagggtctcttgagtttagtttgtgctga

SEQ ID NO: 73349 - DNA, 174 bp, Glycine max
  Peptide Sequence Number=SeqID_190127
atgactgatgtagaaaccttggttctgctctttgaagaaagcaatgatgttgaatatgggaacttctacatcagtggtgacgtaggcactgatgtagtaagttgcgctttctacatcgttttccataaagcaacgatgttgaatatgggaacttctacatcagtggtgacgtag

SEQ ID NO: 73350 - DNA, 282 bp, Glycine max
  Peptide Sequence Number=SeqID_190128
atggtgcaaagaaaggataatgagcttaggggaagcagcaatgagatcgtcggtggctatcacaagtggctgaaggctcggatgcaagagttagattggctcccaaagctaaaggtttcaagtgaggaagaggctgaaacccctaaggagagtgaagaggcacaagcggtcaaggaaaggttcaagacaatggccatcaaggtccaaaaagaatgcaatgagttgagagacgtcaatgtggccacagccgaagcattggaacaggaaacaaagagggcctga

SEQ ID NO: 73351 - DNA, 285 bp, Glycine max
  Peptide Sequence Number=SeqID_190129
atggttattgataaattgccagattcacagaagcaggatgccaagaaaatcacttgtctgcggttgcaattatctttaacttgtatcacactgttgaaaaatactaaaaagaatgatctgatgtacgagtcgatttccgagcttcagaaaaagataaagaaaactaatatggatatttgtgctctcactatgctctatgacaggagaaaaggatacaagagcaaaataccacccttgcaaagaagcctcaggagctactcaggatggacgagaaagatcacctag

SEQ ID NO: 73352 - DNA, 584 bp, Glycine max
  Peptide Sequence Number=SeqID_190130
atggctacatgtcctcgccttcagaggactgcatgtccttgccttcagaggactgcatgtcctcgccttcaaaggactacatgtcctcgccttcagagggctgcacgccctcgccttcaaaggactacacgtcctcgccttcagagggttgggacagtagtttccccttatcagtcccttggtcacccccctgatctcggaggagggccaactatgcgagcacaaccagagggaggctatcgtgcagccactatgcatactggggcaagatttcacccatccgctgcaaggagacgagtgtggatcatgagcaccaacatgaccactcttacacagatatggatgatgttgctacttagaaacattctgcccagcgaccacaatgtcaatctccccttaccgaagtatcagttgggtcgcacccataagacacacagtggacccggaggagcccaacagggccctggggtttccaactctggttacgggcctctatcagtcctacagggtggtcgtccccccaagcaagggatcgcgcacgcaagacacctagtggacccggagaagtccaacagggtctcggg

SEQ ID NO: 73353 - DNA, 924 bp, Glycine max
  Peptide Sequence Number=SeqID_190131
atggagcgaggaattttttttaatgatcctcagactatctacccaaaactcattagaatgttctggagaaatgttgagtttgccaacaagaaaattattgttttcaaggttctgggaactgatgtgactttctcaagaaactcaattgctaaggaaatcgggtgccttattgaaggaaacacctaccaagatggatgggagaagaactatgattatgacatatcaagagtgcactacaaggagaatgttgagaaggcaggagaccagaagacaatcgtgtacaacttgatgtatgagagggccaagatgtgggccaacattcttagcaagagtgttctccacaacaagactaacctgaaagctacgaaggttgctctagaaaaaaccttgaaggaggctcctcatatggatctagatgccataaacaagataaagcaaaaaaggcttgccaaggagatcaccgatgaagatagaggtctcaacagcttttgcattgccaagaagatacaaaagatcatgactgagcaccacaaaaagaagaaaactagtaaacaatccgagaaggagggagaagaaaagttgattgcaagggagcaagggacaaacaagcatcatgtacagactaagaacaaggggctcgtaaagatagctcttcaaaagagaaaggctggagtccaagctgccctgccccaaagagagcctagaccgtccaaacagcttttgaagtctgagaatctgtacttccttctgccattcccagacgtattaagaccagggacacaaaattcaaccctaattttggtgagaaggaatggacaatctccttcactggaaacaaggagaacccaacctcatctttctcagatagtgagtctactaacaaaactcctatctttcctctcaggaagtgttcagatcccctaa

SEQ ID NO: 73354 - DNA, 222 bp, Glycine max
  Peptide Sequence Number=SeqID_190132
atgaagcttgagaccaaccttctcgagttcctagatttcaaagaagtgttcgatgtggatggatggctcattatctgtgtgtatggtggtaacctctacaattggaataatctcggcaggaaaggagttagaggtggccattgcagagagtttgagagtttaaaggtgatcgaggccgtacccgaatcaaataaacatgaaaatgcagtaactaggaagtga

SEQ ID NO: 73355 - DNA, 591 bp, Glycine max
  Peptide Sequence Number=SeqID_190133
atggatgaaatagagaaggtgcaagagcagatgaaggccgacacggaggccttgaaagagaaaatggccacaatggtcatgatgagcataaaggagatagtggaggttagtgcgacttaccaaacccgtgctagagctagagtaatgggtgaagtagagaaggtgcaagagcagatgaaggccgacatagaggccatgaaagagcaaatggccacaatgatggaggccataataagcatgaaaaagataagggaagtcgatacggttgtagttgccgctaccagcgctgttgctaaggtgaacccgatgcccccatctggcctcaaccaaatgaatcatccaaccttaaatatggtaggcaaagatttgggaagtacggacggccccatgatgtgcaaattcaaaacgagcacgccttcccatcatatggcttgcctcccaactatacaccacccaatgtggcatacactctcaatgaaaatctcaataactccactcagatactcattgagaaccaataacctcaatctgatcaggcacatatctctcaaaccatgggggagacacatgaaattccccaccacaatctag

SEQ ID NO: 73356 - DNA, 111 bp, Glycine max
  Peptide Sequence Number=SeqID_190134
atgggtccgttcgacacgtgtcactcttctattggttttctccaattgttccgacgtagcgcaggaccaccaaatcttacgttgtctgctgtgagagtgaaagatttttaa

SEQ ID NO: 73357 - DNA, 177 bp, Glycine max
  Peptide Sequence Number=SeqID_190135
atggatgaaattcattaccgacgaccgcttgaagatacagatgaatcgaaggatttgatcaagcaagtagcacctaaagggaatcctcctcatgggattcatgaatcccaacttgtaaggcgtttgttttatcgacaacctgctcatttggagtattctgacagttttaaaatttga

SEQ ID NO: 73358 - DNA, 741 bp, Glycine max
  Peptide Sequence Number=SeqID_190136
atgtaccctccacttgaactgatccacaagagatgtaccctctcttgttctcagtcaacaacccaagtagatgtaccctctacttgtaccacaaaggatgtaccctccaatgtcttaagacaaacatctcagacgctactgaagaagacttctgcgcgtcaaatatcaaaaaccgcttcacctgtggaacatttccggcaggcattgcaaaagggttgtgatgtatcaataaaggagctagacacccttttgtcacttcttgccgagaagaaaagaaaaatggaacaagaagaagctgagagaaatatgcaaatattgttagacttcttgcattgcttacgcaagcaaaaagttgatgagttgaaggaggtacaaactgatctccagtttataaaagaggacattaatgctgtggagaaacatagaatggatttgtatcgtgcacgggacaggtactctgtaaaattacggatgcttgacgactctggtggaagaaaatcatggcattcatcaatggacaagaacaacagtggccttatatctagtcctctaaatctacgaggagggttgtcatcagggagccatactaagaaaaatgatggaaagtcccaaattagctctcacgggcatggagttcagagaagggatgccatcactggatccgattcacaatatataaatcaatcgggtctttctctagttagaaagaagagggtgcatacacaggttttcttggtttaa

SEQ ID NO: 73359 - DNA, 533 bp, Glycine max
  Peptide Sequence Number=SeqID_190137
ggctacacaccctggccttcagagggctacacaccctcgcctttataggactacactctctcaccgtcaaagggcttcacgccatcgccttcagaggactacacgtccttgccgtcagaggactacacgtcctcgccttcagaggactacacgtccttgccttcagaggactgcacgccctcaccttcagaggactccacgtcctcgcctttagaggactacacgccctcgcctttagagagctacaagccctcgcctttagaggactacacgtcctcgcctttagaggactacaagtcctcgccttcaaaggactacacgtcctcgcctttagagagttacatatcctcaccttcagagggctacacgccctcgccttcagaggactacacgtcctcaactttagagggctacacgccttcaccttcagagggctacacgtactcgccttcagggggttacacgccctcgccttcggaggctccaaatctgcgcctttagagaactcaaagtcctctacccttaatgcttaa

SEQ ID NO: 73360 - DNA, 303 bp, Glycine max
  Peptide Sequence Number=SeqID_190138
atggtggaaagggagaaatttgatcatatagaggaaaggctaagggtcattaaaggaggcagaaattatgcctttgttgacatggcacagttgtgcctagtgcctgatgtcgtcatccctccgaagtttaaggtgctggacttcgataagtacaaggggactacttgccccaagaatcacttgaagatgtactgcaggaaaatgggggcatatgcaaaagatgaaaaactattgatgcatttcttccaaaaaagtcttactgggccagtcgtcacatggtacaccaatctggagtcttcctgg

SEQ ID NO: 73361 - DNA, 198 bp, Glycine max
  Peptide Sequence Number=SeqID_190139
atgggcccaaaatctaccataaggctcatgagaactgttcgacagccggcaagtgcactggatcatgcaagtagtataaaacgcataatcgtagtcaagcatcatcctcagatccctcttgttggactaaacttaaccagaactgcattaagacataacataacaaaaactaagttatcatacctcgatgtctcgtga

SEQ ID NO: 73362 - DNA, 183 bp, Glycine max
  Peptide Sequence Number=SeqID_190140
atgaaagttgagctagcgatcctttgtgttggtggtgtcgcagggggacctagcccttggcgcaacgtgaggaggtgcatccaaaagagtgacactctttttatacgtgtgaaacaactcaatacactatcccctataagaggtggaaatgattatgagattattaaaggacaacatatataa

SEQ ID NO: 73363 - DNA, 357 bp, Glycine max
  Peptide Sequence Number=SeqID_190141
atgcctaatcctgcaaagttcataactgagacgtccatctcccgacttgcaggggtgacatcaactaactggggaaacgaagcatgtgtagatggaggcgttggctttgtatgcgagttgctggtacaggatgttgtggagtatcgaagtgagcctgatcatgaaatgtggagagattcttacctaattagggttcatgacattgagagaagaatgagggaggtagagggcaagagactatgtgttttagaaaatttgacaacattaggttttttattaaccattgttaacgcacacaaccgagctcagtattggtcaaaaatgaagttaagggatacacacaagatcggtttttaa

SEQ ID NO: 73364 - DNA, 370 bp, Glycine max
  Peptide Sequence Number=SeqID_190142
actcctgaagcagtatgttgttgctgatccagaaattcaggaagaaaaagttgacagctcccttgagtttcttattctggccagtgacgggctatgggatgttgtctctaatgaggaagctgttgctatgataaagccaattgaggatgcagaggaggcagcaaagaggctgatgcaagaagcatatcagagaggtagtgctgacaatatcacatgtgttgttgttcgtttcttgatgaaccaaggtggatccaaagagttagtagcttatcctcataatagtagctctgcgggtaagaatccttcagtagaagagaaatctgaaccaaacattattacgaagcataactcaaatataaattttagttga

SEQ ID NO: 73365 - DNA, 348 bp, Glycine max
  Peptide Sequence Number=SeqID_190143
atggttttcaataaaagatggagaagtgagatcagtatcgtgtttgaagtgaaacagcgagtccagagtaagttgcaaagcttgttgatgataaacaaggtagaaggcaatccaagaggggatgtttctaaagatatgtcatgcgtagcttcctgtggtgaggttttaagagatcatgcttcgggatttgtattggcctttgcaaggaagattggcattagtccgatgatgtttgctaaacttagaaccattcaatttggagttcaactttcatgcgacaagggcttctcggttgttgaagttgagagtgactctcaagaagctataaagttgatcttaagggtgtga

SEQ ID NO: 73366 - DNA, 631 bp, Glycine max
  Peptide Sequence Number=SeqID_190144
atgaggagggaatcactggaaagtaaattcgggcatgctcttggaacttatagctctaagagtttcaatgctatctaccgatttggcccctttttggctttgtacagggcaacaattatttcatttcatgtgttaaggctaatgatatggcaattattcgttcaagacatgggaaaacgagcagttaaggcattgagcacccggcctgacatattaccaacagtatattgccaagaacttgccaagttacaggatcaaatacctccgtttccaactgatgttgcaatcaaatctattgagaaccatttgggtgttcctattaatgaaatttttaaggatatcagcccagcacctattgcagcagcatccttagggcaagtatataaagctcacctgcattctggagagcttgtagctgtaaaagtacagaggcctggtatgtcactttcattgacccttgatgctttgttattcaatatgattgggggtcaattaaagcggtttgccaaggctcgaaaagatcttttggtggcagtaaatgaaatggtcaggcacatgtttgatgaaattgattatgtcctagagggcaaaaatgctgagcgctttgcttctctttactgttggtctgcaa

SEQ ID NO: 73367 - DNA, 153 bp, Glycine max
  Peptide Sequence Number=SeqID_190145
atggcgcgcgaacaacacacgccgacgcgaccgtggatccaggatgcagtgcctttgttagtggttcttctaatagcagctcatgtcctagctatggaagcatgcgtgatggaatgggaaatcccagactataggcagggcatagtaccatag

SEQ ID NO: 73368 - DNA, 615 bp, Glycine max
  Peptide Sequence Number=SeqID_190146
atgggaaaatttgtagggtgtagtgatcagaggaaacaggcaagcaagttcagtggaaagcatgggaaaacggtgaacaccaattgtttgagaaaatgcatagctgctgcgaccaataagtcatggctgaatgcagaggaaagtgccacgtctggtgttaagtacgcaaggcacttgacagttggcaccgaaccacctcttgggattggattaaccctttacgacctgggcaccattagatcaatctcgtgcctacattattacaatacaccatcaacaccttacaatttctcaatcatcctctttcactttcctgtccacactttcgctaacgccgacagacacgtcgctgctgaacctgcaacaggcgagggttctgatcaagatctgcgtggaattgatgagctcgagcatgagaagtcgcatccagcaacggagccgacgccggagaggagcttgccgacacaaagggtggtgcggttgacatgcgcaaagacttgttcgacagcggcaggtagtggaggaagaggtcgtgatgcggtgactcaacgggatggggctgctggggagagtgaggagtttggcgacgcaactatgggttgccggtggcagtga

SEQ ID NO: 73369 - DNA, 540 bp, Glycine max
  Peptide Sequence Number=SeqID_190147
cttgcagtgaatttccttgatgaaatggatcactttattatatgcagggatgtttctttgatgctacaagggaacaatacagaacaaagtgatccaggaaataggtctgtcggaggattttcagttatagattcagcaaaaaggatcctagagaaattctgccctagaactgtttcttgtgcagacataatagctctagctgctggagatgctgttgaaatagctggtgaaccaaggactatgattcctacaggagctcataccattggaacagcacattgcagctcattcagggatcattttcaagaagattcaaagggaaatcttaggctcattgacaaaaccctatacagtgactatgctaatgagctaatgaaacagtgtccagctggtgtccaaccatctgtaacagtgaacaatgatcctgaaacttcaaagggaccaatcacaagaaccatgagcaagaggctccaagaagattgggctagagctgctgaagaaggccctagggttctcatgaaccttagggtagatttctga

SEQ ID NO: 73370 - DNA, 552 bp, Glycine max
  Peptide Sequence Number=SeqID_190148
atggcagcggaatggagaaggaagagagagaggagacgccacttcaaggagaagatgagtctagaagaagctcaccaccataggaggccatggataagaacttggaggaagaaggagatgaatgaagggagagggagagaagagcacgaaattttgtgctcaaaaggagctctgaaatctgaatctaggtgcctaaaaatacaagggctgaaaaatcctatatttctagggtaccctacctacaatatggagccctatatacaaggaccaaatataatgacatcccagtctaatatgtacaaagataattggacccaaccttggcccatgggctcagaaatctaccctaaggttcatgagaaccctagggccttcttcagcagctctagcccaatcttcttggagcctcttgctcatggttcttgtgattggtcccttcctagggaggattgcatcatgttgtcaaagacctttgaagtttcaggatcattgttcactgttacagatggttggacaccagctggacactgtttcattagctcattagcatag

SEQ ID NO: 73371 - DNA, 644 bp, Glycine max
  Peptide Sequence Number=SeqID_190149
atggctataaatattgatactgaaaagattgaggcaagcaagtgctgcccggctgggactgggagtactattattcctaacacggtcaacaaatatatgcctcggaattataaatactatggcgatgagaatgatgtacaagaggacaatttgaaatttgatattgggtttggccacatcatagttgttcctccatacaagtttgagaagctcgaaggtgtaatcagaaaaatctactgtcagattggccttactataagggaagatggcttttggatgcctgttagtcatgtcactgacaaaaccttgggttattgctttattgagtataatacacctcaggaagctgggcttgctaaagagaagactcgtggatacaggttggatcgctctcatatctgttatgtgaatatgttaaatgactttgacagggttgtgctaaatatttttgacgtgagaactgggaaaaaaatgagaaatttcaatggaagtgctgatgattttgctactggaggtgtcacaggaggagtttcatggcccattttcagatggggtggaggaaatggtgacaaatactttgctagactcggtaaaaacatgatctctgtatatgagacaaagacattttctctcattgacaagaa

SEQ ID NO: 73372 - DNA, 443 bp, Glycine max
  Peptide Sequence Number=SeqID_190150
atgccggtatcggaggcatcggtttctacgatgaatggtttgtcgaagtcaagcagagctagcacgggggcactagtcatggctgttttcatttgttcgaacgctgagtttgcagttaaagaccagttgaatgcttctttgcctagtagtgaattgagaggagccgcgaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 73373 - DNA, 279 bp, Glycine max
  Peptide Sequence Number=SeqID_190151
atgactagtgcccccgtgctagctctgcttgacttcgacaaaccattcatcgtagaaaccgatgcctccgataccggcatgggagttgtcttaatgcagaagggtcatcctctatgcttcgacttacgtccgggaacttcatgcaatcgtctcggccgtgcgaaaatggcgtcaatacctgctagggcattcgttcaccatcttaaccgatcacaagagcttctgagaactaatgtcacaggtcgtccaaactctagaatagcattattatctatctaa

SEQ ID NO: 73374 - DNA, 1272 bp, Glycine max
  Peptide Sequence Number=SeqID_190152
atgaagatagcggtggaagggtgcatgcacggggacctggacaatgtctacagaacccttcaacagttggagaaatctgaaaacacgaaaatcgaccttctcctctgctgcggcgatttccaagccgtgaggaacgagcatgacttgaagagcctgaacgtccctctcaaataccgctccatgaactccttctggaagtactattccggcgccgaggttgccccctaccccaccatcttcatcggcggcaaccacgaagcttccaattatctctgggaactgtactatggaggatgggctgctcctaatatctacttcttgggagctgctggggtggtgaggtttgggaatgttcgaattggtggcctctctgggatctataaatctttcgactataaattaggacactttgagaggcctccctatgatcataataccattaagtccgtgtatcatgttcgtgaatatgatgttcgcaaattgatgcaagtcaaggagccaattgatgtttttctttcgcatgattggccagtgagaatcactgattatggggattggagggagcttgttcggcgcaagcattattttaagcaagagatagaggaaaaaagactaggtagtaaacctgctgctgaacttctagaaaaattgaaaccacattattggttttcagctcacttacactgcaagtttgctgctcttgttcaacatggggaaggaggtccactgacaaaatttcttgcactggataaatgtattcctgggcgtgatttcttacagattgtggaaattgaatcagatgcaggaccttatgagattcagtatgatgaagaatggttagcaataacacggaagttcaaccctatattccctttgacttacaaaggtgcagacttcagaggcataaatcttgagatggaagattgtcttgaatgggttagaagcaagctacaagagagggggtgcaaaccttttgaatttgttagaacagctccttgttatgacccttcacgatccaattttgatggtgcttttgctgtgaatccccgaaatcctcagacagaatcttttgtgcggcttctggaacttccatatctttttgataggaatcctgaagcaaaggatttgtcaccttatccttctccttcaattcagagaggcacggcttatgatagcgaggacattcccattgatgatgtggctgatgatgatgatgatgatgaagagctcccaaaagttgataacgttgaaactgagacttccaatttgtga

SEQ ID NO: 73375 - DNA, 276 bp, Glycine max
  Peptide Sequence Number=SeqID_190153
atggaatacgtgtacttcccttttatcattaccaccgactttttgccagtgctaatcattccagaagatggagcctatggaggctttagaagaaagaataacatggaagatgtagctctatgtggagcttctaggccttggatcttcttcatcaatcgagtcctttgcttcttgaagatcatggcagtggaatggagaaggaagaaagatgattggagacgccacttcaaggagaagatgagtcaagaagaagctcaccaccatacgaagccatga

SEQ ID NO: 73376 - DNA, 486 bp, Glycine max
  Peptide Sequence Number=SeqID_190154
atggagctactcacatgttccatttggagttctatagcttcctctagtccctacacaaggaatataggtcaagaaaagaggaaggttgaagaagaagacgtcgttgttgctgctacacaagaagatgctaccttcgtccaagatgaagcatctaaagttgtggataacaccattgtacatggggtcatcattgatcttaccaacactagtgtcatggatgaaactcctgaggcatccaatgcagccatagctgatgaatcaacaacttcaaataaggatacttctatagacaaaggagaacctgatgccatcattttctactccaccggtatagggcttgctcctctgaactattcacaacctgctagttttacctgggatcaagtgcaagacatgatagggcaagctatggaaaccttcatcaaacgacaacgtcaagagaatgaacaattcaaaatatttatgcagaatgcaatcaccacctag

SEQ ID NO: 73377 - DNA, 756 bp, Glycine max
  Peptide Sequence Number=SeqID_190155
atgaagggcttaggtggtctagacgacatttattttgctagtctcatcgataagatgttgtgggatcaatgggtgtatcatgtcttcaacaagatggacgaagactctaagcacaccctaatagccaagggttcggttgtcgctaaacaacaaaagtttagcaagaataacctaaaagctataaaggttgacttagaacaaagtcagaaggaggctcctcaagtggatttggatgtcatcaacaagaggaagcaaaaaaggctagctatagccattgctgatgaagatcaagcccttgaaccacgtgtatctatcattccctttataataccaagacacatcaagacgagggtgaccaaagctaatcccaagattggtgacaaggaatgggcagtttccttcattgggaacaaggaggatcaagcctcatcatcatcagataatgagtctatagacaacacttctatttttcctctccgcaaacatgtttcctctacacaaccgtgtccaccttcatcacccattcatctagagagaatcagaagggttgctccaagggaacccttaataaatgctcaaaggtttcctctatcattcattaatggtaaccctacacctataaccccatactctaagtttatctatgttgaacttgttgaaatggaaacaatcaatgtccaagcacctacatggacaaagtataacataagaataatccatgtgaggcctttaaggctctaccaacagatgccatag

SEQ ID NO: 73378 - DNA, 870 bp, Glycine max
  Peptide Sequence Number=SeqID_190156
atgaagaaattcaacatggacgatgcaaaagaaatgaagactccaatgcatcccacgacataccttggactagacgaggagtcaacaaaggtggatgggactcagtacaaagcaatgatcggctcattgctctatctcactgcgtctaggcctgatataatatatctaattggaacttctaatcttggtattctattcaacaaaagtgaaagttttagacttacaagctactatgatgctgattatgctggtgataaagttgaaagaaaaaacattaatggaagctgtcaattcattggtggaaacttagtgacatggatatgtaagaagcaaggctcaactgcattgtccaccgctgaagctaaatatatgtcaacaatgtcgacactcatggtattactcactactctgaaacacttcatcttcttctctgaaattcaatccctaactctcaaactctctgtaatggccacctccaactcccctattgccgaaattattccaacactggaaaccatctattcatgtagaacactttttcgacatttaggaactcaaaaaagtgggtctaaagctcaacgagactactattgtgccagacacattttcaataagccacaaaccatataccctgaactcatcatgactttctggaggaatgctaagtttgtcaacaagaaaatgatagcatccaaggttctaggagtcgaggtcgtgttgtccaatgactctatcgccaaggcaacgagatgccttcatgaaggcagcacctaccaagagggatgggagaagaactatgaatcccatattacaagggagctctaccgagaaaatgatgaaaaagctagtgataagaagactacaacttga

SEQ ID NO: 73379 - DNA, 705 bp, Glycine max
  Peptide Sequence Number=SeqID_190157
atgtcccttgaggaactagttggtaccctcaaggttcgtgaacaagaagttcagcaggacgaaggaaccaaaagagaaaagtctttgactcttagcagccaaaagaacaagaaggcatcatcgtccaaagaacacgtattgagaagttcgtccaaagctctcaaggataataattcatctgaagaagattttgatgaagatgagttctccttcatttcacatacaacatctgatgaatttgaatctaataaggaagacgaggatactgtagaaattcctcagaaaaatttggaaatggatatgatggaaaggtatatgttcatgataaggacaccattatctgctacttctatgacacctatcatggtacctgaacagtggctgctcacgacatatgacaggagaaaggtgtatgttccaatttctaacttcctatcatggtggaacaattactttcagagggaatcaaaaaggaaaaataaccagagtcttaaacataatctattgagcataagccaattatgtgacaatggatacaatgtctcctttaacaaagatgagtgtgtcgttctatgtaaaaatgggtctcctttattctttgccaagagaaaaggtaacctctacaaaatcagactgggatatctcatagatcaaaaagtatcttggctaccgtccgttaaagaaaatccattggctatggcataa

SEQ ID NO: 73380 - DNA, 1395 bp, Glycine max
  Peptide Sequence Number=SeqID_190158
atgatgaatgttgagaagatcaacaaggctaaggagctctctgaatctcttgttaatttgcaggaactagaggaaagtatgctcagacaacgagcaaaaatagactggttgagattaagcgacggtaataataagtatttccatgttgcgataaagataaggaatcaaaccaatggcataaagaaaatcatgagaaatgatggtacatatactacagatcagaaggcaatagaaaccaaagtcgtggcgttttacagaaatctaatggggaaggcttcaggcgatcttgagggagtagacatcagtgcaatggagatactaataggttcggttactgaagtagagatcacagatgctttgaacggcattgacaatgataaggcactgggcttggatggttttggggcatatttcttcaaaaaagcctggcacattattaaacaagatgtaatagcaacagttcaagatttttttagaaacaaccgtatgtatagagctgttaattgttctagtgttaccttgattccaaaacacaagggagcaaaagaaatcaaggattatcgaccgattgcgtgttgtagcacattgtacaagatcatatccaagattttggcgaatagattgagcaaagtgctagggacaatcgttggaaataatcaagcggcatttgtgaaagggcagaaaatacataaccacatcctactcacctatgaattgatcaagggatatgaaagaaagagaatttatccgagatgttttatgcaaatggatattcaaaaagcctacgatacggtggattggaatgcgcttgaaaaaatattgaatgaggtgggttgtcctcagcaatttaagaattggataatgattgcggtatcaactgtatcctatagattcaacgtcaatgggtacaagactgagatcatggaagcgagaagaggcctccgacaaggcgacccaatatcacctatgctctttgttattgtcatggaatgcctcaatagatacttgtacaaaatgcaaaaggatggagactttaattatcatccaaaatgtgataaattgaagattacaaacctttgttttgtggatgacttactgcttttttccaggggtgacaagatctcaattggtatgatgatgagggcctacgaaagtttctcgaaggcaacaggtctagtggtgaatccacagaaatgccgcctgttttgtgctggtattgatgctgtgaccaaaagggagattctagaggtatcgggtttccaagaagggcaattaccgtttaaatatttaggcgttccggcaaaatcaagcactggacaacacaactcttatcttatgcaggaaggttacagcttgtcaatagagttatgtttgcacttactaactattggctaa

SEQ ID NO: 73381 - DNA, 177 bp, Glycine max
  Peptide Sequence Number=SeqID_190159
atggataagagcttgaaggtaggagaagatgagtggagggaaagggagagaaggagcacgaaattttgtgcctcaaatgagcctactaatccaagaccaagtccaagattctcaattaagtgtgctttcatgaggcatgtaaagcatgaaggacatgcacaaagtgtgactatatga

SEQ ID NO: 73382 - DNA, 417 bp, Glycine max
  Peptide Sequence Number=SeqID_190160
gaagacaggcaaagggctttgttgcagttgcagttgaaagtgatgagtgacaagcccaaagaggaccaagaagtgaattcaaaacagactttcagtcatagcctctgccagggaataaataccttgaattcaaatgtcaaatcagacactgcattcaaaggcggttattacataataaccgtctttgaatgttacatggtaacattcaaagacgggttgactacgaaaagtaacaaaaatattgaggcattgcttaaaaatcatgctgctctaactctaaaaaggtatagattatcatatatcaagcaaatgaccaacaacttcaaagttaaactaggacaaggtggttttaatactttgtacaaaggaaatctacccaatggtagtcttgtggctataaagatgttgaatgtataa

SEQ ID NO: 73383 - DNA, 297 bp, Glycine max
  Peptide Sequence Number=SeqID_190161
atggaaggaggtcaagaggttctgacgcctatctttgattgtagatataaaggtttcaatttcttggaaaaaggactgaaaaacgacttagaaacttattttggaaaaaacagtccttttgttaagcgcaggcctctcgctaagcgcataattgttcatgcgctaagttgtgagtctcaagcgcttagcgctcaacccttgcatcttaggttgattcattccactaagctagccaaggctgagctgagccaaatccaattcgatctggatttggctaagcaaaagcctaaccgctaa

SEQ ID NO: 73384 - DNA, 849 bp, Glycine max
  Peptide Sequence Number=SeqID_190162
atccgaagggcgatacagcacgatgacgccgtctttggattcttgcagggtgatccagatggcgtcggcgccgtttttcaacgcggtttcgatggcgatgcgggtgttttccggcgcatcggcggtgccgccgcggtgggcgacgatcgccggcgcgtgaccggcggcggcgctggccgccagcgcgctcagcgacagcgcggaagccagcagcaaatgagaaaatctgatcatgtagggtaccttttcgttgtcgttgtgggtgcgatgcgtaaaatcattcatgtcgatatggactgtttcttcgcggcggtggaaatgcgcgacgatcccagcctgcgcgatatcccgctggcgattggcggcagcgccgatcggcgcggggtgatcagtaccgccaactacccggcgcggcgctacggcgtgcacagcgccatgtccacggcgatggcgctcaagctgtgcccgcacctcaccttgctgccggggcgcatagcggcttacaaagaggcctcgctgcatatccgtgaaatcttcgcccgctataccccgctgatcgagccgctgtcgctcgacgaggcctacctcgacgtgaccgacagcccgcaatgcaacggttcggcgacgctgatcgcccaggagatccgccaggcgatcgccgacgagctgaacctcaccgcgtcggccggcgtcgcgcctatcaagtttctcgccaaaatcgcctccgagatgtacaagccgaacgggcagtacgtgatcacgccggcgcaggtgccggcgtttctgcagcagctgccgctcagcaagatccccggcgtcggcaaggtgaccgccaagcgcctgcaagcg

SEQ ID NO: 73385 - DNA, 357 bp, Glycine max
  Peptide Sequence Number=SeqID_190163
ggccctggggtttccagctctggttacgggcctctatcagtcctgcagggtgcccggatcacgcccgcaggacacccagtggacccaaagaagtccaacagggtcctggggtttccagctctaattacaagcctctgtcagttctacggagtgcccgtcacccccagcaaggtcatcaggcctcctactaaccgagctttcatcaagaagtattgtgcccccatgcaggcagaggacaacaaatgcacagccgccacctccagaccccctcagctcatccacaaaaaggtccgtgaccgacaagtcatcatgcgtcctgctcaagacgttaaagaagcgatactaggaggcaaccta

SEQ ID NO: 73386 - DNA, 654 bp, Glycine max
  Peptide Sequence Number=SeqID_190164
atgcctgtccggaaccgtcaccccggcaaggaccgcaaaatgactctacagctcaacccacatacctacagcccgtcgcaccgaaacgccgccctgtcgtcgcccgcgcagatgtaccgcaaacccggcgagatgctgctgatcaacgcgccggataacgccgccgtgccagccaccggccgcgctgatttttcccgcagcagcctgccagcgcacctgcattatctgctcacgccgcgccccggtttttctgccggtcagcattttgtcccggagtatccgtacatgctggacgccgcgctgtcggtcactgcccgccggggcgcggtgtcgttagcaccgtatcacgccgacagtgacaagtgcgcgctggtgattgagcggcagacgctggtgaagtttgatttgccgccactgcacgatttggtgctgagctacatcggtctcaacacctactttagcgaagtgcgcttctacaactgtgccggacgcatcgtggcgtttcgtcgcctgaacgccagcaaaaagcgccacgaagtgttctgcttcgctggcatgaagccggtctcactggtgattgagaccagccagcacagctcgattttgctcgatgagatggtgtggaaccagaccgtaggcgcgggcgcgcgctga

SEQ ID NO: 73387 - DNA, 4362 bp, Glycine max
  Peptide Sequence Number=SeqID_190165
atgttttccgttgatcagcttctcaatacttactggccaggccagcagccagcgcactggcagaaaagcctgctgaagtgggcggtgcgtgaacaggagtttcaggactttgcccagcgctatccgcatctgaaaggggtggatatggtggagcaggtgctggaacacctggatgtgcgctgtgagctcagcgaacgcgaccttgaacagatcccgacgcacgggccagtggtgatcgtcgccaaccatccgcttggcgcgctggacggcctggcgctgctggcagcggtatcgcaggtgcggcgcgacgtgaaaatcgttgccaaccgcatgctgatgatgctggaacccatcaacaacctgatgctgccggtggataacatgggcaaccgcaccagccgcgagcagctgacgcgcatgcagcagcatctcgacaaccagggcgcgctgatcatcttcccggccggtgaagtctcgcgcctgtccagccgcggcgtgcgtgaccgtcactggcaccacagttttctgcgcctggccgcccgcgcccgcgcgccgctggttccggtgcacgtggtaggacgtaacagcctggcgttttacgccgcggcgaaggtggcggcaccgctggcactgctgatgctggtgcgcgaaatgttccgccagcgcggcacgcgcatcaaactgcatatcggcgaacagattcccttcgccaactggcacgatggccatacgccgggcaaagagctggcgaagcggctgcgcaagcatctgtaccgcatcggccagggacggcgcggtctgtttcttactgaagccgccatcgcccgcccggaagatcgcgctgagctgaaaaaagcgttgctggagagtgaacggctcgggacgctgccggacggcaaacagatctatttgtggcggcgcaacggggccagctgggtgccgctgctgcgtgaactgggccggctgcgcgaaatcgccttccgtgcggtgggcgagggcagcggccggcggcgcgatctcgacaagtatgacgatgattactatcacctgattttatgggatgacgaggcgctggagattgtcggggcctaccgctttattcccggcgccgagcagctggcgcggcgcgggctgcagggtatctacagcgacagcctgttccactatgacgagcgcatgctgccgattattcagcaggggctggaactggggcgcagcttcattcagccggcctactggggcaagcgcgggctggattatttatggatgggcatcggcgcttacattgcgcgctatccgcagacgcgctacctgtttggcccggtatcaatctccggcaccatgccgctggcggcacgcgatctgctggtggcgttttaccgtctctactttccgaccgatctgccgctggcgaagtcgcgccgcccttatccggcgtcgctgccggaggtgctggcgcagttcaccggcgataactacgccgacgatttgcggcgtctcaagcatttgctggctaatctcggtaccgcgattccgacgctgtacaaacagtattcggaagtgtgcgagccgggcggcgtgcagtttatcgatttcggcagcgatccggatttcaatcactgtattgatgtctgcctgaagattaagaattatcttaactgcgcatcgagaccaggccagcataggcgaacaacaatgaacaataactctgacgtaatgtaccggctactggtgcagagcgtggtggattacgccatctacatgattaagccggatggcacggtggctaactggaacaccggggcgcaacgcgccaaaggctatacccccgaagagatcatcgggaagaattttgcgctgttttacagtgaagaggatcggcgcaacggcgcgccgcagcgcggtctggccatcgccaccgccaccgggcgctatgaaaccgaaggctggcgctatcgcaaggacggcagcgccttctgggcgcacgtggtgattgacgccatccgcgatgagtacggcgaactgctgggctttgccgaaatcacccgcgactgcactgaacagcaggcgcagcagcgtaaacaacaggaacaggagcagcgtttccgtttattggttgaaggcgtaacggactacgccatctacatgctcgaccttgacggcaacgtcgaaaactggaacgccggcgcacagcgcgctaaaggctaccgcacaggatcgcctgaaccatatcccggaacgccacctgaccccccgcatggcagcgccttttgggcgcatgtgatcatcgacgcgattcgcgatgacgccggcaaactgatcggctatgccaaaatcacccgcgactgcaccgaacagcaggcgctgctgcgcaagcagcgtgaatacgagaaaaccttccgcctgttagtggaaggcgtgacggattacgccatctacatgctggatttacagggccgggtggtgaactggaacgccggcgcgcagcgcgccaaaggctacatggctgacgagatcgtgggccagcacttctccgtgttctacggctcaccggaacgtcaggcacgcacgccggatgccaatctgggcatcgcgctgaaaaccggtcgctttgaggacgagggctggcgctaccgcaaagacggctccgccttctgggcgcatgtggtgattgacgcgattcatgatgaagagggcaaaatgatcggctttgccaagatcacccgcgacgtcaccgagcggcgcgagcacgagcagcagctgctgcgcgcgcgcgatctggcgcaggcgcagagcgccaaaatgtcggagctttccggcttcctcgacaccatcatcagcaacattccctcctgtgtgatcgtcgaagacgccatcagccgcgaaatcctgatggtcaatgacaaagccgagcagctgtttggcttcagtaagtcgctgattatgcataagcggccacacgaatgtatgtcggcggaactgagtgattacttcaacagcctggcggatatcgcgctgcgcagcgaaggcattcacgcgcgcgagcagctgttactgaccgccggcggtgagcgggtgctgcacacgcgcgccactaccatcagcggcaaagacatgcggcagaattacgtgatgctgattgtggaagatgtcaccgaccagccgaggcgctgcgcgtcgatcagcagcaagggccagaccagcgccacgctgtgtctcgatctggataacttcaagaacgtgaacgacgcgctggggcatcagatcggtgacgatctgctgcgggtagtggcgaagcggctgcgcagcgtactgcgcgatcaggacacgctggcgcgcatcggcggcgatgagtttgccatcgtgctgcccaacgtgcggaatgccgatgaggccgcgatcgtggcgcagcgcctgatcgaggcgatccgcccgccggtgaatgttgaaggccacaacctgtcggtcgggctgagcgtcggcattgcgctgacctcgcaggccaccaatacgccggaacatatgctgcgctgcgccgacatggcgctgtatgaagccaagcgtaacggccgtaaccgctatgagcactttacgctggagatggataatgtggcgcgcagccgccgggtgatcgagaacgatctgcgcgaggcgatcaccggacggcagctgaagctctactatcagccgatcaccaacgagaccggcatcattggctatgaggcgctgatgcgctggcatcatccgatcaaaggattgatcatgccgaatgacttcattccaattgccgaagagaccgggctgatccatatgctcggcgcctatgcgctgtacgaagcctgccgcgaggcgcagagctgggaaaccgaacagtcggtctcggtcaatctgtcgccgctgcagtttaagaacagctcgctggtatctgtggtggagggcgcgctgcgcgaatccggcctggcgccgcatcggctggaggtggagatcaccgaatcggtgctgctggatgacacgctcggcaatattcgcacgctgcagagcctgaaaacgttgggcgtgcagattgcgctcgacgacttcggcaccggctattcgtcgctcagctatctgcgttcgttcccgttcgataagatcaaaatcgacaagtcatttatcaatgatatgggcgacagccgcgaggcgctggcgatcatccgcgcgattaccggcatgagccgcagcctggatattcagatcaccgcagagggcgtggagagtaatgagcagtttgtccggctgcgtgaagagggctgtacgctgtttcagggctacctgtttggccggccacaaccgtcggagctcagactgaaggcgctggagtaa

SEQ ID NO: 73388 - DNA, 1917 bp, Glycine max
  Peptide Sequence Number=SeqID_190166
atgtctgaagaaaaaatcatggccgcgccacaaacggtcacggcaagcgccggaaattatctcgcgctgatactggcaatactgtttttttccggtttgctttataaggtcgaaggctttagctggctgggcgcgtttgatttcaccacgctgggtggcagctttggcaccatcaaagagtcaggttccacctttctcggtgccggcggcatcagcgccaaagccggctttctgttcgcgctgtcgctggcacctactgtaatgctggcgctgggcgtgctggagattttcacccactacggcgcgattcgtgccgcccacacgctgctgacgccactgctgaaaccgctgatggggttgccgggacgctgcggcctggcgctgattaccgatctgcaaagtaccgatgccggtgcggcgctcaccaaagagatggcggatcagcagcaaatcggtaaaaaagagctggtggtgatgagcgcctggcaatattccggtgccggactgatcaataattattttgccattggctcggcgctatttgcgtccatgagtgcaccaatcattattccgctgctgctaatgcttccatattgctattcacaatctgatgcccaatgtggtgatggcctacgtactggcggaagtgctgaatctgctcggcatcatgcagtttcttggccacgcgtttgcgccgctgatgggaattttcggtttgcccggcgaggcgatcaccgtgctgctgactgcgtggctgtcatcctcggccagcgtcggggtggcggtgagcctgatggccaaaggagcgaaacggtgtccagagttctcgatcactaccattttctgcatgaaatccccgagctggggtttcaggaagttaaaacttcggcctacatcgccggccagctggaacaggctggcattaaggtcacgcgcggcatcaaccagaccaccggcatcgtggcagagatcgacagcggcgtgccgggcccggtgctggcattgcgcgccgacatggatgcgctcgggcatgtgatcgacggcgttgcctgcgcccgccatacctgcggccatgacggccactcgtcggtggtgctgaccgccgcgcaggagttgctgcaggaaggcgctattaaaaaagggcggctgaagctgctgttccagccggctgaagagctgggggccggcgcgctggcgatgattgagggcggcgcgctggatgacgtggagatgatcctcggcttccatttgcgcccgctggaggagtgccaggtcgggcaggcgacgcctgcggtgatctattcagcgtgcagcacgctggaggtcaccattaaaggtgttccggcccatgccgcacgaccgcatctgggcgtcaatgcgcttgatgcagcagtccaggcggtgcaggcggtgaacagcattcatctggcaccgggcctcacctggagcgtaaaagcgacgcgcttcctgtgcgacgccggcgtgaccaactcggtgccggacgaggcgcgcgtggtgtgggatctgcgttcgcaggagaacgcgccgatggaactgcttaaagagaaagtcagccaggcgattcagcacagcgtggccgcgctgggcgcaaccgctgaagtggtggtgttgaaagagatgccggcggcggaaattgatgccgatgccaccgcgctgctgagcgccgcgattgtcgatgtgctcggcgagcagggattactggcggcgaaaaccacgccgggcagcgaggatttcttctactatccggtgaaaaatccgcaggtgaaagccggtttctgggggctgggaaccaatctggtgccaggactgcaccatccgcagatgcgctttgagctgagttcgctagagatcggcgtgaagatcttcaaggcggcggtggtgcgcatgctgggataa

SEQ ID NO: 73389 - DNA, 528 bp, Glycine max
  Peptide Sequence Number=SeqID_190167
atgagcctgctgcggcgcaactgcaacgacagcgaacaacctaatctgctcaatgggcgttcgctgtacgacattgcgctgctggtgggcgccacgctgcgtgaagtgattgcgcgcgacggcgaggagtttggcggcacgctgctgctgggcggccagattcgcggcgaagagccgcggctgttccagatctatccgcagggcaactttattgaagccagcgtcgacacgccgtacttccagattggtgagagcaaatacggtaagccaattattgaccgcgtgctgcgctatgagacctcgctcagccaggcgatgcagtgtgcgctgatctccatggattcgacgctggcgagtaacatctccgtcggcctgccgctcgacgcgatggtttaccacagcgacagcttcagcgacagcgagcagtaccacatcaccgaacagcatccctacttttcccagatccgccagctgtggagcaaagggttgctgagcgtattctctcagctgccgccgctcaagctctga

SEQ ID NO: 73390 - DNA, 522 bp, Glycine max
  Peptide Sequence Number=SeqID_190168
atgagtgtccaaagccagagtggttcaagcaatggcaccgaacgatcaaggacgcattggactccattgctggaacgctatttcattgatctcatgttggagcatttgcagagagggaacagggttggccacactttcaacaagcaagcatggacagacatgctcacctcgttcaatgataactttggttctcagtacgacaaagatgtcttgaaaactcgctacaccaatttgtggaagcagttcaatgatgtcaagagccttctttctcactttggtttttcctgggatgctgcccggcaaatggttgtggctgctgatgatgattctgtttgggatgcttatttgaaagctcaccctgatgctagatgctacagaacaaaaccagtgctcaattttgatgatttgtgtgttatatatggccacactgttgctgatggaagatatagtttatctagccatgatgtaaaccttgatgatcaagtacaaggacaacatttggttgaaactaaatcagaatag

SEQ ID NO: 73391 - DNA, 618 bp, Glycine max
  Peptide Sequence Number=SeqID_190169
atggcgctattagataaagtgaggggacggcaggcgcaggatcattactcaatccggcagctcgaacaaacgcaggctgttgtgccacagcgcatcggcgatctcatcgggcggttccgggcgcagctggcacaatacttcaaacacattacgcgcgcgctccgggcgatttggttggccctgaaaaccgtgcagcggcatatcgggcgcatcggtttccagcagcagcgcctgcaatggcaggctggcgatggtgtggcgggttttgctggcgcgcgtataggtaatggtgccgccgacaccaatcgcgtagccaagggcgatgaaacgctccgcctgctgctggccgccggcaaagccgtgcaccacgccacgccgcggcacatcgtgacggcgcaaatactgcgccagctgatcgtgccttcagctgggcctccagcagccgggtttgccgcgcaaaatccggcgcttccatatacagatccagcccgatttcccccatcgccacgcgttttgcatccggcgtttgcagcccgagcgcgctatacagcgccggatgctgctgcgccagctggctcaccacggcaaaacggctggcatccacgcacggcacgatga

SEQ ID NO: 73392 - DNA, 1080 bp, Glycine max
  Peptide Sequence Number=SeqID_190170
atgactgcaaacactgagggacatccattgggaatacgcatcccggtgtcgctggacacctttgagccactggcactcacgccattcaaatccaaaaaaatcgcgctggtctgcgaaggcggcgggcaacgcggcatcttcacggcgggcgtactggatgaatttcagcgcgcaggctttaacccctttcagttaatgctcggcacctcagccggtgcacaaaacctctcagcctttgtctgtgctcagcccggttatgcgcggcgcgtgattacccgttacaccaccagtaaactgtttttcgatccgctgcgttttgtgcgcggtggccacctgatcgatctcgactggctggtggatatcactaaacaggagttcccgctggcgctgagcagcgccgaaagcctgtttgccaaaggcagcgaattttacatgtgcgcctgccgcagcgatgattacagcgcgcagtatttcaatcccaccaatctgacctggcatgacatcattaaggcttccagcgcgatccccggtttctaccgcagcggcgtgctgatggatggcgtgagctatctcgacggcggcatcagtgacgccattccggtgcgcgaagcggcgcggcgtggtgccgataccattgtggtgatccgtaccgtgccgtcacagatggcgtatacgccgaagtggtttaaacgcatggagcgctggctgagcgacagcgccctgcagccgatgatcaatatcctgcatcagcacgaagagagctaccgccagattcagcagtttattgaacagccgccggataatctgcgcatcattgaaatctttccgcccaagccgctggccagcatggcgctgggcagtcgtctggcgtcgctgaatcaggattatcatctgggccgccgcagcgggcgctatttcctggcgacgctgggccagtggctgagcgatgctgaaccgctggcgcgcccgattgccgtgacgccgccagccgccgtcgccaacgcgccggataaccggccggtcagcacgccgccgctggcgggtaatgacgccgactacgatgcaggatcgctggcatga

SEQ ID NO: 73393 - DNA, 489 bp, Glycine max
  Peptide Sequence Number=SeqID_190171
atgtctggcggtgttgtgggcgatgttggcgctgacactatcgccggcaaggaagacaatgtttacatcggcgtgggagttgagccatggctccgggccgacggcggcggagtgggcaacggtccactggagggcatcccaagtgccgtcgtaggcagcgaggagggggtcttctggggcgaggcggcagtggatggaggcgacgacaacgtcggtggcagcggagacaaagttgaggtagtggtggtaggcgggattgtagggggtgcatgcgcagaacaggccgccatggatgtatatcaaaaagaggagtttttttgcgatggaggaagcgacgacttaagggaggtaaaggcagacggcgacgtcggtttgggcgttgatggttacgtctttggattggacggcgatgcaggggtcgatgccgggagggatggttccggtgccaaggaggcgctcgacatggtcgtctttgcagatgcggagtag

SEQ ID NO: 73394 - DNA, 1566 bp, Glycine max
  Peptide Sequence Number=SeqID_190172
atggaccgatgcctcattgacttgttattggagcaggtcaaacatggaaatagacttgggcagacattcattgcccaagcttggaatgacatgattacaactttcaatgaacgattcaaatctcaatacgacaaagatgttctgaagaatcgttacaaacatttcaggaaacagttcaatgatgtagaccatcttcttcaacagggtgggttctcatgggatgatacaagagaaatgattgatgcagaagatcatgtttgggatgcttatacaaaggcacaccctgaagctcgatcacttagagttaaaaccttgccagactattggaaattgtgtgttatatttggagcggaaagttctgatgcaagatacgtccatttagcacataatgcagatctcagtagtgaattaccgatgtatataacaggtgaacagaagaatggcttttttccaaatgtttatgatgctggttctacaatagagtggacagaatcaatggaacactatattgttgaccttatgattgagcaagtaaatagaggaaataggattggccatttattcaatgagcaagcttggatgcacatggtccaagcgtttaacgctagatggggactccaatctgataagcaggttctaatggatcaatatttctgcttgatgaaaaaacatgatgacatcagcaatattctcagtcacagtgaatttacatggaatgaaaccctacaaacgttaaatgctgaggatgatgtctgggatgcatacattaaggaccacccagatgccatctcatataaaaacaaatgtttgtatcttttccatgatttatgcaagatttttggaaacaaattaatggaagtatcagatgtaagagtgagtgatctggagcagcttcaattgatggaagcaaatgattttaccattgaaatggatatggatgaaacaaatgaaagtttgcttaatgttagcagtgttggtatatcagaccaggatccgggcagggcaaaggaaatagatgcggatggatcatttgggaatttggttgtgagtagcagcaatgaaattgagattgttgccgttggaacatcaggaaatttagatgtggatatggatatgacatctggaacctgtgggaatttggatgtgactggcgacactcaaatattatctcaagataaacaaggccctgacgaaatggctacaaatggaacacgtggggatttggaattgagtggcaacactaaaataacacagcatgtcagaaaaaggcctaatatgatgtttcaagactccagacctcccaaaaagaagctgggaatgaaagaagctttgtctgagatggctagtgctgttaaggcactgatgaatgataaagagaacaacaatacatcatttgacgatgctttaagtgcacttcgagctatgccggacgtagatgatgacttagtaatggatgcgtgtgatctgttggaagatgagagaaaggctaagatatttttagctttggatatctctttgcgaaagaagtggttgcttagaaagcttcgtcagggaaagcccacatga

SEQ ID NO: 73395 - DNA, 2388 bp, Glycine max
  Peptide Sequence Number=SeqID_190173
atggctgtcttagtgctctgttcttcaaccatgtgtagtagcaatttgtcctcttgtgcttctagtgacaccaatgtttatgttatgagcaataatgggttctttggagggatcccattagtcaaaatgaaatcttttccaaatgggtctttggtaaattggaagaaacatggaaagagacaattgggtcttcgtgtgtttgagacaagatgtgcccatgaggtagttgtggtgaatggtaagagcaaaagtagtgtgtcttctgaagaagttattggcgttctgaaatgtgatgagagtgaaaggaatttttccaaatcttcatacttacacacgctgatctctgggcttttgaacctgagaagattagatgaggaattagagcttttcaacaatatggaatctttgggtgttgaacctactgcttattcatacgttcttttcattgactattatgcaaagttgggggatcctgaaaaagctcttgacacctttgaaaaaatcaaaaagagaggcattatgcctagtatagcagcatgtaatgcatctttatatagtcttgctgaaatgggtaggatcagagaagcaaaagatatattcaatgttcttcacaattgtgggctttcaccggactcagtaacctataacatgatgatgaagtgctacagcaaagcaggacaaatagacatagacacaaaacttttgactgagatgttaagcaaagggtgtgaaccagatataattgtagttaattctttaattgacacactttacaaggctggccgagttgatgaagcatggcaaatgtttgcaagactgaaggacttgaagctagctcctacagttgtgacatacaacattttacttactggtttagggaaagagggaaaactcttaaaggcccttgatttgttttggagtatgaaagagtctggatgccctccaaacacggtgacttttaacgtactcctcgattgtctttgcaagaacgatgcagttgatttggccttgaaaatgttctgtagaatgacaattatgaactgtaatcctgatgttctgacgtataacactatcatctatggcttgctcaaagaaggtagagctggttatgcattctggttttaccatcaaatgaagaaatttctctcccctgatcatgtaactttgttcaccctccttcctggtgttgtaaaggatggaaaggttgaggatgcgatcaagattgtcatggaatttgtacatcagtcaggtttacagacaggtaatcaagtctggggagaattaatgaaatgtattttgattgaagctgaaatagaagaggccatttcatttgccgaaggattggtatgcaattctatttgccaggatgataatttgatattacctcttgttagagtcctgtataagcaaaagaaggctctagatgctaaacaattgtttgataaattcaccaaaactttgggaattcacccaaccccagaatcatataactgcttgatggatgggtttcttggatgtaatatcactgaagcagctttgaaactttttgttgagatgaagaatgcaggttgttgtccaaataatttcacctacaacttgcagcttgatgctcatggcaaatctaagaggattgatgaactttttgaactgtacaatgagatgctttgtaggggatgcaggcccaatattataacccataatattatcatctctgcccttgtgaaatctaatagcataaacaaggcattagatttatattatgaaatcgtaagtgttgatttctttcccactccttggtcatacggccctcttataggtggccttttaaaggctggaagatcggaggaagcaatgaacatttttgaggagatgccagactatcaatcatcaatgcaagcccaattgatggttaaggaagggataaggcctgacttgaagtcttataccattcttgtagaatgtctgttcatgactggtagagttgatgatgctgtgcactactttgaggagctaaagttaactggccttgatcccgatactgtttcttacaatcttatgatcaatggccttggaaaatcatgtaggttggaggtagctctttctcttttaagtgaaatgaagaataggggaatttctcctgatctctatacttacaatgcattgattatccattttggaaatgctggaatggtggaccaagcaggaaagatgtttgaggaactgcaacttatgggtcttgaaccaaatgtcttcacttataatgctctcattcgtgggcatagtaagtcaggaaacaaagatcgagccttttctgtcttcaagaagatgatggttgtggggtgtagccccaatgcaggaacatttgcccaattgcctaataaatgctga

SEQ ID NO: 73396 - DNA, 273 bp, Glycine max
  Peptide Sequence Number=SeqID_190174
atggcgtatgaactcactcttctaggctctgcttggattcatcctatggtgcatgtttccatacttcaccattacaatgaaccaccgctgccgaaccctaccattcttcctcacatttctccagaggatttaaatcacttcaacccaactccaatggttttatacccttcactcatcccatcaattgaagacataaactcttcaattccaacactaaactctataacagctggcacccactcaccctcgagctatccaccatattcatcctaa

SEQ ID NO: 73397 - DNA, 279 bp, Glycine max
  Peptide Sequence Number=SeqID_190175
atgcagaaaaatacccaaaagggagggcaaaagggtcattcggaagctttttctgaccctggcttgcccatgctagtctctggctcgcctgggccaccaaataacttcatggtgaaggggactgagagagaggttcagaggtccataggtgaaggattggagaaaaagaagagaaaagaagaaggaagaagagaaaaagaagctaaatcaccgttgaatcgcaactgcaatcaatttctacatcgttcttcggtcgttcttcgttcttcatctggttag

SEQ ID NO: 73398 - DNA, 258 bp, Glycine max
  Peptide Sequence Number=SeqID_190176
atgacacttaacttgaaaagtcccatggaaatgaggcctctacttagtggcaagttggcttctgaccaaggtttggtagtacatttggagtttctgccaaactcattctccttcaacaaaggtattgtgacacaatggttggaactgggtcattttgaagtcaacaatggaaggaggagtgtgcccatacaagcttggaagggggacattccaatggtggaatgcatggacgagttgtaccaaaactatgagaggtga

SEQ ID NO: 73399 - DNA, 1923 bp, Glycine max
  Peptide Sequence Number=SeqID_190177
atggcgcttataaaggatggaaaaatctatttgactactgttgtgtatccccttctaaagaattgcctgtacccctacctgtctttttgtcaattgtacccttgtaagctggacaaaggagattcattgcaagtgaaagtaaataaattaacatcaacgaagacccagcttccttattcatattattcacttccctattgtgccccatcaaaaatacaggatagtgcagaaaatcttggggaagtacttcgtggtgaccgtattgaaaattctctctatgtgtttaaaatgcgtgagccacaaatgtgcaatattctgtgtaatcttaaacttgatgctaaaactgctaaggagttcaaagagaagatcagtgatgagtatcgggtgaacatgatcctagataaccttcctctagtttttcccttgaaacggactgatcaggattcaactgcctatcagcttggttttcttgttggactcaaagggcagtatagtgggagcaaggaggagaaatactttattcacaaccatttggcatttactgttaagtaccataaagacatgctaactgaatctgctagaattgtgggctttgaggttacaccattcagtgttaaacatgaatatgaaggtaaatttgatgtaaaaacgactcgtttgacaacctgtgaccctcatgctaaacacacagttgtcaactccaacagtccccaagaggttgaagagggcaaggaaattatcttcacatatgatgttgaattccaggagagtgatgtgaagtgggcttcaagatgggatgcctatttgctaatgaatgatgatcaaatccactggttctcaattgttaactcattaatgattgttctcttcctttctggcatggtggcaatgattatgctgaggacactgtaccgtgacattgcaaagtacaatgagcttgagacccaagaagaagcccaagaggagactggttggaagcttgtccatggtgatgtatttaggccccccaacaactcagatttgctgtgtgtttatgttggaaccggtgttcagtttttcggcatgatactagtaaccatgatatttgctgtccttgggttcctttctccttcaaaccgaggtgggctgatgacagccatgctcttgctttgggttttcatgggaatatttgctgggtactcgtcaactcgcttgtacaaaatgttcaaagggtcggagtggaaaaaagttgccctcaggactgcaaccatgttccctgcagttgtctctaccattttctttgttttaaatgctctcatatggggccaaaaatcatcaggagctgtgccatttggcacaatgtttgctctgatctttttatggtttgggatctcagttccacttgtttttgtgggtagctatgtcggattcaagaagcctgcgattgagaatcctgtgaaaacgaacaagatcccaaggcagattcctgagcaggcgtggtacatgaacccagttttctctgtcctgattggtggaatactcccatttggagctgttttcattgagcttttcttcattctcacctcaatctggttgaatcagttttactacatcttcggattcctctttttggtcttcatcattctcattgtcacttgtgctgaaataaccattgtgctctgctacttccagttgtgcagtgaggattatttgtggtggtggcggtcataccttacctctggttcctccgcactttacctctttctttatgcaactttctacttcttcaccaagcttgaaatcacaaagttggtatctgcaatattctactttgggtacatgcttatagcgtcttacgcattttttgtggtaaccggcaccatcggattttatgcatgcttttggttcactaggctcatctactcctcagtcaaaattgattag

SEQ ID NO: 73400 - DNA, 237 bp, Glycine max
  Peptide Sequence Number=SeqID_190178
atggcgacatcacctggcatcattttttatattttgaattccaaagaagcttctatttgtgcattgaatggggtctgctttgctaggaagcacattaagcttgaacctggtcttcccaagattgcaacatgtatgatgcagcagtcacaagagggaaaagatgaacctgattttggtcatagtttgagtgacaacatatccttaaggcataaagttgtttggagagattcctgcaca

SEQ ID NO: 73401 - DNA, 288 bp, Glycine max
  Peptide Sequence Number=SeqID_190179
atggagctggagctcactcaaactacagtaagagttagttctaggccagctgatgctgcaattgctagacttattcaaggaacaaaggtgcttacatcaggagggcttgataaactatttcaacaaacatttaggggttttcccaaagagaagctcttacagccatgtgcttgctacatatcaacaaactctggacctctagttgaaacactctatatatccaccaaaagattagaattttgcagtgactctattgtgccatcatccattctccctgcagtagcatga

SEQ ID NO: 73402 - DNA, 276 bp, Glycine max
  Peptide Sequence Number=SeqID_190180
atgacctcatttgatgttgccaatccattaggggaagagcatgctactgatgtggtgcctactacagggttatactttcaatgtcatcattctacacgcatggtggccttgggaaaagtttacgatggggcaccaccatacacaatgtggcttatgcaaatgatgggatcaaggtttatggatgagtggagtacaggttggatgtgtatggattccttgagctttagtccatacacaatgcaaatgataaacgtgttgaagtcagcagtacattaa

SEQ ID NO: 73403 - DNA, 426 bp, Glycine max
  Peptide Sequence Number=SeqID_190181
atggagataattttcagagatcattggtttgggttgaatatgagcccttgcacatgttgtgttctcattgtggacgttatggaaatgtctccacaaactgtccagacaccccgaaggagactcgggttgtggtgcaagggggcagtgacggcggaggctgggcagccaagctctagcgctacagcgaagcaaaaccctaatgcagttattgcgagcgatatttctgtaaagaatgggctgaatggagactggttggttgttaaacgtgctaacaatggtaacaaaggaagcagactgagtctaagagaggaaagttggtggagaaataataggagcaatggcgtcgatagtgagcagcagggggacccaccttctcaaaaggtttgcgggagtttgaggaagacaggaagattggtgaaccagtga

SEQ ID NO: 73404 - DNA, 1537 bp, Glycine max
  Peptide Sequence Number=SeqID_190182
atgtggctgctttgcgagggtgtgtggcctaggcctgcattggatccaagtataacggatccttatcagctggcaaatcatttaacttgtcgtatattccaagaagatccagctattcttagtttcaagctgactctattggaagtcaaccggggtagtagctgtattgcactaaacaaagtgtgtgcatcaacatcatcctcttcccactgtaaagcatggttagtgcaatccattcccaccaatatgccccacttatcccatgttcccggcaccctctctactggggatgtgcttcggtggctggctgcaaactccaccacgaggcttcacattattgctcagtactggcagctgctaccttctcctgatgatcctcgctcaggggactatggttatactcagcatcagatgcatgaatttggtgccgatcaaggtgttgccctttatgaagcattggatgctgctgctgaccgtaatgttagcatcaggttattgtcccactctggagtgtatccaacttttgcctcagaaccatccaaacttgcttttggaaggcctaatgttgagaatgtgagattgttacttgagaattggtggggctcgggcattgtccatgccaaagtttggatatctgatagtaggaatgtgtatattggatctgcaaacaatgactggaaatctcttacacaggtcaaggaactgggaatttattttgctgattgtcatgaaatagctaaaaaggttgaggtttactttgacaatttatggacactagcatcgcttaattcttcagcttacacaaaaacagtgtttgatcaagactggcaagttgagagaaaggttccttgctggtcgcatttcattaatcatggagagaggtgcatgtcacctctccctcaatatctggagactcctcatattgcaggatatcctattctgtctgaaccttatatgtttaagcttccatttcaaacgcctgggagtaactatttaacaaagcacctccaaggcagctatctatcctttgcacccccagagctattatttggcaaatatcaggctgatgagcaagcatggattgatacaattaagtctgttggaaagaaggaaacagttagaatcagtaccatggactggctaggtcagtcacaatttatggaccaaacaatttactggtcatccctatcctctgcaatatcacaggtggtgttttccaagaatgtaacagtgcagatattggtggcatattgggcacactctatcaacaacacagatgagtacctgaagtctctcctctacaccaacaatctctgctcttcctcaaaatacaacacatgctctgggaaagttgagataaaatattatgtggttccaggtttcaacatgacagggcctgccatcaagggtggagctagaacaggaaacatataccctgattttacaagagtcaatcatggaaaatatgcagttagtgatgtaagggcacacattgggactagcaatcttgtatgggactacttcttcacaacagcag

SEQ ID NO: 73405 - DNA, 1263 bp, Glycine max
  Peptide Sequence Number=SeqID_190183
atgacttcagattgtcttggaaaaccagaccattcactgggtcaaagtaaaatacctccaaaggcagaattctataatgggcagaatgcaattgtggctgtcaatgtacatctgggatacaatcaagaggattccctggtgatgaaccgtgcttcactgcagcgtggtatgttcaggtctgagcacataaggagttacaaatctgaaattgacaataaggaatcttcagataagaagcgaaaacctgaagacattgtaaattttgcaaagctacaaagtaaaattggccgagttgatagccttgatgatgatggctttccatatgttggcgctaatctccaaagcggtgatattattattgggaagtgtgctgaatccggtgcagacaatagtgtaaagttaaagcacactgaaaggggttatgtgcaaaaggttgtgctgtcttcaaatgacgagggtaaaaattttgctgtggtttcattaagacaggttcgtagtccagttcttggagacaagttctccagtatgcatggtcaaaagggagttttgggatttctggagtctcaggaaaattttcctttcacaagacaaggcattgttcctgatattgtcataaatccgcatgcatttccctcacgacaaactcctgggcaactcctagaggctgctttaggaaaggggattgcttgtggtggtatactgaaacaagctacgcctttctccactccttctgttgatgccattactgaacagcttcacagagctgggttttcaagatggggaaatgagagggtatacaatggaaggactggtgagatggttcgatcactcatttttatgggaccaacattttaccaacgtctgcaccatatgtctgaagacaaagtgaaattccggaacactggtccagttcacccgttgacccgacagcctgtagctgacagaaaacgatttggaggtatcaagttcggtgagatggagcgtgattgcctaatagctcatggtgcatcagccaacctgtatgaacgcctgtttacactcagtgactcctctcagattcacatctgcagcaaatgcaaaaaagttgcaaatgtgatcttgcggccagtgtctggtggacggaaaatacgaggaccttattgccgtcactgtgaatctgcggatgacattgtggtggcccatgtcccgtatggggcaaagttattatgccaggagctctttagcatgggcataaatcttaaatttgaaacccaactttgttag

SEQ ID NO: 73406 - DNA, 408 bp, Glycine max
  Peptide Sequence Number=SeqID_190184
atggaggagttgattaacaaaacacaaaataatcccaacgccaccacgtcggattggcagctcctcaacagaatctcacttcctacaccctactactgtcattctgctcccacgaacaaggttcgcaatcatcacagaatgatgcatgcacctgacctcaactctcagatgcaatgtgtaattgtcgaggtcacccagtcgtgcaccgtaactccccccccccccttggtgatcagcctgggccacaagggagttccctaccaggtgacacaccccttagtacaaagtacatactgccacaatttatactatttcccgtgtcatatgaggcatgaaacatgggcaccatcaagtacaatgaccatggatgagttaaagatcctaagccattccctcggagatgcttaa

SEQ ID NO: 73407 - DNA, 444 bp, Glycine max
  Peptide Sequence Number=SeqID_190185
atgggtgacatagaggatgcgcaagaacatatgaaagtcgatatgtcagatttgaaagatcaaatggtttccatgatggaagccatgctagggatgaagaggttaatagagagtaatgcagttacagctgccgccaaagcagacccggtcctagcatatcatctcgtcctagacattgtgggacgagggagagacacattggggcacaccaacaacccacatctagggtataatcggggcgcctacccctacggtttacccccaaacttaacaccaccagctgtgcatgacaacatggatcatgccgctcctattgcttcgaaagggcagcctcctcaacccaccggcgatgtccacgaggacccacgggagggcgcccacggggacgtcgactcctaccccccttttcccaccgagggactggcgcctaatgcattgccttag

SEQ ID NO: 73408 - DNA, 600 bp, Glycine max
  Peptide Sequence Number=SeqID_190186
atgggcttgtcggccgcgattgacgaagggcgcagaagacgacgtcagtctttgcgtgctatcaggcttttcgtcttacagacagcaaaaaagaatgtttatacggataaccactcgggtatttccgcccgtcagcgtgactcaaatttcagtatgacagatcttgtgagcgcggaagatgacacagcaaaaaagaatgtttatacggataaccactcgggtatctccgcccgtcagcgtgactcaaatgtcagtatgacagatcttgtgagcgcggaagatgacgtaaatctccgcgtgtcaacgggcttgtcggccgcgatagtcgaagggcgcagaagacgacgtcagtctttgcgtgctatcaggcttttcgtcttacagacagcaaaaaagaatgtttatacggaaaaccactcgggtatctccgcacgtcagcgtgactcaaatgtcagtatgacagatcttgtgagcgcggaagatgacgtaaatctccgcgtgtcaacgggcttgtcggccgcgattgacgaagtgcgcagaagacgatgtcagtcttcgcatgctatcaggcatttcgtcttacagacagcaaaaaagaat

SEQ ID NO: 73409 - DNA, 165 bp, Glycine max
  Peptide Sequence Number=SeqID_190187
atgggtgcaagggataaatcaatcatgcacaagggaaataaaaatcttgatcttgtcactgatcctatgcatgctcattcaggtccagtgctggtacagatgatggatcctgagaaagaggaaggtccggcactggtgcagatggctcaggctgaggagatatag

SEQ ID NO: 73410 - DNA, 393 bp, Glycine max
  Peptide Sequence Number=SeqID_190188
atgaccaagagcaagggcaagggcaaggatccacttgaaggacttggagggcctatgacaagggctagagcaaggaaagccaaggaagctcttcaacaagtgctttccatactatttaaatacaagcccaagtttcaaggaaaaaagtccaaggttaaatatattagtcatcaacattcaataaggaacactagaagtggagtttattggccttgttgccttgatcatgtggttaatgatcagaaagggaaaactcagtttgatcttttgccacaagcaataaataatcataaggtcataatctattaccacttgaaaagtccctacccttggaaggatggagtgcatgatgatccaatgaactattctccaaaaagagttgagagattttga

SEQ ID NO: 73411 - DNA, 1140 bp, Glycine max
  Peptide Sequence Number=SeqID_190189
atggccccaagaaagctaccacaaagcgatccaggaaggacgccactagagaaggctgcagcgctgcctagccagctgacgcggattttgacaaccacagattccggagtgccgagcatcagcagcgcttcgagaccatcaagggatggtcattcctcagagagaggcgggcgttgggcaccacttgtgacccccatggctaaattcaacccagagatagtcatggaattttatgccaacgcctggccgactgaggagggggttcgggatatgcgctcgtgggtgcgaggccgtgtgaatacggccaaaggaggaaccaggcctttggctttgacgaggatgtcattgcccaacttttgtgcattctgggtaacatcctgcccagtaaccacaactccgatctctcagtcgaagtgtcagctggtgtatgccattctagcacagatgagtgttcacgtggctcagttgattgctgatgccatctatcagtttgtaggaacgacacctatgaggcaccctgtggacccagaaaagtgcaacagggcattaggatttccagcacggatcacgggcctctaccagttttacagagtatcggtcgcccccagcgaggtcatccgaccgcctgtcaccagagccttcattgagaagtattgcatgcccaggctggcacagggtgaggcaccacagcagcccagggatgatcagcagcaagctgcaggtgctccaccaccacctccagagtctacctttgatcacctgcggagattggagcggtatatacgacatgtagctgaccagcaggcagccaaccacaggggtcagtttgaggctgcagtagcatggctgggggattggcccgaggatcaaacaggacccgccggtgctcctggagctgaggacaaggctgaggatgatcaggacatggcggacctgatagatacggagacaccttacgattatccgtacctcgtcattcggagaccccaacaactcgggaatccggtggcatgcggagataccttacggttatccgcacctcgttattcggagatcccaagtccgatgacatgcaaagaccgatgtggtcatctgcacccttcccggagatatcaacgtctttcggccgagactatttag

SEQ ID NO: 73412 - DNA, 3159 bp, Glycine max
  Peptide Sequence Number=SeqID_190190
atggtgctgcaaagatgctaccctatggcttttgtgcaatggggtttcttggcttgcttgctttgcttttctgtgggacttgaaaccccagccagatcttgtgacaagcatgatctgttggccctgaaggaatttgcaggcaaccttacaaaagggtctatcatcacagaatggtcagatgatgttgtctgctgcaaatggattggggtttattgtgatgatgtggttgatggagcagatgctagtagagtgtccaagttgattctacctggaatgggtctcaacggcatgatttcgagttctttagcctatctagataagctaaaggagctcaatctttcattcaatcgtctccaaggtgaattgtcttctgagttctctaatttgaagcagttagaagttcttgacttgagccataatatgctgtctggaccagttggtggggcactttccggtttgcaatccattcagatactgaatatttctagcaatttatttgttggagacctcttccgtttcaggggattgcaacatctcagtgctctcaacattagcaacaattcattcaccgaccagttcaattctcaaatatgcagctcctccaagggtattcatattcttgatatatccaaaaatcattttgctggtggtcttgaatggttgggcaactgtagcatgtctctccaagagttacttttggattccaatttattttctggcactcttcctgattccttgtattcaatgtcagctttgaagcagctctcagtctctctgaacaacctctctggtcagttaagcaaggatctaagtaacctctcaagcctaaaatctctaataatttctggaaatcatttttcaggggaactcccaaatgtttttgggaatcttttgaaccttgaacaactaataggaaactccaattcattttctggatcattgccttccaccttggccttatgctcaaaactccgagtgcttgatcttcgaaataattctttgacaggttctgttggtcttaatttcgctaggttgtctaatcttttcacattggaccttggtagcaatcattttaatggatcccttccaaattcgttgtcctattgccatgaattgacaatgttaagccttgctaaaaatgagttaactggccaaatccctgagagctatgcaaacctcagttcacttttgactctgtcgttgtcaaacaatagctttgagaacttatctgaggcgttttatgtactgcaacaatgcaaaaatctcaccactcttgtcctcacaaagaatttccacggtgaggaaattccagaaaatttaacagcaagcttcgagagccttgtggttttagcacttggaaattgtggtctcaaaggccgtattccttcttggctattgaattgcccgaaattggaagttcttgatttgtcatggaaccatttggaaggtagtgtcccttcttggattggtcagatgcaccatttgttctacttggatttgtcaaataattctcttacaggagaaataccgaaaggtttgacagagctgaggggcctcatatcccccaattatcatatatcaagtctctttgcatctgctgctattcctctctatgtcaagcgaaacaagagtgctagtgggctgcaatataaccatgcctcaagtttccctccttcaatatacttgagcaataacagattaagtggaacaatatggcctgaaatcggtcgtttaaaagaacttcatatcttggatttaagcaggaacaacatcaccggcaccattcctagctctatttcagagatgaagaatttggaaacattagatttatctaataatactcttgttggaactattcctcggtcatttaacagcctcacattcttgtctaagttcagtgtggcatataaccacttatggggattaattccaataggaggacaattttcaagtttcccaaattcaagttttgagggcaactgggggctttgtggggaaacatttcatcgttgttacaatgagaaagatgtgggcttgagggccaaccatgtggggaaatttagtaaaagcaatatccttggcataacaattgggttaggagtagggcttgcactgcttcttgctgttattctgctaagaatgtcaaagagggatgaggataagccagctgataactttgatgaggagcttagctggccaaacaggatgcctgaagcacttgcttcttcaaaattggtgctttttcagaattcagattgcaaggatctgacagttgaagatttgttaaaatccactagcaattttaaccaagaaaatataattggttgtggtggatttggtcttgtctacaaggggaatcttcctaatggcacaaaggtagctatcaagaaactttcagggtactgtggtcaggtggaacgtgaattccaagctgaagtggaggcactctcaagagctcaacataagaaccttgtttcacttaaaggttattgtcagcatttcaatgacagattgttaatttactcctacttggagaatggaagccttgactattggctgcatgagagtgaggatggaaattcagctctaaaatgggatgtaagactcaagattgcccagggtgcagctcatggattagcttatttgcacaaggagtgtgaaccacatatcgtgcatcgagatattaaatccagcaacatacttttggatgataaatttgaagcttatttggctgactttggtctctcaaggctacttcaaccctatgatacccatgtttcaacagatttagtaggaactttaggatatattcctccagaatatagtcaggtactgaaagcaactttcaagggtgatatttatagctttggtgttgttctagttgagcttcttactggtcgaaggcctatagaagtcaccgtcagccaacgtagcaggaatctagtgtcttgggtattgcagatgaaatatgagaatagggagcaggaaatttttgattcagtcatttggcacaaggataatgagaaacagctcttagatgtactagttattgcttgtaaatgtatagatgaagatccaaggcagagaccccatattgaattagttgtttcatggcttgataatgtaggatttgatggctctgaacagtcatcatcttaa

SEQ ID NO: 73413 - DNA, 303 bp, Glycine max
  Peptide Sequence Number=SeqID_190191
atgccgatctccccctgtggaagtatcagttggtctatgtcgttccgacatagggatcgcgcccgcaagacatccagtggacccggagaagtccaacagggtcctgggtttccagctctgattacgagcctctgtcagtcctacaggatacccgttccccccaacaaggatcacgcccgcaagacactcagtggacctagagaagtccaacagggtcttggggtttccagctctgattatgggcatctgtcagttctacggagtgcctgtcacccccagcaaggtcatcaagccccctactaa

SEQ ID NO: 73414 - DNA, 240 bp, Glycine max
  Peptide Sequence Number=SeqID_190192
atggccattgagggctttacaatgagaaggggtgaaagaaagggagtaaatgaaacccctaggagagggggttctgtcgtggtgtgttctttcctttggactgactctctatttatagctgttgaagtgggccttcgtaggcgcgctcagcgcaacacccctcgcttagcccgtgtagatcgcgcgcttagctcgcgtgttgtaggcttagcgcgttcttctgttggatcacaggcttag

SEQ ID NO: 73415 - DNA, 1935 bp, Glycine max
  Peptide Sequence Number=SeqID_190193
atgggtcacgtaggttccagcaaggacggcaccaaggtggggctgtccgctgctgcgatggacatcgacgacgacgacgacgacgacgacgacgacctcggcgacgtcgacctagaccctacgaactccgaaatccttgaagaactcggcgaagacatggtgaaatactggtgcaagaaagcgtcgatgctgttcttcgacgagtacggtctgatcagccaccagatcaactcctttaaccacttcgtcgccatcggcctccaaaacaccttcgactccttcggagacctagtcgtaactcccggttttgacccctccaagaagggagaaaacgaacacttccgttacgcctccgttaagttcggcaaggtgaagctcgacaagcccatgttctggggcggtgaagggaatgcgcaggagttcaagatgcttccgagacacgcgagaatccagaggatgacctacgcttccaaagtcaaaatccaagttaaagttcaggttgggcaaaatggagtgatgccgtgtaatgtgtatgttccgaagaaggttcggagtgataagttcaagactgggaaagaggagttccttgatagagagattatgaaggaagacgagagggaaatcatcattgggagattgccagtcatggtcaagtctgatttgtgctggatgaaagacgcggaaaaagatgatgatgaatttgaccatggaggttattttatcgttaagggtgcagagaagacttttattgcacaggagcaactgtatttaaagaggctatgggttatgaacagtccagggtggatgattgcctacaagtcacagatgaagagaaacaggatggttattaaactggtaggcaattccaggagtgaagaagtggagaatggggacatgtgtcttactgtatattttttgtctgttgaggttcctgtgtgggtactgttttttgctctcggtgtctcatctgacaaagagattgtagatctcattggttgtggcaatgatgatgtcagaattcagaatatcctctttgcatctgttcgtgatgctgatgagaaatgtggagcatttcgaagagttaggaatgctgttcaatatttagaaaaatgtgtaaaaagtgttcaatttccaccttcggaatctatgcaggagtgccttgaaatgtatgtctttcctggaattagtggtttaaatagaaaggcgcgcttccttgcatatatggtgaaaggtctcttgctggcttatactggccgcagaaaatgcgacaacagggatgattttcgaaataagaggcttgaattggccagtgagcttcttgaccgtgagttgaaagtgcatgttgcacatgctcggaagcgaatggcaaaggctttgcagagagacctttatggagatagggacgtacgcccaattgaacattatcttgacgcgtccataattacaaatggcttgcaaagggcattttcaacaggagcgtggtcacatccgtataagaggatggaaaggatctcaggtgtggttgcaaatgttgggcgcactaatcccttgcaaaccatggctgagttaagaagagcaaggcagcaggtccagtacacaggaaaagttggggatgctagatatccgcatccttctcactggggcaaggtttgtttcctcactaccccagatggtgaaaattgtggactagtaaaaaatttgtctgtcacaggattagtaagtactgatgtaactgacgtaactgaatctatactgctaaaattggtggattgtggaatgcaagaacttgttgatgatacttccactcatcttggcagcatggacaaagtcctcctaaatggtgattgggttggagtgtgtcccgattccagttcgtttgtggcagagctacgaagtagaagacgcagaaatgagctgcctcatcagggcagatga

SEQ ID NO: 73416 - DNA, 828 bp, Glycine max
  Peptide Sequence Number=SeqID_190194
atggcgaaagcagagtataactatacggtagattcagcgagagcgtctttggttagacaagaagacaccatcatatttggtttgatcgagagagcaaggttccccttaaattctccaacctacaatcaaagttacacttccattccccaatttcgtggcacattgctcgattttctcgttcgccacaccgaggccattcaagctaagacaaatgaggcggtgtggtcacgatgtgagaacggagatctcaaaaaccttggtgagactgatatggcaggaaggtacattaaccctgaagaaaatcctttcttcccagaaaatttaccaccttcggttgtgccacgttaccccttctcacagtttttgcatcctgcagccgctatgatcaacataaacaatgccatatggaaactgtactttgatgagctgcttccaatgtttgttgcttctggtgatgatggcaactatgcgcaaactgctgctaccgatctttcattgttgcaggccatctctagaaggattcattacggaaagtttgttggtgaggccaaattcagagaatctcctcaaggctatgagcctttaattcgtgctaaggacaaaggagcattgatgaaattgttaacatatgagagcgttgaagagatggtggtgaagagggttaaaaagaaggccatggtgtttgggcaggaagtgagccttgatcgtgatgtcaagggaataacatacaaggttgatccatcagtagtttctctcttgtaccagaaatggttaatacccctcacaaaaaatgttgaagtcgagtacttactaaaccgcttagactga

SEQ ID NO: 73417 - DNA, 735 bp, Glycine max
  Peptide Sequence Number=SeqID_190195
atgggaatggaaccaacgtgcgtcgacacttcgctcaaccttaacgttattccctctccacacatcgcggaagaagttttggttgaagagttgcggcgtttaagtaatgagaacaagagattaactgagacgctgaaacacgtttgcgagaactatgttgctttgcagaaacatttaaatgaattcagccaactgaggaacgcaaattttgataaagaagcaggaacagtaccgtcactgaagagaaaggccgagagtgtgaatctgtttggtattaacaactatactgagtgcagcaccatcactgaggaagaaacattcaaaaggcccaagcatagcaccgagccaaaggtttccaaagttcttacacgaacagatgcatctgataccggcttatatgtgagggacggatatcagtggagaaaatatggtcaaaaagtcaccagagataacccttctcctagggcttacttcaagtgttcatatgccccaagctgcccagtgaagaagaaggtgcaaagaagtgtagaagatccaagtgtgttgggtccaattgtaacgcttgacttggtccagtcaaaagtggttgacattaatgcgcaaaactcatctttccagcagtttttagttcaacaaatggctacttctttgacaagagatcctaatttcacagctgcacttgcttctgccatctcaggaagaattctagacgatacttctgtgggaaaacgctga

SEQ ID NO: 73418 - DNA, 750 bp, Glycine max
  Peptide Sequence Number=SeqID_190196
atggatcaagaggtagaaacgcttgaagcgaagctgcaacgtgtgaaggaggataatcgcactctaagagtgatgctggaaactctgagcagcaaatgcgagaagcttcaatctcatcttcaagaaatcaataatgaggaacaacaagtgggcacgaagtcagaccaaagtggatcagtattattagctagacccgagttttccatggcacaaaagccatcacaaatcttttttaaaacccaccccaaggacaatagtttgatggtaaaagatggttatcagtggaagaagtatggacagaagaaggttaccaaagacaatccttcgcctagagcttatttcaagtgctccctggctcctagctgccccgtcaagaaaagggtgcaaagaagcatacaggataagtctatccttgttgcaacttatgaaggaaagcacaaccatggtgtttttcacgatttactcaagccatcatcttctatacccgaaacctcaataatgattaataatttacctatgacaaacatgcctaacgacaaagatacggtgaacattgacctggctctatatgttaagcaacagaacgaccgtggcagcaaaagcaaaattgaaggatatgcaagtcctctagtgaaagatcctgacttcatcatgccattagctgaagcagttgtccactccctcaagagccagacttataagcaagtgggtcttaacctgaatttgggtcttccagaacctcatttgtga

SEQ ID NO: 73419 - DNA, 813 bp, Glycine max
  Peptide Sequence Number=SeqID_190197
atgaaacagaaacacgccttctttaaatccccaaatcttaatttctgtcccttcgctcactctcactccgtccatcgccgtttacgcgtcgcggatattcttctcgccgacgaagatcacgacggcgacgccgttgatttcatggacggcgtccgagaaacaccgtccaccaaatgcttttcgcctcggaggctcgttgcttcgttgctcgcgccgctgcggccgaccaaggggctccgactccagcaacggcgccagaacgagaccggtgatttggaggcgccgtcgtcgtcgtcgctgacgaacgaacttaaaggaagcgacgattcgacaggacagttacatcagagtgatacatcttttaagctaggggttggttgtggtttgctatatctgattgcagcaagtaaaaatgagcttggcaagatggttgagctgcggaaagaaatggaaatgctccttcaaaatgcgaaaggagaactgcaaagtaaagatgcacttcttaagccattgaaacaaagtgatgctcttgccctttccataactgatattcaagaagtttccagctctagtagtcatctttctattcattcaaatacacaatatgttcaaccagagtcaaaaggcgatatggttcctaattgttttctggaatataacataagcgaacaagatgaatgtgcagaagagataaatgagctccaggcagaatttgaaattgagttacaacggttgcagatgtatttggatggagaagctggatttgatgatgcacaacatgagggagtaaaggtagattgtttcatagtttga

SEQ ID NO: 73420 - DNA, 459 bp, Glycine max
  Peptide Sequence Number=SeqID_190198
atgggtcactgcaactttgagatcattccaacgtggctatttaacatgtttcctcttctcaagtatctcatgtacactccatcgtttcactctttgcaccatacccagttcaggacaaattactccctatttatgcctttttatgactacatctatggcaccacagacaaggctacaaatcaactatatgattctgcattaaaacgagaagaagaaaccacagatgttgtgcacttgacccacctcactacacctgaatccatctatcatctcaggcttggatttccttaccttgcctccaaaccttacacaccaaaatggtaccttcgtttgatgtggcctatgacggcttggtctgtgttcctcacctgggcctatggtcgtgcattcattgtagaagggtgtcgttttgacaaacttaagttgcaaacttgggcaatacctaagtacaattttgaa

SEQ ID NO: 73421 - DNA, 840 bp, Glycine max
  Peptide Sequence Number=SeqID_190199
atgttgcaagagaatttgagcagtttcaggcttgtctcaacaccaccatcaccatcatcaacaagttcatttgacggcagaaaagtgtacatcattgaccatggccttgcaaaaaaatatagggatcttcagactcctaggcacataccatacaaggaaaacaagaaccttacgggcacaactcagtttgcaagtgtcaaaactcatcttggaattgttggagctgaatgtatgatacatagaggtttagaagacaagctagacctgaattatgttaaatggttgcaaatttatctggacattgttagtgcaggctatcaatttgactacattttttattggactatatggaagtatccacagattggtggcagcagctctaaaggacggtggaaagctatgcatgcaagaccatctgtacaaaagccagaaaaagtatcagttgggaaagagattcgagaaaaattctctggtgctgttgaagctttctcccggaggaacccaacaagtcctagtcctcgtggtgatcactccaaacataggagttttgaggaagtagcagtacacaaggatgtgtatcatgatcaagagaagggacgcaattcatctcgatatggcagtagttcaagaagacccataatcccatcgtcaactaggccaagttcctctggtgatcatactgatagtcatactggccaactaagttcaagtggaaaccgaccatctacctcacatagaaatattcaacctatgtatgagacaaaacaaccaacttacatgcactctagatccactagaggcaactgcgatgcaggcatgcaaaagttagtgaatcattaa

SEQ ID NO: 73422 - DNA, 327 bp, Glycine max
  Peptide Sequence Number=SeqID_190200
atgtctgcaatggatgacaaaacattaatacaaacacacactttaactatagaagaagcatctaaggttaagggcactaaccctttgatggttgaggctgcatgtgcctccatgccacttgcaaaagcactaacagtgcttttaggttgcaaacatagtagggtggcagaaaagagaaccacaagagtgcatgtgaaccagaatgaagagtttgtcattcatttagttttagtcgtggagaatctcaaccaaatgaaaactattccattaggagcgattttagccattgttgatcctgtggtcataggcattgttgagaagccagag

SEQ ID NO: 73423 - DNA, 690 bp, Glycine max
  Peptide Sequence Number=SeqID_190201
atgactaatgcaaactgtccgcaagaatcattgcatttagtctcaaacgggaatctaagggcgtgtgtgtctttgtgtgtgatgaagggtgtgtctctgtgtgtgtatcatgagcatgtgtctctgtgtgtgtatcatgaggattatggaaatgtatccattattgctttaagtgtgaaggaccctattctacaaaccaactatgttgtgcctaaaagcaaggatgaaatcctcactttgtcttggatgactttagctatgaagtcactttgtgaaagtcacaatgacatatggacccttatgactgcccttgagcttcctgtgagtgattgggaggacaaatggattgatgtgtacttggacataagttcaaagttgctagacatttgcaatgcatttagctccgagctttcatgtctgaaccagggaaaccttcctcttaagtgtgcactgcacaatttagactctgcctcttcaaagcagtatcttcaggcatgttccctacttgatgattggagacagcatgttagttctaggaaccctagaattgagaaatgtagttttatgttagataatcttgtgggctcacttgatcttcctaagggtgtttactgcagcattctttggctcgtcaaagaagttatcagacttgaatgtggccgacatacattcatgggctccatattttag

SEQ ID NO: 73424 - DNA, 210 bp, Glycine max
  Peptide Sequence Number=SeqID_190202
atgagtgaccaagtgggaaaggagggagcctctgcttctaaccctttgcgggattggggcttagggttttcgccaatgagagagacaactgttaaagaatgtgggtgggcacgagtgagaggcgcatgccttttcaataagtcaaatgcgttttcaaaggcggttcttcacgtaactgatgtagtaatgcgtcttcaaagatggttttga

SEQ ID NO: 73425 - DNA, 228 bp, Glycine max
  Peptide Sequence Number=SeqID_190203
atggtgactacgatcccaatatgtccattccccacatggcgaagggtcaagggaagctcagactgtgaaggttgtcaggaggagtgcatggtacatctacaaactctatgtggaagcaatgctttccaagtttattttgatgatgccaaagactcaagtcaagaatcaagagtcaagcaagtttcaagaatcaaagagtcgttcaatcaagaatcaagattcaagtaa

SEQ ID NO: 73426 - DNA, 240 bp, Glycine max
  Peptide Sequence Number=SeqID_190204
atggaactgtccactccaccgtgtgctgaagcgtccgtgcaggagctcgcctgtttaggtacatcacaggttctcactgaccgactatgcccgggttgggtcgggattggtcaagcttggttttgggcaatagcaccccacctgacgtccccaaggtctcctgacccccgcgacatatctccaggtggcggtcgggcgatggtgcacaacaagttttccacatccacaaagcgcgcataa

SEQ ID NO: 73427 - DNA, 147 bp, Glycine max
  Peptide Sequence Number=SeqID_190205
atgagaagggtgggaggctatgaggaaagtattaaggtgatgtcttcatatcggagaggagatcgacgagggaaaacatttggctttgccacaatggaaggtgttgaggatgtcacattcatggaatgcaatttggatacaaaatga

SEQ ID NO: 73428 - DNA, 2491 bp, Glycine max
  Peptide Sequence Number=SeqID_190206
atggtgacggaagctgaatatactgatttttctgatatgcttgagcagattggtctggctgaaatggatagtcaaggagactattttacttggtcaaataagcatgtagaaggcaccatttactcgagaattgatagagttctggcaaatgtttcgtggtttcagaacaatctggatgtgaaccttcacatcatgcccccaaatgtctcggaccacactcttctatggctgcaacaccgcgatagggtaattctgaaaaaatcccacttcaaattcattaatggtagtgtcgatctggatggttacaatgatgcagtctcggccagctggagagagccaatcacaggcagacctatgttcgtggtctgggaaaaattaatgtgtctacagccagttctgagaaatttaagtaaaccactgatgcatctcaaacagaatattctccaagccagggggaacctgcagcaggctcaacttgatctctccatcgacctgatgaacagtaccaatattgctaaggtaaaaaagtgcactgatatacttatttactttcaggaacttgaggaaaatgttcttaggcagaaggccaagattgattggctaaaattaggtgatggcaacaattcatttttctacgcaaccgttaaatcgagggctaatgctaaagggatgaacatgctaaggaagattgatggtacaatttgtgcaactcaggaagatattgagaatctggtcctggagttttatgatgctatgcgaagaggtgggcaactttcaatggagcaacgaaagtttcttgttgccccagtcaatgatcaggaaatcctaaaagcgctaaatggtataggcgatttgaagtctcccggtatcgatggatacggggcaaaattctttaaatccagttgggatattatcaaagatgatatcaataatgcaatatatgactttttcaataatgatagattgcttaaggcatttaactgcactattgtaactcttattcccaagcatgagaaggctgtctctgtgaaagactatagaccgattgcaagatgcactatcttatataagattatctcaaaaatacttacagctaggcttggaaaagttttgaatagtattgtaagtccgtgtcaagcggcctttgttcctagacagcagatccataatcacattctgttggcctatgagcttataagagggtatgctaggaagaatggaaccccccgatgcatgattcaattagaccttcagaaagcgtatcacatggtggactggtttgctctggaaactattctgctggaaacaggtattcctaaacagtttgttaagtggattatgcttactgtcacttccgtcacctacaggtttaatatcaatggtaattacaccaaatgtatgaaagctaataggggcatacggcaaggggaccccttatccacgatgttgttcgttattatcatggaatatctcaatagactcctccacaagatgcaaaggaatcctgatttcaatcatcattccaaatgcgaaaagctaaatattactaatttggcctttgctgacgatgtcttgctttttgctataggagattgcagatcagtagagatgttgatgcagaccttgaataccttctctgaaacaactggtttagtggggcccctccctttcaaatacttaggtgtatccttgactagtaagaagttgtctatttctcattatctcagtctaattgatagaataactggaaagattaatcactggagtaataagttgttgagttatgcaggttggctacaactcattaagagtgttaccttttccataacaatttactggatgcaatgttttccgttgcctaagcctaggaaatacgggggtttgaatgttattcacctccaaacatggaatcatgtcactatgatgaaactacttcggagtcttagtgagaaggcagataatttgtggaaggataggggaaaattcagtatgaagacactgtatctgaagatgcgatgtgaaggctcgaatgaggttgtgtggaatagacttttttgtggtaaccctgctagacctcgcgctttgatgactctatggcaagcctgccacgaattccatgatcaccttttctttggatgtagtgtccttggtgatgtgtggaaacaagtccttgagtggattcaggtaaagcatcatcctcaggaatggaatgaaaagcaaaaatggattattaggcacagtaaaggaaagggacataaggcctctattctgaagttggcggtgactgaaactgtctatggcatctggaaataccgcaatgctaagatttttgaagaaactgttcttctggaacgtattccggaagaaggttcttctggaagacgggattgcataagggcaatttcggccattcactatttgttgggtgcactagcaatattgctgggtgcacgtagcatgtccctaattccaattttgaaaagctttgcag

SEQ ID NO: 73429 - DNA, 354 bp, Glycine max
  Peptide Sequence Number=SeqID_190207
atggcaaaaatagaaaaagttgtcaagatcctagaacaggaattagaacggttgaagcaaaatagaaatggggtaggcctgtctgtcctctgcaaggtcatcgcatgtgcgccaaaaaggaaaaagcaaattgggaagaactcttggcaggtgaaaaagaggctaagtcgtgaagtgccaaaagtgatagttgagcgcagcttcagcgcacttagcgtgatagaagaatctggcaggccatcaacatcaaggtcgcgcactaagcgcgagattagtgcgctaagcgcagcaggtgtcttcagccaggctcagcgcacgactggcactaagctcgaatccacttacccgcattaa

SEQ ID NO: 73430 - DNA, 705 bp, Glycine max
  Peptide Sequence Number=SeqID_190208
atgttgaccctgctcactcacctgtatggtctcccacctgattttatgccccccgttgcatacacaatagaacccactcagccaatggttgaggttttgataccgactaaccaaccagtttatttcatgcctccagtgaaccacaagatgacacgggtcatagaaggagtcccaacgacctgttcaaatgagcaactacaaatgttggaggagaggttgaaagctattgagggtagtaattatggcatggtggaagctgcagatctttgttcgattcccgatgtaattattcatccgaagtttaaagcaccagagtttgataaatacaaaggaactagttgcccaaaaagtcgcctaagtatatattttaggaagatggaagcacacgccagagatggtaagctacttatccattgtttccaagatagtctaaccggggcagccctaaaatgttacatgcagcttgagcgagcccatattcactcatggaaagatttaggtgatgttttcattaggaaatacaagtacaacattgacttgactcctaatggatttgagttgcagagcatgtcaaagaaggaatatgaagcattcaaggcccaaagatggcgagtagtggcagctcaagtggaaccccccttatcggagaaagaaaccacaacattacatatcgataccttgtgtgagccattttatgacaaatga

SEQ ID NO: 73431 - DNA, 411 bp, Glycine max
  Peptide Sequence Number=SeqID_190209
atgttaaagtacccaaggttataccagatctcatctcagcagcagcagactattatgcagatgggaagcaattcaggtgcagtttgggattggcagcttaattggaggagacctttgttcgatagtgagatcgcaatggcggatgactttattgggaagatagctcagaaggaaatccttccacacagaactgattcctggtggtggaaacctgacccaggaggaaaattctcatcaaaaagcgcctacagaatgttatggggagaattaacggggacaaatcaggaggctgcttttaaggatctatggaagctaaaaattccaccaaaagcagctgtgttcgcatggcggctaatcaaggatctaagaccatacctctatggtgggagtcattatcttggatcggagtag

SEQ ID NO: 73432 - DNA, 132 bp, Glycine max
  Peptide Sequence Number=SeqID_190210
atggaagtaaaaactacttttttaaatggtgaattagaagaagaaatttatatgaaccaacctgaaggctttgtagaaccagatgtgattttgggtattaagcttataaacaaagatgatggcatgctttaa

SEQ ID NO: 73433 - DNA, 663 bp, Glycine max
  Peptide Sequence Number=SeqID_190211
atgaatcaaggagaggatcttaacatctatggaggattatatgttagtcggaatccaaatctaaaagttaagattgtagatggaagtagccttgctgctgcagttgttcttaacaatattcctaaaggaacaactcaagttttactcatgggaaagctcaccaaggttgcttatgctcttgctttcgcattatgtcaacgaggtgttaaggttgccacaatgcataaacatgattatgagaggctcaaaaagtctctcactaattctgaatctaatttgatcattgcaaaaggctacactcaaatgacttggttagtggaagatcaattgactgaagaggaacaactaaaggcacccacaggtgcattatttattccctattcacaattcccaccaaggaaataccgtaaggattgcttctatcattgcaccccagcaatgctaattcctagttgtgttgaaaatgttcattcttgtgaggattggttgccaaggagggtaatgagtgcatggcgcatagctgggatagttcactctttagaaagatggagtacaaatgagtgtaactacaaaatgcataacatagacaaagtttggcgttcaacccttcaacatgggtttcaacctctaactactccaatcaaagagatagcgcattgttaa

SEQ ID NO: 73434 - DNA, 342 bp, Glycine max
  Peptide Sequence Number=SeqID_190212
atgatgggcatatgcagatttgtccaggaccacatatataacacgtttgacccttctattatgctcacgcatgacattacaagaattataaaaggtaagtttgagggatgttgggagagttatggggaggagaataagcataatccacaattggccaatttatggtatgaggagtttaaggtagaaagggcaaggagagtatcaaaggatattgctaagagagatccagaagaggtaacaaaggatggtgtgtcaagtaagccgtcggatgatgatattttctataacattgttggaggtatggacaacaagggacgtgtatatggtttaggtccaaattaa

SEQ ID NO: 73435 - DNA, 450 bp, Glycine max
  Peptide Sequence Number=SeqID_190213
atgtatcatctcttgttcttagttacaacaacccaagtagacgtcccctctacttgtaccacaaaggatgtcccctccaatgtgttaagacaaagttctcaagcggttagtcctttgaaactttgtgaaggggaaacaaaagatatctcaggcgggagaagagagacacaaaaagaattcaggcggttagtccttgtcgaattctttttggcaaagggagaagagagacacaaaagaattcaggcggttagtccttcgttcttttggaaaagggagaagagagacacaaaaagaattcaggcaaataaggtttggaaaccagaaaactttgaaagcttttggcaaaggaacaagaagaaagatgagaagcaaatgtttcaagatttctcaaaggttgttaaagaagttgtaagagttactcaaatacaagtcaaggtcttgcttttatag

SEQ ID NO: 73436 - DNA, 649 bp, Glycine max
  Peptide Sequence Number=SeqID_190214
ttcattgtttgatgatgaagtccctcatgtgaagaatgagaatgaagatgaggaagaattgtacattaaggatcaatgcgcaagacaatttggagaagaggttgatgcacatgaggatcaagatgtgcttaatgcatatgatttggatgatattgttttaggtgatggtgccatgtctttgagttctgagattaatgcacattatttggaattgtgtgatcatgaagagtcttcctctatgtgggataaatttaaagattatgttcatggtttgaatatgcccttgcttgttcataatttgcattgggttcacttggctatgaaatttgtgctaaagtgcctaagatccaagagaggaaagcatttccatataatattgtatagtagtttccttgtccttgtatttgatataggaggatggataggtgcagatggcttcaatttgaggttgaattcactcaaagaaggagggcatgatgaggaccaactcaagagcatggaccttgaaacacagcatggatttgatggactaatcacaagaacacgtgataagaaaatggttaatgaagcccaacttaaaatggaaaacatgaagcccaaactcaaattggtcaagtgcttgaagaataaggaaaatgagctaacttga

SEQ ID NO: 73437 - DNA, 105 bp, Glycine max
  Peptide Sequence Number=SeqID_190215
atggcttccaaacctggcatactaaccaattggccctggaagcctctcgggagtttcaagctgatgccatttactgttacagttgaggttttgagaggcttctaa

SEQ ID NO: 73438 - DNA, 435 bp, Glycine max
  Peptide Sequence Number=SeqID_190216
atgctttaccagcaggatcagcttgatctagcagccacgtacataaagcatctaaaggaaagaatacaaaaattgaagggggagaaggagattttcaatattggctcacagttgcctctaattgagataaaggacttgggtttgggcattggagtgaagttgataagtgggttaaataagaacttgatgctctatgaagtaattagtgtcctcgaggaagacggtgcagaagttgtcactgttaacttctctacagttgctgataaattttttacacgggtcatgctcaggtggcttgggggcttgctgtccttggcaaccttatcgagtcaaagcgaggaggatacatcatgcattttcggcaacattacctctgctacattggtagagtttggaagaaaaggttggatcttactggaaaagactgaatattaa

SEQ ID NO: 73439 - DNA, 246 bp, Glycine max
  Peptide Sequence Number=SeqID_190217
atgaatttggcagttgcaagaggtgaaaaacctacttatccatctttaaaagcgaaaagaacagattgggataagcttgaacctcaacttaagaaagaggttggtacacttggttcctctaccctaacacttcatttcaggagaaagaagaaaaacttgatggtgatgcttcgttcaacaaatgttcttgctaccgctacagaattagcaccactagcatttccattatcagaaacagaaccttga

SEQ ID NO: 73440 - DNA, 507 bp, Glycine max
  Peptide Sequence Number=SeqID_190218
atggtgagcattgtaacaaagttgcaggtgttaactgttgtgggtgaaggagacacaatcatcaaagctttagacgatattgttccagaagatgactgtggaaagttaacagatgcaatgcatgcaattttgcatgcaaggggctctaagttgaagatagataggattcttaatatttgtcaggcttctcaatccttatcagggcaaaagaaccaaaataaattcaaaactaatagtcctgtagatggctctgataaggctccaggtagcattcacaagcttactgaagaaacagaaacaaaagttattcccatagataaatcacctaattctacaaatttagcccagtctcaagaatcaaatcatgaagttggttcttttggttctttaaggaaggaaactaacaaatgtaatgataataatgacacaaatgaggaatcaaagggaaaagttgttcctgatgttggtcacaacaataacggattggaaacaggttctaaaccatag

SEQ ID NO: 73441 - DNA, 285 bp, Glycine max
  Peptide Sequence Number=SeqID_190219
atggttgttaccatatttgcaaagggcattccacaacacatcattattgttgactttggtgaacaaatattaagtgttacaattagtatcccttgcaaagatgcatatgccttccaatctggcttatttggaaagaaactaaggatcattggttttcctctatcagatcgaataaccaaatgtcggtatgaagttttgtccaccaaaattgaaattcgccttgcaaaaatagatcatatccaatggacatctctagaattcaacaagggtagcacaattgcatag

SEQ ID NO: 73442 - DNA, 291 bp, Glycine max
  Peptide Sequence Number=SeqID_190220
atgttatatgtacacatttttattctacaagatgatgctgatgttcgacaaatattcaacattttttacaacaacccatcactaccatttgtggagttatttgccataatctatgacaataataacccaccaagcaaccaacatggctcaacctccaatcttgaggacttatccgatgaatacgagacttgttgggtcaaaaaccatgatagtgatactgactcctcttccggacctgatggaagtaacatgtctccatcccacgaaacaatattcaaacgggattggtaa

SEQ ID NO: 73443 - DNA, 867 bp, Glycine max
  Peptide Sequence Number=SeqID_190221
atgggcctgtatgtagttgccgagcagtctactcaactagtggcattgggaaaagtgtatgacactttggccaccatacacaatgtcccttatgcagatgatgtggttagggctattggcactttcgtggggtggccaacacatcttgtgaaacccatatttgatgaggattcacaaaagcgtctgcgcataccggttaaatctgctgagatggacaatgtagtggctacaattgatctattgggagagttggtaaagaacttgtttgaaatttaccaaaagctaattgagttggcatgggatggggcaaaatttgggatagctaatgtcaaagatggctttttcatcacacacgcatatgttagtgagattattttaggtgacaagtgtttgaacatatccatactacaactttggctgatgtttatgaatgattggagtacaagcataggttatggatcacggtatggtttccttgaacctcagtgtatccacaatgcaaagaacaaacatgaagattgtcaacattacattaaaacatgggtcaaggaatcacaacgagaagtgtacttgggaccttacctgaatcatgtaatgaaaacattaagcactactttggaaggaaaggcagatcaagctgtgccttggtggattgaactaaagagtcatgttcaaagaggctacgagtgtggatattatgtcatgcattggatgtggtgcatagtgagcggcggtttgaagaatgaatggaataggtggttttctgatagaacaccgctaagcaaggagtccatgacaacacttcgcaacaaatggcgggatattttctctagattaagaacttggaagttagaaaaatttagataa

SEQ ID NO: 73444 - DNA, 555 bp, Glycine max
  Peptide Sequence Number=SeqID_190222
atggaggacgcaagtcactcacaatggtgccctcctccaatttcggtgattaaagttaatgtagacgaggagaatggtgatgctttagagttcaaatttcttgctaccaagtgtggccttgaggtgtgttgggaagaaggctttgttaggagagtgatatgtgaaactgactgcaacaatgttgtggagattgtgcaagagcctgtggagaagcgcattcgtggcacatgcagtggttgcactgtttggagggtagctcctcggtttaccctagaggtcctttgtcaagacagtctgggcatccctaattccctctccaatgctttatatcttgaagtgcttgatctttccagtaataacatttttggaacaattccctcatgtttaatgacagtgagtgagaacattggggtgttaaatctgaagaacaataatctctcaagccctattcctaatacaatcacagcttcttgtggtttgtggactctaaatcttcgtggaaaccaattagatgggccaattccaaattctcttgcttattgctcaaagttagag

SEQ ID NO: 73445 - DNA, 132 bp, Glycine max
  Peptide Sequence Number=SeqID_190223
atggatgaacttagaagtggtttggtgtcaagctggaggaaggtcactcatccatgtggtaaactattgggagaatggcaggtttttgtccctactaatcgaagggtagtgatacaatcacatggaaggtga

SEQ ID NO: 73446 - DNA, 240 bp, Glycine max
  Peptide Sequence Number=SeqID_190224
atgaatcagaagcataagaatccatggaagacagaagtagctagggttctgcgaatgacgaagcagaaggttgaatggacaaacctgtttgtgggaaggagaaggtttctgtcgtcctgtgcgtgcgtggaaggaagaagatacgcgatgatgtttctcagtttctcagtttctgtcgattgtgagggttgcgattatgagtgtctcagtttctcagtttctgtcgattgtgatttgtga

SEQ ID NO: 73447 - DNA, 442 bp, Glycine max
  Peptide Sequence Number=SeqID_190225
atggcatcaaagaagagaaaggcacctgccacaccttcccatgtccgatatgaccgatccaggttcacttctcctgaggcttgggaaaggtacactgacattattgttcctaggaagctgctgccagagagaaatttggtaatctaccacactgaatttgataaattcatggaagaattggagagaagaagatgggatgaagaattgaccagctttgaggaaggcaacattgatgacaaatcaccaaagcaggtaagggtcagaggtcatttgataaaatttgatgaagacaccctcaacacattcctgaagacccctgtgatcattgaggagggggagacattatcagcttattctaggtttgcactcttgaggcctaatcctcaagagttagctgctaagctctgcatcccaaggaggggatttgagcttaatgctgatg

SEQ ID NO: 73448 - DNA, 857 bp, Glycine max
  Peptide Sequence Number=SeqID_190226
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattggaatgcgccagcggcttggaatcgcgtgtgcaattgtcggagatccggctgtgctgctgctcgatgagccgacagtcggcctcgacccggcatccaggatcggggtgcgatccctcctcggtgaacttgccgaggatcggacggtcatcgtttcgacgcacctgcttgaggacctccaggaattcgtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 73449 - DNA, 300 bp, Glycine max
  Peptide Sequence Number=SeqID_190227
atgagtgcgggtttaagatgcgaaggacaagtcgccacgatatgcgatgaaaactcctcgaggagatcggatttggtacaaccatgccctcccggtttccaactagggaattggcgggtggaggaacgcccggaggtttacacgacaagcataatatctgacgacgagtcccgcgaaggtactaatatcgaggacccggtcgtcgatttcgagcaagaagcgagtcggatggaggaggaagaagacgaagatgtagggcttcccccagagttggaaagaataattgctcgggaggattga

SEQ ID NO: 73450 - DNA, 279 bp, Glycine max
  Peptide Sequence Number=SeqID_190228
atgactctaatgagtatgctcctatctttgaaaagctgcatgcttgtgagaaatgtctctagaatatgtccattggatttaatgatgaaatatgtgcaatttcagctcatcagtaggctaagcgtgcatccaccgctaagcgcgacagaagaatctgacagggcatcagcatcaaggccacacgctaagcgcgagatcaatgcgctaagcttagcatgtgtcttcagccaggctcagcgcacgattggcgctaagcccgaatccacttacccgcgctaa

SEQ ID NO: 73451 - DNA, 197 bp, Glycine max
  Peptide Sequence Number=SeqID_190229
atgaagtcccgagacgtctcagaaatcaaaaggaagcaggcttgcgtgatccttgaattccgtaatgtggcgaaagtcgaaaagagaaaatcgaagccgaggcgcttccgtaacgtttccgtgagtaattacgcgaagattctcgaccgttcttcaagattcatcgttcgttcttcgttttcttcagtcttcaacgg

SEQ ID NO: 73452 - DNA, 234 bp, Glycine max
  Peptide Sequence Number=SeqID_190230
atggagatgcgagcagtaggcatggtgcaaacaagatctggccatgaaataggaatagggccagacgatgtcgatggtgatggggtcgaagtggtggtgtggtttgcggtggagtgtttggggtctggcacggtggttttttggtgcggcggtgactggtgttgggtagaggaagaaaaagaagaggggctcttcatgcagagaggaaattcaaacgcaaatgaagattattgg

SEQ ID NO: 73453 - DNA, 557 bp, Glycine max
  Peptide Sequence Number=SeqID_190231
acgatcgagtccgatggcacccagagacaaattatggtcattctgcacctttgtcatctagaggcggcgggcccgatgacacgcagagacaaattatggtcattctgcatctttgtcatccagaggcggcgaacccgatgacacaggcggcaagcccgatgacatgcgaggaacctcttggtcctgcactttttttcaccttttgtcatccagaggcggcggactcgatgcctaataacacgcagagactaacgtcgtcttctgcaccttttgtcattcagggacagcgagtcaggcggtggacggagataccttatggtcatccgcgcctttcgttgaccggcaggaatgaattcggcagtatcaggatgatgtttttttcactctcgtcgtccggaaacattcaagtccagcgacgcgaggaattcttctctgctgggcagagacgattgggtgcaatggcaaagggaagtgtcgcggtgtccaactttgtcgttttcaaaacactgaagtttattgacgcttctgatgccttttcttttcttactgaacgacag

SEQ ID NO: 73454 - DNA, 573 bp, Glycine max
  Peptide Sequence Number=SeqID_190232
cactcaccgccacttgagccacctgatatacaagtggtagttgcaggtgtgagcaccaaggggagctgtgctgaagcttacacaattccattagctaaaaagccttctgatctgcacatcgacattatgggcttgtacgtagttcatgaccagtgtactaaactagttgcattaggaaaagtgtatgacagtgcgtttaccatacacaatatcccttatgcagatgatgtggttagggtgagtgttgtcaaagtttaccacggtgacgcttatgggtccccattgcagttactttttgtgcatttatatctcaaggaaatttcaatgggggtttatcggaaagcacaccagatcgtcaagtatttaaaattaaaacggatgaatccgagtatcgaacacagagaactaatgttagccaaaattaagttcagaattgaagcattgttgatagaacatcctaaattactaaaccctcgatccctcgtcaggctgaatatccaagcttcgtccacagatccctcatgtaagactacacccgatttagatagccctcttaggtttagactaacttaa

SEQ ID NO: 73455 - DNA, 711 bp, Glycine max
  Peptide Sequence Number=SeqID_190233
tggattccctttgatgagcatgccatcaatcagtttctggggcatccaccggttttggaggaaggccagcactgtgagttctcacagaggaggagtcaggcctccggcttcgatgaggaggctatcaatcggttgctatgcgtgccaaggcaggactttgcccagagcgtagtagggagacgggtgagtgtccatgtcgcccagctgatttcagatgttatttaccagtttgcaaggattacacctcgaagacacccagtggacccggagaagtccaatagggccttgggatttcctactatgatcacaggcctctgtcaattctgtggagtggcggtcgcacccaccaagctcatccggcctcccatcagtagaggtcaggcttcgcagcagccaaatgaggaccagcagcagccagctacagatgcaccaccgccgcctctacaagaggtaccatctttggagtccatctccaatcacctgcggaggttagagctccagatgcacagaggccaggtgcagcttaacgataccttttactggtacaacatgcaccaacagagccaggacccccatcctttcccttggcctaccctcgatcaatttggggccacagtggcctcgcctggggattgggtcaattttgagacgaggttgggacctgtaggagctccggggggctgttggatcaagtggcctcggaataattaa

SEQ ID NO: 73456 - DNA, 207 bp, Glycine max
  Peptide Sequence Number=SeqID_190234
atggcggcgacaccgatattagaaatgcgggcaattacccggcgcttcggcagcttctatgcgctgaaaggcgtcgacctgacggtctggccgggtgaagtgcacgcgctgatgggcgaaaacggtgccgcggggaaattcttatcgatggtcaaccctacgccatcaggggcccgaaagaggcgctggcggcagggatcaccctga

SEQ ID NO: 73457 - DNA, 1202 bp, Glycine max
  Peptide Sequence Number=SeqID_190235
atgagtcacagtctgcactggcacgccggcgcgcgcgggcgcctgctgatgtttaacctgctggtggtgagcgttacgctggcggtgagcctggtggctattttcggttttcgccacgccggtcacattcaggagcaggcacaggcacaaacgctggccgatatgaacggcagcctggcgctggcgcgtgatacggccaatgtcgctatcgccgcggtgcggctggcgcaggtggtgggcgcgctcgaataccagagcgagtcggcgcgtctgcagcagacccagcaggcgctgcagcagtcgctgagtcagctggccagcgcgccgctggccgcacagcagccggcgctgctggcacgcatccgcgagcgcagccagatgctggagcaaagcatcagccagctgctgctggaggggcatcagcgccatttacagcgtaacgtgatgctcagcggcctgtggcaggcgcagctgctgctcaaccgtatcgacctgctggccagcgacggtgcgtttctgccgctgcgccagcagacggccgcgctgttaaccgtggcaattcagtccgccacgccgcaagccgcagtgcaacagctcaacagcgtgctgccgatctggtctgcgctgccgctgcagggcgtgctggcgatgcagcgcgcgcggctggtcagcaccagccagcagctgctgccggtggccggtcagctggaacagagtgacatcgccatcgcctacgccacctatcgcatcaaggcgctggtggcgatgctcaacgaagacatcacccactacgttcagctggtggcgcagcagagcgatgcgcgcagcgccaccgcccatcaggaactggattcaatcatcggtttcatcggtctgtttatgctgctggcgctgctgattaccggttacgccggttactacatctaccgcaatctcggttccagccttaccgctatcgcgcacgccatgacgcggctggcgcagggggagaaaagcgtcagcgtgcccggcctggcgcggcgcgatgagctgggcgatctggcgcgcgccttcaacgtgttcgcgcgcaacaccgcttcgctggcgcatacctcgcagctgctgaaagagaaaagcaaccagctggaatcgaccttcctcgccatgcgcgacggcttcgcgctgtttgataacagcggtcagttggtggtgtggaacgcgca

SEQ ID NO: 73458 - DNA, 1471 bp, Glycine max
  Peptide Sequence Number=SeqID_190236
atggcttttggcgttaacgcagcggatgcaccgaaacagctgaacctgggaattctgggcgggcagaacgccacccagcagattggcgataaccagtgtgtgaaaaccttcttcgacaaagaactgggcgtggatacgcaactgcgcaactcgtctgactatgccggcgtgattcaggggctgctgggcaacaagatcgatatggtgctgagcatgtcgccggcatcttacgcctcggtctatctgcaaaacccgaaggccgtggatatcgtcggtgtcgtggtggatgacaaagatggctcgaaaggctaccactcggtggtgatcgtcaaagccgacagcccgtaccagaaactggaagatctgaaaggtaaatcgtttggcttggccgatccggattccacctccggcttcctgatccctaaccaggcgtttaaaaagctgttcggcggcacggttgacaacaaatacaacgacaccttctccagcgtcaccttctccggtggccacgagcaggacatcctcggcgtgctgaacggccagttcgagggcgcggtgacctgggcgtcgatgatcggcgactacaacaccggctacaccagcggcgcgttcacccgcatgatccgcatggatcacccggacctgatgaaacagatccgcatcatctggcagtcgccgctgatcccgaacggcccgatcctggtgagcaactcgctgccggccgacttcaaggccaaagtggtcaccgccatcaagaagctggataaagacgatcaccagtgctttatcaaagcgatgggcggcaagcagcacatcggcgacaccaccctggcggaataccagaccatcatcgatatgaagcgtgagctgaccaaaggcgacccgcgaagcgctgctgtggtcgctcgggctggtggtgctgtacctgggcgccggcaacctcgccgagttcaacctgcacaccgtctgggtgtctattccgcacttcttcgactacctggccgaaaccattccgacgctgcattggcctctgctgttcgccgacgggcgcaccgagggctcgctggcctactggggttaccgcctgaatatccagctgccactgatctgggagaccctgcagctggcgctggcggcgaccattttctcggtgctggtggcgaccgtgctggcgtttctggcggccggcaacacctataccccggcctcggtgcggctggcgatccgcacgctggtggcgttcttacgcaccatgccggagctggcgtgggcggtgatgttcgtgatggcgttcggcatcggcgccattcccggcttcctggcgctggcgctgcacaccatcggcagcctgaccaagctgttctacgaatcgatcgaaaccgcctccaacaaaccggtgcgcgggctggcggcctgcggcgccacgccgctgcagcgcatgcgcttcggcctgtggccgcaggtgaagccg

SEQ ID NO: 73459 - DNA, 978 bp, Glycine max
  Peptide Sequence Number=SeqID_190237
atggtggcggatctgcagggcctgaccgacaacggcaacaacccgcaaaaaatcagcgccaacgtgctcaacgtggtggccgactatctggcggtgggcatcgatccgcacaagaccacgatctgcctgcagtcggcgctgccggcattggccgagctgacgatgtactacctcaatttggtcagcgtggcgcggctggagcgcaacccgacggtgaaaaacgaaatcgccgagaaggatttcgcccgcagcctgccggccggttttttgatttatccggtcagccaggcggcggacatcaccgccttcggcgccacccacgtgccggtcggcgaggatcagctgccgatgctggagcaaaccaatgagatcgtgcggcgtttcaaccacatcgtcggccaagcgatattaacggagtgccagccgctgttgagcaacgtcgggcgtctgccggggctggacgggcagggcaagatgtcgaaatcgcgcggcaacgccatcccgcttggcgccggcgccgacgaggtgcacaaggcggtgatgagcatgttcaccgaccccggccatctcaacgtcagcgatcccggccgggtggaaggcaacatggtgttcacctacctggacgccttctgcgaagacgccgcgctggtggcggatctgaaggcgcactatcgccgcggcgggttgggggacgtgaaaatcaaacggctgctggaggactgtctgcagagcctgctcgagccgatccgtgcccgccgcgccgaattcatcgccgataaaggcgagctgacgcgcatcctgcagcacggtacccgccgcgcgcatcagccactgaaaccagagaaatcatatggctcaggcactgttaaaattggcacagcacgactttccagggcagcacgccgccgcatcccgcaaagtattatcggtaaagggactcggcaaggcctacaaagcgcagcagcgcgtgctggatga

SEQ ID NO: 73460 - DNA, 1104 bp, Glycine max
  Peptide Sequence Number=SeqID_190238
atgaacgagtcatacgtacttgctgaagtcagcaatgagaaccagacgctggttgcggtggttcagcaagggagcagggcagcctatttttatatctatcccgccgaagcctacagcgatcgctatcaggtgcgcgcctgctggctgcgcaacctggccgccgcgccgctgcaggaagatcgcgccgcgctggaacaagggcagccgccgatgctggcggcggagtattgccgcaacctggaaggcgaagcgccgctgaacccggaagggctgatggtggtgtggagcgaaagcgacgacggcgcggccctgtggtattacggccaactgctggcggtgatccccggctggagcctgtatatcgaccattcggtgtgctattcggccagctgcatcaaggagagcccgttggcctatccgctcggttcggcctcgaccaacacgcaatatgctcaggcggaaagcacccgccagttttggcgcagctggcagcgtgaagagggcaacccgtggccgaagatgcagcgcgattttcaggcgcgctatgagtcgcatttcggcccttcggtgaagtactacgccatcgatcagggcaagtggccgccgatggccatcacccagcacgagcgcgacggcatctattacttcctcaccatgggggtcagcatccggccgatgccgtgggtggagatcctgttcaacgacgaggcttcgcgctatcgccgcatggagatggcgatcgccatcgacagccaatacatgaccgaagacaacgcggtgcagatggccagcgcgctggccggtttcgcgcatgcgccgtgggcgcggctgacctggatcggcgaagggcatacgctggagtcggacgtggcgccgctgggctacgagggctatattttatcgtcgtccttctacccgcataacgcgcacctgactctgccgcagcagtacggcgatccggtgaacctgttctgggccagcccagtgtttaccgctgagcggcagctggcgcacgccacgccgaacggcgggcacgatctggttaaccgactgcgggagcagggtgtcgaccatattttccgcccgcgccagccggtgtgctga

SEQ ID NO: 73461 - DNA, 282 bp, Glycine max
  Peptide Sequence Number=SeqID_190239
cttgagaggattgatggggacccggtgttgagagaaacgaggatatgggctacgtgggagtacgtgagctcagatggaggtgggcaacaggggatgagtggtacctggagatatgtcgcgggggtcaggagaccttggggacgtcaggcgagctcctggcagtcaacagataaaaggaaaacaagaccacaaagcaaggaggcttgtggtggctggccagctgaggctaagatggtctctggtaatcgattaccaaggggtgtaatcgattaccaggcttga

SEQ ID NO: 73462 - DNA, 420 bp, Glycine max
  Peptide Sequence Number=SeqID_190240
atggctaagttcgatcttgaaatagtcctggagttttatgctaatgcctggcctacggaagagggggttcgagacatgcgctcttgggtgaggggtcagtggattccctttgacggagatgccatcagccagtttctgaggcatccattgatcttggaggaaggccagcagtgcgagtatagccagaggaggagtcaggcttcaggctttgataaggaggctattaccaatttctggattgcgcctacgagacacctggtggacccagagaagtccaacagggccttgggatttcctgctttaattaaaggcctctgtcagttctatggagtgtcggtcacccttagcaagcttatccggcctcctattaatagggctttcattgagaagtattgcatgaccaggcaggcacagggctag

SEQ ID NO: 73463 - DNA, 183 bp, Glycine max
  Peptide Sequence Number=SeqID_190241
atgggtgccaagcacctcacaaggaccaaagaaaggtcgcatgtcatcaagcaaaggtccccggacgaaattaggggtgtactgataaaagctctcattcatccgtacctgacccctatggttggccacttactggtggactctagaggtggcggtgatgtgtctgtagctgcttactactag

SEQ ID NO: 73464 - DNA, 1011 bp, Glycine max
  Peptide Sequence Number=SeqID_190242
atgggatcaaatcaagctcccttgcttaagaaaaggttctatcaagtcaaaattaaaagcctagaggttgccagtttgcaagatttggggcaattgatggatcaactccaacatcaagctttccacaaggcctatgggaagatttgggatctagctatgatagaagtctctgtcgaagccattgcatccctcactcagtattatgatcaaccgctaaggtgcttcacatttggggactttcagctagtgccgactgtggaagagtttgaagagatcctgggatgtccactaggaagacaaaagccatatcttttttctgggttctatccctccatggcaagaatagccatggtagtcaaaatctcaatgcaagagttggaccaagtaaaacaaaacagaaatgggatagttggaataccaaggaggcacttggaggaaaaggcgaaggtgttggcggatcaaggtgaatgggctttgttcattgatgtcttggcgctattggtatttggacttgtcctccttccaaatgtggatgggctagtggacttagcggcgattgatgccttccttgcttatcaccatagcaaggaaagtccggtcgttgctattttggccgatacctatgacactttcgaccgaagatgcataaataatggcacaaggattgtttgttacacaccagctctttatggaggaagagtcggggttttgtcctcatgtgaaggattctcaaacgtcttcttgatgggaacaaggggttgtatcaattataatcctgtccttgccataagacaaattggctaccccatgagaggagcaccatcggagaaaagcatcacgcctttcatcgcacggggtttcagtgaccccaatgcgaggatacttcaaggagtctgtctgcaagacgctcagatgcaagagttggattggctcccaaagctaaaggtttcaaacgaggaagaggtcgaaacccctaaggagagtgaggatgtgcaagccttaaaggcatag

SEQ ID NO: 73465 - DNA, 265 bp, Glycine max
  Peptide Sequence Number=SeqID_190243
atggcgttagtctctgcgtgtcaacaggctcgcttgcccctgattgacaaaaggtgtgtgcgggttatcgtcgggtgtctccgcatgccactggactcatgggtcacgtttctaccggaagatgttgacatcttcggaaagggtgcagatgaccacattggtctctgcttgtcaatcggacttggggtctccgaattactaggtacggataaccgtaaggtgtctctgcatgttactggactctcgggtcattggatagcaaagg

SEQ ID NO: 73466 - DNA, 354 bp, Glycine max
  Peptide Sequence Number=SeqID_190244
atgcggagacacccgacgataacccgcacacaccttttgtcatccagagacggcgagtccgatgacatgcgggggtaccttatggttatccgcaccttttgtcatctagagacggcgagtccgatgatatgcaggggggcaagcgagcctgttgacacgcagagactaacgccatcttctgcacctttgtcatccagagatagcgagtctgatgacatgcgggggtaccttttggttatccataccttttgtcatccagagatggcgattccaatgacatgcgggggtaccttatggttatctgcaccttttgtcaaccagaggcaagtgagcccgttgacacgcagagactaa

SEQ ID NO: 73467 - DNA, 1001 bp, Glycine max
  Peptide Sequence Number=SeqID_190245
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccacaactgaatcaattctataaagagcatcgctgtctgtgggaaattgatactagttatgatggtatcgagattatcgatgctgataatagagatcagagtgtcctttcctttattcgtaagggcaagaaggacgaaatgttagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 73468 - DNA, 465 bp, Glycine max
  Peptide Sequence Number=SeqID_190246
atggacatgaatctaggctacctcatctcccaccagatttctatcattgcccagtatgactcctctaggcttggatttccagccttaatcacagctttgtgtaaagctagaggagtcacatcagattccagatctttggagagtcttagccctgccattaacttggcatatataaagaagaactgttggaatctagatgatccaatagttacatttagagggccaaggaaggccagggcccatgagcctgttcctcctgagccatttatctttgagactgatccagttgctcaggagggagcagcagctcaaaagcctacctctccagttcatatctctccaacacccatccctgaggattcccaaccatctgcaccagtatcgaagcccgagcagcctattgttcaagatccaccagctgctccagtgctggatctaaatgagcatgcagaagatcaacagtag

SEQ ID NO: 73469 - DNA, 540 bp, Glycine max
  Peptide Sequence Number=SeqID_190247
gcgagagtcttggcaagtcaagacgaatgggccccgttcatggacatcctgacacttttgatctttggggtggtcctctttccaaatgtggatgggttggtggaccgggcagcgattgatgcttttctctccttttacgaccacaaggaaagcctggttatcgctatcttagccgatctatatgacacatttgaccaaagatgtgagaagaacaatgcaaggattgtttgctatacactggctctctacgtatgcaccaacgcgggggtgcttcagagggtccacaaggcatgggaaatgtcgcaaaggaaggacaaggaacttaaggggagtagcaacgggcccatcggcggttaccataggtggttgaaagcctatgcacaagatctggattggctcccgagtttgaggaccactaaagggatggaggttgaaactccagaagaagatgaagaggatacgaaaggagaacgccgaactgagagacgtcaatatagccaccaccaaggccttggagcaagagaccaagagggcccataa

SEQ ID NO: 73470 - DNA, 240 bp, Glycine max
  Peptide Sequence Number=SeqID_190248
atgggttctggcaatgcaatgtggttagactctcatgtcgatctgaatgaatcatcctttccatggagaaaagcaatttgtacatttttccggggtctcaaaggggcatggaaacacataagaactcttgaattcaaatggaaaaatagacgtaactccagttacttcggaaatggtaagatctttggcgcaagaacacaagaggaggggttgatccgtatcatcttgacttggttctga

SEQ ID NO: 73471 - DNA, 133 bp, Glycine max
  Peptide Sequence Number=SeqID_190249
atgtcgttcaccaagggaaagataggtgtaaatgaaatggctccaaagaaactctccatgaagaggtctagaagagacgccacaggagaaggatccaatgctgcctcagagtttgatagtcatcgtttccgga

SEQ ID NO: 73472 - DNA, 267 bp, Glycine max
  Peptide Sequence Number=SeqID_190250
acctcatttgaggcacaaaatttcgtgctccttctccccctctccctccactcatcttctcctaccttcaagcttttatccatggcttcctatggtggcgagcttgttcttgactcatcttctccttcaagtggtgtctccaatcatctttcttccttctccattccgctgccattgaacttcaagaagcaaaggactccattgatgaagaagatccaaggcctacaagctccacatggagctacatcacgttacttccatacttga

SEQ ID NO: 73473 - DNA, 306 bp, Glycine max
  Peptide Sequence Number=SeqID_190251
atggtgcagctatggtttggaattagggtgaaagaacctggtggaccattcggtcctgccaacaaatcttatccggagccccatgaattgattgtcattcatgcatcctccaccatcaagtccggagccccacgaattgattgcctagcgctgttcgtgcgtcctccaccatcaagtccggagccccatgaattgattgtcattcatgcatcctccaccatcgagtccagagccccacgaattgattgcctagcgctattcgtgcatcctccaccaacaaatcttatccggagcaccatgaattga

SEQ ID NO: 73474 - DNA, 315 bp, Glycine max
  Peptide Sequence Number=SeqID_190252
atggccaacaaaaacatatcatccaatgaaacataccctcccacacttattcccaaaacaattccaaagctccaaaattcgttaagggtaggaaaggggaacataggctcaaaggtgctatcaaaggaattaattcaaggtaggctcatttggctagaggcttataagaacaaactgcctaaatcatctcccaacatgcatgtgaagcaagaagtatcaacaagagtcaagccaaggctattgtgcaagcaatcaatggggcaaaacacaccgaataaaatagatgatgatggctcaaattctcaccaagggtaa

SEQ ID NO: 73475 - DNA, 396 bp, Glycine max
  Peptide Sequence Number=SeqID_190253
atgttcatagatgggctgagaccacaaaccaagcaactgctagatgcttctgcagggggaaaaataaagctgaacaccccgaaagaagcaactgagctaattaagaatatgttagccagtgaccacgccattctgttacaggttgtaccatctatggtaaggctcatgaaacaggccaatgtatttccaccgaagaaaacactcaagaaattcattttatggggaatcaacaacggcaagggtatactcaaggaggattttcaggcttttagcagagtccctataatcaacaaggacagtataggacacaccctggtaaccaattcaacaaagaccaaaatggaccttcgaataggccaatccaacaagggcccaacattttccagaggacgatga

SEQ ID NO: 73476 - DNA, 315 bp, Glycine max
  Peptide Sequence Number=SeqID_190254
atggaagtcaatgcggctgcagtcaccgctgccaatgctgttgctggggtggacctgactcccccatctggcctcaaccaaatgaatcatccaacctcggatgtgggtgacccccattttgtgcaaattcacaacaagcacgcctccccatcatatggtttgcctcccaactatacaccacccaatgtggcgcacactcctgttgagaatgtcaataactccactcctatacccattgagagccaacaacctcaatctaatcatgcacatgtctacccatgggggagacacatgaagtacccaatcacaatctag

SEQ ID NO: 73477 - DNA, 330 bp, Glycine max
  Peptide Sequence Number=SeqID_190255
atggatcgcgcccacaagacacccagtggacccggaggagcccaacagggccctgaggttcctagctctggttacgggcctctggatcgcgcccacaagatacccaatggacccggaggagtccaacagggccctaagtcctacggagtgcctgtcgcccccagcaagttcatcaagccccctattaaccgggctttcatcaagaagtactacgccccgaggcaggcacagggcgagacaccacaacagcctagggatggccggcaacgggcaacaaatgcactgccaccacttctagagttcaccttagctcatccacgaaaaggttag

SEQ ID NO: 73478 - DNA, 192 bp, Glycine max
  Peptide Sequence Number=SeqID_190256
atggtgagaaacacaaagctcaaaaagctaaacaaaaaggtcacagctttagcgatcgagagcaacacaaaggtcacagctaccatcatcgagagaaatcgagagctctggaccatagagagagagttcagaagaatggagaggaacagagagttcagaagagaggaacaaaaatgggaaacggagagttga

SEQ ID NO: 73479 - DNA, 852 bp, Glycine max
  Peptide Sequence Number=SeqID_190257
atgcattgctgtagcagggccggtgagtgggcgtcaactgcacaagtttggcggcagcagtctggcggatgtgaagtgttatctgcgtgtggccgggattatggcggaatacagccagccgggcgacatgatggtggtatcggccgccggcagtaccaccaaccagttgatcaactggctgaagctcagccagagcgatcgcctgtctgcgcaccaggtgcagcagacgttgcgtcgttatcacagcgatcttatcagcggcctgctgccgccggaaagcgccgagccgctgatcgccgagttcattcaggatctggaacgtctggcggtgctgctggacggcaaagtcgacgaggtgtgctatgccgaagtggtcgggcacggcgagatctggcggcctggctggatgcgcgtgatttcctgcgcgccgagcgcgccgcgcagccgcaggtggatgaaggccgttcttatccgctgctgcagcaattgttggctcaacatccgggcaagcgcctggtggtgaccggcttcatttcgcgcaacgacgccggggaaaccgtgctgttggggcgtaacggcagcgactactccgccactcaggtcggcgcgttggccggcgcggcgcgcgtcaccatctggagcgacgtggccggggtttacagcgccgacccgcgcaaggtgaaagacgcctgcctgctgccgctgctgcgcctggacgaagccagcgagctggcgcgcctggcggcaccggtgttgcatacccgcaccctgcagccggtctccggcagcgatatcgatcttcagctgcgctgcagctaccagccggagcagggctcgacgcgcatcgagcgc

SEQ ID NO: 73480 - DNA, 210 bp, Glycine max
  Peptide Sequence Number=SeqID_190258
atgccgaatcctgatgtcgaacccttatacatgatggcattgaccatcccgcagcttttcctcaagcttttgcagatgttgtgggatgctaccatgtttgaggtgtataatgatcacttcgccttgcacataaagcatgaagatctttctaaaatagcacacagtgttcaatgtctcggcatctctgttatacaactgtggattttttaa

SEQ ID NO: 73481 - DNA, 899 bp, Glycine max
  Peptide Sequence Number=SeqID_190259
tcgaccgtgacgatggcctgcttgtagaccttgtcgaagtcggcgttggtgaagccgccgtagttgctggtgcccaggctcttgggcgagtcgagcgaggcgacccacagctggaacagcgccgaggcttcgcccgtttccgccggccagccgcccatggagaagctgaactcgcgcttggcgcgcttggggaagtagatcgaggcggtcatggcgtcgacgttggtcttgatgccgacgcgggccaggtactgggccacggcctgcgccacctggccgtcattgacgtagcggtcgttggtcgacgacagcgtcagctcgaagccgttggggtagccggcttcggccagcagcttcttggcgccttccgggtcgtacttgatttccggggccttgggcagcgcgccgaacatgccgtcgggcatgaactggtaggccggcgtggccatgccgtccatgatgcgggcggtgatggtcttgcgatcgatggccatggagatcgccttgcgcactcgcaggtcctgcagcgggttcttgccgtcggcgctcttgacgaacgggctcgggttgcgcgccacgtcgggctggaagaacaccaggcgggtggagggcgtggccacgaagccgaacttggggttgtccttcaggcgttgcaggtcgcgcgcggcggggttttcgatcatgtcgaagtcgcccgacagcaggccggtcaggcgcgggccggcggcaggcaccggcacgaacttcacttccttccagtagggtttcgggccccaagtagttttcgttgcgcaccagttgcgatgccggtgcccttgacgtacgacttcagggtgtacgggtcattgccgatggcgtggaaattttttatcaagtcggccaccgtgggtcacgggccg

SEQ ID NO: 73482 - DNA, 264 bp, Glycine max
  Peptide Sequence Number=SeqID_190260
atggaggctagtctgtgcatttcaggcaagggctttattctaaacacggagggccaaccatggaagctcctcagaaaagatcttaccacccttgctcagacatggagcgtcctctcgtactcaaacttagctcctacctcctgcatttcagatttgaacacagacagagctaggttggtctatggcttaatcacaaggatggacatgaacattggcgatcgaggggagtgggatctgatgcccttacctcctatgaaaatctaa

SEQ ID NO: 73483 - DNA, 270 bp, Glycine max
  Peptide Sequence Number=SeqID_190261
atgcagaattcaaagagggatgtgtacctaggagcctacttgaatgctgcacattggcaaatggtcatcattttgcctaaggaaaatgttgtcatctggttttgttcgttgcacaataggccaaacaactacctgaaaggaattattaacagtgctttgaaaggatttaacgataatccacaaagtaaatccaaagttactctaggtggattgttgttaaatgtaatagacaaaaaggaagcattaagtggatattacgtcatgcactag

SEQ ID NO: 73484 - DNA, 783 bp, Glycine max
  Peptide Sequence Number=SeqID_190262
atgtccttcaacctctacctgccgccccaggccatccagaactcctcgcagaaagtccccgtcctcatctacctgtccggtctcacctgcaccgccaacaattgctccgagaagggcttcttccagcacggcgccagcaagaaggctatgtcgaagagagtggaaacggctaacaaggatgtaggaggcttgaacatccagggtgaggacgactcctgggacttcggtaccggtgccggattctacgtcgatgccaccaaggagccctacaagggtggatacaacatgtacacctatgtgacggaggagctgcccaagaccgtctttgccgcgttcccccagctagatgagagccgtgtcagtatcaccggtcacagcatgggtggtcatggtgctttgactctgttcctccgcaaccccggcaagtacaagtccgtctccgcctttgcacccatctccaaccccatcaactgcccatggggccagaaggcctttggcggctacttcggcgaggaccagcaggagaagtggaaggagcacgatgcaacggagctcgtgaagaagtggaagggacctttggatgtgctcattgacgtgggcaccggcgacaacttctacaagcagggccagcttctgcccgagaacctcgagaaggcggccaaggaggcgggcgtcgagggtctgaaggtccgctaccagcctgactacgaccacagctactacacgatggcgacgttcgcggatgaccacgtggaacacgcggccaagtacttgtttgcatag

SEQ ID NO: 73485 - DNA, 558 bp, Glycine max
  Peptide Sequence Number=SeqID_190263
atgaaatttcaaagattacccggacctgtcggccaaggctatagactcgttgaatacatcagtgtagcgcgcgtgcggcccagaacatctaagggcatcacagacctgctgaggtctcgttcgttaacggaattaaccagacaaatcgctccaccaactaagaacggccatgcaccaccacccatagaatcaagaaagagctctcagtctgtcaatccttactatgtctggacctgcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 73486 - DNA, 827 bp, Glycine max
  Peptide Sequence Number=SeqID_190264
gctttgattttgatggcggccgcctggatattagcgcacaccccttctgcggcggcgtgcctgaggacgttcgtattaccacccgttataacgaaaacgatctactcagcgcgctatttggcgtgatccacgaaaccggccacgcgcgctatgaacagaacctcccgcgtaactggctcgatcagccggttgggctggctcgttcaacggcgattcacgaatctcaaagtctgttcttcgaaatgcagcttggccgcagcgaagccttcctcaaccgcctgctgcccgccgtgcgtcagcgctttggcgaccagccggcgttcagcgcggaaaactttatcgcctggaaccagcgcgtgaagccgggcttcattcgcgtcgatgccgacgaagtcagctacccggcgcacgtcattctgcgctatgaaatcgagcgggcgctgatcgacggcgatattgaagtagacgatattcccgccctgtgggacgagaaaatgcagagctggctgggcatttcgaccctcggcaactatcgtgacggctgtatgcaggatattcactggaccgatggcggtttcggctatttcccttcctatacgctgggggcgatgtacgccgcacagttaatggcggccgccagacgcgcgttaccgaatctcgcacaggatatcgccggcggcgattttaacgctctgttcgactggttgcggcaaaatatctggcagcacggcagccgctttaccacttcgcagctgattaagaatgccaccggcgaagatctcaacggtgagtatttccgccagcatcttaccgcgcgttatctctaa

SEQ ID NO: 73487 - DNA, 171 bp, Glycine max
  Peptide Sequence Number=SeqID_190265
atggggaccaccaatactttctgcagcatatcttcaaagaagtacaatttgctagtgccacctatacttgaggatcgagcgactgttccattgcctttatactatgagccaagtgctatagcacttgtcttctcaagattggacgttgaggcaatattgtccaatgactaa

SEQ ID NO: 73488 - DNA, 183 bp, Glycine max
  Peptide Sequence Number=SeqID_190266
atggagaaggagttaaaggatttagaatctggtatatgtaaaaaagagaaggtggagtttgagagccccataatcagaaactttagtgatcagaagcagtttaaagaacctaatgagattgatcaggatcttcaaatgcaatctcaacatcagaattcagtactagttagggagtttgattag

SEQ ID NO: 73489 - DNA, 150 bp, Glycine max
  Peptide Sequence Number=SeqID_190267
atgaggatgaggaaatggagggaggaatcagagtttcttgagtctcagaatgccgttggcttcgaatcgaagaaccctttcacttctttgatggttccaccatttgaagaggggcagggacgcgttgtaatcaattacaaaatttggtaa

SEQ ID NO: 73490 - DNA, 324 bp, Glycine max
  Peptide Sequence Number=SeqID_190268
atgtctttttcaagggatttcctctctggtaatcgattaccaaagtatgtaattgattaccagtgcccaaaaatgaattacacagcctttgcacattggaaactaaaaattacactgtgtaaggtaatcgattacacagtgttacctctaatcgattacccacgaatggtaatcgattaccagaggctaatttccagataccacccaagatacatagctggccagccgccacacaagtctccgtgctttgtggactttgttcttttattggttgactgccaagagctcgcctgcttaggtacgtcacaggttctcactgactga

SEQ ID NO: 73491 - DNA, 261 bp, Glycine max
  Peptide Sequence Number=SeqID_190269
atggcttctaggaaaagaaaggcaccatctacacccacccaagttagatttgacagatcaagatttacttcccaagaggcttgggaaagatacacagacattattgtgcctaggaagcttctgccagagaggaacatggtggtttactatacagagttcgatgagttcaacgaggaactcgaaagatgccactgggacgaggagttgactgactttggggatggcaacattgatgttgccattgtgaaggaagattgttag

SEQ ID NO: 73492 - DNA, 2151 bp, Glycine max
  Peptide Sequence Number=SeqID_190270
atgtcgcgggggcatcgtggccgttaccgccgcgcgcgggcgcgcgccgtcgtcaccgcaccgacgaaaggggcgacagaaagtatcgcccgctttgccggcgagcgttttcattttatggccccggacgcactgttagcttcttcgcatcaggctgactggctgattgtcgatgaagctgccgcgatccccggcccgctgttggaaaagctggtgagccgtttccctcgcgtgctgttgaccaccacggtgcagggatatgaaggaacgggcaggggattcttgctcaagttctgcggtcggtttcccgggttgcagcgctacagcttatcaacgccggtacgctgggcggcaggttgtccgcttgagcggatcgtggccagcgcgctgctgtttgacgacacgctgcttgaccgccgcccggaaggcgaggtgcgtatcacctctctgacccccgcggcatgggaacgctgtccggcgctggtcgcgagcgtctatgagctgctctgtgcggcgcattatcgcacctcgccgctcgatttacgccgcatgatggacgcgcccgggcaacagtttgctgtcgccgaagcgaacccggtcatcgccggagcgctgtggctggtggaggagggcgggctgtcccctgcacttagccgcgcggtgtgggcggggttccgccgtcctcgcggaaacctggtggcgcagtctctggcggcgcacggcggctctccgctggcggcaacgctcagaggccgaagggtgacccgtattgccgtacatcctcaccgtcagcgggaagggattggacaggcgcttattcgcagcaccagcggggaggattatctgtcggtgagctttggttataccgaagagctttggcgtttctggcagcagtgcggctttgtgctggtgcggatgggaagccaccgtgaagccagcagcggttgttacaccgcgatggcgctgctggcgcagagtgaggctgggcatcagttgtgtcagcaggcgcagcagcgtctgaagcgcgatgcgcgggtgttatcggcctggaacggtgaaaagatcccggtggaagatgagtgggaagctacgcttaatcatgacgactggctggaactggcggggtttgcttttgcccatcgcgcgttttccacgtcggttgccgcgttgacacggttgttgctcgccgtcgatatgccgcttccggcactgcgggggaagatggaagggaaaacggaagacatcggacaaaaagcgctgctggtaaagttgcgcagtgaaacggcgcaagcgcttgaaagcgtagaatccaggtcatctattaaggagaccaccatgaaacacgaccattttgttgttcaaagccctgacaaaccggctaaacagttactgcttctgtttcatggtgttggcgataatgccgtcaatatggggcagatcggcagctggtttgcgccggtttttccgcaggcactgattgtcagcatcggtggcgtcgagccgtgtggtcctaatggacggcagtggttctctgttcagggcgtgacggaagagaaccgtcaggcgcgcattgatgccatcatgcccacgtttatcgacattgtccgctactggcagcagcagagcggtgtgggggccgacgcaaccgccctgataggtttctcacaagggtcaatcatgtcgctggaaagcgtaaaagcgcagccgggtctggtttcacgggtgatcgcgtttaacggccgttttgcgacactaccgacccacgcgaccacgcagacgaccatccacctgatccacggtggggaagaccgggtgattgaactctcgcatgcggtcgccgcacaggaagcgctgattcgcgaagggggagatgtgacgctggatatcgttgacgatctgggccacgcgattgatgaccgtagcatgcagttcgcactcgaccatctgcgctataccgtaccgaagcactactttgatgaagcgctcagcggcgtcgtcgtcatcgtcccacttgtcgttaaaatcgcggtgcgggggaagatccggtttgttggcgagaaattttttatggtcaacgcgcttaaggtctttaatcacgttcagcaatacgccgaccagaaaaaccaacaccagaacccaccagtactttga

SEQ ID NO: 73493 - DNA, 198 bp, Glycine max
  Peptide Sequence Number=SeqID_190271
atggtgtcgctgggtgagaatggtgtgactagtgatgaagattcctggattgtggtggtggtggtggaaggtttgagttcatggtggagacaggttggtggtgaagggtttggggtcgtggtggcaatgggatcaaaagaaaaactagggtttgtgaagagcatgtatagagagcaaaaggatcgggagttcaaataa

SEQ ID NO: 73494 - DNA, 321 bp, Glycine max
  Peptide Sequence Number=SeqID_190272
atggattatgttacatcattgcttcggctactgtcaaacacgtttaggattgttgatatccttgttacttccagtttcaccttgacaaagatgtcatggaccaaaacccgctttacgacgcccttaccgaacctgtacggagctagagtaatgggtaaagcagaggaggtgcaagagaaggtgaaggccgacatggatgccatgaaagagaaaatggccacaatgatggaggccatgatgagcatgaagaagataatggaagtcaatgcggttacaattgagagccaacaaccccaaactgatcattcacatgtctcttaa

SEQ ID NO: 73495 - DNA, 150 bp, Glycine max
  Peptide Sequence Number=SeqID_190273
atgtcaatgaatgctgcccattctccttggctggtgttcgacggccggcaagtgcaccggatcgtgcaatggtgtgtgaagacagataaaggatgtgttggtcttcctactggatgtgatgcaatcctaaaccccaagggcattggatag

SEQ ID NO: 73496 - DNA, 297 bp, Glycine max
  Peptide Sequence Number=SeqID_190274
atgcatgacacaaaacctgaagaaaaaataataggccaaaggacggaggtgtataggcccactgtccaaatagcaccaaaacaacgatctaaggacttaaacagaatatggagaggccgacaaccaaaacccaggtgtcgcatcacagttctagtgatcgaagacgtacatgtgggacgcacatgcctgagaatgatacgtggaaaaacgacgtgtgttgaggtttctgatttcgaaacctctagggttgggctacgctggaagagacgacctatatctaggtatcgttggagatag

SEQ ID NO: 73497 - DNA, 897 bp, Glycine max
  Peptide Sequence Number=SeqID_190275
atggccgaggttgttacttcagctcccgggaaagtgcttatgaccggtggttacctcattttggagcgacctaatccaggacttgtcctcagcaccaacgctcgcttttacgccattatcaaaccaattcatcacgaaatcaaacccgattcctgggcatgggcatggacagatatcagattaacctctcctcagctctgcagacaagccctctacaaactcgctctcaaaaatctcgccatccaaaccgtttccccaaggcaccttcaccttctccttttcaaattatttttttcactattagcaagcattatagaattattactgtgctctttctggttttggtatttcagtgatacgagaaatccttttgtggaatatgcgattcagtattccgtggctgctgcttatgcaacgtttgaccagaataaaaaagagctgttgcacaaactacttttacatggtcttgacattacaattttgggtggcaatgatttttattcatataggaatgagattgagagacgtggactccctttgacaccggaatcgttggccacccttctgcctttttcctccattaccttcaatactgatgatgccgatggagggagttgcaaacctgaagtggcaaaaactggtttgggctcgtctgcagcgatgacaacggctgtagttgctgctttacttcattacctggatgttgtaaagctttcctcttcgaaagatcattgggaaaggaaggatgttgcagatcttgatatggtgcataaaatagcacaaactgcacactgtattgcacaggggaaagttggcagtgggtttgatgtcagttcagctgtgtatggcagtcagcgctatgtgcggttttcaccagaagtgatttcttccactaag

SEQ ID NO: 73498 - DNA, 2364 bp, Glycine max
  Peptide Sequence Number=SeqID_190276
gttgtggattttgagcttccgccaccaggaaaatatgccgttggcatgcttttcttgcctacatccaatagtcgcagggaagagagcaaaaatgtatttcaaaaggttgccgaatctctggggcactctgttattggatggcgttctgtgcccactgataacacaggattgggcaaatctgccgtgctaactgaaccagtgatcgagcaagtgtttcttactccaagtactcagtcaaaagttgatttggaaagacagatgtacatattaaggaagctgtccatggttgctataacatctgcattaaacctcgataatgatggcattacagatttctatatctgttcactttcatcaaggaccattgtttacaaaggtcagttaacaccagctcagttgaaggattactattttgcagatcttggcaatgaaaggtttacgagctacatggccctggtaaatatattatccagtaacttctcttctttctccactaactctatatactccaacaaacagcatggggaacaaccagtaactgaagagatgcaaggttggggaatgacttctgaggcattgagttggcctggaagacaatatcttagtggtggagtgaaaaaatcatttcagttaaaatggaataggatttctggaatttctacaggcgctgtggcacttcagtatactatcattgatatacattcacgattttcgacaaatacttttcctagttgggatcgtgctcaacctatgcgtgtattgggccacaatggagaaatcaacacacttaaaggaaatgtaaactggatgaaggcacgtgaaggcctactgaagtgcaaggagcttggtctatccgagaatgagttaaagaagcttttgcctattgtggatgcaaattcatctgattcaggagcttttgatggtgtccttgagtttttgattcagtctggaaaaagtcttcctgaagctgttatgatgatgattcctgaagcatggcaaaatgacaagaacatggatcctcagcgcaaagccttttatgaatacttctcagctctcatggagccatgggatgggccagctcttatatcatttactgatggccactatcttggagcaacgttggacaggaatgggctgcgaccaggccgcttttatgtcacccacagtggacgagttgtaatggcgagtgaagttggggttgtagacattcctgttgaagacgtgagtcggaaaggaagactaaatcctggcatgatgcttctggtggattttgagaagcatattgttgtgaatgatgatgccttaaaggaacagtattcattggcaaggccatatggggaatggctcaaaaagcagaagttagaactcaaagacatagttgattctgttcatgaatctgaaagagtgcctccatcaataacaggagtggtgccagcatctggtgatgacgtggatatggaaaatatgggaattaatggtttattggttccattgaaagcttttggatataccgttgaatccttggaaatgttattacttcccatggcaaaagatggtacggaagcccttgggtcaatgggaaatgatgctccattagccgtcatgtcaaatagagaaaaactcacttttgagtactttaagcaaatgtttgcccaagtgacaaacccaccgattgatcctattcgagagaaaatagtcacgtccacggaatgtatggttggtccagaaggcgacttaacagaaataactgaggatcaatgccaccgtctttccttaaaaggtccccttttatccattgaagaaatggaagccattaaaaaaatgaattacaggggatggcggagcaaagttatagatataacatactcaaagggccgtggcaagaaagggttggaggaagccttggataggatatgtgcggaagcacatgatgcaattagtgatggctacactacccttgtgttgtctgatagagccttctcaaggaaacgtgttgctgtgagctccctgctggctgttggtgctgtccatcaacatctagtgaaaacacttgagcgtactagagttgccttagtaatagaatctgctgagccacgtgaagtgcaccatttctgcacacttgttggcttcggtgctgatgctatatgtccatatttggctgtagaggcaatttggcgactacaggttgatggaaagatcccaccaaaaacaaatggtgaattctactcaaaagatgagctggttaagaagtacttcaaagcaagcaactatggaatgatgaaggtgcttgcgaagatgggaatatctactttggcctcttacaaaggtgctcagatttttgaagctctgggtctttcatcagaa

SEQ ID NO: 73499 - DNA, 427 bp, Glycine max
  Peptide Sequence Number=SeqID_190277
atggcgggggaagggtctacttctgctccatcggaatgcttttggtggcaggtctttctattaccgatatggacctcagggtctcattctgtacctaggaggtcaaattcagactttagactgctgttcaattatttcagtgtcattctcgatctaacaagaatggaatcacgctctgtaggatttgaacctacgacatcgggctgctggaggaagaaccgcccaaaagcgggagagaagcggaacgggcaagtcggtgtcgaggaatggcatggtctccgggagaaagaaagccaaaggagcgaaaagcacaccatcctaggagctcggactgagtctagtttaggtccatccgagggtttggacgtcacttcttcacttttctgctttttggatgggtgctctcccccgagtgaaggcataagcc

SEQ ID NO: 73500 - DNA, 346 bp, Glycine max
  Peptide Sequence Number=SeqID_190278
gctttacgctcgctcggagagaactcttccgagcgaaaacgagaagccacgactcaacgtacgatgtccggggccgggtcggtcaccgaagctgagggttgcggttcggtcggctatgtccgccgtaccgaacaagccgctcgggctttacgatccggccatggataaggactcgtgtggagtgggattcgtggcggaactgtccggcgaaagtagccgcaaaacggtgactgatgctttggagatgctggtgcgcatgacgcacagaggtgcttgcggctgtgaagccaacactggagatggagcagggatcatggtggctctacctcaccagttttacaaggag

SEQ ID NO: 73501 - DNA, 348 bp, Glycine max
  Peptide Sequence Number=SeqID_190279
atgacttccgctcctacttggccgaagccccaacaaacccctcacgacacttaccaatatgcccaacatcaaccaagctttttggctcgcgtcggaaactcctccaatctggcactcgtccagcaaagggcacctactcaaccacaaagggcccccactcaaaacttggctcccgcacaacctcgccccgtcggaaactccaatcctagcacaagcacaaattcgggaaggaattttccggtaaaaaaacttgcagaatttactcccatccctatgtcgtacacagacttgctaccatccttgatcgccaaccaaatggcggtggtgacccccaagaagatttactaa

SEQ ID NO: 73502 - DNA, 189 bp, Glycine max
  Peptide Sequence Number=SeqID_190280
atggctgagaagacaaagaaaaaactagaggaagctgctcagtcaggaagcactgagggtgtcattaaccttctatctcccatcagacgacacgtgaagtggaagatagcccgcaccaaggaaactgggcagatgacgtctgaggctgcaaaggaaatcattgaaaagattgattctttggaggagtag

SEQ ID NO: 73503 - DNA, 390 bp, Glycine max
  Peptide Sequence Number=SeqID_190281
atggcacatattgttgacaagataaaaaccattgatggatctaaagaaactctgaaacttgctataaggataactgagctctggtttgttgggacgccgggcaggtctgaacaagctgagatggtcattgttgactctgacggtaatcagatccatgtggtctacatcattggtgtcgttgacgaggttatctttcgtcatatttcacccagaagatcctatccatgctcggttagcaattctttgaaggcttctaaattgactattaatgagccagtggcaccaattgaagaattcaatcaaaagctttcagaattgggcattgagatccactcagttttgacacgtcgttcccagtggagttcacaaccttcaggttctgctcagtaa

SEQ ID NO: 73504 - DNA, 831 bp, Glycine max
  Peptide Sequence Number=SeqID_190282
atggcggatcgcattcacgagagctgggtgacgcgcaagccgggcggcgatggcttcgtcaccaattgcccagctgtacggccagcgcagcgagggcacgccggaacaggcacgctggcgcgagcaggtgatggcgctgacgccgacaggagccgccgcatgaaagcgctgatcctgacactgcttgctctgctgacgctgccggcgtgggcgacgcagcgcatcattactatcgggggcgatgtaacgcagatcgtctacgcgctggatgcgcaggcgcagctggtggcgcgcgacagcaccagccagcatccggcggcggccaccaggctgccggatgtcggctacatgcgccagctcaacgcggaaggcattctggcactgaaaccgacgctggtactggccagcgcgctggctaaaccatcgctggtgttgcagcaggtggcggacgccggggtaacggtggtggaggtcagtggggataaccgcctcgatgccatcacggacaaaatcgccaccattggcaacgcgctgcagcgtgaacaggcggcccgcgcgttgatcgacaaagtcaacaaacagcgtgcgcagctaccgcagcggccgctgccggtgaaagtgctgtttatcatggcgcacggcggcttacgcacccaggcggctggtgcgcagaccggcgctgacggcgcaattcgcgctgccggcctggtcaatgccatgggcgcggtgccgcactatcagcagctgtcacaggagggcgtcgtggcggcggcaccggatttggtggtggtcggcgaagaggggctgcgcacgctgggtggcgaacaggcg

SEQ ID NO: 73505 - DNA, 210 bp, Glycine max
  Peptide Sequence Number=SeqID_190283
atgctacaatgcgaaaggtatttctctcatctcaaacatgatatcaaaattcccaacggtgagaatgctcgtaattggggctgcaaacatagtgctcaaatttcacgacgatccaacggtggcctgcgggaaaaagagagggttttgggagaagagagaagaaatgaaattgtgaggcaggggaggctgaggagtcagtctgaaaactga

SEQ ID NO: 73506 - DNA, 501 bp, Glycine max
  Peptide Sequence Number=SeqID_190284
atgcgggaggaccctgtgcaacctgaaaatattcatctggataatccactgacaagccgggaagaggtgctacggctggtcaacgacatgctgaacgcggtggcgccctggtttaaaaaagacgccagccgcattgatttagcgaactttaccgctcactacggtcagcaggtggcgagcatggaaacgttttcccgcctgctgtggggcgtgacgccgctgttggctggcggcagcgagccgcagcacttctcattctatttacaggcgataaaaaacggtaccgatccgcagcatgccgattactggggcgatgtcgggccttacgatcagcgaatcgtcgagatggcggcctacgggctgctgctggcgctggcgggtgaaaccgtactggcacacttcactgagacggagaaagagcatttatggcgctggctaaagcagtgcgagacccaggaaatccccgataacaactggcacttcttcccgattctggtgcag

SEQ ID NO: 73507 - DNA, 459 bp, Glycine max
  Peptide Sequence Number=SeqID_190285
gaacgtgaaatggaactccaacgtcttaatcaaaatgaagaaaccgacaaaaagaaaagaagtatagcacttaaagcctcctcgtcaatgcaagcagaaaatgaagaagaagaatcagaagatgaagaagacttctcactctttgtgaagaagtttcaaaaatttgtcaagaagagaagaatcgagaggcgtcaaaacttcaacaatggaagaagatctcaagaagactctcaaattcttagatgctacaaatgcaaccaacttggtcacataaaagcaaattgtccctcaaatgaggaatggcctgagaagagtgataagaaaaggtatgaagaaagaaggaccaagaaggcgtacattgcatgggatgacaatgactcatccgatggttcagagaaggaaatcaaccttctaaccaaggactatgagagtgatgagaacatctctcaagtagattaa

SEQ ID NO: 73508 - DNA, 342 bp, Glycine max
  Peptide Sequence Number=SeqID_190286
atggtgcaaaagaaggacaaaaaacttaggggaagtagcaacatggtcgtcggcagttaccataagtggttgaaagcctacgcacaaggtctggattggctcccgaatttgagagtcattaaagaggtggaggttgaagctccagaagaaggagaagaggtacaagccttcagaatggagcttgagaaagcccaagcggtcaaggaaaagttcaagtcagtagctgttaggatccgaaaagagaacaccgaactgagagacatcaacatagccaccaccaaggccttgcaacaagagaccaagagggcccgcaaggaagaatacggccggaacaagttctaa

SEQ ID NO: 73509 - DNA, 447 bp, Glycine max
  Peptide Sequence Number=SeqID_190287
atgggtgacctagaggaagtacaggaacagatgaaagctgacatgttggctttcaaagaacaaatggcttccatgatggatgccatgttgggaatgaaacaactaatggagagtaacatggccatcgccgccgctgttagttcggctgccgaagcagacccgactctctcaactaccgcccaccaccctattccaaacatggtgggacgagagggaagcacatcgaggcatatcaacaacccccattcgtggtacaaccgaggtacttatccctatggtttaccacccaattacacaccaccagccatacatgaagacgtgggtcacgttcctaccctcatcctcgaaggggaacctcctcgacatcctgacggggtccacgagaatcctcaagagcatgctcagggagacatcaactcctactgtagaagcaaagcttcatggtga

SEQ ID NO: 73510 - DNA, 135 bp, Glycine max
  Peptide Sequence Number=SeqID_190288
atggtaaggagaggtgaaaaagtggctaagcgcttatccaccgctaagcgcagcttcagagcgcttagtgcaaaggagaatctggcagagcatcagcatcaaagccgcgtgctaagcgcgagatcagtgcgctaa

SEQ ID NO: 73511 - DNA, 270 bp, Glycine max
  Peptide Sequence Number=SeqID_190289
atggtcattgaccaatccctcttctatgatttgacccaattgtctagtgatggtgtaccatttgaaggtgcactggatgatgattggaagtgtgatttttctgtgcatgatgcctgccggttggtctgcaccaaccaagtggatatgaccggaaggctgcttgtcggttcattagctcttgaaagtcgcatcctccattataaatctttcttgatcggtgctgctatggttgcctcctttggttaccgcaaagagcgtgatggctcttag

SEQ ID NO: 73512 - DNA, 351 bp, Glycine max
  Peptide Sequence Number=SeqID_190290
atgtccacagcggaagacagcttcttccgtggaatctcgtggaagacgtctttcgtgagcactcacggaagaagctgtcttccgatgtgcagcggaaaaaagcttcttccgtggaatttcgcggaagatgtcttccgcgagatcccacggaagaagatttcatccgctgttgacattacaactgcggaagactgcttcttccgtggaatctcgcggaagatcggggtgggagtagcgacagtgctggtggtggtggtgttggtggaatggtggtgtggaggtgacgataatggtaggggtggaatagtggcgacaacgatggtggcagtagtggtggaatggtcatggtga

SEQ ID NO: 73513 - DNA, 555 bp, Glycine max
  Peptide Sequence Number=SeqID_190291
atggataagagcttgaaggttggagaagatgagtggagggagaaggagcaaaggagcatgaaattttgtgccgcaaatgagcccatgggcccaaaatctaccctaaggctcatgagaatcctagggccttctcctacatctctgacccaatcttcttggagtcttctatccaatgcccttgggggggtaagatttgaaaacccctttcctaggcatctttccatgagggaacatggttcctcaccaactcaaaatgtaagctacatgtgtttgacagctcacttaatagataacgattggaagttgcacaaaaagattttgaattttcgccaaagaaaagggataggtctgccttcctgtgaagattgggaatatgttgaggctactctacctttcttgagcatcttctatgaagccactctgggcatctcaggtacctcttatgttactagtaacatgtacatgttagaggtggtaggtatttggcatgggattaacgattttcttaactgcaacattaaagatagtgctacacataagatggctaaaatatga

SEQ ID NO: 73514 - DNA, 327 bp, Glycine max
  Peptide Sequence Number=SeqID_190292
atggaggctaccctcccttccaactggaagagtttgactatcaaaaagtatgatggtacaagtgacccgaatgagcacctagacatttatgtcactcaagtcaacctgaaccaagttcaagttgaggccacgtcaactagaaaggagatcgaaaggcccaactttaacaaaactagtgaggaaggacgaagggatcagtctccccgagaacctcgttacacttattacacccctctcagcgtgagcatatctcatatcttagatcaagccttggctatcgaaatcctagccatgccaaaaaaagacaacactccgcccaaggcatag

SEQ ID NO: 73515 - DNA, 729 bp, Glycine max
  Peptide Sequence Number=SeqID_190293
atggcttcagatgctgacatggaggactacggtttcgagtactccgatgaggaggaagtggagcaagacgttgatatcgagaatcaatattacaattcaaaaggtatggtagaaagtgatccagaaggtgcgcttgctggttttgctcaggtagtgcaaatggaacaagaaaaagcagaatggggatttaaagctctaaaacagactgtcaagctatattatcgactgggaaggtataaagagatgatggaagcctatagggagatgttgacatatattaagtcagcagtgactcgtaactatagtgaaaaatgcataaacagcattatggactatgtctcaggttcagcaagccagaactttggccttctccaggaattctaccagactactctgaggtcccttgaagatgcaaagaacgagagattgtggtttaagacaaatctgaagctttgcaagatatattttgatattggtgaatatgggcgtatgaataagatcttgaaggaacttcacaaatcttgtcaaaaagaagatggcacagatgaccacaaaaaaggaactcaacttttggaggtatatgctgtagagattcaaatgtacacagagaccaagaacaacaaaaaacttaagagggcgagccctggtgcagcggtaaagttgtgccttggtgacttgttggtcatgggttcgaatccgaacacagcctctttgcatatgcaagggtaa

SEQ ID NO: 73516 - DNA, 735 bp, Glycine max
  Peptide Sequence Number=SeqID_190294
atggcggaagaaacgaacaaagctagccaatggaggatgccaatagctgtggaggagaagatgggaaccaaatttgaaatcgagaagcaaatgaaggagaagaacgaaggaagaagacaaagtggaaggagaagaacgaaagcttgctggttcactgaattgctgggtgcaccagcaattttgctgggtgcacctagcaacgccctttcctttcacatatcaaagtgtcccaatcggagccaatcctcgaagctcggatacttggaagcaggtgtggagtggaaggtggggaatggggagcaagtcagattttggtgtgatgagtgggtgggagatcaaagtcttgccacgttatatcctaggctttttctcaattcattaataaaactgaggaagttagcaaagtgggaatatgggaagagggagtttagaggtatgttgagagaccttgaacaaattgtggcaagttgtgacctacaaagggaccgcttggatgcttggagatggagaggtaatccgagtggtgtgtattcggtagattcagcttatcaacaacttttgggggatactttggatcaacaaattcatagaatcttcaccactttatggaaacagaatatacctctgaaagtgaggttttttctatggagattgttcttgaataggttgcccaccttggataacttgaaaaagaagaatagtagcggaatcagtgtggaagacgatctattctag

SEQ ID NO: 73517 - DNA, 234 bp, Glycine max
  Peptide Sequence Number=SeqID_190295
atggaaaatcaagaaagtggacatcaagatacaactcatggtcctggctatactccttcaccttttgctggtcatgccccttcaacaacaccaaatgaatccattccaccacatgaagcaaaagaaacaactgataatttggaggggacaacacaaataggaacaagaaggcttcaaagtgagatttggcagcattttaaaaaggtcaaagttaatgaacaagacaaggcctga

SEQ ID NO: 73518 - DNA, 222 bp, Glycine max
  Peptide Sequence Number=SeqID_190296
atgaagacattaaacaccagtttcgatggtaaatctgatcaacctacatctcgatggattgaagtaaagagccatgttcaaaccagaggctatgagtgcggatatgtcatgcatcggatgtggaacatagtcagcggaggtttgaagaatgaatggagcatgtggtttgatgatgaaacagtgtttgacatcgaggccataacaacaattcgcaagaaatag

SEQ ID NO: 73519 - DNA, 234 bp, Glycine max
  Peptide Sequence Number=SeqID_190297
atgcttgaatgtaatgttgacattcatcacgtttatcctttgcattgtgtatggactaaggctcaaggaaaccatacgatgcaatcctaccccgcaagggcattggatagaagactccaagtagattgggccaaagatgcaagagaaggccctagggttcttatgagccttagggtagggtaccctagaaatatagggattttcagcccttgtattttagggcacctagactag

SEQ ID NO: 73520 - DNA, 213 bp, Glycine max
  Peptide Sequence Number=SeqID_190298
atgactgggggcactagtggtggaatggaagcaaggtcaaaacaatgggataacaacaaaattgaagactttattgatgctttgttacttcctgccatcaataaccagcttgttactgccactggttgctacaatatgaccaagtgtccaaaggaaatacgggagattgaggtagtgatggtagaggcaccatggctagctcagaagatctag

SEQ ID NO: 73521 - DNA, 748 bp, Glycine max
  Peptide Sequence Number=SeqID_190299
tgttctaactccatactacagtgaagagactgcctattcgaagaatgaccttgagcttgaaaatgaagatgatgagtggactaacttcatggaacgacttgattgtaagaaagatagtgagatatggaagaaagatgaacacatattgcagctacgacactgggcctcgttacgaggagtaactcttagcaggatagtaaggggaatgatgtactaccggcgggctattaagcttcaggcttttcttgatatggcaaatgaacaggagatacttgatggctataaagcagttattgttccatctgaggaagataaaaagagccatagatccttatatgtcaaatcaagaaacaagctttgtcataattggtcaaagagttcttgcaagatcactgaagattttgtgtttgtgatttttgctgcggtggagacccttttggttttgggttgtgctttgggttttcaggatggtggggtttctgtaagttcaactacatcaaaacttgccaatcccaatattcgattaccaggaacaacttcagcaaattccagagcttcttcagctgcacttggtcaaaagaaattgtatgcagaatcccagacaggaaagtccacttttcaaaagcttttggagccaatgcttcctcaacttcctggaatttctccttatagaattgtcctggggaatgttaaggataaggtattgcttctaattcattctggtgataaatacttgacaaaaaaatga

SEQ ID NO: 73522 - DNA, 666 bp, Glycine max
  Peptide Sequence Number=SeqID_190300
atggttcaaaacacaatcttgaattggacatcttataagagcagtaattttatggcatactgtgctcctcaaaatttgtctcggtgtctccctaagattgttcccaaattgactaaggttgggagtgtgataaagagtccagaaatatctggtcttgtccctactctacttaaggaactttgtcatcctaatgagcatacaaaatattcctttaatattcttcttcaagtaaggcttttaataatgttttcagttgtggtatcacttgctaaacaatgggcatttgaagaaccttatgtggagacaataactagtgaaaatgttttgacatggccacatgtgggaagcaaaggcaggtgcagtttgcagtttgtggaatgtccaaatgatatcaatggcatgatagatgccgcgaagtttgacgatttaacacttcttcttatcgatggaagttatggtttcgaaatgaatgacaaaatagaagctttggataaatatcagcctgggactggttctgatgaagatgaagatgcaccaaatagtactgctaagaatggagtccacttgcaagaacatattgattttcatgatggaagatggaggagaagagcaatatttgaaaatgattgtgtagtcaataaaattaatgtttgtttatttgggtag

SEQ ID NO: 73523 - DNA, 171 bp, Glycine max
  Peptide Sequence Number=SeqID_190301
atgcaggttagctcgcctgggcgagctgagctcacctgggcgagcaacccctgcacgagggtggttaaaaaggggagggggaagaaattttttgcgttatggctctcagttatttcatcaccgtttttgcgacttactattttgtgcatttttcgtttaccttgtggttag

SEQ ID NO: 73524 - DNA, 828 bp, Glycine max
  Peptide Sequence Number=SeqID_190302
atggaagagttgttggtattggtcttggagaatggtgagtccctggtagattttggggaccaaatcccgaggagtgttggagttgaagctctctactccttctggcaacccaacttgttcacatgggaacttgacaacgtgggttctaatagcgtggccgcggtcacggtcgcgatcgatagagctttggaaaatggcggcagtggctgtggtggtgattatggtgacatcaacaccatgaatggcaaagagcctagctatgtctactacgggaatgagataatatatgtgacacaaatagacgaattagtcactaaaataattgtcaacgcggcatgtcatcgtcctccgcgggctcaccaacaccagcctttgcttccactccaccataaacgacaccttgggaatggagccacacatgggaaccacgcgctttgtcgggatgaccaccgccacgacagagaggaaaagcttgagatccctagggggagatggttacaggaaagggaagttgagttgacaatcaaagttatgcagaagaagggatctattgagtattacaaaaacaacccagcaatgtccatgtgtactttggaagaaagattttatccctctccgacttgggtaatgaaagcatgggaaacaactcaagatgaaatgatgattgctggtggtctgcatgttgtggtttttaacaaaatggttgtgttcacggtgttcaatcattttaaaattgacacttttgaagcttcatgtcttatactgtggcagtctactttctggatgaacctggtcctaggaatcatatgccaagagtacatgttttga

SEQ ID NO: 73525 - DNA, 1635 bp, Glycine max
  Peptide Sequence Number=SeqID_190303
ggatctcaagcttttcctctctgtcgtggcggtggtcatcccgacaaagcgcgtggttcccatgtgtggctccattcccaaggtgtcgtttatggtggagtggaagcaaaggctggtgttggtgagcccgcggaggacgatgacatgccgcgtgaacatgatcacaaactaaagcttgtttctcttccctttgtatcaaccagtcacctcattcccgtagtagacatagctaggctctttgccattcatggtgttgatgtcaccataatcaccaccacagccactgccgccattttccaaagctctatcgatcgcgaccgtgaccgcggccacgctattagaacccacgttgtcaagttcccatgtgaacaagttgggttgccagaaggagtagagagcttcaactccaacactcctcgggatttggtccccaaaatctaccagggactcaccattctccaagaccaataccaacaactcttccatgacttgcagcctgatttcttgttcaccgacatgttctacccctggactgtggatgctgctgctaagttgggaattccacggctcatttatgttagtggaggttaccttgctcactcttctcagaacacaattgaacaattctcacctcacaccaaggtagattcggatactgagagttttctgcttcctggattgccccatgaattgaagatgacgcgtttgcagttaccggattggcttagagcaccgacaggttatacttatttgatgaacatgatgaaagactcggagagaaagagctatggatcgctgttgaatactttttatgagcttgagggagattatgaggagcattacaagaaggccatgggaactaaaagttggagtgttggaccagtttccttttgggtgaaccaagatgctttggataaggccgatagagggcatgccaaagaagagcaaggggaaggagaagaagggtggctcacatggcttgattccaagacagagaactctgttctctatgtgagttttgggagcatgaacaagttccctactcctcaacttgttgaaatagctcatgcccttgaggattcagaccatgatttcatttgggtggttaggaaaaagggtgaaagtgaagacggggaaggcaatgactttctccaagagtttgataagagagtgaaagcaagcaacaaggggtatctaatatggggttgggcaccacaacttctcatactagagcatcatgccattggagctgtggtgacacactgtggatggaacacaataatcgaaagtgttaatgctggtttgccaatggctacttggcctctgtttgctgagcagttttacaatgagaagttgctggctgaggtgctgagaattggggtgccagtgggggcaaaggaatggaggaattggaatgagtttggagatgaggtggtaaaaagggaagagataggaaatgcaattggtgttttgatgggtggtgaagagtctatagaaatgaggagaagagcaaaagcacttagtgatgctgctaagaaagctattcaggttggagggtcttctcacaacaatttgaaagaactgatccaggagttgaagtcactcaaactgcagaaggccaaccacaaaagttag

SEQ ID NO: 73526 - DNA, 237 bp, Glycine max
  Peptide Sequence Number=SeqID_190304
atgccagttacagtgcgaaacagacgatcattcaatgttttgatcaaggatgcgaagatgcccaaaggggagggcaaaaaggtcattttaaggctttttctgaaccctagctcgcctaggctagcctctggctcacctaggccaccaaataacttcatgcgtgaaaaaggggctgaaagggaggttctgaggtccgaaggtgaaggattggagagaaagaagagaaaaagaagctaa

SEQ ID NO: 73527 - DNA, 333 bp, Glycine max
  Peptide Sequence Number=SeqID_190305
atgaccattttaccctccccttttggtattttcacatccttgatcacaacattgaatgatcatctgtttcgcaccatactggcatttaacattacaagtcgattagcaaggatcaaaagatcatcaaacgatagtcccttgacaaaattaaggagcctcgagtttaagaagattgggttggctgagaaagatctctttggagggaacacaaagttgacaaatttttgcctcgataagctacacctacttcgtggttctgcctttcttcgccgcaagaagcctctagataatatcatcaagcacattctcatccatcttgggaaaatttcataa

SEQ ID NO: 73528 - DNA, 276 bp, Glycine max
  Peptide Sequence Number=SeqID_190306
atgtccccaatggagtttccaactatcgcaacctaccctttggcgggggtgcgaaaaggccgtgatcatgggccaaggcatttgtctccaagggagaacacaagcggagtcgccaccaacgtttatttgaggaaaacgttagaaaaacaaaaaaataggtctgcgaatattaaaaatgagggttcgggagttgtttacacacggggaagattgattttaaccgcaaacaaaagtcgtttaaggtgttggaccttgaaacgatcttttgatttttga

SEQ ID NO: 73529 - DNA, 396 bp, Glycine max
  Peptide Sequence Number=SeqID_190307
atggcgatagaacctcttccaccatcaaggagaattgtggacgaaagtggatgggaatggcagctgctatggaggaggctttttagggaagtggagatagatatagttgcaaaattcatggaggacatcaagggtatggtactgctaccaacaaaggccaatttgaggaggaggaatgtggatctgaatgatgcatcttgccctttctgtcgatctactaaggaggatgcgtcccatctgttttttggctgtgataaaatattgcctctatggtgggaagcattgtcttggttaaacatagctggtgcttttccagaatcacctagagaccattttcttcagcactctcacggatatctcaagggtattagaattcagcgatggcaaacgtggtga

SEQ ID NO: 73530 - DNA, 384 bp, Glycine max
  Peptide Sequence Number=SeqID_190308
atggtgtgcgacattgaaagaagggtatcaaaggtgtttaacttatttgcaaattttctgtttgtgaagagtgaagctgaatctaaagaagggaatggtttgaagttagtggggagtaacagaaaaggtggtttggttggaagaagtgagaatggtgtgactggtcaagtgaaagatttgcagacgtggtctagtcggcatttgacagttgaggtctcagatagttttgctgccactttgcctggtctgcaaactcaaacctgtgatgatgaagcttcgacggcaagttctggatttggttctgatgagaaaactatcaaggcagtttttgaacaaatgaaggtgaggtataacaaagcttgtatactgttatgtctggattaa

SEQ ID NO: 73531 - DNA, 396 bp, Glycine max
  Peptide Sequence Number=SeqID_190309
atgaggattgacacacattacgagaaaggaacagatgaacgaggtacactaagggatggtccgaacaattcaaaggaacttgggggaatatggagtagtgataacctgactaagggcattgccaatgatgcaatgccctatattggattcgactcctcatctgaggatattgaggtcatttcccctattctgatgtctcccagattagagttgcatgagtctcaggtaccacctgaggtagattgggtagatctcatgttagaggactatagagaggatttggagaaggacacaccttttgaggaggatttgtcgatgaataaggaggattctgtcatgaagctagagtgtatggaggaggattcttcacaggattcctctaagaagtctttctag

SEQ ID NO: 73532 - DNA, 756 bp, Glycine max
  Peptide Sequence Number=SeqID_190310
atgaatgaggaagaggataaattgagaaaacaattgcatgaggatttatggcgggtagcaagctcagttgaatccattgcttggcaaaaggcaagatcaagatggattaaggaagaggattgcaactctagatattttcacttgactgtaaattggaagcgacgttacaatatgcttagaggagtgagatttgaggaacctgattgggagagaccgaggctgaatggggtcagattcaagtctattgatcagcaacataatgatctgttggtggcacgtattgaagaggaggaagtgagggcagcaatctgggattgtggtagtgcgaaaagccttggaccagatggattaaattttaaattcatcaaagagttccgggatatcctcaaaccagatgtgcttcccttttttaatgaatctcatgctaatggagctatccccaaagctagcaatgcatcttttctggtgctgatccctaagccaaatgagttttcccctcagagaggtctcaggcaagaagatccactagtcccattcttgttcaacattgtagctgaggggctaactggattgatgcgagaagctcaggataagaatctatttgaagggtttaaggtagggagggatgaggtggatatcaagggctccaaagaaggtggtcaggagactagtgaggttgcagcggtggttcttgtgggggagttcaaaccagcagaagaatgcatgggtaaactgggagacaatctgtctgcctaa

SEQ ID NO: 73533 - DNA, 570 bp, Glycine max
  Peptide Sequence Number=SeqID_190311
atgcctaaagtgggactaggagactatgtaagtgacaaagacaagttctgtatgtacaaggccaagaacaagaagaatcatattccttatggaatttttttcactcagatcatgaggaatattggagtagatgtctctgtgatggaactatctacaagaaccacgcaacttaaagaaactaaacaatctctaggggagtctagaagaaaagctaagatagataaacatcttgagaggaaatatgccatacaaatagaagcagacatcattgcatttgttgaagctatgtctatagaagaacataagaagaaagaggctgaggacacaactctaaaggtcttggtgagtaaagattctaaagaaattctagaagatattgttttagaatctctaaagactttgtttactgatgaaattcaaaggaaaatagttcaagaggctaccatagttgttgttgatggtgagccaatactagaagaagccatcataaaatctatgcaagcacagtctgcactggaagctaaacaagttgagttcgaagagcttgagagacttcagtctacaatttag

SEQ ID NO: 73534 - DNA, 150 bp, Glycine max
  Peptide Sequence Number=SeqID_190312
atggagattgttggtagaaaaagattgcttgtggtggaaggtcttggagatggtaaaactagttcttggcggtggacatcaataagaaggctgggtgatgggtgtagaggcatgaagaaggggtggtttctagggttcttaaagtgtcag

SEQ ID NO: 73535 - DNA, 267 bp, Glycine max
  Peptide Sequence Number=SeqID_190313
atggaggaggagaggttcaatggagaagttctcttaaagaagtctattgcacaaggtgagaaggttttatcaatattaggcaatggtaaaggctatatggagggttgcaagggggggcttggaggtagactgaagaaaaaagagattgaagtgtttattgttggggtgtatggtccttgcaagctaagcaagagaaaaagagatgtgggtgagatggtgaaatttaaaaaggacaaaaggggtgatagatggtgtttttttgggtga

SEQ ID NO: 73536 - DNA, 180 bp, Glycine max
  Peptide Sequence Number=SeqID_190314
atgcaaaagataccaaaagggaggggcaaaaggatcatttcaggaaattttttgaaccctagctcgcccaggctagcctctaactcgcctgggtcaccaaaagacttccatgttaagcgtgaagggaggctgatcaaggggttggaaggtccaaaaggtcaggaattgagagaagaataa

SEQ ID NO: 73537 - DNA, 495 bp, Glycine max
  Peptide Sequence Number=SeqID_190315
atgcgtgttagcacaaagggtagctgcgctggacctgaaggaagcagattacttaaagagcttttgaatggtgatgacgatctgatgggcttgttcgtagttgtagggcaaaatattgtgcttgcgggcttgggaaaagtgtttgagaattcattcaccatacgtaatattcgttatgaaaatgatgttgttaaggttcaggttgtcagaacatacatgcctcacgctgaggtccctattcctacatcagaggtggtcgtaggacccgataagcctccatcaaagtctattggagaaccgaacaggttaacatctgtggccatagatggcccactgggagaattggttaagaagtcatatgtggtttacacaaagccaatggagttggcatgggatggggcgaaatttgggttacctaatgccacaaatggttttttcgtcacacatgcagatgtgactgaaatcattttagctgtggatgatgtttatgaatga

SEQ ID NO: 73538 - DNA, 180 bp, Glycine max
  Peptide Sequence Number=SeqID_190316
atgacaacagaatggagaaggaggaaaggtgattggggacgtcacttcaaggagaagatgagtcaagaacaagctcaccaccgtaggaagccatacataagagcttcaaggtaccctaaaatacaagggctgaaaaatcctacattactagggtaccctccctacactatggagccctaa

SEQ ID NO: 73539 - DNA, 645 bp, Glycine max
  Peptide Sequence Number=SeqID_190317
atggagattcacatggacaggaaatccaaacaactatggctctcacaacatggctatgttgagaaggtgctagataagttcaacacgagcaatgtgaaacctgtgagtactccatttgcaaaacactttaagctttctataaatcaatgttcaaagatagatgttgaggtgaagtatatgtcaaaggttctctatgccagtgcagttggttgcttgataaggtctacaacaaggtatgtctttacttttggaggtgggcctacttgttggaagtccataattcagtctcttgtggcaatgtcaacaattgaagcgaagtacatggtggtagcagagaccagcaaggaagttgtgtggttagcaaggctagtaaaggagttagggattgaacaaggtggaatttggttgcattatgatagtcaaagtgctatcgatttggcaaacaatcaggtatttcatgctagaaccaagcatattgatgtgaggttccatgagataagggagctgatgacatctggtcaggttttgcttaggaagggcaaagttggagtgaagtgtaaggatcacttgttgttgggttacaaagttggttgggggtgtaggggcaaagccctcgcagaacacataatgttgtacatggattaa

SEQ ID NO: 73540 - DNA, 291 bp, Glycine max
  Peptide Sequence Number=SeqID_190318
atggagcccgggaaggctccgatggtggccttgttaacgtggaggacgacgaggctggtgaggagggtggcggcgagggcgcgacagtcggagggggcggcgggggagaggaagccctcgacgacgaggctgaccttggcgtcgttgtccagggagaggtggaggaggagggagagggcgcggtggcggaggtcggtggcagagatgtgttggaggcagggcaaggaagtggcagtcgaggacgacatcgagctcgtcgtggaagcgggtgatgctcttgtgcaggcgtga

SEQ ID NO: 73541 - DNA, 111 bp, Glycine max
  Peptide Sequence Number=SeqID_190319
atgtcagttgagactgcattaggtacaaagggaaaatatgaggtaatcttagagcttaagaagttagagttgaacatccattatgtaactaggattgccagttgcaactaa

SEQ ID NO: 73542 - DNA, 1176 bp, Glycine max
  Peptide Sequence Number=SeqID_190320
atgtggttgaaaggggtgaagacccctgtggttttgtctggaaatcgcgatgaacgcgctaagcgcgcctgtgcgcgtagcctattcatcgcagctgtcaaaattttggatttccagatgaacgcgctaagcggaccatgtcgcgctaagcgcgctaagcgtgccctgtgcgctaagcctgagtgttattctgttgaggctgagctaagcgtgccatgttgcgctaagctccaactctctttgatggcatctaagaaaaggaaaacaccttctacacctacccaagccagatttgatagatccaagttcacatcccaagagacttgggagagatataccgacattgtggtgcctcgaaagctactaccagagaggaatgtggtagtttattacagagagtttgacgagttcaaggaggaactcgagagaagacattgggatgagaagctgactgatttttttgtcagtagcatagacattgccattgtaaaggagttttacgccaacctctatgatcccgaggataaatcacctaagggattcgagcttaatgttgatgggcagcctttgaagattttgaggaagaacatgaccactctagcccatacatggagcgttctttccttctcgaacctcattcctacctcccacacatctgatgttagcgtggacagagccaagttgatttatggtatcattatgaagatggatatgaacttggggtacctcatctcccaccatatctctctaagtgcacaacatgatacatccagacttggattccctgccttgatcacagctctatgcaaggctagaggagtccaatcagattctagatccctggagaacttgagccctgccattaacttggcttatattaagaagaactgttggaatcttgatgatccaacgatgacatttagagggccaaggaaggctagaggtaagagatcagaggtccccactacttcagcaccacctgagacaccaactccttcttcttccacagctctagtacctttctcagctccagttattcctcctacatctactcagatgtcacttccagctcctatatctgtaggaccatcagactttatatttacacctcaggtgcttcattccatgctccagagcatccacaggggacagtccattatcatgcagagcctttag

SEQ ID NO: 73543 - DNA, 2424 bp, Glycine max
  Peptide Sequence Number=SeqID_190321
atggcgcaacggtccatgggtgaccagaatatgcaatacacccagcgaccagcgattgccggcggcttcgcgattgggttccatctctcctccggtatcacgggagaattaggcatggcggtgttaaacgccatggctaaaaaagtgcagcaacatcctctgattaaaataagtgtattactcagaagcgaggctgcgcatgccacgtccggcccacttaaaacccggctggatgcgctgcaaaagctaaatatcactgtggcggaaggcgacctgcagaaaaatagcctgagcgaactctcagcattatttcgcacttatgatgccatcattaattgcagtggttttgtcggcgggccgggaacgcagctcagaattactcaggccgtgctgaaggcgggtgtcgcccgctattttccctggcagtttggcgtggattatgacgttatcggcaaagagagtgggcaaccggtatgggatgagcagcttgaagtgcgccacctgctgcgcgcccaaagcaacactgactgggtaattgtttcgaccggtatttttaccagctatctgtttgaacccgattttggcgtgatcgatgccgggaataaaacggtttatgccctcggtgactggaactatgccctgacactcaccacgccagacgacatcgggcagctgacagccgatatcttctttcatcagcccgcttttcagaacgacattgtttatatcgctggcgatacgctgacttacgcagagctggctgacctgatgcaatctcactggcaaagcgcggtcaggcgagtattacttagccgggaaaggctaagagaagatgcagagcgtcatccccgtgacactggcgcggcctaccggctggcctttgcccgtccggacggtgtggcatggcctaaacaggagacatttaattaccgcgagcacattgccaccaccagcgccgctcagtggctgacgaaccagccagcagcagtcagcagaaaactcatgctcgggtttggtgtgctgcttatcctcagcattgctgtagcttcctgtggcatcaaaaacctgcacgacatcgcggaacgtgcggaaaaactcagccagttgaaaggcatcaacgatcagttcgcgcaggctaaagatgcccgcctgcaatacgtaaaaacccacgatgaaaaattcattgccgacaacgaatcgcgactgcaggcgattgagggcagtatcaaccagctgaaaacctggcgatgggatagcgcgcagaccgcgctgattgcctctctgccggctgcgatgaacctttatcgtcagcatcgtgcagaaacggtgaacgaagtgcataagcgccagagcattctgcaggcgctgcgcttcagtgacgaaaccacggcggttgccgcgctggccagaaactatgtcagcacacagcaggatacggcaaccgcgctcaatgaaatcgctaaatatctgaatggtatcagtattcgtgtaaagctgatggcgctggacaacactgaggaaaaccgtctggctttgtcaggctttatagctgaaacgattcaactcattgacgaggctcgaccacgcctgagcgctgatgacagcaacgcgctggataaaattgccgtaacgctggcggccagacgcgacagcgtgcaggactacaacgcctccgcggaagaagaagtggaagcgacccgccagcttgccatcgcgggcctgcatctgaccaataccagtaatcaattatttacccagcagctggccgccacgcaccaggatatcgcccgggcaatcctgtggatgtcgctgatcctggcggcggctgtggtaatcagcattctgattgcggtgtttatcacccggcagattacccgtcctttagcggtaacactgaacgtcgcgcggcagattgcgcagggagatttgagcgtacagctgcaaacttcgcgtaaggacgaactgggcgagctgatgcaggcggtcggtgagatgagcaacgatctgcgcggcatcattggtaacattcgcagcggcgtgatgcaggtcagccacgcttccgcagaaattgctgcaggcaataacgatctttccgcccgcaccgaggagcaggcggccgcgctggagcagacggcagccagcatggagcagttaaccgctaccgtgaagcagaacgtggaaaacattcatcactccagcgaactggcgcgtgccacttcagagaaggccaatcagggcggctcgctggtcaaaggcgtggttgaaaccatggaccagatcagcgccagctccggcaaaatcgccgaaatcaccaccgtcatcaacagcattgctttccagaccaatatcctggcgttaaacgcagcagtagaagcagcgcgcgccggtgagcagggacgcggctttgccgtggtcgccagtgag

SEQ ID NO: 73544 - DNA, 291 bp, Glycine max
  Peptide Sequence Number=SeqID_190322
atgaggagaaaacacgttgtctcggaccagaagattttattcagattatttgcggagcctgtgatgcgtcactcgcaattcatgaagagtatgccggagatatcgcataaagtcctgactcaacatctgcgcaagcttgaacgtgatgggctgataacccgcactgattttggtgaacagcccccacgtgttgaatacgcactcacgcatgcaggccataatatgatgcccgtgctgctctcaatgcgtgaattctcacgagacaacctgtcaaaaccgggacaggattaa

SEQ ID NO: 73545 - DNA, 339 bp, Glycine max
  Peptide Sequence Number=SeqID_190323
atgcctatgatattagccgagggcgagactttaccagcatattccagatactgcaggttgcccacagattataaagagattaaggctgccttatgtataccaggccgagggaaagatttgacgactcttgctcaagtatggagtattctctcatattccaacctggctcctacttcacacacctcagacctgacagtagatagagcttggttgatctttggcctagtctctcagatggacatgaatgtgggagcccttatctctggccagatcacatctatagcccagtctaactcttctagacttgggttccctgctctggatcatcaccctgtgtaa

SEQ ID NO: 73546 - DNA, 825 bp, Glycine max
  Peptide Sequence Number=SeqID_190324
atgaatttggcatttgattttttttcaacgccttcgaagaaaaaactggcatcgatttccaaagactggatgaggtccaacaaaaccggaagagaaggaattgttctcccattttcaatcctggacacaagtccattgcttacattggctttaaaggccagctcgttgatgggacttcaggaaaaaggctatgagatttctgtagcttttgacggacgtacaggagtacagctggtagaagccaatgattttgatctggtaattttggatattatgctgcccgaaatgaatggacttgatgtctgcaaggaaataagaaagaccaatcagcatgttcctattctttttctgactgcattgggaacctccgagaatattgtccttggcctggagagtggcggagatgattatctggtaaaaccttttaaatttatagaactggttgcccgggtaaaatccctgctgcgaagaagcgttaataataccgcgacccaagaagcggtagaaccggatgcggatagtgaatatatttatcaggtttccgatctgatcgtgaatgattatactaaaaaggtaacccgtgcaggagaagaagtttcccttacctccacagaatataagctgttgatgtattttctgaataatacggaaaaagtaatttcccgggcagaaattctggacgccgtgtggggcgtgaattatgagctggggactaatgtggtagatgtatacgttaattatcttaggaaaaagctcgacaaccaggatgatcaaaagctgattcacacggtaatcgggatgggatatgttttaaaaaaaccttag

SEQ ID NO: 73547 - DNA, 357 bp, Glycine max
  Peptide Sequence Number=SeqID_190325
atgacttacaccaagaaaactgatcaaatgatgtttgaggcggcaaaggaaattgctaacaagattgtaagattccatggaggagcaggcttcacaggattccattgtcgcccatggacattaagatccgatgtcacgatcaaacaatactttggaccggctccaaggacctcccacacgtcttcgtccatgtctccgaaagacatggagcagttgagccaaaaaatcagggaccagctagaggagtggatcacagaaaaagtgactcgacaggtactcgcactacctcctgagcctgaggatggtcgttcaactactcatgtcagcacaaaggaaaatgttgtcatctggttttga

SEQ ID NO: 73548 - DNA, 242 bp, Glycine max
  Peptide Sequence Number=SeqID_190326
atgaaaaagcttcaggacaaagttgccctcgtaaccggcgcatctaaaggcattggtgcggcgattgcccgccagctggccgccgacggcgcaaaggtcgtcgtcaactatgccgccgataaaaacggggcggataaggtggtcgccgccattgaggccgccggtggctcggcgctggcgctggcagcggatgtcaccgatcagtcgcaggttgaggcactcattcaatctaccctcgcgca

SEQ ID NO: 73549 - DNA, 687 bp, Glycine max
  Peptide Sequence Number=SeqID_190327
atggaatggagcgatgtacgcatctttctggcagtgatgcgcagcggatcgtatggcgaggccgcgcgccggctcggcgtcagccatccgaccgtgggtcgtcgcattaaggtgctggaagcgcaggcccatcaggcgctgtttcgccgcacgccgtatggcctggtgttaactgatgccggtgacgccgtgctgggcctggcggaaagtatggaaaatgctgcgctggcgatggagagacgactggcgggcaatcacccgcgactggaaggtattttacgcatctcctgtgccgagtggtttgccaccgccgtgctggcaccggtgctgagcgagctgacacagcgccatcccgctatcgtgccggaaatcatcgccagctaccgtttgctcaatctgtcgcgacgcgacgccgacgtggcttttcgcattgtgccttttaccgagccggatatcgtccagcggcgcctgatgagcatgccctatgcgttatacggcacgcctgaaaatgcccgcgcattgcaacacgatcccgcctcagtggggctgatcctgatgaataccgcgcaagcgcattttccggacgtcgtctggctgctcgatcaatttccacagtcacggcgggcttttaccagcaccagccgggcggtgcaggcgcagatgtgccagcgcggcatgggcgtggcg

SEQ ID NO: 73550 - DNA, 297 bp, Glycine max
  Peptide Sequence Number=SeqID_190328
atgggtttccttcggtttttccgactttttccacaaataaacgttggtggcgactccgcgcatctttcctcctttggaaagcgcacccgtgagcctcaccttgcacgcccgcaaaagagcatgttgcgacagaaggtaactatagtgctatcattcaacgcattcttccacctaagcacaaagatcctagagttgtcacaataccgtgttctattggtgagaaatagagataatgcccacacgcatgaccctccagttagccgacctctccatcacaaggccatatggagtgattga

SEQ ID NO: 73551 - DNA, 408 bp, Glycine max
  Peptide Sequence Number=SeqID_190329
atgggtgccaagtacctcgaagtggtcaaacgagggttgcatcctaacaacggatggtccccggacgaaattaggtttctcccacaaccacaacccttgcattttgcactggggagagtccttcttgctttggcagaaaagggaaaattggatcatatagaggaaaggctcagggccattgaaggaggcagagatcatgcttttgctaacatgactgagttatacctagtgcctgacatagtcatccttctgaagttcatggtaccggatttcgataagtacaaggggaccacttgccccaagaatcatctgaaaatgtactatcagaagatgggggtgtacgtgaaagatgaaaaactgttgatgcatttcttccaagaaagtcttactggggcagctgtcacctga

SEQ ID NO: 73552 - DNA, 914 bp, Glycine max
  Peptide Sequence Number=SeqID_190330
atgaccccaagctttgggactggctggcagcggcttaccaggggcagggcaagcagatgctgcggcatcaagcgttgggtgaaagctatgtgcgcaaatatgatttaccgcgggcgattgaccagtttgatatcgccagcaaagcgaaggatggtctggtgttgacggcgataccattctggctggtctcacgcaagctggaggctgctccttggtttgcgcaagcgtttgaggccaagcaaactgatcaggtgatggcggcgctcaaagccactgcggtcccggtgacgcctgagttgcagattgaagcaccgcaaaaagctgaaaatggcgcggtggtacaagtcgagctgaccagtcatcagcctgcaggcagtgtaagcagtttacgtttgctggcagatgcaaatccaacgccgctgatcgccagctttgaatttggtaaacaagtaatgcccaaggtggtcacgcgtatcaagctggcgcaatcaggcgaagtcattgccttgctgcagcaggtgagtggccagtttcagcaacaacgccgcgaggtggttgtgctggaggatggttgtgccggtagcgagcgtgaagagccgttttctaccagtatgaagatgcgcgcacggatactggaagatggcgctttgggaaaaaacatcactgaactaaagatcattattctgcatcccatgcgtactggccgcagtaaaaacgatgatggccagttgatgcctgcacatttcatgcagttgatgcaggtggtgctcaatggacaagtggttgttgatgcgcaaaccggtaccggcatttcgcgtaacccttatttcaccttttacctcaaagatgccaaagcaggtgatgtgattgcggtaaactggcaggataacctgggctatgaggggcatgggcag

SEQ ID NO: 73553 - DNA, 570 bp, Glycine max
  Peptide Sequence Number=SeqID_190331
atggcatattcttcttccggagcttctcaaataaaatatgtttttcttcttctttgtgatctcttgcttgtctcgggattgacgggtgaaatatcagtgcaaatatcagataatattcctcgaataaagtatgatgtttttgttagcttcaggggcgaggacatccgtcaaggttttcttggttatttgacagaggcttttcatcaaaagcagatacatgccttcatagatgataaacttgagaagggagatgaaatatggccatcacttgttggagcaattcaaggatcattgatttccttgaccatattctctgaaaactactcctcttcgcgttggtgtctagaagaacttgtgaaaataattgagtgcagggagacatatggacaaactgtgatacctgttttctaccatgtaaatcccacagatgtacgacatcaaaaggggagttatgaaaaagctctttctgaacatgaaaagaaatataatttgacaacagtgcaaaactggagacatgctttgaagaaagctgcggatttatcaggaataaagtctttcgattacaagtaa

SEQ ID NO: 73554 - DNA, 1617 bp, Glycine max
  Peptide Sequence Number=SeqID_190332
atgaacacagcaaaatctggtgtccgtcttgtaaaaagtcctgatatcgtgacccgtgcacgaggcatactattgcacgaagcggatgaaatccgccaattggccgaccggttaggcagtgcctttgaagctgcggtcaacttgattcttgattgccgaggccgcatcgtggtcacaggcatgggaaaatccggacacataggcggcaagattgcagccacactcgccagcacaggcacccccgcttttttcatgcatccggctgaagccagtcatggtgacttgggcatgattacggctgaagatgtcgtcattgcgctatccaactccggagaaagcgatgagatcatcaatattttgccagccatccgccgtattggcgcacgcattttgagcatcaccggtagcgaaaattcaaccttgtcacgtgagtctgaggtgcacttgagtgcagcagtgagccacgaagcctgcccactaggattggctcccacagcaagcaccacagccgcccttgccttgggcgatgcactggccatctgcgtactggatttgcgcgaatttacagctgaggatttcgcacgctcacaccctggaggcagcttaggccgacggttgctggtcaggattaaagatgtcatgcgtaccggggacgcgatcccatacatttatgaacaagcaacggttcaggatgccattacccaggtttccagcaaaggcatgggctttactgcgattgtggatgccaagcttcatccgggcgaaacccacactgagactgcaatcacactggtgatgaataaacgcccccgcttgttaggcacgcaacaaatggcggttgaagcagtcaacatgatggagcaatataagattaatggatttctagtcatcgacgagcaacaacaattgacggtccaggagcaaggactcagcatgagccgcttgagccgccatgatccagactacatgctgcataactttgtcagcacccgcactaacgctgctgggatgaccaaatacgtgttagcagcagtagaaatgcgccactttcctgacaatgactatactgaattaaaacgtccacgttttacccaatttgggctggacaaaccttacacccaaatttatgggcagcgtggaaaaatttccgccaatggtaaactggtggagtttaacaaacaggtaaaagtcgtccgccagggcactgctcaaaaaggtgagatgcaactgcaaactgaacggcttatcatggagccagatacggaaaccgcctataccgacttacctgtcacgattcaccaaaaaccggcaactgtcattactggcacgggtatgcgatttgataacaagacagaaaccatgcaattatttaaccgggtacatgtacattacgagcgtgcaccggtcgcaacaaaacctgcaatcccgacagcgcctgccaaagccggcagccgaaggtggtcaggcagcgcgttggctgaagaatcagaccgtgaccagcccattgagctggaagcggataccgtaacggtcaacgatgccaagaaaatcagtgtttatacaggcaatgtcatcctcaaccaggggactttacagatcaaggctgacaaaatgatt

SEQ ID NO: 73555 - DNA, 189 bp, Glycine max
  Peptide Sequence Number=SeqID_190333
atgctggcctatttcatgatcggtattgtgctgggcccacatgcgttgggcttgctggaagatgaagagagtggtcgccaggttgcagaattcggtatcgtgttcctcatgttcagcatcggcttggaattcagtctgcctaaattgtatgccatgcgcaaaaccctgtttggtttgagcggcggccag

SEQ ID NO: 73556 - DNA, 507 bp, Glycine max
  Peptide Sequence Number=SeqID_190334
atggaaccagaattggccatgatactttacacttatagaacagtcttagatgtgccatcaggattaccccctagcagaactcacaatcattcaatcccattggttgaaggtgctggaccagtaaaagtcaagccatataggtatcctcacagccggaaggatcagattgaagaaaactttcattggaatgaccacacttccatggctttttacaatttgaaagctgcaattaccaaggcaccagtactggcattgcctgatttttccaaagcctttacattggaaactgatgcctctggtataggcattagggctgcattgagtcaggaacaacacccaatagcttttttctctaagaagctcacacctaggatgcaaagacagtcagcttatataagggagtcctatgctatcatagaagcagttgcaaaattcagacattatttacttgggcaccgatttgtgatcaaaactgaccaaagaagcctcaagtcactcactgagtaa

SEQ ID NO: 73557 - DNA, 153 bp, Glycine max
  Peptide Sequence Number=SeqID_190335
atgagcgcgcttagcgcaactctagaccgcttagtgcgcattagtgaatttcggcttagcgcgcatcttcttgctcaacggatggactcaagcggtgcacttagcgagatgaaccgtcactcagtgaacatgcataactcatccttcttctag

SEQ ID NO: 73558 - DNA, 438 bp, Glycine max
  Peptide Sequence Number=SeqID_190336
atgccgtctcttgtgacggacgtgtggggtgctaataccttccccaccacgtcttttcccgtttttccaacattttcctcaaataaacgttggtggcgactccgcgcgtattcctttcttggcagacgcacccgtgagtctcgcgtcgccctcccaccgaagggtaggttgcgacacaaggtgctagaatttgacaagtacaaggggactacttgttccaataaccatctaaagatgtattgtcggaagatgggggcatacacaaaaaatgagaaactgctgatgtatttcttcaaagaaagtcttattggggcagctgtcaccgggtatactaacttggaaccttcccgagtccgttcttggaaggaaaacgagcggagtcgccaccaacgtttattcgaggaaaattctagaaaaaccaaaaagatgatggtctga

SEQ ID NO: 73559 - DNA, 477 bp, Glycine max
  Peptide Sequence Number=SeqID_190337
atggttaaggaggagtgtaaggaggtaagtgtctcctccaagagattagctaagaaggaaagacattttgaaataaagacaaatattaaagaaatttcccctcttagacaacctccacattttctcctttgtcaaaagacacttgttagcattgccacacctcttaggcctgagtttattcctcaattaaaggagttgttggatgagggtttggttcacaagagcttaaatccttgtgctttgttggtgcccaaaataggggttcccatgaaccctaagagaataaaggtcattcctgagaggctcactccaccaagtgtggagggaagaagcccagagtttcatgaacctcgggatttgaggtcaaatccttttcaaggggaggtaatgatgcaatcctacccccaagggcattggatagaagactttaaaatgattgggccaaggatgcaagagaaggccctagggttttcatga

SEQ ID NO: 73560 - DNA, 315 bp, Glycine max
  Peptide Sequence Number=SeqID_190338
atggctggtacattcttccttttgaaacagcaaaatagtttagagattatgagtgggaaaaacacacccaactcaattttttttgctcttgatgtccaccccaacccaattataagcaaaggagacactctcttgttttgtaactaccttttctctcactctggtgtcttacagatgaaaatcttagagggcaatgctggtgcactcacaaattttgaggtccttgatttctgtcgagctaaaggagcttcaaaggatccaacaagagttattgccaaagtagcgcagtctgaatacaaggtttatgattattag

SEQ ID NO: 73561 - DNA, 192 bp, Glycine max
  Peptide Sequence Number=SeqID_190339
atggataaccatgagcatgcaaatcatcgtgatacagcacaagccaggataaagaataaaggtatcaggcagcacaaagttaatgacgaggctcagaatattgattgctgtgttcagtttcttcacctgaaaaccaaaattatatgtcctcagctaatgaccccgcaattaataggagaaggtaacgattaa

SEQ ID NO: 73562 - DNA, 324 bp, Glycine max
  Peptide Sequence Number=SeqID_190340
atgtgggtcaaggagtcacatcgagaaatctacttaggaccttacttcaatcatgcaatgaagaaaatatgcagtaatctccaaggcaaggacaatgcacctccacctccacctcaatggattgaggcaaagagccatgtacaacaaggagcatatgagtgtggatattatgtgatgcattggatgtggtacatcgttagtggcggtttgaaaaatgaactccacaactatttttctgatggaacatcattagacactgacaccatgacgacactacgcaagaaatgggcagcctattttctagaagttggaaaatggatgtaa

SEQ ID NO: 73563 - DNA, 853 bp, Glycine max
  Peptide Sequence Number=SeqID_190341
atgcagagaaggccccaaggggaggagaagagctcaggaaagttgataatcaatgaccgcatgatggatcagacagtagttaatcagctgagtgagtttgaagaacagatgccaagcaccttccatagggaaggcatcacaactcagaaaattagtgtcaaccacatgataagtcccacaaaaggtgatcagttgagccaggatcaagaagaggagataaactttattgaaatgaaaataggcttaataccagaacctattagtggaatgatagatcaaacaaaagcagatcagctggtccaggataaaacacaaacacagcggagatgccatgacgatttactggatgagcgtcaaggtgaaatcattttggagaattcaaagtcctctgcatgctgtatatgcaaaagtaggcgtccgaacaatgcatggacaaaagactttaattatgaagaactcctagaagctacagaaggattttcaattgagaactcgttatcagaaagagaagatggacctacttttgaaggcttgctagagagacaggtaaaaatagttgttaagaaatatcaagttactacatcccaccaagagaagatattaaaatcagaagtacagttgttcatcagtgctagacataaaaatgtggtcatgttgttgggtttatgcacaaataaaagccaactgatgattgtgtatgagcaagtatgcaacggttcacttgaacagtacctaacaaggggaagtttccagtcattgacttggaagcaaaggctgaaagtggcaatgggtactgccagaggtttaaagtacctacatgggaataacataattcatggaaatataaaaccaa

SEQ ID NO: 73564 - DNA, 750 bp, Glycine max
  Peptide Sequence Number=SeqID_190342
atgaatgcatcacaagggatattatacgtacttaagacaattgagtggctctccataaaacttaggaggcttaaattccaaggatcactgtctgtaaaaagtctcaagctctttcataaatgtttctcgatccagaggtgtgccatactcatcataatcagtcatctgtgggttaacgataagataattagtcaagctttttcaacacatagatccaaacacactaaaatagcacccaataccgatccagacttcttagaggacattagtcaagcaattgaaaggcactatatctgggggaaaaagagacattaccttgttgttggtgacaaagtcagtcacattaatagcagggaagagaagagtgccattcggttgcatttgatagagcctcttaactccagtgttggggtcgaggagttccttggtcttctcataaagttcctcggccttgacgccttcatggatgaggagggtagcgtcatcaccatgatcgacgatgaggttgggtcctccgccggggacccagtcgagggcacgctcggtgcaatagtggcagcggcgtggtcttgggtggagaagatgctgcaggagcatcggtgtggccctacaaaagccatggtttacccactgagagagaaaaagaaagaaagaaagagagtggagtggcgaggaaagaaagagagtggagtggtgaggaaatactctggagtcgtggaagaggaaacggtgttgattgaggctagctag

SEQ ID NO: 73565 - DNA, 276 bp, Glycine max
  Peptide Sequence Number=SeqID_190343
atgaatgaagacatgaagcttacctcgagtggcagcgagaggcaatgcggagtggcagtgagaaagaagattcgcgacatagtggagccaacacagagattcgatgaagatgatgatgcaaaggtaacaacattgtggcggcagggactaccagcgacaatgcatcatcaaaagaggaaaactctagataagacttcactgttaacaagcaagttgaagacccaacatgaccatagatcgacctccactccctatgtctcacagactcgagtatag

SEQ ID NO: 73566 - DNA, 868 bp, Glycine max
  Peptide Sequence Number=SeqID_190344
atgatagaagtgtcagttgaagccatcgcatctctcactcaatactatgaccaatctctcagatgcttcacttttggggactttcagttagcaccaaccatagaggagttcgaagggatcttaggatgcccgataggaggaaggaagccatacctcttttctggcgggaaaaccaaggaagtgcttggagagaaggtggaaactatggcaagccaaggagagtgggtatcattcattgatgtattagcactgctaatgtttgggacaatactatttctgaatatagacgagctggtggatctagcagcaatcgatgcttttcttgcttatcaccacaacaaggaaaacccagtcattgctattttagcatatgcgtatgatacattcgacgtaagatgcgagaagagtagttatcgcatgtgctcaggaaatgacaaggcaaattgggaagaactcttggtaggcacgataggagcgttcattagttggttcccatggtggaaagaaggaggggcaggagtgttatgctcatgtgaaggatttccaaatgtccctttgctaggaacgaggggtttcaatgaagctaatacgaagatgcttcagaggatccgtaaggcatggaataaaatgggaaaaaaagataaagaacttaagggaagaagcaatagtgtcataggcggctatcataaatggttgaaatctaggacgaaaaggataacttggctccaaaagctaaaggggctgaatggggaagaggaagaagtgcctgaggaaagtgaagaggtgcaagccttgaaagctgagcttgaaaagacaaaagtatcaaagaagaggatgaaggtggtagtcactagagttaggaaagaat

SEQ ID NO: 73567 - DNA, 315 bp, Glycine max
  Peptide Sequence Number=SeqID_190345
atggaggagaagaaaaagaaaaaactgaaggaagttgctcaatccagaagcactgactccgtgattaatcgtccatctcccatcagacgacacgtaaaatggaagatggtccgcacaaagaaaactagccaaatgacatttgaggcagcaaaggaaattgctgacaagattgatgtactgattgctatcattgggcaaccaaaacaccctgatcatgtgcgtgctgctagagccggtgtaatgatcaagcaatactttggactggctccaaggacctcccacacttcctccatggctcccgaagacctggagtag

SEQ ID NO: 73568 - DNA, 697 bp, Glycine max
  Peptide Sequence Number=SeqID_190346
atggcttaccagcatggttactgggaaggactggatcaagaagcgagcggcaatccacaaggtacatcctttgtggtacaagtagagggtacatcctttgtggttcaagtaaagggtacatctacttgggttgttgtaactgagaacaagagagggtacatctgttgtggatcagttctagtgaagggtacatccactaggttgttcaaagagaacaaggaaggacaaaacaacaacgacggtcttaagataaaaccgcctttgttcccagtggttaattaccacgtgtgcacacccagggctaagttggacacacagaacaagccagaagaaagaattggaaagggcttgacgttcatccttctctctcacacacacacactctctcaaaatatcctctttcataatctcacgccgcttcttcaccgctctcgcctccgtcaagctgcttcctcgcagttcgccgtcgagcgcgactactctaactatgaggaggttagtggcacggacagtgacgaaggactagtgatcgcaaatctcgggatcgctccgcaaatcgtagatgctctagccaagaaagggattgcgaagctctttcccattcaggttgacatggctaacattcagaagaataaggaagaggagaaggcgctaaaggagttgaaagccaaggcgcaacataaaggaagctttggag

SEQ ID NO: 73569 - DNA, 207 bp, Glycine max
  Peptide Sequence Number=SeqID_190347
atgctgcttaatcttggaatttatactaaggataaggaatctgagttctcagtgttagttgatcgtgccactggtggagccagcatcaaagatggtgaggtggaattgatgcttcacagtattaacacaacgtttactactcaaggcgtattctccatgatgatagtcgaggagttggggaaccacttgacgaacaagtttgcatga

SEQ ID NO: 73570 - DNA, 285 bp, Glycine max
  Peptide Sequence Number=SeqID_190348
atggcttttacccagacatttagggaaagtaagccaggttccttggtgaaattggcctgtgtttctgctattgaagatatgctaaccctcattgaaagcatgctttccatagagacaagcaatcccgaaaatttagaacttcaagatgctttactcgcatggattagagagctccctctgttgcttatccagcttggagataaacacacaacctgctcccaattagtcattatttctaagacattcaacgaaatacaacaagtagtgtcgcgaagaagtaattga

SEQ ID NO: 73571 - DNA, 267 bp, Glycine max
  Peptide Sequence Number=SeqID_190349
atgattaacaagctctaccttgcattctggttgccaatatatgtcactggaattattgaagttggtaatgcagaaatcacagttctggacagtgatgttggaagtggtgaaacccagaaaaaaaccaaggaaacattactaaatggaggaaacaagagggagacaagaatacacgacgacgacgacgatgatgatgatgataatattgttcttcttcttgataatatgcagtaccaaaatcaatttgctgatatagaatacttttaa

SEQ ID NO: 73572 - DNA, 618 bp, Glycine max
  Peptide Sequence Number=SeqID_190350
atgaccgaccctctcgatgagtcgatctcttgctttctcataatggtgaacccttgggtactagtaccctcaactccagaggactacatgtcctcgtcttcagagggtcgcacgccctcgccttcagaggactacacgtcctcaccttcagaggactacacgtcctcgccttcagaagactacacgtcctcgccttcagaggacttcacgtcctcaccttcagaggactacacgtcctcgccttcaaaggggcaacacgccctcaccttcagaggactacacgtcctcgcctttagagggccgcacgccctcgccttcagaggactacacgtcctcaccttcagaggactacacgtcctcgccttcagaggactacacgtcctcgccttcagaggacttcacatcctcaccttcagaggactacacgtcctcgccttcaaagggtcatgtaccttcaacttcagaggactacacgtcctcgccgtcaaagggtcatgtaccttcacctttgtagggctacacgccctcaccttcagaggactacacgtcctcgccttgagaggactacacgtcctcaccatcagagggctgcacgccctcacctccagaggactacac

SEQ ID NO: 73573 - DNA, 216 bp, Glycine max
  Peptide Sequence Number=SeqID_190351
atggcagtcagtctgtcaaaagatgatattgaatccaggaaaagcaataggtacataccattttatagaatcactcagggacagaacaaagtgctaattactgatagaatttgggctaggcttctatcttcaacaaatctgcctagctttacgattgctaagactatctctgaagaaaaaagggaagaagaagcaaacgatcatgtccctgagtaa

SEQ ID NO: 73574 - DNA, 363 bp, Glycine max
  Peptide Sequence Number=SeqID_190352
atggtagggttgctaccacttgaccagaaagttatggcttcaaattctggaaacagctttgctggtagggcacgtatatcaaccttctccaaaccccacaaggcaaggcctctactgggaggaaagaagtaccctaagttggtggatctgaaaatcagtaactcctatgaagaagaaaaacttctatggttggttcaagtaacagaacaatgtctcagaaagaatcctaaggaaagaataacaatgaatatggtaagtctaagtgacgtagaatatgatcagaaagtgcataaaacagaaaagaaagcatgctacttcatacagtatagcattaagtcaatggagatcatgatagttacttga

SEQ ID NO: 73575 - DNA, 279 bp, Glycine max
  Peptide Sequence Number=SeqID_190353
atggaccttgagggtaaggtccaagtgaacccatcggtagtgataggatgggcctacgaggctcaaatagatgacttttatagattaggtaatttagataatatcttttttgattcaatcctacccccaagggtactggatagaagacttcaagaggattggactagagctgctaaagaaggccctagggttctcaagaacttcaggctaagctctaacttctcgaggaagcttctcttgagaagcttctcaaagaagtttctcaagaaagctacctag

SEQ ID NO: 73576 - DNA, 1809 bp, Glycine max
  Peptide Sequence Number=SeqID_190354
atgaaagctgatccagtgaagcaggagcaagaatggattggcagaaaccaatatgaggaggaaagaagcctaagattaacagtcataaccaatgacataataggtcagcgaaatgcagatcaactgatacagggtggagaagatgtgcagagcagcccccatgaagagatgtccagagtaacagttatcagcaatgacgtgattgatgagaaaaattctaaccaaaaaatccaggaaaaactgcagattaagggaagctgtgatgagggtttgaagaatgcgaatgaagcgaaagtcattttggagaattcgaagtcttctgtatgctcaatctgtagaagtaggcgtccatacagtggattgcaaaagaaatatacttatgaagaacttgaagctgctacagaaggattttcaataaagtattctctatgtgaaggtgaatatggacctgctttcagaggccagctagagaataaccaagaaatagttattaagcaacacacattcacaagcttacaagaacagaaggtctttatctcagaattccaattgctcataaatgccagacatgaaaatgtgatcatgctgttgggttcgtgtatacgattaagtcaattgctaattgtatacgagaaggcatgcaacggttcacttgaccagtacttatcaaggcaaagtgctacatcattgacttggggagaaagggtgaaagttgcaataggtgttgccagaggtctaaagtatctacatgagaataatatagtacatggaggaataaaacctagtaacattcttctaaatcatgagttcaaaccaatggtaggagattttgtgtttggaaaagaaagatgtgaattgaagaatgtctgcaagcaaaaaagtatacggaattgtggatacactgcaccagagtgtcaggagagtgaagaattatcaactgaggcagatgtgtactcttttggtgtagttcttgtagagttgattgccggccgtatgatagcagataaaatattaggacagaaatgtcttgttgaatgtttgtgcatttttaggcttcaactatttctattaattggaaccgcaagtcctaatgataggaacgtaaggtcacttcttggacgaagagagtatcgacagttggtggatcccaaagtcagaagctcctatgatgaacaagaacttgtttcattgttccacataacagaaaattgtctgaaaaagaatccaaaggaaagattcacaatgaatatggttgtctctgcactgccatgtgtagcaaatagcaatggcctctatgtaaaggaagacttttcaccagaaaactcaaatgtttcagatgcaaaaaactcaaaaggtgaagaggaatcactgaaagaaaacaatttaggaacagagaatactgaagaggtaaggatgaatcacagagaaggtgagaaagaggaatcattggaggaagaagatttagacacagagaatagtgaaaaggtaaggaggaatcacaaagaaggtgagaaggaggaaacactagaagaagaagaagatttaggcacagagaatagagaagaaagagtggaacaaataacttgtagtagaggcaataatgaaccagaagttagtcaagagtgtgatacctacacaaagtgtggtgaaattagtaagaaaacagaagaaaaagaaggttctagcaccaagctatgtcaaaaatgggaagggtgcttatcttatggtggagctagaaaattttatcaccaaggggctcaagaatacacagcatgtaaagaatttttcggctggtgtgattccatttga

SEQ ID NO: 73577 - DNA, 144 bp, Glycine max
  Peptide Sequence Number=SeqID_190355
atgtctccttttcctctgttctttgcacataattcacagtctattcagacctccccacattctccacaagtctggcttaaaaaagggctttctgtctacgaaggcgcgcttagcgccattctcgtgctaagtgcgagtaagtga

SEQ ID NO: 73578 - DNA, 327 bp, Glycine max
  Peptide Sequence Number=SeqID_190356
atgagttctgtaatatccactacctccaccgttgcagcacccagttacttcgacaacccaattatatacaaatttcaatctgttgtccacgttgatagaaacttcattcaaataccatcagcatgtcacatacaatggggtcctacttacccaccgtatgtaacgtttgattacaatggagaaaaacattttataaagattagaagagatggtaacaaattctattttgcggatggattgaaggacttcaggagagcgttgggtatttatgaaggcctggtggttcattttgctacacccgatagaaatacaagcgttgggtattag

SEQ ID NO: 73579 - DNA, 207 bp, Glycine max
  Peptide Sequence Number=SeqID_190357
atgagtgatcaagccacgagcatcttctcccttggctttgtttttcgacccccctacttggatgtttcatcttctgaaggctcgcttagcaagactggctcgctaagcaagaggtttcccaacatgctaagagagctgtatgcctcgcttatcggatgtcaatcgctaagcggatccgcctcgcttagcgagacaccagctacttga

SEQ ID NO: 73580 - DNA, 105 bp, Glycine max
  Peptide Sequence Number=SeqID_190358
atgtggaggtcatcgacgtttgtggctatggcttttgtttggttaaacattgaagggaaactgaggaaacatggcgttgcaaaaggctgtaatttatatgtttga

SEQ ID NO: 73581 - DNA, 240 bp, Glycine max
  Peptide Sequence Number=SeqID_190359
atggaaaagagacaacaaagctatgatcctattaatttggaagcccttgatgaccatattgattgggtaatggagggttcaccaccattcctaaccaatgaggagttttttcatcataggtcctttaaatttggaaatgaaagcaacgttcatcatgaagttacaatgggagattatgagttctttaatgaaggagttcttgaaaatgacaatgacttgttgtatgccccttggccatag

SEQ ID NO: 73582 - DNA, 246 bp, Glycine max
  Peptide Sequence Number=SeqID_190360
atgcacatctacgagaatgtaaccaagcacaacaacatgaggtggaactacctgaaggaggagaggctgaatcaatggccttcgatctacccaaggctactaacccaaatagttactatagttcaagaaccccttatgcctgacatcatggaagtaatcctcccctccaactggaaaaaaatgacaattgaaaagtatgatgctaccagtgacccggacgaacaccttgacgtgtacatcacatag

SEQ ID NO: 73583 - DNA, 1158 bp, Glycine max
  Peptide Sequence Number=SeqID_190361
atgagccagtggatacacgtggcggtggcagcatccgccgtgggatgcgtctcgacccttttgttggtctttctctggcgttggtgccataaaagaaatcatcgcagaaatttcgttgagccggctagtttgaccagagtggagagtgtccagggagggatttctgtttccaggcttcatcaacaacaacaaccttttcaattggatcagggaaacaagaacaacaacaagggcaattacaattactatgtttttcgcggtggtggcgtgtcggggaaaagaagtttgttcaattggggtgatcatccatctatggccgctgatgctgttgaaaatggatggtcacgatttgctttcacagggtacaagagttacacgccatctccttcgaaaagatcagcacttttaggagtttgcgctgcacctggtggaggaagtgattttggaagagaatcagaggttgagataagctgggaagtggcccgtggatctgctgagtttatgcagaaggtgaggttgaatcccgggatcaaaaaatctcatcatcacaacaacaataacaacgctttttctctgagtgttgcttctatcattagaggggctttgcctttgcctggtcctcctttggggaactgtgcgttcccacaagaggcatattttgagattaccattttgtactcacgtggggatgagtatgagtttgttgggaagagtgtggaaggtgaaaagaccaagcttttggttcaaggtaactccaatgttaaagggaattcggaggctttggttcatgttactagtggcaatggtagtaataaaatcaacaatgttgaaggagaaggtgggaagggtgaatctgtgatgttctcttttgggttaactgctgggggttctgttcctttgagagttccaggtagctacactgggagcattggcttcaactccaacggttctctctatcttgatggaatgaaacttgtaagcgaatcagagaaggcagaatgggtaggaaccgatagagtgattggttgtggatttgatcctaggcagaagaaggttttcttcacattagactcagagctaatgcatgtcattcactgtcagacagaggaatttggtacaccactctttccaatcttggctgcaaacatagacattctg

SEQ ID NO: 73584 - DNA, 339 bp, Glycine max
  Peptide Sequence Number=SeqID_190362
atggcaacaagtcaacaagaagatgctacagtatcaacaacaggggtacaccaaccaaacaaagaggtgcaattagcaaagtttgatatcggagaagctacgaaggtgaagacgaaggttatgtcaacagtagcgacgagatggcggcaatttaagtccacattgactagcaaatttgtgtttgctaagagtgaaggtcaacaaacacaggatgttgtgacaaaatatggactagatcctgaagcatggaaacaatttgaagaaacccggctcacacctaactgggagggtattaggaaacgagcacaatcaattcaaaaacacaatgactgcccccac

SEQ ID NO: 73585 - DNA, 519 bp, Glycine max
  Peptide Sequence Number=SeqID_190363
atgggttggaaatggaaatggagagtgagagagatagatatggaagaagcgggtttaggagattgttgttcctctaatacgactattacgaggaaaagcgagaagcgaaagcagcagcaccaacaacaagagaagccatacagaggaataaggatgaggaagtggggcaagtgggtggcggagattagagaacccaacaagaggtcgaggatctggttgggttcttacgccacccccgtcgccgccgcacgcgcctacgacaccgccgtcttccacctccgaggcccttccgctcgccttaacttccccgaattgctgtcccaggacgacgacgtttcgacccaacaacagggcaagatgtccgccgattcaattcgcaaaaaagcgacccaagtcggcgccagagtcgacgcgctccaaaccgcgcttcagcaatcctcgtcgacacactccattagttccagccacgtcagctatgagaaaccagacttgaacgagtatcccaaacctgaagattag

SEQ ID NO: 73586 - DNA, 783 bp, Glycine max
  Peptide Sequence Number=SeqID_190364
gcctcgtttattgacatcttcgccctgttgatatttggtgtcgtcctcttcccaaatgtggagggattagtggacctagcaacagttgatgccttccttgcttatcaccttagcaaggaaagcttggtcattgctattttaaccgatgtctatgacatgttcgaccgaagatgcggaatgagcggcgcaagaaatatttactgtacatcggctttctatgaaggaagaatcagggttttgtccttatgcgaaggatttccaaatgttcccttaatgggaacaaggggttgtatcaattacaaccctgtcctcgccataagtcaacttggctaccctattagaggagcgccgtcaaaggaaagcgtcatgcctttcatcgcccggggtttcagtgaccccaacgcgagagtgcttcaaggagctgcaagagaggaagaggctgaaacttcggaggagagtgaggaagtgcaaaccctaaaggtggaacttcaaaaagcccaaatagtcaaagagaagttcgagtcaacgaccatcaaagttcggaaaaacaacaatgaacttaagctccgacgagctgaaagggatcagttgcgggtcgaaggcatgatcttgaaagacaagtttaaggagtgccataggctagaggatgagtacgtcaaggtgtcagtccttcaagtggaaagggaagctagggaaagggtgatcgattcattgcatagagaagcgataatgtggatggacaggttcacctttactttgaatgggaatcaagagcttccctga

SEQ ID NO: 73587 - DNA, 243 bp, Glycine max
  Peptide Sequence Number=SeqID_190365
gtagggcgagacggcggagggagggggagcggtggcggagcagcgacgaaggagggtgagttttgcattgtgacagagaaagagaatggagggatggtggaattgacggtcggaaatctcgtcggagatacgacggcgacaacggaagtgatcgaaatggcaatgggttggagggagagatgggaacagagggacaaaatgtcttctaggctcaaggttttgtatgtactctctcagttctaa

SEQ ID NO: 73588 - DNA, 516 bp, Glycine max
  Peptide Sequence Number=SeqID_190366
atgggtgcggatcaggtgagtgtgcacgtggctccactgatttctgacgccatttatcagtttgcaggttttgcacccatgagacacccagtggacccggagaagtccaacatggccctggcgtttcccgctcaagaggaggaccaacaaccagccgcagatgtgccaccaccacctcaagaggaggtacagtctctgaggtccatctctgattgcctggatgggatagaactccagatgcacaggtataagcgtcacgtgactagccagcaggcggctaatcatagagggcaaaggcagttgaatgagacgttctactgttacaacatgcaccaacagagtcaggaccctagtcctttcccctggcccatccccgagcagttcgaggccacggtggcctggcttagggacgagattgattttgagatgcaggcagggcctgcggggacctccggaggtggggatgaagcccaggacaatcagaacatggccgacatgttggacttcctcctgtga

SEQ ID NO: 73589 - DNA, 228 bp, Glycine max
  Peptide Sequence Number=SeqID_190367
atgctattgatgttctgcgctctagaatcggtgtctgtcgaagtccatgtcaacctgcggggcagcactggagccctttccggtggtgtccttcctggacctctttgcgggaagctttctcgaggccatctcttgtatggagtgaacaaggataccaaaatggaagcaaagcacaaaaatggtggcttgggggctgcaaaatcatgcactgccagggtgctcacttag

SEQ ID NO: 73590 - DNA, 597 bp, Glycine max
  Peptide Sequence Number=SeqID_190368
atgggtccgaaatctaccctaaggctcatgagaaccctaggaccttctcttgcatctttggcccaatcttcttggagtcttctatccaatgcccttgggggagtaatagggtctattgtttaccagcaatccattggagcagtttgtatcctagattggccaaaggaaacaatgcttctacagtttgtatccattgaagcagatacccaacaactcatcaaggcaaaagtgcataaatggaaacaaacgggtgtttggataatatatagacatcgacttatacgtataggctacaacgcagggaatcttaaatcaacaatgaactgtgattatgttaaggattacgagtttgtggcaatatttgaggctgatttccagccaacatcgggtttcttaaagaagacagtgccttattttaagccatatcaactttgtaattggtattcagatctttctttggcaacaaattggtccaacctgctggattcaaattccaaagagaaggatgggatcctggagtcaagaaaactagccagcaaatgttgttctcagctttcagaaatcaagaagattgagggagttgaagagatcgaatag

SEQ ID NO: 73591 - DNA, 129 bp, Glycine max
  Peptide Sequence Number=SeqID_190369
atgggggcgaaatcagatttcacccctttatttaaggctgatgtccgacctgactcacccaagcgagcagatgcctcgcccaacctaagacgtgaggatcctaatgagtcctcaggaggccctggttga

SEQ ID NO: 73592 - DNA, 354 bp, Glycine max
  Peptide Sequence Number=SeqID_190370
atgcaaaagactgaagacattgaagtctttggaaatggtaatgtgcatatcagagcacttgaaaatgacgttgatgctcctcacaagtgcttaccatcaagtttacaagtgcttcctctcatttcccatcaacgtcgtttaactacatatgccccctatgggttgttgcttgcttatcagccaaatgttgcatgtatgcatgcacctggagctctatcctctgcatgtgagctaagatggactctaaagttggtggctgatgtggaggcggtggtggtgtgtttgcggctggctactgctgctggtcttgccccggctgttgtacctgcctcgacatgcaatattgctcaatga

SEQ ID NO: 73593 - DNA, 816 bp, Glycine max
  Peptide Sequence Number=SeqID_190371
atgtttcactatgcttcatatttttgccaagacgtcggcaagggtgagggttccgatgacgttggttcagatgctctagactttgagggactcacaccagtcgatgttaggacggcccatgacaccggtggtgttgaagacatgagtgggcttgagagggagggtgtcgaggaggccgccaatccagcccatgtggccgtagatgaggaagttgaggggatgagacatagaggcgccgttggctgggaagtccaacagaatagtgtgatgccaggtttttcgggttttatggctggccatgtggttgcatgtgcattgcttatggcgggtgaggatctagacaaaaatgttgatgtaaagaacattcttgttgagatgggaacatactttcaagtacaggattgctttggtgatcctcaaacaattggaaagataggtacagatattgaagatttcaagtgctcttggttaattgtgaaagccttcgaacttagtaatgaacaacaaaagaaatttctacaagagaactatggtaagccagatccagaaaatgttgctaaagtaaaggccctatacaatgagcttaatcttcagggtgtatttgaggagtacgagagtgggagctatgtgaagcttgtatcctccattgaagctcatcctagcaaagcagttcaagttgtattgaagtcctttttggctaaaatttacaagaggcagaagctactcaagaacaagaggcatgcaatagcaaggcaactgagaaaggacttggttgagctaatacaaagtggccatgaagaaattgcatttaatcag

SEQ ID NO: 73594 - DNA, 285 bp, Glycine max
  Peptide Sequence Number=SeqID_190372
atggccccgaggaaacgtgctgctaagagagctaggaaggccactgcaagggaaggatccagtgcagccccacaagcaaaaattgagtttgataggcaccgcttccgatgtgaggagcatcaacgtcattttcaagtgattgaagattggtattgcacctctgagacacccagtggacccagcgaagtccaatacgacactagggttttcggcattgattacaggtctctgccaattctacggagtaccggtcgccccgacaaagctcatccgacctcctattaa

SEQ ID NO: 73595 - DNA, 183 bp, Glycine max
  Peptide Sequence Number=SeqID_190373
atggaagaaaggaacaaaagagttgtcaagctcgatgacaaaagatattttaatatatcaccacaagaaacctatgccgccgccaacgactttgaagacaaggaagccctcgaggtttatgtagttgtcgttgagcttccatacacaatcgaggcacaaatttatgatttctttaccgattga

SEQ ID NO: 73596 - DNA, 486 bp, Glycine max
  Peptide Sequence Number=SeqID_190374
ttgcctggcattgttgcggttgaggtaactggtagacctgaagttcccttccatcctgaaagagaggtagatcctagtaagagaccattgatggattatgttcagaagattcagagggatgttaatgctaacatgcgcgatgttcttgtggattggttggtggaagcagaggttgcaattgttggggttgcttcaatgctcattgcttcgaaatacgaagagattaagccgcccgaggtggaggatttttgttacattacggataacacatactctaaggaagaggttgtgaacatggaggctgaaatattgaaggctttgaaatttgaattgggtggtcctatagtgaagacattcttgaggtgtgtttctttgttgaatctatgtccatgttgtgttaatttcgcttgttctagttatttttgccttggcattttggctcatcacttgtatgcttttgccttcttgtttgcaggagattcttga

SEQ ID NO: 73597 - DNA, 402 bp, Glycine max
  Peptide Sequence Number=SeqID_190375
atggcagaacggaggaatccaatgggaaaaataccaaaaatcccatttcccagtcaagagggtgctctctcgtcggggaagaacacattggagaatggaggatccaatcgggaaaataacaaagatcacatttcccagtcaagagggtccactcttgacggtgaagaacacattggagaatggaaaaattcaattgggaaaataacaaagatcacatttcccagtcaagaggggtccgctcttgacggtgaagaacacgttggagaatggaggaatccaatcgggaaaataacaaagatcacatttcccagtcaagagggtccgctcttgacggtgaagaacacattggagaatggaggattcaatcgggaaaataacaaagatcacatttcccagtcatga

SEQ ID NO: 73598 - DNA, 804 bp, Glycine max
  Peptide Sequence Number=SeqID_190376
acgcaggcgcgcgacagccagttcgcgctggcgcgttcgttcgcgaatcagggcctgtcgctggaagagagcacgctgagtgatgtcacgacggcgattcagtcggcgcaatccacgctgatcagcgccggtaacggctcgctgagtgacgatgaccgcgcgtcttatgctacccagctggagggcattcgctcgcagctgctcaacctggctaacagcaaagacggcaacggccgctacctgtttgccggctatgcgtccgacaagccgccgttcaccgaagatgccagcggtaaaatcatctatagcggtggcagcgacgcgatcacccagaaagtcgacagcgaacgcaccatgacggtgggccataccggtaattcaatttttgaccagctgaccagcaacgccaagccggagccggatggcagcgccagccagactaacctgttcgatatgctggatgacgccattgcggcgctgaaagtgccgcagaatgacgctgacgatgccactaaacagaccttcagcgcggcgatggacaaagccaaccgtggcttcagcaactcgctgaacaacgtgctggcggtgcgttctgagattggtacccagctggacgaactggatacgctggatgcaaaaggtgacgaccgcaaggtgacgctgaaagatcagatgagcacgctggttaacgtcgattacaccgaagccatttctacctataccatgcagcagcagctgctgcaggcgtcgtacaccaccttcagcgatatgtcgaagatgtcgttgttccagatgaataaataa

SEQ ID NO: 73599 - DNA, 570 bp, Glycine max
  Peptide Sequence Number=SeqID_190377
cccgaaacgccagcgccagaagtggtgcatcaggctgaaccgcaggcgcacactgaggtgccggtggtgaatactgatgacctgacgccagtggcggcaccggttgatcaccagccagcagtgatttccgcagccgatgaagcagttgcacaggaaaccgcagcagaagcgcaaccggctgttacgcctgccgaagatacgccgccagtggttaccgaagcggttagcgcagcggaacaggctccgatcgaggtgtcacccgcggttgaagcgcaggtagaagaagtgctgtccgcgccggtagcggccgaagcacctgtcgcgccggtcaccgaaccgcacgcaccggttgccgcccgtgataccggtgtcagccatgctgagacccgcttcaggcatcacgctacggcaccgatgaccaaagcaccggcaccggcatgggaacctgagcccgtgcgccacagtgactgggtccgtccggccttcaacttcgaaggacgcggttcagccggtggtcacagcgccacgcatcaggctaccgcaccggctacccgtccggaaagcgcgtaa

SEQ ID NO: 73600 - DNA, 1368 bp, Glycine max
  Peptide Sequence Number=SeqID_190378
atgagtacccatgtcgttcgtcatgtttcagaatgcttcgtcaagccacattgtcccggccaagagtcaaaccaaatatgcaacttaacaccttgggatattgctatgctgtccgtccactacatccagaagggtctgcttttcaagaagcctccaacaacacttgttgatcaacatgatttcattgagaacctgttggagaagctcaagcactctctttctctcaccctcttccatttctatcctttggctggtcgccttgtaactcagaaaacccaagaccctccctcatatgctgtgcttgttgattgcaacaacaatagtgatggagctagattcatctatgcaacattggacatgaccatatctgacataatctctcccattgacgtcccacccattgttcactcattgtttgaccaccacaaagcagtcaaccatgatggccacaccatgccattgttgtccatccaagtcactcaactagtggatgctgtttttataggttgttccatgaaccacgttattggcgatggcacttcttattggaatttctttaacacgtggtctgagatttttcaagctcaagctgaagggcatgaatatgatgttcccatttcacacaatcctattcataatcgctggtttccagagctttacggtccattaatcaatcttcccttcaaaaaccacgacgagtttattagcagatttgaatcgcccaagctgagagagagaatcttccacttttcagcagagtctattgcgaagctgaaagcaaaggcgaacaaggagtgcaataccaccaaaatctcttcgttccagtcattatcagcacttgtttggagatccataactcgtgcgcgctcagtaccacaggagcagagaacaagttgcaagctggccacagacaatcgatcaagaatggaaccacctctgcctaaggaatactttggaaactcgcttcatgcggtgagtggtgaggccacgacaagggagttgcttgagaatggtttgggatgggcagcatggaagttgcaccttgctgttgcaaaccataatgccagtgctgttttggattttctcaaagagtggttagaatctcctttcatatatcaaattggtggtttttttgacccctactgtgtgatgatgggtagctcgccaaggttcaacatgtatgggaatgagtttggaatggggaaagcagtggcagttagaagtggttatgccaacaaatttgatggcaaagtgacatcataccctggccatgaaggagggggaagcattgatttggaagtctgtctttcaccggatacaatgagcgcgttggaatcagacgacgagttcatgagtgcagtttgctaa

SEQ ID NO: 73601 - DNA, 1893 bp, Glycine max
  Peptide Sequence Number=SeqID_190379
atggcgcatattcctcagacccccaccaatgacgcggcggcttctggtgcaaatccgtcgatgacgaccatctcgttgtacgtcggggatcttgaccacgacgtcaacgatccgcagctctatgatctcttcaaccaggttgcccaagtcgtttccgttcgaatttgcagggacgtggccacccaacaatcccttggttacggctacgtcaatttcagcaacgctcgagatgccgcaaaagcaattgatgtgctgaatttcactccgctaaatggcaaaaccattagaataatgtactctattcgggaccctagtgctcggaagagtggtgcagctaatgttttcataaagaatttggacaaggcaatcgatcacaaggctttgtttgatacattttcggcttttgggaatattctatcttgcaagattgcgacggatgcttctggccagtctaaaggccatggttttgtgcagtttgagagtgaagaatctgcacaaaatgcaattgacaagttaaatggcatgctgatcaatgataagcaggtctatgtgggtcctttccagcggaagcaggatagagagagtgctctcagtggcacaaagtttaataacgtttatgtgaaaaacctgtttgaggcaacgacggaggctgacttgaagagcatttttggagaatatggagctattactagtgctgtagtgatgagagatgtagatggtaaatcaaaaggttttggttttgtcaattttgcgaatgtagaagatgctgctaaagctgtggaggctctaaatggaaagaattttgatggtaaggagtggtatgttggaaaagcccagaaaaagtctgaaagggagcttgaactgaaagagcgaaatgagcagagtacgaaggagactgttgataaatatcatggtacaaacttgtatatcaagaacttggatgatagtgttggtgatgaagaactcagggaactgttctctgagtttggtacgataacctcatgcaaggttatgcgagatccaagtggaattagtaggggatctggatttgttgcattttcaattgctgagggagcaagttgggctcttggtgagatgaatggtaaaatggttgctggcaaacctctctatgttgcccttgcacagagaaaagaagatagaagagcaaggttacaggcacaattttcacaagcgaggcctgttgcaataacccctaatgtttcacctcgaatgccactataccctctaggggctcctgggataggacaacaattgctgtatgggcaagcagctccaagcatgatacctcaagctgcatttggttaccagcagcattttgttcctggaatgaggccaggtggtgctccaaacttctatgttccactggttcagcagggtcaacaggggcagcgctcaggaggacaacgaggagcaggtcctatgcaacagctccagcagccactgccattgatgcaccaacagatgcttccaaggggacatgtctaccgatatcctcctggctccaatatgcaaaatattcaactggcaggagtacctggaggaatggtcagttacggcattggtcaaccaatgcccacacaggccctggcctcggcccttgccaatgctactcctgaacagcagaggactatgcttggtgaagctttatacccgttagtagataagctggagcatgaaacagcagcaaaggttactggtatgcttttagagatggatcaacccgaggtattacatctgattgagtcaccagatgctcttaaggcaaaagttgttgaggccatggatgtgttgagaaaagttacacagcagcaatcaaacagcccagccgatcaactggcttcactctctctgaatgataatgtcgagtcttag

SEQ ID NO: 73602 - DNA, 1476 bp, Glycine max
  Peptide Sequence Number=SeqID_190380
atggctatagaagtgagaaagaagacttcaataacagcagcaacaacagcaatatggctggtctcgtggagccttattatggcctacaatgtcagtttagcagaaagagttttgaaagaccaaaaatctgagagttttgttgccaaagaaaggcaaggagttatgaatagtataatcgatttcttccggaacgatggagagcctactaatgaccgtgtttggcctgaaatgaagtttggttggagaattgtagtagggtcgattgttggattttttggagctgcattgggtagtgtaggcggggttggaggtggaggaatttttatccctatgctcactttggtcattggttttgatgctaagtcttccacagccctttctaagtgtatgataatgggagcagcagtatcaactgtatactacaacctgagatttagacacccaacactagacttgccagttatagattatgatctggctttgctcttccagcctatgctaatgctaggaataagcattggtgttgcatttaatgtcatgtttgctgattggatggtgacggttttgcttatcatcttatttattgctacatccacaaaagctttattcaaaggaatagatacatggaaaaaggaaacaattatgaaaaaggaagcagctaagatgttggaatcggattcctctcctggctatgtttctgaagaagactataagtcactaccagctggttcagctgatccacgagatgaggaggtccctttactaaagaacatctattggaaagaattattagtccttgtgtatgtctgggtggcttttctcattgttcagattattaagacatacactaaaacttgctccatactgtactgggttcttaattccttgcaggtgcctattgcaatttcggttacgctttatgaagccatatgcttgtgcaatggaactagagtgatttcatctaagggaaaggaaaatacagattggatgaagcttcacaagatctgcctttactgttcctgcggaataatagctggtatagttagtggactgcttggtctaggtggtggcttcattttgggaccactctttctggagttgggaattcctcctcaggttgctagtgctacatcaacatttgctatggttttctcctcctccatgtcagtggtacaatattaccttctagaacgcttcccagtaccttatgcttcttactttattttggttgcaaccatagctgcattaactggccagcatgtggtgagaaagataattgctatcttcggtcgagcatccatcataatctttgtactagcattcaccatttttttgagcgcaatcagtttaggtggagtgggaattgagaacatggttgagaagatggaaaataatgagtatatggggtttgcaaatatctgccatgtcaatcttgggggtgtttttcctacatacagaagtggaagttttctatag

SEQ ID NO: 73603 - DNA, 243 bp, Glycine max
  Peptide Sequence Number=SeqID_190381
atggcttgtgatgtggtgtcgtcgccgcgttggctcttagtgctgaaaacatatggaggtctgaactctgaagcagcgatgcaaaggagcgacgactttgacagtggtgccgacgattggaggagggttgtggaagagaaagtggtggtgatggttcgtaatctccaagtgagagagaaggggatagggataggattaaattgggaaaaacaaaaagatacaaattttcaatcgttcatttaa

SEQ ID NO: 73604 - DNA, 2145 bp, Glycine max
  Peptide Sequence Number=SeqID_190382
aagggtctactctttaagaaacccaccccacttgttgatcgacatgatttcattgggaatctgttgggaaagctcaaacactctctttctctcaccctctcccatttctatccattagccggtcgccttgtcacccaccaaacccaaaaccctccctcttacactgtttccgttgattgcaaaaatagtgatggagccagattcatctatgcaactctggatatgaccatatctgatatcctctccccagttgacatcccactcgttgttcagtcattgtttgaccaccacaaagcactcaaccatgatggccacaccatgcccctgttgtccatccaagtcactgagctagttgatggtgttttcataggttgttccatgaaccactctgtcggtgatggcacttcttattggaactttttcaatacatggtctcacatctttcaagctcaagctcaaggccatgaaactgatcttcccatttcacaccgacccattcacagtcgctggtttcctaatgattgtgctccaccaatcaatcttcctttcaaacaccatgacgagtttatcagcagatttgaagcacccttgatgagggagagagttttccagttttcagcagagtctattgcaaaactgaaagcaaaggccaacatggagtccaataccaccaaaatctcttcgtttcaatccctatcagcccatgtttggagatccataactcgtgcatgctccctaccatatgagcaaagaacaagttgcaggttaaccgcaaacagtcgaacaagaatggaaccacctctgcctcaggaatactttggaaactcagttaatagagtgagtgcagaaacaacagtaggggaattacttgagaatgatttaggatgggctgcatggaagttgcacatggctgttgcaaaccataacaacaaagtggtgttgcaatcactcaaagagtggttacagtctcctttgatctatcaaattggtcaagccatggacccgtacgttgtgttgataagtagctcacccaggttcaacatgtatgggaatgagtttggaatgggaaaagcagtggcggcaagaagtggatatgcgaacaaatttgatggaaaagtgacatcatacccaggtcgtgaaggagggggaagcatcgatttggaagtgggccttttaccacatataatgagcgctcttgaatcagacagggagtttatgaatgctgtttcgatcagaatcaaagatgttcagagtgaaccaagagtgttgattgatgctattgtcgcgtctagagtggatgcatataagattctggcggaaatcgcctctagtggtgttggtgatggaaacattttcattttcaaaattttggcgcaccccaacgaagttccaaaccagatctggaatttaacagattgggatattgctatgttgtctaccaactatattcagaagggccttctcttcaagaagccagcaactcttgttgatcaacaagatttcatggaaaatctgttggagaagctcaaacgctctctttctctcaccctctcccatttctatcctttggctctggtcgccgagtcacccaccaaacccaagaccctccctcttattctgttttcgctgattgcgacgtcaacaccattgtttgaccaacacaaagcactcaaccatgatgactacaccatgcccctgttgtccatccaagtcactgaactagttgatgctgttttcataggttgttccatgaaccacgttattggccatgcaactgatgtgcccatcgacaatccagaatctattgcaaaactgaaagcaaaggccaactcggagtccaatacccccaaaatctcttcgttccaatcattatcagcgcttgtttggagatccaacttgcagggattgcttgagaaaggtctaggatgggcagcatggaagttgcaccaggctgttgctagagtggtgctgcaatctctcaaagtgtggttagagtctcctttcgtaattcaaataggtcgtttctttgaccccctactgtgtgatgatgggtggctcgcccaggccgtgaaggaggtggaagcattgctggaatcagatgaggagttcatgaatgcagtttcggtgtctaatcccttgtactag

SEQ ID NO: 73605 - DNA, 1388 bp, Glycine max
  Peptide Sequence Number=SeqID_190383
atggcacctcttcccaagggatacaagactcctaattttaccactttatcagtagaagatggcaagtctaccttagagcacgttggacgattcacaacccaatatggaaaggcaagccataacaaatttcacaatctccagcctcaactagatgtgaatgtcaccgatttggtggcattgaaacggaaggttaatgaatcagcaatggaattcttggagaggtttagaaacatggcaggtcgatgttcggtacagtttcttgaagccaaatatgcgaccattgttatgggaaatatgcactttcatttaagaaagaagttgagagcacaagaatgcaatgatatgaatcagttagcctctaaagctacaagggtggagcaactcatcatagataaagaacaaatacaggaaaacaagggtcgtggaccacaactggagtcaattgttgattctgatgaatacactactatttctattcaaggggaagctaagatcatggcatccaaaattgccaggattaagcttgctaataaaagtatttctaagatgattgttgatattgatcttttcccaagtatcgataacattatgatttcatgcagccctagtaagaagaagagacgagccatttggcagtcaaaacaagttgagcatcacgaatacaataaaggactttgtagttctaatacaaagttaccgattactgatgaggatcccattccaaaaggagaaaaggaatggttgagattaaagtgggaaaatggcatgaaaaccttgaggaaaacggtaaaaggcaaaggatcaaaagaggtttcatcctctaaggtgttgaaagctttacaaaaagcttttgtgatgaaagaagattacccaccgacaacatgctcctctaaagaagaacaattgatagaggaaaagggggaatcaaaagacatatgtcatggtcagccaaaaaccaataaggaagagttatacactgacttgaccgataaggcttatatcaacaacaaaatgctaagtagagtgatagtaaatggtagagctctgttaaatgtgatgccaatcaacaccttagagaaaatcggtactcatgctttgggagttttggtggctgatatcactgtcggtactaaaatcaagaagatggtagagatgattcatgccaatagatttatgtttaaagtcgaagttcatattgttgaagctatttactactcaccattcatgaaactgatccagtgcctggaatgtatgaagagggggcgacgcatgactcgcgggatgcgtgttccacgaaaggaatacgcgcagagtcgccaccaacgtttatttgaggaaaacgtcggaaaaaccggaaaagacgcgatctacgaacttttaagtgaaag

SEQ ID NO: 73606 - DNA, 2175 bp, Glycine max
  Peptide Sequence Number=SeqID_190384
atggctgttatggcagaatggtatggcagattttttgccaaccgccataggcaatttgtgaagggaggcccgctatggcagcgccataggccgcaatggcgtgtctatatggcagaattttggccttctgccattgataacatatttgcatcttatattccttcaatgcaagggcagagaggtacagttggttcaatgcctgaaaccttagaatttgattgtggatctgcatcaggcaattctaccgtggatcagcaaatttgctggaataatgtgaatcctgcagagaatcaaatacctgattatatactttctcctggtgatatgaactcatcttatgggaattccattattaatcgtgaatggcaaaatttgagtggatggagcttaggggagccaagttccagtaatacaccaaatgaggttaacaataatgagcaaaaaagagaacttggatggtcatcaaccattactgctggtgcattggctggtccaagactagaagaaaggcgccttgaaccagccaatgctctttcactagacaatgtcaatacaggtcctatgtacacgcgtagccccaattctcgtttgatgtcccagaatctcaacttaaatgcaggtttagcggacaatggcagtgataatagtcaacatctggagctccctaacttaaacaagtctagtgggtcagcaaacgagtgtataccacctaatgttggatctggttcttttctgcttccttctggaaataatggcttcctggtagaagatactgatggtaggccaggttgttctcatgatactcgacgtgtctcttgtaaaagaaaggctgttgaaggaaataatggacaatcttcagatgctgggagttctagctacagtcagcatacagatggtagtgcttggcacaccattcctactcaggttaatgctggaagcagttcaagaagatctatttcctcagaacaggtaaatgcaagacttggcctgggaatgggggatggagcatctgaaaacgttcctgattcaaacattgcaggaagctcagaaagctttcacaggaatttccgtttgaggttaaatccttcaaacccaccaaattctgttcctcccactgcattctcaactgggagcatgattaggcattctggtgtccctccatcctcccaagtatcccaaaggcttcattttgttgataattctctgaacttgaggtcagcaccaccgatagataatgtggttcctcaaagccagccacttgtaattcatgttcctgctttgcctaggaatagacaatcatttagatggagtggtggttctagctccagaaacatccattcatcaaactcagttatatgcgcagacagggatcagcaggatgcaagctcaagaagaatgtctagaaatatgttagaacatccagtctttgtacctgcaactgatttaagaaatttagttcaaaatccaacagttagagcttcaagttcaagtagtgaaaatttaagtattcccggaaatgttgcttcttcatcacggactggatcaaatccagctaccaatccctcatctgccacaactttttctcgttctaatcctccacagcatccacggaggttatctgaatatgttcgtcgttcgttgttttctcccagttctgatgctattggaagtccaagccataattattcttccttgcgctctggtctttctacatctgaaccaagggcgttatcatctgggagtggggcaaacccgagatcagcttcatggttggagaggcaaggtgatagtgaatttggaattccttattcactacgtactttggctgttgcaagtgaaggaggaagtagtagacttgtatctgagctccgcaatgttttgggccttatgcgtagaggtgggaatgtgcgatttgagatgttatgccttggtgacttgttggtcatgggttcgaatccggaaacagtctctttgcatatgcaaggtgccataatggcttcgaagctggttcaatccctatacagatctaattcaaaaaatataattacttgtcctgctccaatgcagatcagttttgatgagcctgtggaggaggttgaaggctcaaggtcttggaaggtgtttggaagaaaaagaaataggccaagactggcaagtcctgaatgtcttgtttag

SEQ ID NO: 73607 - DNA, 945 bp, Glycine max
  Peptide Sequence Number=SeqID_190385
atggagttcaaatatcgtgatgatcaaatccaaaggacaccatcacctttgcggcaccctcttccttccaacacctacgtctccaatcgcccattacaaggtggctttcccagaaatgtttcagtgcctagagtttttctaatggccatgccgatcaatgtcaatgaagtgttccaacgagagttggagaaagagaaaatatggcgagagctagagaaggaaggaatcaggagagaaatcattgctcgcgagatgacatttgcacaacaacgagaactggaagatgaagtgagaaaagaaatagaattggaaagaacattcagaatctcgatgcaacgatcaaatgggatcacatttcgagaaccagtttcagtgtcttttaatcatagtatgggtccgttgaataatattaccatgtctggagggctaccattccatttactgtcacaagcttctaagcaaattaacaaggataaagtgattatactgaataagccagatgatcattgtggtgaaaagcgcaaagcaatgacacttgcaattgatgacaatgagagtctacagaagaaatccaagaaggactggagttgcgagttgtgtcaaatttctgcaacaaggttggattcaagaccagaaagtgaaacacttcatccttgtttaacacccgcggacacatgcaaactggaatctaaagaaaagggccaggttgtccaaaagggcaaaggtttaggtgatttggacgatcaaaatgaaacaactactagtaaacaagcacaggaaacaagcgcactgtcaaaagggaagaaatttgaattttggtgtgagctttgtcaagttcaaactcaatcagaaattgtcatgcaaagtcatcagaatggaaaaaaacacttgagaaatatgaagaaattgaatcacaacaatgatggtgttgcaaatcttggataa

SEQ ID NO: 73608 - DNA, 387 bp, Glycine max
  Peptide Sequence Number=SeqID_190386
atgggttttacatatcttggcaaaagaacaaatgttccatttacgtgggggaagctttgcatcagagcgcaatatacatcaaaagcagaagctgtgggcataactagctacatggatttagaagaggatatattggctactttacttttaagagatataagaaagaaagaaaaaggcaaagaagagagagagagagagagagagagagagaaaggcaaagggcatgagtacgacaggactaagatcagctggaatttgcggtggaaggtggtggaagtggatgaggaggtggtgggaataattataataacaataatagattgcaagatagatagttataatcatgggcgaagcatattcactttcctctttgtcatcactttctaa

SEQ ID NO: 73609 - DNA, 270 bp, Glycine max
  Peptide Sequence Number=SeqID_190387
atgtcgtacacggttccaacaaccaagaaaatgaaacatactaatatgggaactctaataacaactaccatctatgattactactatgcaaccaacaaagcaaaggaatcaaaagaaagaaaaagtagaacagatcctttctctttctctctaacgtttgagaactctattagagcaatcacaggaaaaattgagaaatctcagaaaattgttagagatgcagctatcactttcagaagacacgtgagtccgcttagaggtaagagatga

SEQ ID NO: 73610 - DNA, 261 bp, Glycine max
  Peptide Sequence Number=SeqID_190388
atggaagaaggggtagggcttcaatgtaaaatcgctgaggtcaatgtcaaagaaagcgagggttcaaacgaaggagcaagcagaaagcgagggttcaaacgaaggagcaagcacaaagttctagggttcaaagcaatctcgaaagctagtagaaacagccgcgagaattacgacggtttttttctaaaaatcggcataaattttataaaacataacattctaaggcggttttcaataaccgccttagaaagtgcatcgtaa

SEQ ID NO: 73611 - DNA, 447 bp, Glycine max
  Peptide Sequence Number=SeqID_190389
atgaaaattttctgcagaaaaggttcaagggttgacctttgccatcaagcatatgatgatgatgactatgaaggaagtttttgtgacaaccctttgctggagaagacttcaaatgaatcaaatttagcaagcatagatagccatagaaagtgctttccttttcggtttggtcgtgttggaaatcggcaaaagattgtgattttggttactttgctagttttcatcatcgtggttgcttttgctgtagtaatctggattgggataggaaagaatcccattgattctgaagtggcagctcagcccactcaaaaatgcaacagcttcttcatcaacaagtcatcgatgacatgtgcgtgtcttccctgcaacgacaattaccaaacatcaccattaaaagaaattacatggaacccgcgacctttcttcaacagtacacgaaccagttaa

SEQ ID NO: 73612 - DNA, 396 bp, Glycine max
  Peptide Sequence Number=SeqID_190390
atgtgcattgacaccattaagaaaaagtacaagagtgagaaggctagggtttcagcctccaacaatactctctcttcctcttggcctttctacgagtgcttggacgctctaatcaacctatttgccatctcctttgctgtcgcattggaagaaccaaaatcaagtcgcattggaagaaccaaaaccaaaacccttgctcttctactacgatggacgagggggatgaggaggttggcgaaggcgatagagaggtttgggaagtttatgagaaagtggaggcagattgtggatttgaagaaacaaaggatgaagatgtttatggacacacagaatttgacagttaagcaatcttctttgaataatttgttcaagtcaaggatagctataatgtcttga

SEQ ID NO: 73613 - DNA, 414 bp, Glycine max
  Peptide Sequence Number=SeqID_190391
atgaggatcgggagcatagagcctattgtagacttgttcgccgacgaggtagataccgaaggcgacgacggcgatgccaaggccaggggtggcgtggcggagctgattggtgagcatcggatgcttcctccatgcatcccttctcctgaagaactctccatggatgaaactgaagcccaagaagcccatgggcgggcggagtgtgatgttatgatgattttggttagggtgtgcccctccttctccacttccgtttcatcttcgcctggcttcctctccttctcctttggccttcccaataatccacaaattccaaaacgcaggcaagtcagtgataacaatctgttcaaagaaaaatgcaaaatcaagggtggtcactctctgctctgcacctgtgcaagagcaggaggttag

SEQ ID NO: 73614 - DNA, 297 bp, Glycine max
  Peptide Sequence Number=SeqID_190392
atgaaacccttggagtttgaattcgcattcccccaccatgatatctactgtcacgcctgcctcgcccatcctctctgcgtactgcaaccttgtctactcatcggaaactacgcacatgtgtcttccacacaagaagcggacagaggtggtggcgaggcatatggggcgggcgtgggtgtggatacgttcaaagttaggagtgggcatgggtgtgggaagggcgagagactcagagagttgtgccccaagagactgagagagcacgtgaaaattaagggaaatgaaagcgtaaattaa

SEQ ID NO: 73615 - DNA, 264 bp, Glycine max
  Peptide Sequence Number=SeqID_190393
atggcggaacctcgtggcgaaagggagtttatggaccttctgttgtccccagcttctaaggttttgattaactggtttgagttttgtattgttcatacaaagagtgtgaataccatgctatttattccatatagatatgttgaaggtggaatggacttaatatccaaggctattggtaacgctgctattgaatctggagcacatgtaaccaatgttgaggtattccatcaagaatctctaactttcaaattacttcctccatag

SEQ ID NO: 73616 - DNA, 144 bp, Glycine max
  Peptide Sequence Number=SeqID_190394
atggaatctcacctgaagagctttgcagtacatgtctacaatttttccatgtgctcactgctagctatgtctacaagccaagttactcataacaagttgcatgtaaaaccacctcccaaccataacaacttctaccaagactaa

SEQ ID NO: 73617 - DNA, 792 bp, Glycine max
  Peptide Sequence Number=SeqID_190395
atggagataatttccagtttggagtataagctctcttgtgctgaagaggacgtgcataggctaaattccaagatagttgatggggttgaaaaattacagagttcaaaacaaaaatgtcttctcttggagacatcaaatcacactctgcagtcagaattacaatctttggcacaaaaagtggggtctcaaagtgaagaacttaatgagaagcagcaggaattgggtagactttggggttgcatacaagaggagagactgcgattcattgaggctgaactgctttccaaactcttcagcagttgcattctcagtctcaggaatagcttagatctcttgcttttgaacttaacagtaaagtggaaatactggggaatgtggaatctccaaaaagtgaaaaaaacagaggaccctcattttcaaagagtgatatctttcaaattgctaccaaatgaaatgaagggaacactacatgtgatctctgaaaggctaggtagaaaatgggttgacctttgccatcaggcatatgatgatgatgactatgaaggaagtttttgtgacaaccctttgctggagaagacttcaaatgaatcaaatttagcaagcatagatagccatagaaagtgctttccttttcagtttggtcgtgttggaaatcggcaaaagattgtgattttggttactttgctagttttcatcatcgtggttgcttttgctgtagtaatctggattgggctaggaaagaatcccattgattctgaagtgacagctcagatggacttgctgagaatttag

SEQ ID NO: 73618 - DNA, 927 bp, Glycine max
  Peptide Sequence Number=SeqID_190396
gactagacgtcctcgctatcagagggttgcacgtcctcgccatcaaagggctgcacgccctcaccttcagaggctacacatccttgccttccaagggctacatgccctcaccttcagagggctgcacgccctcaccttcagagggcttcacgccttcgccatcagaagactacacgtcctctccttcagaggactgcacgtcctcccctttagagggctacacgcccccgccttcaggggtctgcacgtcctcaccttcagagggctgcacgccctcgccttgagagggctgcacgccctcgccttaagagggctgctagtccttgcctttagagggctacacgtcctcgccatcagaggactacacgtcctcgtcatcagagggttgcacgccctagccattagagggctgcacgccctcaccttcagaggactatacgtcctcgccttgaggactgcacggctacacgccctcaacatgagaggactacttgtccacgccatcagagggctgcacgccctcaccttcagaggactacacgtcctcgccttgaggagtactcatccttaccttcagagggctacacgccctcaccatcagaggactgcacggctacacgccctcaccttcagatggctgcacgccttcaccttcataggtctacacgccctcaacttcagcggactacaagtcctcgccttgaggactacatgtcgtcaccttcagacgactacatgtcctcacactcagaaggctacacgccctcaccttcagaggactacacgccctcaccttgaggaatacacgtccacaccttcagagagctgcacgctctcaccttcagagggcttcacgccctcgccttcagaggactacatgtcctcgccttcagaggactgcacatcatccccttcagaggactacac

SEQ ID NO: 73619 - DNA, 723 bp, Glycine max
  Peptide Sequence Number=SeqID_190397
atggcggctcacggcggtcatcgctggtcttgggtggtgaaaaatgaggttttagggtttgggccgggcttagcgcacccttgggcgctcggcgcaacttcctctctggttggaattgggcttagcgcacctctgggcgctcagcgtaacttcttctctgttggaattgggtttagcgcacctttgggtgctcagcgcaacttcctctctgttggaattaggcttagtgcacctctaggcacccagcgcaacttcctctctattagaattgggcttagcgcacctttgggcgctcaatgtcattccctctctgttggaattgcgcttagcgtgccattcatgcttagcaagagatcaaaaggtttgaaggaacctggtacttataggagtaggatggtgttgcgggtcctttgtcacataagatgccacatgtattttgtggaccttggacaacacataagccctccgagctttgagtcggcttgtgggcaaaagaggttgtccagggttgaaggagcccccaagtatggacaaatgttgtgtgatgttgagagcggtaacctcgacaagtgtaagagttacaggtctatgaagcttgtgaggtctagcgtgcgtgtgtggcacaggcatagtactcttgtgtacgtgtcactcatggagtgggcacgcactagattcgtggtgcgtgggttagaagggctgcattgtggtgtgaaattttag

SEQ ID NO: 73620 - DNA, 1134 bp, Glycine max
  Peptide Sequence Number=SeqID_190398
atggaccgggaggttatttccattggtggttcctcctcggaggatactcatcatggtgcctctgacaatgaatcctctatcttggagaggttgagggcttcacgttgtactggtggaggcaccacttgcctccgtgaaagggcgcgaccttctgctacttccccggccagggaacctatcccaaccatggtggttcttcccccttcttcttctagggagcaaggagaatcggtagggacgtttgggtgtctcctcgcatacgatgtaggcatactgctgggtttccatcatccccacctatcattgttggctttgagtggcgtgtccaagaagttgtttgagtttgacttaaacgtttttctccgcttcaaggtcctagctacttatgttgtggctaatggttttccacttatgttcaacaaggacggggagccctgcttcccgttctactggcagtctaaccccaccaggaggaagcaagatgacaacattggggtgtcaggccataagaagttgagggcccctataagtcttcgtgcacttaggctagttgtagggttgacgcctagtcgggagattactcctgttgctggagttgatgtgtcgactacttcatctagttttgttgtggtgtcttcgtccaccgttgccacacccttgctgagtgccggtgtggtgaccactagtgctcctatgatgttgtcgcccccttctttggctccatcggttcctccctttgctgtgttggcaacggcggtgccttcctcatcttctcgttcccatttttctttggatcaactgtacacttccagcgatgctaattcactgtacagtgcaaattacaaattggagcagaagaccccagttagctttgtgtcagccttttatagaaaccttatttggtcagctggggtgcagaatgctatggactccaccaaagtcttccttcagagaagtttggtgattcaggaggagaatggacaatggcaccaagagactctacgcaaggtggcgtccttggaggcggaggtcaccaagtggaggcctattgctcacacggtttggagacaggagcacccaaaggtagctaatgccactattgctgatgtgtcattattttctcatatttcttaa

SEQ ID NO: 73621 - DNA, 634 bp, Glycine max
  Peptide Sequence Number=SeqID_190399
atgagatgggcggagagtgcggccttaaatagccggtgggacaggtgccaactactaacaataatactcctcctccgttgtgaaattggatctatcgatctcatctccgtcatggctccgaatccgatgaagatgaacatgaagcaatctgccaattccactacaactaccatagctaataaggagattctggtccgtgaaacgatgcgtatcagtgccaatttggcttccacccctctcctcgaagccccgccgccgccgtcgcccattgtcggaatcatctgctgcgaagaattggatgggcgtcgttggaagtacgtggccgagagcgatgcccgtggcggattcaagaagaattcattccgccctgtcaggctcaacttccacaaccctcgcgaccaccctctccatgaagtcctcgctttcgttacatcctatgttgtccccgaaggttttcctgatagtgttattccttcctatgtcccctacatgacatggagggctcttaagcactttttcggtggagcaatgggcgttttcacaactcaaaccctcttgagttctgttggcgtctctagaaacagagctgctcctggggctgtcgccatcaactggattctcaaggatggcgctg

SEQ ID NO: 73622 - DNA, 3525 bp, Glycine max
  Peptide Sequence Number=SeqID_190400
atggccaatttagctttgactggcatactagaaaagatgactgggaaggacaaagattacagatatatggccacatctgatttgctgaatgagttgagcaaaacaacgtttaaggccgatgctgatttggaggtcaaattggcaaacatcatcatacaacagcttgatgatgcagctggtgatgtttctggacttgctgtcaagtgtcttgctccgttagtgaggaaggtgagtgaggtaagggttgtggaaatgaccagtaaactatgtgacaaattgctaaatgggaaggatcagcatcgtgacattgctagcatagctttgaagacagttgttgctgaagtttctactcagtctcttgcactatctattctccagactctcacaccgcaattgataaaaggaattactggtcctggaatgggctctgagattaaatgtgaatcgctggatattttatgtgatgtccttcataaatttgggaatctaatggcagctgatcatgaactattattaagttccttgctttctcagttgagttctaatcaagctagtgtgcgcaagaagactgtggcatgcattgcatctctctcttcaagcctgtcagatgatttgttggcaaaggcaactgttgaagttgttaccaacttgaaaaagaaagttgccaagtccgaaatgatccgtaccaatatacagatgatcggtgctttgagtcgagctgttggctaccgatttgggccccatcttggagacactgttccagtgctaattaattattgtactaatgcctcagaaaatgatgaagagcttcgtgagtacagcttgcaggcactggaaagctttctcctaaggtgcccaagggatatttctgtttactgtgatgaaattcttcatttgactctagaatatcttagttatgatccaaattttactgacaacatggaggaggatactgatgacgaaggtcttgaagaggaggaggatgatgacagtgcaaatgaatatacagatgatgaagatgtcagctggaaagttcggagagcagcagctaaatgcttagcagcattgattgtttctcgtcctgagatcttgtcaaagctgtatgatgagcaaaaaggttgctcctttaacacggatatgttgcagatggatgtatttaatactttcattgagctcttgcgtcaaactggaaatgtcacaaaagggcagattgatgcagatgaaatgaggcaacaagaagtgtcaaagattgtcaaatctataaataggcagttgcgtgagaaatctattaagacaaaggttggagccttttctgttttgaaagaacttgtggttgtattacccaactgtcttgcagatcacattgggtcactcattccaggaattgaaaaagcattgaatgacaaatcatctacctcaaatttgaaaattgaagccctaacatttacaagattggtattatcttcacattctcctgatgtttttcacccttacatcaaggctctttctgcccctgttctatcagctgttggtgagcgttattacaaggtcactgcagaggccttgagagtatgtggagaacttgttcgtgttgtgcggccaaacattgaggggtctggttttgatttcagaccatatgttcatcccatatataatggcattatgtcacgcttaataaaccaagatcaggatcaggaggttaaggagtgtgctatctcctgcatgggcctcattgtgtcaacgtttggcgaccatctaaatgcagaattacctgcatgccttcctgtgcttgttgatcggatgggaaatgagataacccgacttactgctgtcaaggcattcgctgtcattgctgcttctccacttcgggtggatctatcatgtgttctagagcatgtggtagcagagttgactgcatttcttagaaaagctaatcgtgctctaaggcaggctaccttgggaaccttaaattcacttatagttgcttatggcgataagattatgttgtctgcttatgaagttattatcatagaactgtcaggactaattagtgattctgacttgcatatgacagctcttgccctggaactctgctgcacattaatgggtgacaagaggtcaaatcaaagtattggcttggctgttagaaacaaagttcttcctcaagctttaacattaattaaaagctcactgttgcaggggcaagcacttatggctttgcaaaacttttttgctgctttagtctattctgcaaatactagttttgattctctgctggagtcactactagcctgtgctaagccttctccacagtctggtggcattgctaaacaagctttgcattcaatagctcagtgtgttgctgttctatgccttgctgctggtgatcagaagtgttcatctactgtgaaaatgcttactgacattctcaaggatgacagcagttctaactcatccccttttgaagagataaagtctgctgcctcatacgctcttggtaacattgctattggtaatcttccaaaatacttgccatttatcttggatcagattgataatcagcagaagaaacaatatctcttgcttcattctttgaaagaggtaattgtcagacaatctgtggataaagcagagtttcaagagtccagtgtggagaaaatacttaatttactcttcaaccactgtgaaagtgaggaagagggagtgcgcaatgtagtggcggagtgtttgggcaaaattgctcttattgagcctgtaaaactcatccctgcactcaaggtaagaacaaccagcccagctgcatttactcgagctactgttgtcattgctgtgaagtactctatagttgagcgtcaagagaagatagatgagattatataccctgaaatatcttcatttctgatgcttatcaaggataatgataggcatgttaggcgagctgctgttttggctctcagcacatttgcacacaataagccaaatctcatcaaggggcttcttcctgatctgctgcctcttctatatgatcaaactattgttaagcaagagctcataaggacagttgatcttggtcctttcaagcatattgtggatgatggacttgaattgaggaaggcggcttttgaatgtgtagacacattactggatagttgccttgatcaagtgaacccgtcatcattcattgttccttatcttaaatctggtttggatgatcattatgatgttaaaatgccatgccacctgatactctcgaaactagctgacaagtgtccttctgcagtcttggcagtgttagattcattggttgatcctctccagaagactattaattttaagccaaagcaagatgctgttaagcaagaagtagatcgtaatgaagacatgattcgaagcgcactccgagctattgcatccttgaatcgcataagtggaggagattgcagtgtcaagttcaagaatcttatgaacgaaatatcaaaatcacaaactctctgggataaatattattcaatccgcaatgaatga

SEQ ID NO: 73623 - DNA, 276 bp, Glycine max
  Peptide Sequence Number=SeqID_190401
cgcactgtggagtggatactacccacgcctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttcttgaggtggattctcccgaggaagtcatgtcggcatctgaggcagactctacggaggatagtggcccgagggagatggcgatcagcggaggctcttcatcctag

SEQ ID NO: 73624 - DNA, 117 bp, Glycine max
  Peptide Sequence Number=SeqID_190402
atggcattgttatttttgcctcacttcacgttgctcccaattatggacacttgctatgtctccaacgtaagtgatgatgtagtacctttaaatgatatcggatcatcatttaattga

SEQ ID NO: 73625 - DNA, 204 bp, Glycine max
  Peptide Sequence Number=SeqID_190403
atggcaggacccccaacccaggagaccaaggtggatttgttatttatcttccaaggggctaaatattcgcaaaggtggagattgttgtgcatgactcgtattttatgggccgctcaaatgttggagcagagtgtaaaggccgcctattgttgggttacgaagcgggttaggggtgcaagtaaagctcgcgatacgcattcctga

SEQ ID NO: 73626 - DNA, 635 bp, Glycine max
  Peptide Sequence Number=SeqID_190404
gggttcagtaaaggtggaccgggttggttagtttgtaagttgaagaggtctatatatggattgaagcagtctccaaggcaacggtacaaatggtttgattcctacatgcttcggattggctataagcgatgtgagtacgactgttgtgtttatcttgatgatggctcttttatttttctactattatatgttgattatatgataattgttggtaaccatttgtgtgatgtgaatgagttgaaatcactgttgagcgaggattttgacatgaaggacttgggtccttccaagaagattcttgggatggagattcacaaggacaagcaatccatacggttgtggctctcacaacagggttatgttaagaaggtgttagacaagttcaacatgagcaatgcgaagcctgtgagtactccattggcaaaagactttaatcattctgtagatcaatgtccgaagacagatgttgaggtggactacatgtcaaaggttccatatgccaatgtagttggttgcttgatgtatgctatggtgtgcactagaccggatttggcacatgttagtgatcctttagttgcgggatatgtggattctgactatgctagtgatctagatgacaaaatatctacaaaaag

SEQ ID NO: 73627 - DNA, 313 bp, Glycine max
  Peptide Sequence Number=SeqID_190405
atggttctccacacctttcgtcaaccagaggcaaacgagcccgttgacacgcagagactaacgtcgtcttctgcaccttttgtcatccatagacaacgagtccggttttactttcatcatctagagacattcaagtccctcgacgcgcagtgccttctggtggaagcaaccctgctcgcctgggcaagctgggcggcaaccacctccctcttttctcctataaataggagaaagagggcagagcaaaatgttcagcccttctggtttcgtggagattcttcaccgttcttcatcgttcttcagtcttcaaccg

SEQ ID NO: 73628 - DNA, 426 bp, Glycine max
  Peptide Sequence Number=SeqID_190406
atggagtccggtgacatgcggagatacccaagcggttatccatacaaacgatttctgttaaccctgacccgggaaactagcgttatcttctgcaccttttttcatccagacccgtggagtccgatgacatgcggagatacccaagcggtgaagttaggtggcaggcggagatacccaagtggttatccatataaacactctttcgctatccctcagactcaaagtccggggggaagcgagcctgttgaggagcagatactaacgtcgtcttctgcaccttttgtcatccagacccatggagtccggcgggggtaccgtatggttaaccgtacctttcatcaaccagaggcaaatgagcccgttgacacgcagagactaacatcgtcttctggaccttttgtcatccagacccgtggagtccgatga

SEQ ID NO: 73629 - DNA, 657 bp, Glycine max
  Peptide Sequence Number=SeqID_190407
atggaaccagaatattggaacaaaaatcccttcaaggctacagctaaggctttccctccagtattccatttcaaacccactactatcaataaaacaaggactttctatgagttcatactgatagactcaaactcagtgtctatcaaacatttcaaagatccaaaaggccaatctttaaacactcattcaacaatccagatcctaaaagtaatgcagccaagacaatttggaccaaacctaaatcaagccaagaaattctctgcaccctttgatcgtgtaggttatacctatcgggattatatcgatgcctggaccaaagcattctggcaccaaaataccagattcaaacattcatggcttatttacttgaagactaacataatctacaattttcccaattggtacaacaaaatcgaagggaacaagaatttcccgtcactacagaggcatgcctttgtaaagtggtggacacaatttgatgtatccaaagtagaactagaacaggtcaggctttggtttaaggctcatcccgagctcctcaaagcagctgatcctaagacttcgttgtttcttaaccagaagtcccaacttgctgcattccttgcaagtgctagatcaaaagaaagtctggccaaaaatctcaaagaattcttatag

SEQ ID NO: 73630 - DNA, 660 bp, Glycine max
  Peptide Sequence Number=SeqID_190408
atggagccggaatattgggacaaaaatcccttcaaggctacagctaaggctttccctccaggattccagttcaaacccactgctatcaataaaataaggactttctatgagttcatactgatagactcaaactcagtgtctatcaaacatttcaaagatccaaaagaccaatctttaaacactcattcaacaatccagatcctaaaagtaatgcaaccaagacaatttggaccaaacctaaatcaagccaaggaattctctgcactctttgatcttgtaggttatacctattgggattatatcgatgctgggaccaaagtattctggtacaacaaaatcgaagggaacaagaatttcccgtcactacagaggcatgcctttgtcaggctttggtttaaggctcatccagagctcctcaaagcagatgatcctaagacttcgttgtttcttaaccagaagtcccaactcgctacattccttgcaagtgccaaatcaaaagaaagtttggccaaaaatctcaaagaagtcttacagatcctgcagcaagaagaagataaaggttcctcatcaaaaaaggaagaaactaactcttcagaagaagatgatcctttttaccaaaacgaagatgactgttttggtatttctttaaatgatgattaa

SEQ ID NO: 73631 - DNA, 491 bp, Glycine max
  Peptide Sequence Number=SeqID_190409
atgagtcatcgttcatctagtgttaatggtgaggatactagtcataaggaccctctatctagaatattatatgagttaagttccctcaagttagggaaagaaaaactagaaagaaaagaaaaagaaaaagagagggtagaaataagtcaagatgagagggaacaaataagggaagaagaaagaaggaaaatactaaaagagttaagaaaagaaaaatatgcctcctatagtactcatgactcttgcaagagcctaagtgaagaacttcgtggctattatgaaggaaggcataggtcacatcttagacctcactcccataggagagaaaaggaaagaaagcctcaagaggctaacattaacctcccatacttccatgggaaggacaatgtagaggcttatttagattgggaaatgaaggttgagaaactctttgcttggcatcatacaagtgaggaaaggaaggatcctttggctactcttagcttccaagg

SEQ ID NO: 73632 - DNA, 414 bp, Glycine max
  Peptide Sequence Number=SeqID_190410
atggatattgatccattccacatccatgttaattatatcgagcccatgcagatcttaatgatgggaactttgataggatcaccaaaggtgaatactcccttatatgaagaagagaatgcgacagtcttcgatcctcctactgatgaaatgaggtgtcatgtgaagccactccactttacatctatggtggaagagcaaatcattcataagatattggtagatggaagggttgcattcaacatcttaccaagattaatgtcgcagaggtttggtaaaaatatagaagatttgatatctcacaacatagtggtatccgatttctatggaaaaccttcagattttgaggggagagtgaatacatgtggtatgagtagttccatcaacggttcaccagaagcttttcttttggaatga

SEQ ID NO: 73633 - DNA, 615 bp, Glycine max
  Peptide Sequence Number=SeqID_190411
atgggtgaagtagacgaggtgcaagagcggataaaggctgacatagaggccctgaaagagcaaatggccacaatgatggaggccatgatgagcatgaagatgatgatggaggtcaatgcagctgcagttgtagttaccagtgccgttgttgaggtggacccaactcccccattcgacctcaaccaaataaaccatccaacctcggatatgataagtcagggaggcaaaaaattgggaagtacgggcggcccccattttgtgcaagttcaaaacaagcatgccttcccgccatgtggcttgcctcctaactatgcaccacccaatgtggtgcatattcccaatgagaatgtcaataactccactcccatactcgttgagagccaacaaccccaagctgatcatgcacattgggaagagcccctcttgcaatatctaaaaaagggaaagttggatcaaatagaggaaaggctaaggacagctgaaggaggtcaagattatgcctttgctgacatggaagatttgtgcctagtacccgacatggtcattcttccgaagttcaaggtaccggaattcgataaatacaaggggacaacttgccccaagaatcacctaaag

SEQ ID NO: 73634 - DNA, 408 bp, Glycine max
  Peptide Sequence Number=SeqID_190412
atggctattgtggttgtcgaaatcaaggaaacgactactgtgactgtcaaaatcaaagaaacggctactaaggctcttgaaatcatagatacagctattgcggccgttggaattaaggaagtggctactgcggccgaagaagaaagaaagatggatactgatgtcaccgtaaacaagaaagtattggttgaaaaagaaaaatcaaaagaaaatgtttttgagcaaaaaaggcgaagaattaaaattggactagaattggtggaacataaattgcttatttatgaagggaagaaaccagtaaagaaagcacaaaggagatttgctcttaatgtcatggaggtcatcaaagtagaaatagaaaggctactgaaggtcaatttcattttaactgcaaggtatgttgactag

SEQ ID NO: 73635 - DNA, 548 bp, Glycine max
  Peptide Sequence Number=SeqID_190413
atgtccctagaaagaaaagaagaagtgaagaagcaattcgatgttgacttcttggttgttgctcgatacccggaatgggttgccaacatcgtgccagtccctaaaaaggatggaaaggataactttcctttgtcgcacatcgacatccttgtagataacacgaccaatgtttccctgttttctttcatggatgagttcttaggctataatcagataaagatggcaccaaaggatatggaaaagacaactttcatcaccctatggggaactttcttctacaaggtgatgtcctttgggctcaagaacgctgggcaacttaccagtgggctatggtggcgaatagaggtagacccagacaaggaaaaggccatcctcgaaatgcccgagccacgcacgagaagtaagtctgagttcgtccaatgggacgatgattgtcaagtggcgttcgaaaggattaaatggtgccttatgaatcctcttgtgctcgtgccaccggtgcccggaagaccccttatcttgtacatgactatgttagatgagtcaatggg

SEQ ID NO: 73636 - DNA, 776 bp, Glycine max
  misc_feature (774)..(774): n is a, c, g, or t
  Peptide Sequence Number=SeqID_190414
atgtcttcatttctatcagattccgccatcggcataggaggaagtgatttacggggtttgattcagcaacctctaatggaccaggagatcatttccattggcaattccccctcgaaggatactcatcatggtgcctctgatagcgaatcctcttcctcagaaaggttgagggcttcgcgccagattggtggagacacatcttgtcttcgggggagggcgcgaccttcagccgcttcccaggctagggagcctatcttggagaagtggtgggatgttagggcgtctcctcgcatgcgacatagccatagcattgggtcaccatcatccctacttgtcgttgctggctgtgagtgggtgaagctggcgaatcctgaggactcctacaaggtggtcatccaggcctgcaggagtgatgatttccctttcttgagggcagtggcgggcagtctagcctttttcttcatgtacaagtgtttgtttgagatgaagttgactagcaagattggctgggtctcattgaacaatatgtccaagaagctatctgagtttgacttaaatgtctttcaccgctttaaggaccatttcttcaaggtcttggctactgatgccgctggacttgctagtgggattgtgccaccgtccactatcccccctattgttgaagaagggggccaacctgctggtgaggttggccctgttactggtgaagctgaggttgcccctagtgccccttcctctattttggctaagaggaagcaagatgacaactctggngt

SEQ ID NO: 73637 - DNA, 201 bp, Glycine max
  Peptide Sequence Number=SeqID_190415
atgaccaatagcgagttgacgacaagaaggggttgcaacatcgcgaaagtgagactatggccgagaagacagaggagttgcagtgccgcagaagagagaggtttaaaccaaatgggagtgatagtgggcgcgagagaagggatgaataatatgcacttcaattgtgcatacttctctggggttaggcttgattccacttag

SEQ ID NO: 73638 - DNA, 144 bp, Glycine max
  Peptide Sequence Number=SeqID_190416
aggaactcgttggcctcctccaatgatattgggatcggggcgaactccggagccttctttgctggaaggtttcttccaatgttggagcccatgtcagggttggcattgccggctaggcgaggttgggctggagccgatgtctga

SEQ ID NO: 73639 - DNA, 519 bp, Glycine max
  Peptide Sequence Number=SeqID_190417
atggacagcggcaccaaaaggctctgtataaggtgtcgtcctaagttagccatcgctaccatcgccttcactgaagctgtaaggtcagaccaccaattgtcttccaaggttggcaatgtcttggccaagttgttgtgcacaaggttggagggtgatgaactgtccacacaatgcaagggcttgcaggaagagaaaaaagacttggatagcaaggtggaagacattatggcggagagagatgagcttgccaagttagagtccaagctggaggagtccgagctacgggtggccaaggaaaaagaggccgacaaggagatcgaagaggagctaacaatgtataagaaggaggctatgaagcagcatgagaatgactttagcaaagccgttgatttgggtctttttgaaccttttaaggacgtgaaggacaatgttctgcttgacgaggaagatatcgctattaaggatgaggttggtgagaagcagggtgctgaggagcaagacaatgatgccactgtttag

SEQ ID NO: 73640 - DNA, 360 bp, Glycine max
  Peptide Sequence Number=SeqID_190418
atggagctttttcccctgatggttataaggagtgtgtttgacttgcccatggttacaggtcttgtcaaccagtctggtgatgggtcgtcttggcctatggagcctgaaccttggactttggtcgtcatagttgccgtgagtgagcggaccaaggggattcaagggactaaccgcctaaaaattctttgtcttaacacattggagggtacatcctttgtggtacaagtagaggggtacatccacttggttgttcaaagagaacaagggatggtacatcccttgtggatctttgcttgtaaaggattttacaaggttattgaaaatctcaagaaccggtggttgcttggggattggatgtag

SEQ ID NO: 73641 - DNA, 207 bp, Glycine max
  Peptide Sequence Number=SeqID_190419
atggcaagcgacttgtcgtttttgttcgtcggcattcgtttcgatagaaagaagttcaatgctgatattgccagtgatactgattcggcgatgattttgagcactgccaaagacgaaggcgagaaaacaatagaacctctggaagaagagaaagtcgtggccatcaacgacgaagaagaggaagcacaagggaacctcttccggtaa

SEQ ID NO: 73642 - DNA, 408 bp, Glycine max
  Peptide Sequence Number=SeqID_190420
atgcgaagtaaatcttctacaggtgatctagttccactggatttggaaattgaagccacttgtagaagaaacaacgcaaaaagaaaaaggaaaatactgcaggacaggacaacaccaccaattcttgaggaacctcaatcatccgagtcgtcttctatctttccacagaaaagggaatctacaacaggggcacctgaggccaacataatggctgaagatcaacctagaagagtgacccttgaagactactctagttctgctgtgccacaatttttcactatcaagcttgcaggtgtgctggaagatgctttgcggatgagtttgttctcattttcgctgtctggagaagcgaaaagatggctacattcgtttaaaggcaacaccttaagacttgggatgaagtggtag

SEQ ID NO: 73643 - DNA, 1581 bp, Glycine max
  Peptide Sequence Number=SeqID_190421
atggcggaggtagggtttcaggaacgaagctcgtggagagtggggctgagagcgcgctatagcagccccgactctgtggttttcactctcgaatcgaacttgagcctcttctcctatgcgtccgcgagcgttgatcgatgctccttttcatctgattcacacgaccacgactctttcgtctccgaaatctcactggatatgcggtggtggtggcataataataataataatggaaaagattacaaacacgccacgagggcttttaatttcggaaaaattgacgctgatattcaagaacccgtggagttggattctgccagaaactctttctctttagccctcaaagaggctgcttctttggatctgaacaatgcctctggctctggatctttgccgcgccttcaaacattgaaaaagacttccatttcttctcgaaggtctggtactgccactttccctagtcctggtacactcaattatcgcgttgcaatgcacaagggatggagctccgagcgagttcccttgcatgcaggtgctacccggaagcacgttttgccgttcaacaatgggaaaacattgccgtcaaagtgggaagatgctgagaggtggattctcagccctgtttcggcagatggcactgggagggcctcgcttaatgcaccccaaaggaggccaaagtccaagagcggtcctcttggaccccctggtgttgcgtatcattctatgtactcgccggccgcgccggtgtttgaagtggggaatggggggagttttatggaaggttctccgtttacaggtgatgggttaataatctgcaccggtggccatggtggagctctttccgtgagaacagaaccttgcatggcacgctcagcaagtgtccacggatgctctaagatacagagtcagtcatcatcaatgcccctccaagaggataagtttggtgggttcaaagatgtgggcaccaatgtgtcccgtgccacttcaaggagggacatggcgacccagatgagcccacagggtagctcacgctcctctcctaatctgaggccttctttctctgcctccaccccatcaaccttgcctgtcacagaattgcggactgttggttcctctaaagtggatattagggatgtgcaggtagatgaacacgttaccgtgacaagatggtccaagaaacatagggccctattcactggcagaggctcagaaaaagtcgaaagctggaaaaaagaactaagcactcaatcgtcaacttgggacgtttctgaaacgtcaaagcctgcctcaaagacaagaagtgaggaagccaaaatctctgcatgggagaacttgcaaaaggcaaaagcagaagcagcaatacggaaactagagatgaaattggaaaaaaggcgagcatcctctatggataagattatgaacaagcttagattggcccagaaaaaagctcaggaaatgagaagttcagttccacacaaccaaaccgatcgggttgtaagaacttcacacaaggcttcatcatttcttagaaccagccagatgcgttctttgagtggttgtttcacttgccatgtcttttaa

SEQ ID NO: 73644 - DNA, 777 bp, Glycine max
  Peptide Sequence Number=SeqID_190422
atggagcagcagcacatggacatgatgaccatgatgatgttgcagcacctccctgaattctctgaaccatacactcacaccatggaaggatttcatcccccatcagaagagttctgcggtaacaacaacaacaatatacgcaacactatgcaactagcagatttaattgataacaataaccctcttagtcccataccttggtcctcctcatactcattcacacacttgccagcatccactaccgaaatctctttctccaataatagccatcctactaccccaataatgcttcaagaacacgaacaacaatatgagggtgcaaatgcaaacccttacggaggtgagaagcggaactcgatggcggcgatgagggagatgatattcagaatggcggcgatgcagccgatacacatagacccggagtcggtgaaggcgccgaagcggaggaacgtgaagatatcgaaggatccacagagcgtggcggcgcggcaccgcagagaaaggataagcgagaggataaggatactgcagagactggtccccgggggaactaagatggacactgcttccatgttggatgaggccattcactacgtcaagtttctcaaaacgcaggttcagtcactcgaacgcgcttcctccgctaacaacaatatcaggccacttaacgctgcaggccagataggcttccctgttgcttccaccccttattttcctctgcctagtaaaccttaccaagctccaaacatggacaatatgcacgatacatatcattaa

SEQ ID NO: 73645 - DNA, 132 bp, Glycine max
  Peptide Sequence Number=SeqID_190423
atgcatttggctagatctggcaggaaaaagctggtcccgaaatatttaccggaaaaagctccttccacggacaaaactaagagatgtaatccaactgtcggtgcatggctcacgggtacggtactagtttag

SEQ ID NO: 73646 - DNA, 450 bp, Glycine max
  Peptide Sequence Number=SeqID_190424
atgccggaaggccaaaattctggccatagaaacatggcattgcagcctatggctttgtctagagaagctggaaagctggtagatagctacatatcagataagatgttacaattaaaagagcaaatcgctacacttgagaagcgagaagaaagatacaagactgtgtttgcagacagaatttcagttttccggagggcatgctgtgagctttttggttacaagattgtgatggatgaacaccagcgttctaatggaatcccggtgacacggtttaccttgcaatccatttatgcacaaagtgatgacgaaaagcttgaatttgaatatgaatcagggaatactaacattttggcaaatcattatacatctcagcctgaagtttctcgtcaggatctgatcttgtatttctttgaccacgatcatcaatatgattgtgagggttttgtttaa

SEQ ID NO: 73647 - DNA, 1620 bp, Glycine max
  Peptide Sequence Number=SeqID_190425
atggaggcatcacccagtactctggattggagaggcagaccatccaaccctgccaaacacggtggaatgattccggctgcttttgttcttgggttgcaagcatttgagataatggcaatagcggcagtgggaaacaatctgataacttatgtggccaatgacatgcacttccctttgtccaaggctgccaacctagtcactaactttgttgggaccatctttctcctctctctcctcggcggctatctatcagactcttaccttggcagcttctggaccatgctcctctttggtttcgtcgaactttctggtttcatactgctatcagtccaagctcatgttcctcaattgaagccacctccatgcaatgtgaacgatggagaacagtgcgtagaagcaaagggcatgaaggccatgatattctttgtagcactctacttggtggcattagggagtgggtgtgtgaagccaaacatgcttgcttatggaggagaccagttcgagcaaaacgacccaaagcagttaaagaagctctcaacctacttcaatgccgcatattttgcattctctgtgggacaacttgtgagcctaaccattcttgtttgggtgcaaactcattcaggaatggacgttggcttcggggtatccgcagctgtaatggcaatgggattgataagcttgatatgtggcactctatattacagaaacaagcccccacaaggaagtattttaactcccgtggctcaggttcttgtcgctgcattttccaaaagaaaccttccatcttccccatcatccatgatcagagtggaacaagttgagcaagtgaagatattgctatctgttattccgatattctcgtgcaccatcgttttcaacaccatcttagcacaacttcagacattctcagtccaacaagggagagcaatggacacccatctcaccaaatcctttaatatccctcccgcctcccttcagtccattccttacattttgctcatctttttagttcctctctatgacaccttctttgtcccatttgccagaaaattcaccggccatgagtctggaatctcacctttgcgccgaataggctttggtctttttctggctaccttttctatggttgcagctgctctgttggagaaaaagagaagggacgcagctgtgaaccatcacaaagttttgtccatcttttggataaccccacaatacttgatatttggcttgtcagagatgttcacagccattggcctccttgagttcttttataaacagtccttgaaagggatgcaagcattctttacagccatcacatattgctcttactcatttggcttttacttgagcacacttttggtttctttggtcaataagatcacttcaacttcttcttcttcagctgctggctggcttcacaacaacgaccttaaccaggacaggcttgatcttttctattggttactggctgtcttaagcttcctcaacttcctcaactatctcttttggtccagacgctattctcatgctccttccgcactaccccaacctaataatgccaaggaaatcaacccctactcacaactacatgatcaccatcacaataatattattccatag

SEQ ID NO: 73648 - DNA, 2010 bp, Glycine max
  Peptide Sequence Number=SeqID_190426
atggaagcttctagaatagaaaatttgattagagccaagaaatccttgaagattagcttagagaaatcaaaatcggtagggttagcgctagagaaggcggggccgaggttagatgaaattggggtgaggctgccgtcgctggggtcggcggtgcggccgattcgggccgagaaggacgccctcgcggcggtcggcgggcacatcaaccgcgccgtgggtcccgccgcggcggtgctcaaggtttttgacgccgtccacggcctcgaaaagtcgctcctgtcggatccccggaccgacctggctggatacttgtcggtgctgaagcgcctccaggaggcgctgaggttcctgggggacaactgtgggctggccatacagtggttggaggatataattgagtatttggaggacaattctgttgctgataaggtttatctcgcgaatttgaagaaggaattgaaaaatcttcgcgaatcgcagcatggtgagcttgatggagggttgttggatgctgcattgagtaaattggaggatgagtttaggttgttgttgggtgagaatagtgtgccattgccgatggcgtcggcaagcggggatcaggcgtgcattgccccgtcgccattgccggtgtcggttgttcacaagctgcaggcgattctcgggaggttgattgccaatgacaggctggataggtgtgtggggatttatgttgaggtgaggagttcgaatgtgagggcaagtttgcaggcgctaaatttggattaccttgagatttctgtggcggagttcaatgatgtgcagagcattgaggggtatattgcccagtgggggaagcatttggagttcgcggtgaagcatttgtttgaggctgagtataagctttgcaatgatgtgttcgagaggattgggttggacgtgtggatgggttgcttttcaaagattgctgctcaggcgggtatacttgcgtttcttcagtttggcaagacggtcacggagagtaagaaggaccccattaagcttttgaagctgttggatattttcgcatcgttgaacaagttgaggctggatttcaaccggcttttcggtggtgcgccgtgtgttgagatacagaatttaacaagggatcttattaagagcgtgattgatggggctgcggagattttttgggagcttttggttcaggtggagttgcagaggccaaatccacccccgatggatggtaatgtgccgagattggtgagctttatcactgattactgtaacaagctccttggggatgactataagccaatattgactcaggtcctgatcattcatagaagttggaagcgccaaagctttcaggagaaactccttgtcaacgagattttgaacatagtgaaggctgttgaacagaatgtggagacttggatcaaggcttatgatgatcctatactgtccaacttttttgctatgaacaatcactggcatctgtgcaagcatttgaaggggacaaaacttggggagctcttgggggattcttggttaagggagcacgaagagtataaggactattactcctccttcttcttgagggacagctggggaaagcttccaggacatttgagtagggaagggttgattcttttctcaggaggacgtgccactgcccgtgacctggtcaagaaaaggttgaagaagttcaatgaagtttttgaagagatgtatgcaaagcagacaagttggatcatgcttgaacgagatctgagggagaagacatgtcagcttatagtgcaagccgtggtgcctgtttaccgcagttacatgcagaattatggtcctttggttgagcaagatgctgctgtctccacaaaatatgcaaagtacacagtgcagaagctggaggaaatgcttttgtgtctatatcggccaaggcctgtaagacatggcagcttgagaagtccaacatttagtgccaaatatggcaatggagtgcctgatcttcgcagaacagcatctgcagttgtgtaa

SEQ ID NO: 73649 - DNA, 684 bp, Glycine max
  Peptide Sequence Number=SeqID_190427
atggggggattaaagttatatgttaacatccctaaatttgaaagaggtaggggtcgagtgcaaccacaatcaacagggggacgagaacacaccaggcttgtcgaacaggggcgcagagaaacttaccaggcacagaaacacacagcgacgccgggcctggtacgcgggtcttttgcagatgtggtagctaggagagaaccacgtatacagcagaggaggacatcggcagttcagaatgctaaaaccaacacttcgagatcagaagtacatctcgacagacctatgacagcaccgaaatggctacaggatgcatgggtgggaaggctaaaaaatcttgcactccttgacagagtagaggagaatatgctatgggactggggattagacgtagtgccgaaatacatcggcgacgacatggtacttctccccggacttaccgaagacaaggcaaaacaaatgatggaggaagggaatgcaggaagggaggtgatgttctactcggtagaaaggtggaacaagaagatgcgtgctgggtctagacttacatgggtgcaatgttggggagtgccgctggtagcatgggacccaacacacttaagggagatcgtgacggccataggcgaggtagtggaagtagacgaggagatggaggatttgaggaagatggacagggcaaggctcctt

SEQ ID NO: 73650 - DNA, 552 bp, Glycine max
  Peptide Sequence Number=SeqID_190428
atggctttgctttctttactacccaaaacggcaccgcatgccctttccctcacaaacccttcctcttccactcccctcatcttacctttcagtttccaatgtttgcctcaccctcttccttctcctctctcttccctcaaagctactttttccgacggtggcgacaatttgcgcggcaagcccctggttcctcaggcctttgaagaagaagacgacgacgacgacaacaaatgggttgactgggaggacctgattttggaggacaccgttcctctcgttggcttcgtcagaatgattcttcattctggacaatatagactgacagagtatttaagcaagtcgggagtatcatgtagcatcagagtcttcaatttgattctgaaacttaattccttgtcacctaatatgggtgttcagtgttgccatttctatgcggaattcctcggatccacaatcatgactctgtccgctattgcagctgctatgggtgtcgtggttgcggcaagcatcctgcgtcctcttatcatctttggcaagtctccggccaattga

SEQ ID NO: 73651 - DNA, 246 bp, Glycine max
  Peptide Sequence Number=SeqID_190429
atggcttttggccttggtgttaccatcatgtgtaataaagttattcctgctttagctactgttaaggatattggatatcatcctgatttcgaacgctctaggtgtttgttcatagtacgacaagatggagagctggttgatttttcatattggaaatgcataaagggcttgatcagaaagaactatccattatatgcagacagtttcattctcagacatttcaggaagaagagtcgtaatttgtga

SEQ ID NO: 73652 - DNA, 1254 bp, Glycine max
  Peptide Sequence Number=SeqID_190430
atggcaattgcagctgcaaactcatcacccaccatgagcctcagccatagccagagccaagaggatgccaccaccgcctccaccaccaacaagcccgtcgacgtcgacgataatgatgatcacgagcacgacatggtcatgcccggctttcgcttccacccaactgaagaagagctcgtggaattctaccttcgccgtaaggtggagggaaagcgtttcaacgttgagcttattactttcctcgatctttatcgctatgacccttgggagcttcccgccttggcagctattggtgagaaggagtggtacttctatgtgcccagagataggaagtatcgcaacggtgatcgtcccaatcgtgttactacctctgggtattggaaggcaacaggagctgataggatgatccgaaccgagaattttcgctctatcggcctcaagaaaaccctagttttctattctgggaaagctcctaaaggcatacgaaccagttggattatgaacgagtatcgcttgccgcaacatgaaactgaacgatatcaaaagccactgatcaaaagtcaagacactctcgatcaagatggagaggctgagatatcgctttgccgtgtgtacaagagagctggagtggaggaccatccttccctccctcgctgcctcccaacgaggccatcctcgtcaagggcttctcatgacaataataagaagcacaatgaaatggttcagcacaacatcaacatgggattcgtgggacaattaaagccgccaacaactgaacacatagttgacaaaattaatgaaacggaagcaagcagtgatgtcaacacagctcttggactttccaaatacaatgctgcttaccgtgctgcaatgggagcactcagcaccacaatggcacttccagttgttccaatggatcatgaggaaggcttgatgatgatgcagcagcaatctaagcaagctgcagcacatgttccaacaatcttctctgctgggccttccagttccaacaacagtggagtggtgaatatggatgatctgaataggctaatgagttatcaacagcagtactacaatgttcaaagccaaagccatcccaatcagttctccactttgctgatgcaaccttcagcggtagtgtctctcagctcgctaccaaatccacttccacccaccttctctgaccgactctgggactggaatccaatccctgagccaccaaatcaagagtacagcaacatgtccttcaagtaa

SEQ ID NO: 73653 - DNA, 639 bp, Glycine max
  Peptide Sequence Number=SeqID_190431
atgccgcaggttgtcatttctgggcagaatagcaagtcctttgtcaatgttagactagacacacagaaaaaagttaagtctagaatttcccatgtagttttcagcctggttcctaggcacagtcatggcaatctatgttttggtgggacaaaagttgaacctctagtaaaaatcaggcacacattcttccctagtaggataagagttgctgaagaatatcaagaaggtttgtctgatgaagatgatgatctctgtcccgttgaatgtgtaagagaattcaccactgatgaagagttcagcaaaattctggacaaggctaaagaaactggatctttggttgtggtggatttctttcgcacctcttgtggaagctgcaagtatatagagcagggttttgcaaaactgtgcaagaaatctggtgatcatgaagctccggtaatcttcctaaagcataatgtaatggatgagtacgatgagcaatccgaggttgctgaccgacttagaatcagggccgtgcctcttttccacttctacaaagatggtgtcctgttggaagcattcccaaccagagacaaagataggattgttgcagccatactcaagtactcatctcttgaaagagaagatatcttaggttaa

SEQ ID NO: 73654 - DNA, 618 bp, Glycine max
  Peptide Sequence Number=SeqID_190432
atgccgccatttttgtcgacctcgaaggccctttgctccttagcatcgcgcaaaagcggtggtagtcaattgattaggtctagcaagagcagtgggaagcacgatggatgcagatgcatcactacagccattaccggcggccatcacaatcatccttccgtctctcgcatcggcttttcctctctcatcggaggatcgtgcaatagcaataatcattattataattataatgttgttcaatcaagacggtttcttggatgtggagatggtgaagaaggtattctatccagaacttacgaggagaggcgcgttttggggtactctacagagcaattatttgaagttgtttctgctgttgacttctatcatggttttgtcccatggtgtcaaaggtcggacatacttagacactatccagacggatcatttgatgctgagttggagattggatttaaattcctcgttgaaagttatgtttctcatgttgaattggacaaaccaaagcgtataaaggtattcaacctcctctggtatatgtttggacttaattgtacatatggatggtcagactctggtataaagaaaacgttgcattctgctccatccagttcaatctga

SEQ ID NO: 73655 - DNA, 288 bp, Glycine max
  Peptide Sequence Number=SeqID_190433
atggcattcatagagcgtaatgtgtcgagtgatgggaagcgtgtgatgactgtggagcagtttaggcggtggctgatgacagcattcgacgctaacggagatggaagaattagcaaatccgaacttcgacgtgccgtgcgcctcaccggagggctctttgcttcatggaatagtggcctggctttcaggtccgcagacgccaaccaagatggtttcattgatgaaaacgaattcagaaaccttgctcagtttgcagacaagcatttcaatgtcaagatcacacgctaa

SEQ ID NO: 73656 - DNA, 2679 bp, Glycine max
  Peptide Sequence Number=SeqID_190434
atgggagccaatcacagtcgcgaagatctcttggaatcttccgactccgaacaagaggagtatgaaaccttcgaagacgccaccgaaggaagcgccgaacggaaaccgtcaacgccgtcatccctcgatgacgtggaggccaagctgaaggccctaaaacttaaatactcttcctcctcctccgcccccgccgtcaataacgccgtcaagctctacgtccacattggcggcaacacccccaaagccaaatgggtaacttctgataaactcacatcttattctttcgtgaaaacccactccgacgccgataccgacgaagaaatcgacaacaacgacgactccgacaacgacaacgacaatgacgactacgacgaatcaaacgaaaagcctttctgggttttaaaagttggttccaaaatccgatccaaggtgggcccggagatgggcctgaagagcttccccgagcagcggcgcgtggacttcgtggtgcgtggcgtctgggcgatgaagttcttcagcgaccaagaccagatcgacttcatcgattccttccagaagtgtctcttcgagaacacgcacggcgtcgaggccacggaggccaacaaactcaaaatctacggcaaggatttcgcggcgtgggcaaaacccgaaaccgccgatgattccatgtgggaggacgcagaggaagccttcaccaaaagccccacactggttaggtcaaaccaagacctaaaagaagagttcgaagaagcttccaacggtggaattcagagccttgctttgggtgctttggacaacagtttcttggtgagtgataatgggattcaggttgtgaagaatttcgcacatgggattcatgggaagggtgcttttgtgaatttcagtgatgggtatcaaaaagggggtggtggttcttcctattgtacccctaagaagacacttctgatgagggctgagaccaacatgcttctgatgagtccaatgggtggagggaagcttcactccactgggcttcatcagcttgatattgagactgggaaggttgtgagtgaatggatgtttgggaaggatgggactgagattacaatgagggatattacaaatgatagtaaaggggctcaattggatccttctgggtcaacttttctagggttggatgataacaggctttgtaggtgggatatgagggatcgtaatgggatggttcagaacttggatgattccaatgcccccgtgttgaattgggcacaagggcatcagttttcgagggggactaacttccagtgctttgctactactggtgatgggtccattgttgtggggtctttggatgggaagataaggctgtattcggtgaacacgatgaggcaggcgaagacggcttttcctggccttggttcgccggttactcatgtggatgtaacctttgatggaaagtggattgtgggtactactgattcctacttgattcttatctgtaccctctttactgacaaaaatggaacaacaaagactggtttttctggtcggatggggaataggattgctgctcccaggttgctcaagctcaaccctcttgattcacatttggctggagcgaataataagttccgcaatgctcagttttcgtgggtgacagagaatgggaaacaggagcgacatatagtagccaccgtggggaagttcagtgtgatatggaacttccaacaagtcaaggatggttctcatgagtgctaccgtaaccaacagggtctaaagagctgcttctgctacaagatagtccttagggatgattccattgttgagagccgatttatgcatgacaagtttgcagtcactgattctcctgaggctccattggtcatagctaccccaatgaaagcaaatttgagcacgggaataggagcagataatcagaaaacaatggccgtagcaataggaagaagcttctccattcagcccggctctttattcaacaacaagagcttggatagaggttcaccagctggaagattatcgtggcttggggatggtgctgctgccactccacgttataggcaaacttgtgttggggcgcaacagcgacctacatggctcccaggacttgatcccccacctcatcttgatggaactcttgctggagattttgggttcgacccacttggacttgcagaggatccggcaagcttaaggtgtccttgcctgaacttcttggtaaaatctatgcagctacttcgcgtcacaggaattagtaagataccggtttggtttgaagctggtgcggtaaaatacgactttgccaatacaaagacactcttccttgttcaactagttctgatggggtttgtggaaactaaaaggtatatggattttgttagtcctggatctcaagctaaagaggggtccttctttggattggaagcttcactgaaaggcttagagccagggtaccctgggggtcctctgctaaatcctcttggcctagctaaagatattaataacgctcatgactggaagcttaaagagattaagaatgggcgactcgcaatggtggcaatgcttggcatctttgtacaagcttcagtgactcatgttggaccaattgataatcttgtggagcatctttccaatccatggcataaaacaattattcagacccttgccaattctagctcttag

SEQ ID NO: 73657 - DNA, 159 bp, Glycine max
  Peptide Sequence Number=SeqID_190435
atgcataaatcagaaaccacagtgcgtggatatggggagtgcgtgtcttcttctcattcgaagttttctgtgcagagatatggcaaaaccgcgctttttgatttcgacgattcctctgtgtctgtcagtacaactcccgtgaagttagaattggagtga

SEQ ID NO: 73658 - DNA, 2862 bp, Glycine max
  Peptide Sequence Number=SeqID_190436
atggaggatgttgaagacaagataccccctgtctcctcttcaaaaattgctgaagagacaccactggtagaacatgttggagacaagctaccatctgaatcttctccaaaaattgcagaagagacacccctggcagaacatgttggagacaagcttccatctgaagcttctccaaaaattgctgaagagacaccactggcagaacatgttggagacaagctaccatcggaattctcttcagaaattgttgaagagacactactggcagaacatgttggagacaaccaaccatctgcatcctctttaaaaattgatgaagagacaccactggctgaacatgtgatagacaactccgaatcctcttctaaaactgctgaggagttgccactggtagaacatgttatcgacaaactaccctctgaatccactacaaaaattgctggagacatgccactggcagacccccctgaagaaaatactgaagtgataaacccacatggcgaccaatcttccactgaagctccaacaattccacttagtaatggaaaaatggagcctggtactcatttgccagtggacgagttctctgaattagcagtgttgccaaatgcttctgttgatcaaactttaatacaagatgctgcagttgatgtcacagaaaaaagccagcaggtaacttcagctgaagattctgaaccaggtgctatagaaaatgtctctgacatgcatgaatcgcaggatgatgtttctaatatcactgctgacagtgatgttgataatgagattagactctcagcttcttcttccgaaacaaaagatttgcaaagtgatcacaatgaacttacaatggctatgggaacagttggctcactcccacgtgccaagctgtttgatgcaaaaagaggccatattgataccacagctccttttgaatctgtcaaggaagctgtttccaagtttggaggaattgtggattggaaggctcataggatccacactgtggagaggcgcacccttgtagaacaagaacttgaaaaggcacaggaggatatcccagagtacaaaaaacaagcagaggctgctgagcaggaaaaaggtcaagtactaaaggagttagacagcacaaagagactaatagaagaattaaaacttaacctagagagagcacaaacagaagagcgtcaagcaagacaggactcagaacttgcaaagctcagagtggaagagatggagcagggtattgcagacgaatcaagtgttgcagccaaggcccaacttgaggttgccaaagccagatatacagccgctgtttcagatttaatagctgtgaaagaggagctagcagcattgcacaaagaatacgcttccttagtgactgatagagatgtagctattaagaaagctgaagaggctgttgctgcatcaaaggaagtagagaagtctgtggaagatttaactgttgaactaattgctgcaaaagagtcattggagactacacacgctgcacatttggaagcagaggaacaaagaataggaacagtcatggcaagagatcaagattctctcaattgggagaaggaacttaaacaggcagaagaagagctccagagactcaaccagcaaatttcatctgcgaaggaactcaaatctaaactggaaacagcctctgctttgctgattgatttgaaagctgaattaactgcttatatggaatcaaagttaaagcaagaaggaggcccagaagaatcagagaaaaagacacacactgacatacaagaagcagttgcatcagccagaaaggaacttgaggaagtaaatcttaacatcgagaaagcaactgctgaggttactatcttgaaggtagctgctacatcattaaaatcggaacttgaacaagaaaaatcaactcttgcctccattaggcaaagagagggaatggcctccattgcggttgcatctctggaagctgaattggaaaagaccagatcagaaatagctttggttcagatgaaggagaaagaagctaaagagaaaatgaccgagcttcccaagaaactacaactaacagctgaagagactaatgaagccaacttgcttgctcaggcagctcgtgaagagctacagaaagtaaaggcagaggcagagcaagccaaggctggggtaagtaccttccaaagtagattacttgcagctcaaaaggagatagaggctgcaaaggcttctgaaaatttggcaatagcagcaattaaagcattgcaagagagtgaatcaactagaagcaagaatcaagtggacccgtccaatggggtaacactttctttggaagagtactatgagcttagcaaacgagcacatgaggcagaagagcgagccaatatgagggttgcagctgctaattctgaaattgataaagctaaggagtctgaattgaaagcctttgaaaagttagacgaagtgaatagagagatagctgctagaagggaatctttgaaattggcaatggaaaaggctgagaaggcaaaggaaggtaaattaggtgtggaacaagaattgagaaactggagagctgaaagtgaacaacgaagaaaggccagcgagtctggccaaggagtggtaaaccagggtaaaagccctaggggtagttttgaggggaatcagggtgtaaataattttgaccgcactagtgatgcaggtaatcctgctcatttcatgacaagtccaaaggccaatgtgcaagcagacaatgatgaaggtggatcatccccagaatcaaaacatggaaaaaagaagaagaagtcaattttccctagggttttgatgttctttgctagaagaaagacacattcaaccaaatcagggtaa

SEQ ID NO: 73659 - DNA, 324 bp, Glycine max
  Peptide Sequence Number=SeqID_190437
atgatgttgtcttgccaatacaacagcttccatgaaacctcccaaattcactccctctcttatctcaaatgcggaacttcaacacatcttcccctccatacccttcgctgtggacaacgcaccggagccaccgctcctgcacacggcggcgactttgttccggcgcgcgagcgggtgacgaatgatgttctttcccccaaattcccctcacactatttaaaaagaacttggtcgacgagaggaatggcggtggcttcaagcgtgagcagaaggacgagcaaaagactgtcaagtgcgagctcctccacgcacaggaggagttga

SEQ ID NO: 73660 - DNA, 2136 bp, Glycine max
  Peptide Sequence Number=SeqID_190438
atggtgaagactaaggtgggagagtgctccatgtatgctagcatgggaaagacatatctaaagactaatgtgtctagtgccaaccccaaccatcttaccttttctttactcatcaaagcgtgcctttcttcctcttcttctttctcgcgtggatcacccactgcctggctacaagtaaaccagattcaaacccagttgttgaaacggggcattgaccaatttctatatgtaaacaccgctctcattgacttctacatgaaacttggcttcactacccatgcacgccaactgttcgaagatttgccttctgcagatgttgtttcatggaatgtattgatttgtggatattcacaacatgggcatcctcatgacgcccttcaactctttgtccacatgctaagagagagtttcagacctaaccaaacaactattgctagtttgttaccatcttgtggtcgccgtgaacttttccttcaaggtagatccgttcacgcatttggaatcaaagctggtctgggtttggatcctcagttgagtaatgcacttacctcaatgtatgctaaatgtgatgacttggaagcatcccaactcttgtttcaagaaatgggtgagaaaaatgttatctcttggaataccatgattggtgcctatggccaaaatggtttcgaggacaaggcagttttgtgctttaaagagatgctgaaggaaggttggcaacccagtccagtgacaatgatgaaccttatgtcagctaatgcagttccggaaactgtccattgctatattatcaaatgtggcttcaccggtgatgcatctgttgttacctcactagtttgtctatatgcaaagcaagggttcactgatatggcaaaattgctttacgaatgttatcccaccaaagacctgatttcgttaactgggataatctctagctattctgaaaagggcgaggtagaatctgcggttgagtgttttatccaaactctgaagttagacataaaaccagatgcagttgccttgattagtgtccttcatggaattagtgatccttctcattttgctattggatgtgctttccatggttatgggttgaagaatgggctgactaatgattgcttagttgcaaatgggctaataagcttttattcaagatttgatgagatattagctgctttgtctttgttttttgacaggagtgaaaaaccgttgatcacttggaattctatgatatctggctgcgttcaggctggaaaatcaagtgatgccatggagttgttctgccaaatgaacatgtgtggacaaaaaccagatgcaattactatcgctagtctactatcagggtgttgccagcttgggtacttgcggattggagagacgctgcatggctatatccttagaaacaatgtgaaagttgaagattttacaggaactgctctaatagatatgtatactaagtgtggaagattagattatgctgaaaagatattttatagcatcaatgatccatgtttggtaacatggaactccatcatatcgggttacagtttatatggacttgaacacaaagctttcggttgtttttctaaactgcaagaacaagggctagaacctgataaaatcactttcttgggagttttagcagcatgcactcatggaggacttgtctacgcaggaatggaatactttcgtatcatgagaaaagagtatggtttgatgccaactttgcagcattatgcttgcattgttggcctcttgggtcgggcagggttgttcaaggaagcaattgaaattattaacaacatggaaattcggcctgattctgctgtatggggggcattgttaagtgcttgttggattcaacaggaagtaaagcttggggaatgcttggccaaaaatttgtttttattgaattacaaaaacgggggattttatgtatcattgtcaaatctttatgcgattgttgggaggtgggatgacgtagcaagggtgagggatatgatgagagacagtggaggagatggatcttcaggtgttagtgttattgaagtgacacccctcagagacatcaataacaacttgtgcccgagtgaggtctatttgaatacaagcacttggcagcatttgtgtctatgttga

SEQ ID NO: 73661 - DNA, 288 bp, Glycine max
  Peptide Sequence Number=SeqID_190439
atggcgttcatggagcgtaatgtgtggagtgatgggaagcgtgtgatgacggtggagcagtttaagcggtggctgatgacagcatttgacacaaacggagatggaagaatcagcaaagccgaactgcgccgcgccgtgcgcctcaccggagggttcttggcctcatgtagtagtggccgagccttcaagtccgcagacgccaaccgtgacggtttcattgatgataacgaattcagaaaccttgcccactttgcagacaagtatttcaatgtcagaatcgcacgctag

SEQ ID NO: 73662 - DNA, 1071 bp, Glycine max
  Peptide Sequence Number=SeqID_190440
atgaattgggttcactctcaaatctgccatagtactgatgctatcaacaaccctagtagtatttgttcttcttcttcttctgcatcattgccttatagttccggctacaagaaacaactagcctctcctcctcctctagcttcttcatctggcaccagaataagccctgcacttgttttcatctttgtcattctagcaattgtgttcttcatctctggtctccttcactttcttgttagattcctcataaggcacaggtcctcttcttcatcatcaatttctcagtctaataggtaccctgatgacatgtctgaatctgatgatccttaccagaggcagctacagcagctcttccatctccatgactcaggcctggatcaggccctcatagatgccctcccagttttcctctacaaagacatcatagggttaaaggagccatttgattgtgcagtgtgcctttgccagttctcagaacaagatatgctgaggctgcttcccctttgcaaccatgctttccacattgattgcatagacacatggctgctgtcaaattcaacctgtcctctctgtagagggagtctttatgatccaggctttgcctttgaaaacccagtttatgaccttgagggtgtgagggaagaagatggggtttccggaagtgttcctggtgagggtgtttgtgacaacaagcatgcagaaaaccacacaataagtgggaaaagggtgttttctgtgaggcttgggaagtttagaagctcaaatattgttgagggggtggaaacagggggtggaggtgagagtagtacaagtaatttggatgttaggagatgttattcaatggggtcattccagtatgtggttgctgattcagatttgcaagtggctttgtgccccaatagaggtgatggtggaggtgttagtgatagcagtatgagacaattgaaagggagattgaccaattatggaaattcttccactgatgatgttgaggggaaaaaaatcaatattactaggaaaggtgaaagcttttctgtttccaagatctggcaatggtctaagaaggacaag

SEQ ID NO: 73663 - DNA, 759 bp, Glycine max
  Peptide Sequence Number=SeqID_190441
atgaaggtgcttgcctgtatagccaccacgaggtcgaggacagctgtgaccttgacgttgacaaaagtactcaataggcatgctgattatacttttgcttcaagggttgatactgctggttggttacagatgcagtctactccgggcattatgcaatcaaggaagagtctactccaggctcatataattgctttggtactagatgcagaagaggcctgccaggccctacctaatggattagccactcatggccatcattctataggcaagattataaatgcaagacgaagtatgaaacatgctgaagtaattatagccagatgggcagtggaagaaggacgtgggctggttgtgattgtgaacaagatgaaccttccaagaggcaaacaccaatcgtcatcctatgagaaggttatggaaattgttccacaagaaattcagacaattatacctcaggtaaaaggaatcccagttgtattcatttcagcattggagggaaggggcaggaccactgtcttgaatcaggttatgagcaggcattcttggaaaggccaagcagcacagcctaaggttaagtatttcactcagtccttgaaggagaactttgatttgggtggaattcctatacggctcatgcaacgttttgtcactaagaaagatgccagtggaagtgaaactagaactagcaagaatagccattcagtaggcagagtgattgaaaggactgtctctgacaagagaagtgtcttagttgaataa

SEQ ID NO: 73664 - DNA, 785 bp, Glycine max
  Peptide Sequence Number=SeqID_190442
gtacggtcaccgttatcccagcactcttggatcctgggatggaaccaccacctcggtcaatgatggcgacggcgacgatgagattgatgatcatttggatttgcctggccgtcaaggatgtggaattccttgctactggtccaagagaactcctaaacatagacggatgtgtgggagttgttattctccttcgctgtcggatactttgaggagaaaagggagtagcatgctctgtggaagtcaaagtatttatccaacacaccgtagatcagcttcggcttctcacaagcggagactctctttgaggagtgctcgaggtgttattccattgctcactaacagtggtgatgttagagaagggtcgtctgtgggaaccggttggagtgatgacgagctttccacaaactttggggagcttgatcttgagggattgagccggttggatggaagaaggtggtcatcgagttgtaggagtcaagagggattggagattgtagctctcaatggggaaggggaatatgagagcacaccagaaaataatcggagtttcagccagaagtataggcccatgttctttggtgaactgtttgggcagaatattgtggttcagtcacttatcaatgctgtttcaaggggacggattgctcccgtctatctgtttcaaggtccccgtgggactggcaaaacatcaacagctaggatatttgctgctgccttgaattgtgcaagtcctgatgagagcaaaccttgtggctactgcagggaatgtgttgatttcatttctg

SEQ ID NO: 73665 - DNA, 1488 bp, Glycine max
  Peptide Sequence Number=SeqID_190443
atggtgaatgaatcagagttggagaggttaaaaaatgctttgaagcttctctcggaggcagagaaacagttaaggacatccagtgaacgctctacatggttcacagcaactctattgcagcttggttctacaccttctcctgatcttactcagtcaagtagcagtaggagacagagctgcaagacaactgaagatgatccatcaagtgtttcgagagacgttacctcttgcacgcataagtcagaccctcaatacgtgcctcaaaagtcagcatacactgcatcccagcaaaaagccgtaaatgataattcccaccatcaaaaggatatatcctcaaagattgaaggtttcagcttgaaatcaaagccgtcaagcagcccagtcatagatgatggctccacagtggtctcatctgatgatcttatggttgggaatacaatgtttaggtgcatagattcagggaagttatgttacatctgggtgcattgtattgagaggtgtcactcgaagacattgaggcagctgctacacaatcatggaaagcttgtgtccgtatgtgaagtagaaggtgttttggtagcatatgttgcttttgaggatgcagatattaaagttagggttgagaggtttttaagaagcattacaaactccatggaaatggttcttaggcgcaatgtggaggtaagaataatccatttgccaaatggcgaaggtgaaaatcaagttaatctaccgggcctaaagcaggcagagtcaacagtggctggtgagaaggaacaaagaaagagtcatatgaacggaacggagtcttattctagttttcctcctttgctggatggaaaccttcaatctaccgctgcttcatcagatattttggctgaaggaaatggtgtgagggagaggagacaggataatccaatgcaaagaattgaatccatcattcgtgaacagaggctggaaactgcctggttacaggcagttgaaaagggttcccctggatcattgagtcggttgagacctgagaagaatcaagtactgccacagaatggtgtggacccaattgagtccatggattcaacgagatttccctctcaccagcattgggaagatgatccaaatgatgaagtcaaagttttaagccttaaaaatggaaggatcccacagaaggatcagattggtcgaaagacagatcgttttcccatgtcaccaagtttattgcatgacaacagtttagcaacaatttctggaaaagacaatctgggatatgaatcagggtcaggagcgggtggttgtggatttttatgttggaataagtccaagcctagaagggttataaagttgttgcatgagaatctgaacaaacataacatgtcacgctgtgttgtaagcaggtcaaaggtggcaccccggtttgagcgggtagagcggcaacttttacattgtttggtgactgcggtgggggcaaataaaagggggcggggaagataa

SEQ ID NO: 73666 - DNA, 411 bp, Glycine max
  Peptide Sequence Number=SeqID_190444
atgaatgcagatggttcacttcgagatgcagaaacaatgttagaacaacttagtttgctggggaagagaattactacttctcttgtcaatgaacttgtgggagttgtttcagatgaaaaattattggaacttttggagttagcaatgtcgtcagatactgtagagacagtgaaaagagccagagaactgatggactctggagttgatccaatggttttgatgtctcaactagccggtcttatcatggatatcattgctggatcatatgcagtcattgacaccaaacctgatgattcattctttggtggacggagttttgtttgctatgatggtgggatactggattttgtgcctaagcccgatcattgggctgaacaggacaaggatcaattgctggatccactcccataa

SEQ ID NO: 73667 - DNA, 525 bp, Glycine max
  Peptide Sequence Number=SeqID_190445
atggcgagcttgtggcaaataatactggggtggattcctagcatgttagatggctgccaagtgaacagaattgtcttcgcgtggatctacatcgaatttgtcatccaggcttgcttggtagacatccagggcttagactggagaccccttgtccatgctcatgacttgagtaccttcggccattgtggggtgatgcttgcattgtcatgcttgcttttggttcgccttgacagtcacaatctatcccgtcaaggtagggaacttcatcttcaattgcaggatgaagacgatggctccgagctcgttgagtgttctgttgccaatcaaagaaaagtaagagagcaggccttgaccgaaggtagtcataaggtcgacatagcctgtagtctctacttgttcccctacgaaaccaaggagtggatcagcgtgaagttggatggtgctcccaacaaagggggtttaccctctcatagccacgagagactttacacttcaggggctaatgtggatggaagaaagggctag

SEQ ID NO: 73668 - DNA, 831 bp, Glycine max
  Peptide Sequence Number=SeqID_190446
atggtggaaaacacaggacaaggaggaggcatatggttccagttgttccaccccaaaacggcgccgttcgcgtctcacaagacgctctttgtgttcctgtgggtggccacgctggcctcggtgttggtgtggcagaggaccaccatcagcgggtttcttgtgctcggcggcgtccccgtgaggacgccgccgaagctaaggccggtggtgttctgtttaacggagttcggcggtgttggcgacggcgttactctcaacacggaggcgtttgagagaggcgttggtgccatttccaagttgggggataagggtggtggacaactgaatgtgccacctgggcggtggctcactgctccgtttaatctcaccagtcacatgactctctttcttgcgagagatgctgtcatacttgcagttcaggatgaaaagtattggccactgatgcctgcattgccttcatatgggtatggaagggagcatcccggtcctcgatatagtagtttaattcatggtcaaaatcttgtagatgttgtcataacaggccacaatggtaccataaatggacagggacaaacatggtggacaaagtatcgccagaagcttctgaaccacacaagggggccacttgttcagatattgtggtctagtaacattgtgatttcaaatattactctgcgtgactctcccttttggacacttcatccatatgactgcaaaaatgttacagtaaaaaaggttactatattggctcctgtttctcatgctccaaatactgatggcatagatcctggcaagtatcttctacaaaatgctatatttttcatatcttaa

SEQ ID NO: 73669 - DNA, 345 bp, Glycine max
  Peptide Sequence Number=SeqID_190447
atgacgaaggaagtgatccacggtcacaactttgcaatgcctcagctccacttttcctcttctccttcttcttatgcgtttttctctctgagaaatccattaagtgtagggaaacttgcccaagcgagttgcttgcttagggctaaaggtatcaactcgcccaggcgagcgagctggaactcacctaggcgagtggcttgcttagggctgaagttttctcttagcccaggcaagctagatgctagcctaggcgtatttagggtcagaaatcttcatgaaaaaatcattttacccttccttttagctttatttctggatctaacaaacaaccatcaaaacctataa

SEQ ID NO: 73670 - DNA, 912 bp, Glycine max
  Peptide Sequence Number=SeqID_190448
atgaagttggcgattatgatggagacaaccatggggtcatccttgttgatggggttgatacccttgaagtctctatccgtgaaagtgatagaagggaaacttcgttgtgatggtgttatcgctcacatttgtgctgctggtatctctgactaccttgatcttctactctatctcttcttctatccgcatcatgactcctatgttacttctcttggtgtcctccagggtcaaacaatcttctgtgttatgaccaatactgcgatggtgtcagagatgtgtaatgctcgtacctgggcccttttaggagaggatggcacttgtccagcttatgcctcttgtctgacttgtgtgagtcggtcttggtgcttcattctcgcttgtcgtattgtccgcaaacttgtcaggccgtacaacgaggagcatgaagtgctggccagtgtggccaatgtcatgcgatgtgactggctggttgcatattatacattgaagcgctcaacaaaagtgtcgaagttgtcgatggatcatggaggaagtccatcgttcaggaaagcatacagatgttcatctggatcggtggtcccatcatatcagttgaggttgagtggtttccaacctaagggtatgctagcttccatgatgcggtcaacaaagaggagccaacgagtagtctatcctactggacgatgcatgtgggagagacttagaacatctttagtcttgactgtgcgtcgagggtgtgatttcccttggccttcagctttctcagctccttcttatggcgtcctccatgtccgcaatgcgattttggagttgctggagagtattggtatctatcatggttgctggtggagggttggagccttcgaaaggggtctcatgtctaaggccagattgagtgctaatcatgggtga

SEQ ID NO: 73671 - DNA, 312 bp, Glycine max
  Peptide Sequence Number=SeqID_190449
atgaggtttttggctttcttgctctgttttgcgcctctgttgtgctctcttagcctaattttatccgaattaatgcttgatttttccaacttcagccttaaaaagggctttctgtcctcgaaggctcgcttagtgccattttcgcgcttagcgctagttagtgaatatctactaagcgagctgtgcgcgcttagcgcgggaagagacaaacgcctcgctgagcgagctgatgacgcgctgagcacgcaaacgcttctcagattctcctccagattctcccaactcgctaagcgggttaagtgcctcgcttag

SEQ ID NO: 73672 - DNA, 258 bp, Glycine max
  Peptide Sequence Number=SeqID_190450
atgtctcgtggtcgcgttagctctggtggtgttaaccatgctccacgtccagctcctgttcaaggtggcaactgtggatctctgtttaggaccatagatgaaggaatagcttttggtgttggaagtgcagtggcacacagggctgtggattctatatttagtcctcaaagcggtaatacatgcaatgctcccacaaaggctttccaagatccttttaggcctgttttgatgattttagcttctgtcatgggtggttaa

SEQ ID NO: 73673 - DNA, 156 bp, Glycine max
  Peptide Sequence Number=SeqID_190451
atggattcaaaggtggccatgacgaagtcatggtggcttgatgtgaggaagagaataggtgatgacagtgcaaagtggttgttgggattcatgagagaaactagggtttgtgaagagtcaggatatgagacaacaaggagagggagtttgaattag

SEQ ID NO: 73674 - DNA, 789 bp, Glycine max
  Peptide Sequence Number=SeqID_190452
atgaagatttttgaatggatgcaaaacaggatcaatgggagcaacgggaaaaagaaacaaagtaactcaatttcaactacccattacatgaggcatgaaccttgcaaacaagagttcagtgactggcctcaagcactccttgcaattggaacgtttgggggcagcaacttgaaagaagattcgggtggaaggagtaaccacgccgcagaggattcatcttcctttcaggattgcacacaagaggtcactcttgaagatgttggcaatcttcagagtgagttcagcatattttttaaggggcaaaatttggcagctgaacaagaagaacacaccaatgatcttatcaaagaaaatgactctctttgtgatggctccaatgctagccgtggtaatttctacccaagcaatagtataatattcagcaggggaaaagattgtagtttggatcatagcagtaagaaaggtgttgggaagaaatcactttcttttcttcttaagaagatgcttgcttgcaaaagtggatttcaacctacccctttgttcaaagatccactttccactgagtcaagaatggagaagattttgagggcaatacttcagaaaaagatatatccccaaggttcatgttcaacaacaccgtttgtaaagaagtaccttgaagccacaccaatttctcagtttgatgatgaggaggatgatgatgaagaagaggaactcgctgctgctgctgcagaaaatggaagtaaatgggtcaagactgattctgaatatattgttcttgagatataa

SEQ ID NO: 73675 - DNA, 1152 bp, Glycine max
  Peptide Sequence Number=SeqID_190453
atgatatttctgttcgtgaagaggagtcggaggggggatggggagttgagggtggtgagcaggagcaggagcaacagcacagaggaggtattgatggtgcaggtacctagcatgagggggggcgtaggagataagaagaaggaaggaaataaaagaggggatattgtgatggtgaatgaggagaggggcgtatttgggcttcaggatttgatgaaggcgtcagcggaggtgctagggaatggggggttgggatcaatgtacaaggcgatgatggggacagggttgtgcgtggtggtgaagaggatgagggagatgaataagatcgggaaggacgtgtttgacgctgagatgaggcagttcgggaggatacgacaccggaatatcatcacgccactcgcttaccattaccgaagggaggagaagctctttattactgagtacatgcccaagggaagcttgttgtatgtcttgcatggtgacagaggaacatcccattctgagttaacttggcctacacgtttgaacattgttaagggaattgcaagagggttgaaattcctttactctgaattttccacctacgacctgccccacgggaacctcaagtccagcaacgttcttctaactgatgattacgagcctctcttgagtgactacgcctttcagccactgatcaaccccaaggtctccgtgcaggcattgttcgccttcaaatccccagattttgttcagaatcagaaggtttcgcagaagaccgatgtttactgcctcggtgtcatcattcttgagatcatcacagggaagttcccttcccagtatcacagcaatggcaagggtggcactgatgttgtgcaatgggccttcaccgcaatttctgagggaacagaagcagagttgatcgattcggagttaccaaacgacgcgaattcgcgcaagaacatgctgcatcttctacacattggggcttgttgcgctgagagcaaccctgaacaaagactaaacatgaaggaagctgttagaaggatagaggagcttggagcatttctcattgtcaaaaagtacaagtttaacttcatagcccttgccaagtatatgcaactctcaaaagaaaaccatttttggacagcatccttcaagtttgtagaaacttaa

SEQ ID NO: 73676 - DNA, 141 bp, Glycine max
  Peptide Sequence Number=SeqID_190454
atggcgaggattcctaacaagattaggtctagtgatggatcaaaagaagcgcttaagcttgctgttaggatcaccgatctttggttcgttgggactcctgacaagtctgagcaagcggaaatggtttttgttgattctgag

SEQ ID NO: 73677 - DNA, 438 bp, Glycine max
  Peptide Sequence Number=SeqID_190455
atggggaaccccaccatgcacaaacataacaaggggctgtcaaatagtaacacaagaaggagctcctgtatttgtgttcttgtttgcatcatcatcatgacatttgttgttggacattatagtgatcatcatcataggagacaacaaatactcgacaacatacgggagcacctattgtgtgatggaattaagaaggattatataatgcatatatggcatggtgaattgacagacatgcagagtgggtaccaggctgaagcatttgatgtagaaatgggaaatctcttagaggatatgatttgtgatcttagacaagagtcttttgagcaagcacatgcccctatgtataatacattgcaaactgattcaaagaagtctttgtttctgggggtgcaacaattccttgacactgttatcattggtgttaagtttggttaa

SEQ ID NO: 73678 - DNA, 210 bp, Glycine max
  Peptide Sequence Number=SeqID_190456
atgggagcgactatacctatagatatgccagatcatgatgttggtgatcccctgtatatgatgacattgaccatcccacagctttttctaaagtcgttgcaagttatgtgggatgctattgtgtttggggcatatgattcaaacagatatgcaagcggggaaggccgatgtgtatggattcctcgagccacagtccatacagagatctag

SEQ ID NO: 73679 - DNA, 369 bp, Glycine max
  Peptide Sequence Number=SeqID_190457
atgtcattgcctagcgctgttcatgtgtcctccaccttcgagtttggaggtatgcttcatgattgcctaagcgtggaccttcaagtgcaatcctccattctacacttttatcggagccccatgaatgtcaatgcatgctgttcatgtgtcctccaccttcgagtttggagctatgcttcatgcttgcctaagtgtggaccctcaagtgcaatcctctattctccatttttttcgaagccccatgaatgtcattgcctagcgctgttcatgtgtcctccaccctcgagtttggaactatgcttcgtgattgccttagtgtggacactcaagtgcaatcctccattctccacttttttcgcagccccatga

SEQ ID NO: 73680 - DNA, 168 bp, Glycine max
  Peptide Sequence Number=SeqID_190458
atgccacctgatactatggaactagctggcaagtgcccttctgcagtcttagtagtgttagattcattggttgatcctctccagaagactattcattttaagccaaagcaagatggtgttaagcaagaagtagatcgtaatgaagacatgattcgaagcgcattctga

SEQ ID NO: 73681 - DNA, 1011 bp, Glycine max
  Peptide Sequence Number=SeqID_190459
atgatgattgcagaaaccgcaacgaaagaaccgggtagatattacaccttccagtcgccattaccggctgatgtattttttgaactccggctccggacactgccgcataacgcacaacccatactggatgaaaccagtggcatgtgtattggttattcagtcgcacaggccccgggactgtggcagatatatgatacacagggccattttctgcgcctggaagaggctcctcttgaagcccccctgattgatcccaccgatattgcgcttatcgcttttggcgttttccgtatttttcgcgcgggccgcgtactttttgaaacctctacgcgcgcggctgtcagggtgaaacttagtcaggcgactatcatgtttcttcgtgcgcggttaaaaaccggtttatctgctggtaaccttaaaatgacagaaacagcagcccggcatatgtatgaaccggggcgctatgttccattacatatccaggaaaaagctatccgttacggcaggcgtatggcggatccccgtaaaggggaagggatgtttcgttacgaaactgagatgaaagcacgcatgtttgatttcagaaatgaaggattcgtcttcaccatctcaccctttgagcgtgttgttgataacgaaaccgatccggttaatcacctctgggactgggttaagtcttatgtggagttttccgtcagcggagtaaaggtgcagtttcagactgagtttaccgtcggcgaactgaaggaactgcgcgcaacattttctcgatactacgaggcggtaatggcccgccatgaaattgaatcttttagttttcgcagccaactcaaccagctcaatatggttctgagtaagatcacgggtgatgatatcgtgattattgaatatgttcttcgtccggaacaccatgctgatagcattcagataaagggcgaactggctatcaatgagagttacttcccggacattctcaggcagctggaggagatgatcagctggccggaataa

SEQ ID NO: 73682 - DNA, 639 bp, Glycine max
  Peptide Sequence Number=SeqID_190460
atgcccgttccggcatcggcgctgttggatgcctgcgtggcgggctaccgcgactatttgcggctgaccgcagaaggggcggacgcggcgacggtgctggcggcctttggccgtttccaggttctatgcgcgctgcgtgaagggccgttcggcgtcgccggcctgaacgagcgcattgagctcgggctgcagcgtgccggtttaattgaccgcaagccgggcgtgctcggccgctggtaccgggggcggccggtgatgatcggccgcaatgacagcgcgctggggctgttcaatggggatatcggcattacgttgccggatgagcacggcgatctgcgcgtgcatttccaactgcccgacggcagcatcaagtcggtacagccaagccgtttgccggcgcatgaaaccgcttatgcgatgacggtgcacaaatctcaaggatcggagtttgaccatacggtgctggtgttgccgaatcacttcctgccggtgttgacgcgtgagctggtctataccgcgatcactcgcgcgcgtaagctgctttcgctgtacgctacggaggcggtgctgctgcgggccattcgcacgccgacccagcgccgcagcggattggctgaacggctgcaggcgacggaataa

SEQ ID NO: 73683 - DNA, 1255 bp, Glycine max
  Peptide Sequence Number=SeqID_190461
atgcaggtgttgctcaatacgccgctcgacgacagcggcgtgacgttgtcggcgctgacgccgcagcacaagcaggccgagctgcagttctatttgccgattaaccggttgttgcaggcgaaggcgctcgatgccctggtgaagcgttacgatccgctttccgcccgctgcccggcgctagattttcatcaggtgcagggcatgctgaaaggctttatcgacctggtgttctgctggcagggcaaatactacctgctggactacaagtccaactggctgggggaagacagtagcgcctatacccggccggcgatggagcaggcgatggcggagcatcgttacgatctgcaataccagctgtatacgctggcgctgcatcgttatctgcgtcatcggttaccggattacgattaccggcgccattttggcggggtgatatatctgttcctgcgtggcgtggatgcggcgcacccgggcaacggcattttcacctgtctccccgagcttgagctggcggtggcgcttggcgtgctgcgcccgcttgacgtgcagttcgcccgcgtggtggcgagcgaagacgagcccgatattttgctggccgccgcctgcctgagcgcagaggcgggagccggtcacgtctgcctgatgctggaacagctgcaggcggacacgctgtttgaagggcgccagccggcgttggcgctggcggtgtgggaggcggccgggcgaccggatagcgcgcgttggcagcagcgtttggcggccagcgcggcggttggggacggcagcggcgctacgccgctggtgctgcgcggaccgcgcctgtatctgcagcgcatgtggcaaaacgaaggcgaagtggcggcgtttatcggcggtgaaggcgaatcgctggcggtgccggaggctgagctgcgcactattctcgaccgtttgttcggcgcggcgagcgacgaacccgattggcagaagatcgccgccgcagtggccgccacgcggcgcattgcggtcatttccggcgggccgggcaccggtaaaaccaccaccgtcgccaaactgttggcggcgctggtgcagctggatgaaagcgcgcgcttgcgcatccagctggcggcgccgaccggcaaggcggcggcgcgcctgacggagtcgcttggcagcgccagccgccagctggcgttgaccccggcgcagcaggcgctgttcccgacggaggcggcaacgttgcaccgtctgttgggggcgcaaccgagca

SEQ ID NO: 73684 - DNA, 267 bp, Glycine max
  Peptide Sequence Number=SeqID_190462
atgaacccaaaagcgattagtcttttgagtccagtgataacaaccaagaagttgtacccacttcttgcaatgaacccaaaagtggttagttttttggatccagtgatcaaccaagaagcaaatccgcttcttacaatgaacccaaaagcggttagtcttttgagtccagtgattaaccaagaagaccttctcttgaaaacagtcaccaagagtcagtctcttgaaaagctttttgtaagaatggaggaggagaggaaaatagaatag

SEQ ID NO: 73685 - DNA, 135 bp, Glycine max
  Peptide Sequence Number=SeqID_190463
atgacaagctgtattctgtgttcgtattgcagcattgtaacccactgttgttcagtacaagccaacattagtagaagactagccacatccggtctctacttcaaaagcaaagggatctgcactcagaaacaatag

SEQ ID NO: 73686 - DNA, 1026 bp, Glycine max
  Peptide Sequence Number=SeqID_190464
atggaagatgaagaattggcggtgattctattagactcttttcctccctcctatgagaattttgtgtctaggaatggggatgaagcatttgtgttcgaattattagttactaattcttctaaagggcagaagaagaaatgcaaagatggcaagaagatcaaagttgatccaaaggacattatcaattactacaaagaaccaagtcattggacgcgagattgtctaaacaaaggaaagaaagattcttttgctgctcttgttcaaaatgactcctcattggtaagcgatttggttctacctattgatgaacaactacaacaacattccaaacaatggatactggactcaggttattcttatcatatttgtccacacaaacattggtatgtgacttatgagaagaagtttggtgataatgtcctcatgggtaatgatgtttcttgtaagtctgtggctataggtggagttatgcagatcagatggaaatggaagtcaatggtaatgcagggaaccaagcaaggaaatttgaacatccttcaagatttcactatgatatgctctatctttgatgtttcacaatctggaagccatgcgtccaatgactcgtctgataattctctgtggcattggtgcctgggccacataagtgaaaaagtcaacacaacatgttatctcgtaaatcgctcaccatccactgctatagacttcaagatcgctattaagctatggtctaacagactagctaaatacttaatactgaagatgtttggatgttcgatatactatcatgtaagtaaaaatgtcgcttttggaaaactctctatgtttccttttaaatctaatgaagatttgggcaaggttgaggatgtcattaagcagggggcgtgtagcaaagttctagcttctcatctcaaggaggtgagcttagctattagagagcttctcaaggaagtttttctcaaagaagcttctcaaggaagttttctcaagaaagcttctcaaggaagctacctagtctataaatag

SEQ ID NO: 73687 - DNA, 306 bp, Glycine max
  Peptide Sequence Number=SeqID_190465
atgtgtactttcaaagacgtgattacctcagcaacatctttgaaagtagcattcaaagacggtgcttacttcaataacgtcttagaatgtctagacgttgctgagaaatcgacaataacacggttttctgccagggttacaaatgataccctcagtagttcgtcacacatgtcatcagtatcccgtggctatggctctcgggtgaactttgacatcaccagcttcgcatcatcccggggaattgcccctcctggctggacttcgcgagtccattcggctatccgaagcaatacttcggcaacttga

SEQ ID NO: 73688 - DNA, 585 bp, Glycine max
  Peptide Sequence Number=SeqID_190466
gacctgcagccagtcaagaaagcggtcgacggcctggtaaaagttcagctgaacgaataccagcgcgcggctctctacagcttcacctacaacgtcggcacttctgccttttccaaatcgactctgcttaagcggcttaactccggtgaccaggctggcgcaaccgtcgcgatatggagcgctcactttgcctggcggatggaccaaatgacatttagcctgcgcatctacctgatcaccatcgctgtgatgatcgccattgccatcggttacggagaaatccgctacctgaatggctggtatgctcatagcgacaaagttaatgccgactatgcactgaaaaagcagaaagccgaagccaagcttgttcccaccgagcagaaagcggcagcagccagtgctgatggaaaagtcatctaccgaaccattacccgcaacgtggtgacctatgtccagaatccaaatcgcactcgctgcgactttgatgatgatgctgtccggctgcggcaacaggcaatcgacgctgccaaccatatctcaggatttgatgagcccgccgtgcaagctaagtccagcgggaagtaa

SEQ ID NO: 73689 - DNA, 726 bp, Glycine max
  Peptide Sequence Number=SeqID_190467
atggttgagggtgaatcgattactaccactggttgtgataactgggctagattatgtcatgacttgttgggagtcattcctgaaggttcagatttgaagggggctaaggtttctctcgttgcttgcaaaccttcaacaaagtgggagccaactcgtcctaatgctgttgaaattggtggagcatgtttgttgatacaagtgtgggcatgggaaagattccttttcgtagcaccaactattcgtcaagagcctaatgcggttatcccattgcagcatgataatggtataatggtgctcaaaacccccaatttcactagtcgtaggtggttggagtggatggtaaaaaaatgttcaggatctacttacaaaatcgacaccacaaaatattggtatggaggtgcttttaacacacgcaatttaggcaatttgaacatgttttttggacgtttaaacctaccattgacgcattcaactcatgggagagaaacatggtctgttatcttaaacaaaaattactgtgagtgtggagcttttcaagcctacaaatattcttgctcccatgtcattgtagtgtgtgcccatgttaacatcaaccgataccaatacatggataaggtctacaaaatcaagaccaccattcaagggtcgaccctattattgtgggttgaccattatggaaactggaattcccttggttgtaaagaaaccatacctgaaagaagctaa

SEQ ID NO: 73690 - DNA, 678 bp, Glycine max
  Peptide Sequence Number=SeqID_190468
atggtggcagcaatagcatacgaggagagtcgccgcaagagagtggaggagaacaagaagaggatggaagccctcaatcttcccctcctctctcaagctcttcagaaatcatccccttctcccaaatcttcaccggtaaaacatcgcgccattcagaaagaggtggttgtcgtcagaaggtcaagtcgtgtggcaaacttgccatctcctgtttacaaagaaatagttattgatcgcgtgacaatgcctagaaggagttatgataagtacagggattatgcgaatcgggtctatgcctcagatgaggccagagaggaagcattggagaaagcagaaaagttaatgtccggtttagaatcagaatatccagccttcataaagtcaatgctccagtcccacgtgagcggcggattctggctgggccttccagtccacttctgcaagagcaatcttccaaaaaaggacgaagtggtgactttgattgatgaggatgggactgagtattcgacaatatatttggcaggaaaaacaggacttagtggtggatggagaggttttgcgattgctcatgacttagctgatggggatgctttaatttttcaattaattaagcgcaccacattcaaggtttacattgttagagcaatttgtcctccggatgataaacagctcgagtga

SEQ ID NO: 73691 - DNA, 1038 bp, Glycine max
  Peptide Sequence Number=SeqID_190469
atggcgagaggcaagtgggtttgttcctacaagaaaaccactcttttagtttgcttcttcaacattgctgttgctctctacgttcttcgctctctctatgcttctctttacatctactccggaaacgtttcccgcaacgctgcgttgtatagcccagatcagattcggaaaatggaggaatcaatccaaatccgctgggaatttaaacctgtggagttaattaagtgggtgaaggctttagaagcggagttttcgagtgaaactgaggcagttaagttgccctggcatttgaaacagaacataattgatgagatcttgcagagactaaggagcttgaattccagtagaacagatattgctatggaacgagaagtagttgagagttggcgcaaagaaaaactggaagaggtcaagtcagctcttgtgaaggggacttccaattcaaccatcccccatgaagaagctgattgtgtgatgcttttagataatgctctgcaaactggtaatggatgctttacaaacctttcacaccttgtattcaacttcctaggtatgctagtaagagctttggagtctgattgggctgtgctctgtgaagagattggcctctggatacctgctcaaaaatttattcttggacttaccaagtatacattctctccagaggaggaggtccttcctggcagacccgtttcacccgagtgccatgctgaactgcacacagattatgatggcgccgcagtaagatggggtcttaccttccacaaagatagtgcagctgattgctgtcaggcttgcttggaccatgcgaaacatgccaaagaaggggaaaagaaatgcaatatatgggtttattgcccatctgagtttgggtgtcattctccagatatctaccagcacaaacatcaggaatgttggctgaaatatgctgagaaacctcgactaaattttaaggataagtatcctgaatcatatcgaaattcacatccttctgcaccagtgatcgttccatgggtctctggagttatcagttcatga

SEQ ID NO: 73692 - DNA, 1401 bp, Glycine max
  Peptide Sequence Number=SeqID_190470
atgtctgctcgaagtgaacaccaatcggttcctctttcggtgctgctgaagcgcgagttggcgaatgagaaaattgagaagcccgaggttgttattttgcacggccaagctagtgagaataagaaaggagaggatttcacgctattgaagacggaatgccaaagggtgcttggagatggggtttctacctattctgtttttgggctattcgatggacacaatggatctgctgccgctatttatgccaaggagaatcttctaaataatgttttaagtgcaattccttctgatcttaacagagatgagtgggtagcagcgttgcctagggctttggttgcaggctttgtaaaaactgataaagattttcaagagaaagcacaaacatcaggaacaactgtaacctttatgattgtagaaggatgggttttaacagttgcatcagttggtgattcccgttgcatacttgagccttccgaaggtgggattttttacttgtcagcagaccatagactagagagcaatgaagaggagagggtccgcatcacttctagtggaggtgaggttggtcgtctaaatacaggaggaggcacagaggttggtcctttgagatgttggcctggtggcttgtgtctctcacgatccattggtgatatggatgttggtgaatttattgtccctgtaccacatgtaaagcaagtgaagctttccactgctggaggcaggattattctcagcagtgatggtgtctgggatgctctaagtgcagaaatggcccttgattgctgtcgtggcatgccacctgaggctgcagcaacccatattgtgaaagaatctgtgcaagcaaagggacttagagatgacacaacctgcattgttattgacatattacccctggagaagccacctacttctgtgccaacacaaaagaaaccggtgaaaggaatgcttaagtctatttttcgcaaaaagtcctctgaatcatcaacttttattgaaaaagaatacctggagccagatgtggtacaggaactatacgaggaagggtctgctatgctttcagagaggttagaaacaaaatatccactttgcaacatgttcaagttgttcatctgtgcagtgtgtcaggtagagattaaacccggggagggtatttccatacatgagggtctgactaacccaggaagattgcgtccctgggatgggcctttcctttgctcaagttgccaagaaaagaaagaagctatggaagggaagcgaacatcagggtttccattattgcatgcgcaagaactgaaaattagttttgcaaaaactctgaagcatgttacttctaaatgccgagcacgtactagagatgtacccgtatttggtactcattggatacttatgggtacgtactaa

SEQ ID NO: 73693 - DNA, 2769 bp, Glycine max
  Peptide Sequence Number=SeqID_190471
atgtggggatttggtggtagatattattgggaaagaaaagtggcttgtgaaaaagtcgatgggatagttgtggtgttcgcgtggatgtcaagcgaggagaagcacttgatgaaatacgtggacctctattcctctattggatggaattcactcgatttgattcctaaagtgtacggtgatagcttgtcaatcgacatttgttatccatcaaacatactgaagtcttgttgtcttggccatacatgggatcaaggactaaagacaaatagcagcaagaggatacatactgtgaagggtggtgttgcagagggcgcgggggggttcttcccagagaaagccacaattcttgctgttgatattcttaatgaacttgttgaggtgctgaaaatcaggccttgccccattgtttttgcatccttttcaggcggtgcaaaagcttgtatgcagaaggttcttcagataattagtggcaactctgaagctcataatatggatgactaccagatagttagagactgtatttctggctatatttatgattcaagcccagttgattttaccagtgatttgggtgttcgatttcttctacaaccaagtgttttaaaagtgtcccaccctccaagatttgcttcatggattgcaaatggcatagcttctggtcttgattctcttttcctcagtagatttgaatcacagcgtgcagaatattggtggacactttactccaccattgtcccgtatctcattttatgttcagaaaatgataatcttgctccttttcaagttatttcaaattttttccaaagactaaaagaccttggtggagatgtcaaattgttaaaatggagtgcttctcctcatgtaggtcattttcggcatcatccaattgattacaaggctgctatcactgagatccttggcaaggcagttgcaatttatcattccaaaaatagtcgaattgaagacgagaaacagggtatagaaggaacaaaagatgagatcacagatccgttctctgaattgaggaaagcagcaatgttctcaactagttttcagggttttgctcttgctccaagtgataatttgtcttctagttcaacggagtattatgtgggtaaaggtgttggcaccatagcagatgaacgcaaaggagggtttattcatctcccgagccgtcctagcatcaatgcaaatggggttcttggccaaatattgtttgatgtttgtgtgcccaagaatgttgaggattggtgtatcaggtcaaattccaagaatgcactagtagcagaccacccactagcggcgaattgtgtagcaaggaaagaagcagaggctgaggaaacaatgaagatattggtgaccggcgcatccggtttcctcggtggaaaactctgcgacgccctcgtccggcaaggttactctgtcagggttctcgtaagatccaccagcgatatctccgccctttctccgcacatcgaaatcttctacggcgacatcaccgactacgcctctctcctcgccgcctgcttctcctgcactctcgtcttccaccttgccgccctcgtcgaaccctggcttcctgatccttccaaattcttctccgtcaacgttggaggattgaaaaacgtgttggcggcggtgaaggagactcgcacagtggaaaaactcctgtatacgtcgtcgtttttcgctctcggaccaactgatggaatcgtcgccgacgagaatcaagtccatcacgagaaatatttctgtacggaatatgagaaatcgaaggtggccgcggataagattgcggtgcaagctgcgtcggagggggtgccaatagtactactgtatcccggagtaatctatgggcctggcaaggtcactgcaggaaacgttcttgcacgaatgcggtttagtggtcgattgcctggttacgtggggtatggaaacgatagattttcgttcagccatgtggaggatgtggtggaagggcacattgcagcaatgaaaaaaggagaagctgggaataggtatctactaacgggggaaaatgcgtccttcaagcatgtttttgatatggctgctgcgattactcatactaaaaaaccactgttcagcatcccattgtggctaattcaactctatggctgcctctctgttttcttctctagaatcaccggaatgctacctctcatcagtccaccggaagatgtaaaatataagaataaatatccatttcagttcttgaaagtgtcagtgttaaactacacgattttgatagcacttgtcggcattggccagaacatagcacttatcgatgctcctaagaagaaagatcttgttaaagccatggaggatgttaatgttaagaacaagtggaagaagaagggacggaataacaaggcttgtggtactaccccttatccccagttttctatatccacaactgggtcaaacatccgtgttcttgagcatgtattcagggaagatgcctatttttctaagcttcctgtttccattataaacattgtttcgtcgaagtttgtagcgacgaactcggcgccaccggcaatgtggtcgacgacctcgcgtgccactatgggttctccagatgcgtgtggcaatcttccaaaggaggacgaagtgatgactttgattgatgaggatgggaatgagtatccaacaatatatttggcacggaaaacaggacttagaggtggatggaaaggttttgcggttgctcatgacctagctgacagagatgctgtaattttcaattaa

SEQ ID NO: 73694 - DNA, 153 bp, Glycine max
  Peptide Sequence Number=SeqID_190472
atgattgatgaaatatattgtgtaatgaatggaaactcaatggggaaaggaatatgtggcgaggaggggcacgctcaagaggaacaagccaaccttagcttggtgatccgtgtgggaagctgtggtgtgggaactttggctgcacaaaaatga

SEQ ID NO: 73695 - DNA, 453 bp, Glycine max
  Peptide Sequence Number=SeqID_190473
tctgccaccgataggtggcccctcagtctgaagactcaccttattagaactttatttggtaagtctgttggagattgtttagatgcaatcttcagcagatctatgaagtaccctttcttcgctcagttcgaggtgtacccaggacagcgctttactaggtatgccattcttggagacgatgtttgtatcgccgacgagaatgtggcctctctttatcgccagacagtagcttgcttccaagccggcccggccgcgaggaagagatctttgccggtgctgacttggatctcgggtgacggaataaggcgcccagaagctacgagcagtcgcggtcgaagcttggctctaggcgataggctagcagctttctctgataggggctcgttagccgttgtttgggtcgagctcaaaccttcgccacttgagccgtatgcgggggaactcgcacgtgcg

SEQ ID NO: 73696 - DNA, 123 bp, Glycine max
  Peptide Sequence Number=SeqID_190474
atgacacatataaccaatatgactagcatcaactactatccctctgaagaaccagtgttcagactagagaattcgaaagatcttgatatagaaccagtgttcagactagagaattcaaaatga

SEQ ID NO: 73697 - DNA, 444 bp, Glycine max
  Peptide Sequence Number=SeqID_190475
atgacaggagaaaagtgtatgttccaatgcttgactctcatgcatggtggaacagtcactttcaaaggaaatcagaaggggaagatagcaggggtaggaaagataagtattgatccctatcctcacattgataatgtattgtttgttaaagggcttaaacaaaatctaattagcataagtcaattatgtgacagtggacttgatgtttctattgtgtccaaggttcttggaaaagaggttatgttgtccatggacaccatcgcacaagtcactgggtgcattaaggaaggaagcatgtaccaggaagactgggaggagacctataagagcgacaccccaaaagctcctttttctattcctctgtggtgcctcactattgtctctctcttgttctctcttttctctccttatgatttggtcatcacacacttctttgaggggtag

SEQ ID NO: 73698 - DNA, 525 bp, Glycine max
  Peptide Sequence Number=SeqID_190476
atggctaatgttgactgtcgccatcaactggaaggcaagacgaaaagaaagggcgcgtcttcccaaaaaggagaacgtgcgggagtcgccaccaacgtttatttgaggaaaacgttagaaaaaccaaaaagaggtctgaaaatattgagaagaaggattcgggagttgtttatgcatggggaagcctccctagcacgcctatttataggaaaatgggcacttggggcaatggcagctcgcctaggcgagctaagccttagtcatgaagcaatgagctcgcccaggcgagctagtttcttaacatggaagtcttttggtggcccaggcgagccaaaggctagcctgggcgagctagggtccaagaaaaccaaggaaaagacccttttgccctcctttcttggtatctcttgccttcctgatcgaaacattgaatgttccttgttttgcactgtaactggaattcaacaccgtaagtcgactagcaccgatagtccccggacgaaattagggtatgacatcaactaa

SEQ ID NO: 73699 - DNA, 675 bp, Glycine max
  Peptide Sequence Number=SeqID_190477
atgactaaggcaatccaacaaatcccgcaacaactccaagtggccatctcaaagaaaacgcaacaagcgttcataattttccaaaacatacatggaaactacaaccaagtgggagacaacaaaccacaaaaaagaccaaatttatgggaccgcactgcaaagttggaagaagccttgaccaaactcaccaaagtggtcatcaccaaccacaaaaacaccaaagtcatgatcaaaagcatagagactcaaatagatcaattggccaaaaaattgcaaacctcttcaattggtttttctgcaactaccaaggagaacccaaagggccattgcaaggctattatctccaccatagagtgtgatgtggaaggggaagaagaaaaagaggtagaagaaagcaccatgctagaggaagagatgaaagcacaagccaacccttcaacccaaggtatgaaatccttagtttatcctctattgtttgattttagcaagctaagcatccataagcaaggagacgatgaaaggatggccaaattcgagaaatacatggtaatgctacaagggaagaaggatgacctcatagcaaaaacaggtcattctggccagagctccagaggcccccaaaatcagcaaaaagttctaaaagaagaaattgcaaaaattaaagataaaagctag

SEQ ID NO: 73700 - DNA, 816 bp, Glycine max
  Peptide Sequence Number=SeqID_190478
atggcattcttgcattggaggggaagtggaaggaaggggatagagaggtggggaaaagaagactatgaaaagaatagagaaattacgaggcaacctcatcttgcaataaatgacggaataaagaaagccaaggggtctggaacctctcacatgagagaagaaattacacatggtactgtccaaatgacagagcaaaaagtaggattgatagggtacttatttctagtgattggttggagtgttggcatggtttctcacaatatgtctttgatagggacatttcagatcattgcccaattggtcaagagcattcttagtgattgggttagggtccttaattcttggttccaagataaaaggaaacaacaacaaattgtcaaagacttgaatgagttggaagagcatggagacttgagaaaaaataatttgaaaggactacatgcagatggagtgtgggaagagaatcctagtagggtgaaggaggaagtaaagaagttttttgataatagattcatagatgagtgttttgaaagaccaaagttagatggtgtccaatttagtaaaatatccaataaagataatgcatatttaattgtggactctgaaaaggaagaggtgaaagttgctataagagaatgtgatagtttaaacagcctcagacttgattgttttgacttccttttcgtcaaggaattttggaaccttttgaaggtggatatcttgagatccttgaaggacttccatggacatggaactctacctagaggtaccaactcttattctaaagctttgatttccaagcatggcaatccttag

SEQ ID NO: 73701 - DNA, 762 bp, Glycine max
  Peptide Sequence Number=SeqID_190479
atggctccaaagaagcttcttactaaaagggctaggaagaccaccacaggggagggatccagtgcatccctgcaagcagagagtgagtttgacggacaccacttccgaagcgaggagcatcagtgtcgtttcaaagcgatcaaggatgctatcaaccaattcctagggtatccgttggtcctagaggaggggcaatgttgtgagtacaccgaaagaaaaagccaggtctcaggttttgatgaagagatcataggccagctactgtgctccccgggacaggactttgcacggagcgtgacgagaaggcgggtgcagatcatgcataatagcatgaccaccttgacccagatctggatgacgcttctgctcggcaacatcctacccagcattgcaactccgagacacctagtggacccagaaaatttcaataggacactgggatttccaactttgatcacaggtctctgccaattctatggggtgctgattacccccacaaagctcatctggcctctcattaataggcctttcattgagaagtaccacatgccaagacaagcacagcagccggggatggaactctacatgcagcatttggctgaccaacaagcgacaaactatagaggccaggcgtccactgttgcatggcctagggacaggcctaattttcaggcaggggcaggtcccacagaggcctcaagggatgaaaacaaagctgaggaagatggagacatggcagatgtgatggatttcttcctttga

SEQ ID NO: 73702 - DNA, 627 bp, Glycine max
  Peptide Sequence Number=SeqID_190480
atgggtgtgttctaccatgaagagccaccaaaccatcccaagagatgcaaataccttgtggcaacttttattaaggaagttttctccagttgccagagttttgcagcacggctttcaacttcaagttttgaggatgagtacccagtgagcgattttgacgaggaacaagaattgtttatctcagcagtgataagccgaaccatggagaaacagaagcacaagccaaatgtgttgagacacaacttttcttgggtatactctccagcaacgaaagaactttatttcactactcaggcagtggcaccacaagaaaaggtggagagtgatcaagaaagtgatgaaggagaagagtttctgtcagttaaaagttatttctcacgctgttcaagttcgccaagtgggggggaagcattctattctgtgaagacaaacctttcacgatgttcaagcttgaacgaacttgacttgtccaaatataggaggccctcagtgattcaggagttttgtcattgcgagggatggccttttggtctttgccgcagagctgtgttgcttccaccactgcccaagtcaccttctgagtcatggttgtcgcttaaaatgcaaccaacttctaacaaaccatga

SEQ ID NO: 73703 - DNA, 414 bp, Glycine max
  Peptide Sequence Number=SeqID_190481
atgttaatggaccattggactaagagtagcatacctcttcattgtctagcacattctttaaacccaagatattatagtcacgaatggttaagtgaagatccatcaagagttcccacttatcaagatgtggaacttagtgatgaaaggaagaaatgctttagaagatactttgatgatgtgaatgtaagcagacaagtcaatttggagtttgcaaatttttctagtggaagagaaggctttcatgatgttgactctttaagggatagaggtgaattggatgcaaaatcttggtggcttgttcacgatgctcatgcaccaacacttcaaagatttcccttaagctactcgggcaaccatcttcatcttcttgctatgaaaggaattagagcacctataatttcatacatagtttga

SEQ ID NO: 73704 - DNA, 435 bp, Glycine max
  Peptide Sequence Number=SeqID_190482
atgaactcagaacttcaactctgggatgcagaaacttccaaaccagaccattgtgccgcagtcaaggccctttcctggtgcccttatgattcaagtgtacttgcttctggaggtggcactgaagatagaagtatcaagttatggaatgtttgtggattagaatggaatagacatcacaaggagcttttaagtggtcatggatttagtacaagtgcacatcacaaccaactttgtatgtggacgcatccatccatgactaaggtgggaggcttggactgtcacgcttccagagtcctccatctatgtcagagtccagatgggttaacggtggtgtcagttggggcagataaaactcttcgcttttcggatgtatttgggccacctgtcaataatacttctgagatctcaaaccttgataaccttctgtctctctag

SEQ ID NO: 73705 - DNA, 339 bp, Glycine max
  Peptide Sequence Number=SeqID_190483
atgaccagccaccttgtggcgagcattgagaaagctcaagaagtcctaattggaaccaaagaagaggatgctctagagaacaatctccaaggatgcataaaattgcatggaacctttggaaaaacactagtaactacaacgattattgtccaattcattgtgataaagctacaatcatcctacaatgacaaattgggtaggcttaccttgaatgaattaagagcagtgatttcaaaaatccatttggtcatgaaattcctcagcaatgaaatgcaagtcataacattgaaaggagatcaaacgaaagcccgtgagtgttacaaggaatccttaaaatga

SEQ ID NO: 73706 - DNA, 852 bp, Glycine max
  Peptide Sequence Number=SeqID_190484
atgacctactgtatgtcttgtacttgtggagatttggatgtttatgttggactggtaatgcatattttccctatactgtatggtgaaaattctcagagtgctttggagccaattatgagtcaggagacactcgaataccattgggggaagcatcataggacttatgtagataatctgaacaggcaaattgatggaacagatctagatgggaattcactggagaacactatagttattacgtacaataagggtgacattcttccagctttcaacaatgcagcgcaggcatgcatgcttgcatggaaccatgacttcttctgggagtccatgaaacctggtggtggtggaaggccatctggggatcttctaaatctgattgaaagagactttggttcattcgaaaaattccttgatgagttcaagactgctgcttcaacacagtttggttcaggatgggcatggcttgcatataaagaaagcagacttgacgtggaaaatgctgtgaaccctcttcaatctgatgaggacaagaagctagttgtggtgaagactcccaatgctgtaaacccccttgtttggaactactatcatccactccttaccattgatgtttgggagcatgcttacttcattgactttcagaaccagcgccgtgattatatatcagttttcatggataagcttgtgtcttgggatgcagtcagctcaagacttgagcaagccaaggctctaatcaaggagagagagagagaggctgagaggaaaagaagagaggaagaagagaaacggacaagcagtgaagccattcctgagatatattctgatggtgatgctgacttggatgcagaatga

SEQ ID NO: 73707 - DNA, 363 bp, Glycine max
  Peptide Sequence Number=SeqID_190485
atgcccgtcgctagcaaaaccagaaatatgcttgaaggtttggtaaaagaaggatcattgaaatggttgcttggcaagaagagttactttggtgaagaatttgaagagatggaaaattctccttctgctgggaagaactttatacgagagctctctcctgttgcaaacctagttgttcgtagatgctcaaaaatccttaggacctcttcaagtgatcttctggagagcttcaatcaagaggcttctgattctatgaagcatccatcacgatatgcgaggaactttttggaatattgttgtttcaaaacccggttaggacttatcttcgaagaccatggaagcaatattcaagaacaattttaa

SEQ ID NO: 73708 - DNA, 246 bp, Glycine max
  Peptide Sequence Number=SeqID_190486
atggctaccattgcattatcaagtagatatgggagcaagttagcatatgacaccggaatttggggtgaatcctacaggcttttcgctgcaaaattcatttcttggttggtgggtattgttgtcgatttagggatggcctttgtggataactgggcagtgggtaaggaggaggaatggcagtcacaacatgggtttctccctctttctcaacctcttcatttgccccagttttctcagtcgtcctaa

SEQ ID NO: 73709 - DNA, 1578 bp, Glycine max
  Peptide Sequence Number=SeqID_190487
atgggtaaggaaatgttggtggttacctttctaatgagcgtctgggcgtcatccagcgagatggggggctgcgaaggggaaacgggagcacactcctgctgcgagagggcgagagcagtgatggtggggatgaggattttgtgctcggtgttgctgtatcccagcactttctccccgaaggaactctcaagctccgcggggaaagggtcccgcgccccgaagtcccccaggaactcgttcacgtcgatggcgcgcgtgaccaggagcgaaggtgacgacgacgcgccacggccacgagcgaggagggacgttggggcgcgtggggggcacgccatggggcgtgccacggggagtactaggttgaggttgaggttgcctgtgatggccatgtatgcgtgcgcgctgacactgtcttgtgttatggttgttgttggttgggttgggaagttggaatggataaaatggaattggttttgtttgtggctagtgagtggaatggaacgaaggatgttgtgtgtgcaagatggccttagtacaattaaggatatcattttcaatattcgtgaaagtgtcaaatatattaaccacaacgatgcaagactaaaggcattttgtgatgttgttgagaaaaaacgcttgaaagaaaggaaacttgttattgattgtccaacaagatggaattcaacctttaacatgctgtcaactgctttgaaatttaagactgcatttgcttcttacaaagaaagagagcctcactataattatgcaccttcacttgaggagtggaatcaagttgagaaagtttgtaagttgttggaatttttaatcttgctactcatgtcatctcaggttaaacaaatacttgataaggagattgaagaagaagatctcttcatgagggaaatggtaggtccaatgaagaaaaagtttgacaaatattggggggaatgtaatatgttgatggctatcgcaagtgttttggatcctatgtgcaaatttcatatggtgagtatatgttttcccttgatatattctaaagaagttgttgatgagaatataaaggaggtgaaaagttcatttgaagaattgtatgatgagtatgtaggtctatctttacaagagtctacgtctagtgttgttaatttggatgataatatttcatcatcctcccaattcaatacttcagttgtcactggttttgacgaaattatgagcatgctacgtgaaaaggaagctgcttctcctataaaatcagagttgcaagattatcttgatgaaggtatttatgctcctaacactaattcctttagtgctttggactggtggaggaacaatagcatgaaacataagatattgtctaagatggttgctgatataccagctattccaatttcaaatgtggcatcggagtccacatttagtgctggaggtagagtaattgatgaatttcgctctaaattaaacgaagaatctattgaagctctaatttgtggtggagattggtttcgtcagaaatataatgtgaagaaaaaatcaaaggcagaaaaagaagagatacaaatcacgttgaagttttga

SEQ ID NO: 73710 - DNA, 810 bp, Glycine max
  Peptide Sequence Number=SeqID_190488
atggggagcttggcgtggaagcagcttcttctcaacgctctggaatccaacgctcacctcaagcactcttctttcatgcagctcgcaaccctaggaaccaacggaacaccttccaaccgcactgtcgtcttccgaggattccaagacaacactgataacatccaaattaacacccatgcccgcactcccaaggaatcaaattcctgggagcaatttcggataaatggggatgtagatatcattgatggtttgaatcctgatccgctaaaacttcagctacttaggagttttagcttgcatccttatggacaagatggcacatttgctaccatagtggaacttggggttttacattatttgtatgcacgtgcaccgtgcaaaatcaagaaacctttattctccctcatcaaatcaggagaagtaaagcaaaacacttgggcctttttcagtttggttcactttgggggaggtggcggcaacagtgatggtgatggtgtggtggtagtaatgataatggtgggtggtgacagactagcggtacaaagagaaaaatcctggtttgccagttcattgagatcaagattgcaatatttgttgcccaaccctggacttccctgtctaaatgagcaagcactgccagaaatatcattagatccttctataggtccagttgatgctttttgtctactaatcctagagccaaatcaggttgattacttgaatctgaagagtaaccagaggctaactttcaaatcaagtgtgagtgatgcagcaaagaaaagctggattgtggagagggtcaacccataa

SEQ ID NO: 73711 - DNA, 760 bp, Glycine max
  Peptide Sequence Number=SeqID_190489
atggagaactttttctatcaagaaacgattgcgaatagcggcaaggtgagtgctctcaatgggacgacaggtgatcgaccccctaaaccaccgaatggagatggggaaggactgagatcgccattcacaacgtccttaagagacaaggttctagggaaaccaacggaaccaaaggagatacgtaacctgcttcgtgagggaaccatgcagatggaacttgaaggtgggaacagattgctaccaaagttctccctggatgcaacagtttttacgaagctatgtgagtcgtggaagaagtttttggttttaaaactactggggaaaaggatagggttcttggcgttgcgtgacaagctaaagtctcagtggaagtgttctgggggttttgatctgatggatgtggataatggatacttccttatcactttcgactttgaagatgacaagaataaagcgattaaggataatattgatacgactctcgtgtggatcctctttccaaacctaggaatggtttactatgatgatagtgtgctcttgaccattgccttggcgatggggacgccattacgggttgacatgaatactgcaaatctggtacgaggccgttttaccagagtatgcattgaaatcgacttaaccgttctggtgggaaaattctaccttaatggaaaatggtacaatgttgaatatgagggcatagggaaactagatcagcaagatacgataggggaagatactgcgaatccaaagataccag

SEQ ID NO: 73712 - DNA, 3543 bp, Glycine max
  Peptide Sequence Number=SeqID_190490
atgagagaagcagagaagatgaatcccatcgatcatcttcccctccgtctcctcagatccgacacggtcccgcccgccccaaccttgtccgaatccacggtggattttctccctgacttctccggctactcctggatcgcctacgccgcttcttcacttctcaccatctcccacttcccttcccctctttcccctcaccaaacccgcatcggccccattttccgccaatccttccagctctccgccgatcccctcgccgccgtcgcctggtcccctagttccccctcctccggcgacctcgccgccgccgccgataactgcatctcgcttttccgccacgactccgccaccgctaaaggttctttttgttggagccagaatgcagtgcttgtacaacatacgaaagtggcaaacatcagatggacaggatcgggagatggaataatttctgttggaatggaggtggttttctggaaaaagagtaacaaatgttgggaagttgcttggaagtttaaagcagatcaaccccaaactcttgtttgtgcaacttggtttattgagggcccttcagcaactgcagcacatcctagtaaagagcacattgaagggtccttgaccaatgagaaaagcaaatgtgtattggtatgtcaaagcaacggactatctgaatattcaaaagtcaaactacatcatcctttacctgtcgtaatgattcaatggagaccatcaagaggaaagctatcaaacagatatggtaagtgttcagtaaggcatgtcctgttgacatgcagcttagatgggactgcaaggttatggagtgaaattgataatggaaaggccaggagaactgggaaggacatcaatgatcagaagaacacgggatgctctttttgtgttgttgctgttattgagattaatcagtccttaaatggaactcttggttcagatatatttgtgagatgggggacagactttgagggaatatttagaactggcgaagaggccgccaaacaagttttttccaaagaaggatttgagcatgatgttagaaattgtgattggcttgttgggtttggtcctggaatgttgcttagcttttgggctgtccaatgtcttgatgatgtttctccgctgagattcccccgagttacgttatggaacaaacatgaaatccagaaccacgacatagcaaatgtttacaagtttaactcatctgattttaaaaatgcattttttcttcataagatcattatattgagaagttccctgtctggtccaccgattatatgctcttcacttcagctattgccttgtaattccttagtttggtcaaattttcgtattcaaatgatacatgatgctgtggagaaatccattgataatgttaacacagataacatatcctcccatttgactggtggtgttttaaacttagatggtcatagtgggagaatcttaaaggtttcacttcatccttgtacaagcaaagttcaattagctgtttctctggattctaatggactgcttcttttttggtcactttctaacatttcaaactgcattttgggatgtccaactttggttcctactatggaactctatggaaagcttgcaactcaagactcatgttccttgtacacaagcttgacatgggcaccttcaatacttgatgacaagctggttttttttatggggcatactcgggggattgattgcttcattgtcaacatttgtcaaagtgaagaagaaaacatagaatgtcactacttatgtactattcctttcagtggtcatggtccttatgaggatggcccttttgatatctttacaattcctttaaattccacttgtgacaaaactttccgtaataataaacttatgttattggcaatatggatggggagatttcaggccctatcatgggaagtaaacttgcactcatttgacatgtcaacaaactgttgtgaatgcaattttgatgttaaaagcattgataactgcagtgtttgggcatttgaaagtacatttgctaataaaaaatattgcattactgtaaatccatgttcatgtgagtttctaagttccaatgatctggttactagttttgcggtggctgattcaggcactctaagccataggcaacaagagtttggccttgcgaatgatctgtgtagtagttatcctgcatatatcttggccacaggctcctctgatggcatcttgaaactctggaaaagtaaacctggcaactcattgacccagcacttgccatgggagcttgtgggttcgtttgttgcacatgatggtcccatcaaggatatatgtttagctgattgtggtgagaagattgccacattctgctacgaaagcaattcaaatgctatcaataccatccatatatgggatgctgtaccactaatcagtgctgggacttttattttggaggataaaataaagactgaaagtgatgttattgctctaaagtggttacctttaggaactggggagttattgcttggagtttgtttgcaaaatgaattacatgtgtatgctcctaagcgttgtgttggtacaacattgtcaaactctgtaaattttccaaaaaagaatatatgggttcgcattgcatatgctcacacttccattccaatttatgatttcttgtggggacccagagctgcagcagtggtgattcatggaaattactttagtatatttagtcattggttgttccatgaggataaaaggcaagggagtaaatttcgtcccggtgattcaaagcctaatacctataattgcgaggatgaaatatatgaagacatactttcttcagtttttactgaatatgacattggtgctttcagagaacagtcacttggagacagtcatgcagattttgattctgtgcagtccagcaaaatcaatatgaaggacaattccagtagcttgtttctggccaaggaacaattaaaatctgaacttcttaccaaggttggtttatggagcatcttagaagtagctgagataattagtggatcattgcctacttatcaccctgatgtactaattactaatataagctcaggaaactggaaacgtgcttatgtagctgtgaggcatcttgttgaatgcctgactagttatgatactcaaaagagacacatctccaagagaattggccttccaaatattttattgtcatattatctagaaggctgtatatcaaaaggttcccaacctaagggattccagtggggcggtgacactacatcaatcacatcaatttcacaggctcagggtagcttgttccagtttccatatcactcaggttccattgttgaaaatgaaagcatttcctcctcaacaaaatctgagcttaatggctttattgaatctcttgagaaatttcctgatttaccatttttgatcgacatagagaagatgcagattcttgcaattatagatctgcttagtgaagttagtagtcctcactcatcttctgcatatcagagtcttgatgaacctggacggaggtattcatga

SEQ ID NO: 73713 - DNA, 2499 bp, Glycine max
  Peptide Sequence Number=SeqID_190491
atggagaaattggcaagagctcagtatttgaagaacaaaaatcctaaggattgtgctttgctgtatattgcactgaatagagttcaagttttggctggccttttcaaaatcagtaaggatgagaaggataagcctctagtgggcttcctttctcgcaattttcaggatgagaaaaacaaagctgctgctttaaaaaatgcttatgtcttacttggaaagcatcagctggaattagcaattgctttctttttgcttggaggtgatcactcttctgctataaatatttgtgctaagaatcttggggatgaacagcttgccctagtcatttgtcgtcttgttgagggtcatggtggatcattggagcatcatctaattacaaagtacatacttccatctgcaattgataaaggagactactggcttgcaagccttctggagtgggaaatgggtaattactaccaatctttttatagaatgctagagttttcagtaaaccctgtgccttgggagtccactgtcatgtccaattgtggtccttttctggaccccactgttggtttttattgccaaatgttagcaacaaagaatagcatgcggaatgcagtgggggagcaaaattctgcaattcttttaagatgggcgactttgatgacagttgctgccctaaaaagatgtggtaatcctcttgaggcgttggaatatttctcgtcttcactgagcatgtctgagactgcagatcaagagagtgaattaggtgacagtcatgatgtgctgtccagtactcttaagcctttgccaagaaaatgctctaactggttgtctgctaatgtgtctgtgcatctcgagttccatattaaattgaatttggcactttgctacttatcaaaattgataaaagagcatccaagctggcctgacacttttgcagaatataatggagaagcttcttattctgacgagtacatgatgcaatatgcgaaatcagttgaaagttttaaacaaaagttatacacaggacttgctctatttgaacagagtatggaaaattcgcaacaaaattcatctattgatagtaaacctaagtttttggatgctttgcaatgccgctttgaagcttggcttcaaaaaaactcggaagcgcttttgtatatgtcggaaccattcttggttgcacaatctaatggtcgtaatccttatgacattgatatggtgaatctgaagaagcttatcccaaacattgggcagttgttggctcaaacttctttaatgtctaatatagaaaaccttcaactatccaaatgtgcagaagataaactagttgcagatctaaagcatttaattcctgacgatgaaagatggaagattttagggacctgcttgtggcagcatttctctagattcatgatatctaatttgaatctggttcttgccaaacttgaagatgagaagattcggttagtctcatttagcctatgtgatctactgatgacaacggttactcacatttcttcttatcatgttaaacaacatgcagaatttctgtggcagaaagtagggaatgatttgaatgtaatgactcttaaatggttaacacaaaaatcagaattcagtcagaaccaaaacctggacattttagaacaggggaacaggaaagataactattcagttcatcagttattatgggatcactgtgcggatcccaaattgatatctgattgctttgcacaggaaaaactcaattggcctaatgacttggatcagatgaatactaaaggttggaatgacttgtctataattatgacaggactgcataaaactgatgatacatgtggtgatggatgtaaatttagcactggatcttctaatcatgaagttggaactcctgttaaaggaacatctctaagtggccatgcttttgcaagaacaaaccagaaagatatatcttatacaaattttgcagttttccagagtcccagagaaatgtacaagagaaatggagaacttttggaggcattgtgtataaactctactgatcaacgggaagctgcagttgctggcaataggaagggtataatgttctttcatctggaagatgagattccttttagtgctaaatcagatgatcttttgtgggctacagctgattggcctcagaatggatgggcaggttcagaatccacccctgctccaacatgtgtttctcctggtgttggccttgggagcaaaaaaggggcacaccttgggctggatggagcaactattggcgtggactcttcagattggcccagcaatgacttgacaggtggcaaagtattaggaaggctaggttacactggtattggtgcctctggattaggttgggaagttcaacaagattttgaagattttgttgatccacctgccactttggagaacataagtaccagggctttgtctagtcatccaatgagacctttcttcttggttggctctagcaatacacacatttacttgtgggag

SEQ ID NO: 73714 - DNA, 1158 bp, Glycine max
  Peptide Sequence Number=SeqID_190492
atgaagggcaggtacctagctgaagctcatgttcaagccatgcaatttgaccaggcagagaacttctgcaagaagacccttgaaattcacagggagcattgctctcctgcttcccttaccgaagcagccgacaggcgtctaatggcccttatatgcgaggcaaagggagattatgaactggcacttgagcaccttgtcctagctagcatgtcaatgatagcaaatgcacaagataacgaggttgcagctattgatgttagcattggagacatttacttgtcactctgtcgttttgatgaggctgttttcgcctatcagaaagcactaacagtgttcaaatccaccaaaggtgaaagccacagttgtgtggcattagtgtacattcgccttgctgacctttactacaggacaggaaaattaagagagtcaaaatcgtattgcgaaaatgccttaagaatatacagcaagcctgtggctggaacaaccgccggggagattgcgagtggtttgaccgaaatctctgccatctatgaagctctaaacgagcctgaagaggcgctgaagctgctacagaaggcggtgaagttgttggaggatatccctggacaatataggacagtagcaggaatagaagcccaaatgggagtgatgttctacatggttgggaagtatatggatgcttggaagtcttttgagaatgctatcaccaagctgagagcaagcggggagaagaaatctgccttttttggagttgtattgaaccagatggggctggcatgtgtgcaactgtacaaaataggggatgctgccaaacattttgaagaagcgaaagagatattggagagagagtgtggaacatatcattctgacactcttggggtgtacagcaatcttgcagcaacttatgatgccttggggagagttgaggatgccattgagatattagaatacatactaaagatgagggaagaaaaacttggaactgcaaatccagatgttgatgatgaaaagaaacggctgtttgagcttttgaaagaagcaggaagagttcggaatagaaaggggaaaaaatcacttgaaaaccttatagattccaattccttaaagatgaagaaggaaggaaaaaagagatgggctgcttttggcttgagaacttaa

SEQ ID NO: 73715 - DNA, 1338 bp, Glycine max
  Peptide Sequence Number=SeqID_190493
atggccacagcagaagtgagagctgcatggcagagagctgttaatcgttgttttgtccaagaagatgcaaaaagagcccctaagttggcttgttgtcaatcttcatgtgcaacatcaaaattgtttgatgctggagcagccagtgctgctgatgaatatgatcatgctgctgctagtgtcacccattttaaccagaaatcttcattttccaatgtgattcctgattcaagatggtggttgttgcaattgcaagctaactatgaatttcaaaaaggtttaacatatgaacagttaaatgcgttagaggatgaggttgaaaatttgaatgttcgtaatgaacagaaaacatgtaaaggagatgctaatcactttggtgatgagaaccatgagtatatttcttccatggaaggaatgcaagaggtttatagtaaaaattctaaagcatatcgtcaaccaatggatatgattgctaaacatgagactatgaagattgattctgttggctgtacaatgtccaagcatacaaatgatttcttctttgattctgattattcatggattggagttgagaaggcactaccaaggtggagaactacagatagagatgagttagcttgctttgttttgcgcaaatcactcaaccatgttgagaattgtgaccttccccctccacaaaagtatcttagaggacaaccatgtgctgatatctgtgatatcaaaataagaacatcgtcttttgaccaggaagccaaatcctgtgccttttccaatttaaaagttcaagcaaagagaagtttagaatcagaattgatgcataggatgcttgtgccttcaaccaataaagggcatttaaattttgattgggacaaatattcaagaagttatcccatcatccatgggggtgtcacagaacaagtttttgagggaaatcccaacaaagctcaacttatggaagcattgtgtcattcccaaacacgtgcaaggaaagcagaggaggcagcaaaacaggcttgtgctgaaaaagagcacacaattgcactctttttcatacaagcttcacaactttttgcttataagcaatggtttcagctgttgcagctggaagctcttaacactcaggttaagaacaaggatcaaccaatatctactctcttcccatggatacgtaggaaaccgggcgagacaaagctaaaatttggctatgccatacaagagatgcttggcaagccagaaagtgaaattgcaacatatgctgttgcatttgctttaggattgagtcttgttggggctggcttgctcttaggttggactgttggttgcatgttacctagtccatag

SEQ ID NO: 73716 - DNA, 441 bp, Glycine max
  Peptide Sequence Number=SeqID_190494
atggtttattctttttctaacgatttctgtttgaattttatgaccacagggagtgtaacaaaagtagttaccataccaaataccaacttgtttttaactggaagcacagatggagatgtcaaactctgggatgcccagagcacaaagttaatacatcactggtcaaagatacatgaaaagcacacctttctgcagccaagctctcgtggatttggtggtgttgttcggctgatgccgtgggctgttgtagctctgtcaaactcatggcctcttaaaaaaaaataccccagtgtcataaggctcttcactatgcgaaagtatgggagagggtcattgtatgtagccttgtccttgctgatgcaaggaggttgcttccgaattcaaacccatgaccaactggttaggcacaactttactgttattccaggactcgccctctag

SEQ ID NO: 73717 - DNA, 807 bp, Glycine max
  Peptide Sequence Number=SeqID_190495
atgggtggttgtgaagtagagtttgaggcagatcagtgcaagataccaaaactacccttgttgaaccctccaacaatgcattctccagagagaccagggatgaaaactccaccacttttcacttcagcttcagttccatttggttgggaagaggagccagggaagccaaggccttgcactgatattgtgagcttctcaaacccaactccaaagtgcttggaacttcctccaaggttgctacttgattcccaaaacaacaacaaaagcaacaaactttcatcacccaccactgttttggagggaccatacccttatgtggctaccaccaacacttgcaactctccttcttttagaatgaatgaagacttgtacggttcttttgggtctgaaagagggaaacttgggaccatggttttgaaccaaggagtggggatcaaggaggaggagaaggagaaagggtggtttggttcatggagggaaaaggccttgaaaagagaggctagtggtggtgggggtagttatgtctttccatcttctgttgaaaaagatcctgaatgtgttggcactcacaagaaggtgaggagtatgagaaagaggaatcgtcctgggagctttactaacccattccatgccaagtctagtgtgtggtgcttgaaattttactttgctaaaacttgtgttatgatgtataaagcatgtaactttttagcagtttatatctgggctggtgtggttttgaagtcaagcttccctgaatggctatttggtcagcatcctgtagtggagattcataatgagggattttag

SEQ ID NO: 73718 - DNA, 207 bp, Glycine max
  Peptide Sequence Number=SeqID_190496
atgacggtgacaatggcggtgattggcggaagggcaggaacgacggcgcgacgagaagaagaagcaaagaagaaagaagagggatgtgcaacaacaatgaaaatgtacaagaaggagagggagaggagagaaagtgttgaggcaaaacgagaatggaggggtatcaaagtagggtctctctcacagttcgatgtggctcaaggataa

SEQ ID NO: 73719 - DNA, 343 bp, Glycine max
  Peptide Sequence Number=SeqID_190497
atgggttcagttttgtcagagccgcagagacccctcgtgggagaaaagaagttgatgactgagaagacaaagaaaaaactagaggaagctgctcaattcggaagcattgaggccgtgattgatcctccatctcccatcaaacgacatgtgaagtggaagatggcccgcaccaagaaaactggccagatgacgtttgaggcagcaaaggaaattgctgagaagattgattcattagaggagcaggtgtcgcagggttcctttgtcccccatggacgtcaggatgtcctgactgcttccattgggcgactagaacaccctagtcatgtgcgtactgctggagctg

SEQ ID NO: 73720 - DNA, 411 bp, Glycine max
  Peptide Sequence Number=SeqID_190498
atggcaagagttggtcttcttcgtctttgtcggtgtcttctacttctggtggatcttttgggggaagttcttcggttatggaatggtccagtgtggaggagaatgagttggtggttcctcttgggttttctttggtggtttatgcttggagaagcctgtttgtcgagagaagtcaaaagatcacgatgtacatggaataacacatctgttaagagaagtcaattgaaactccttattaacaacgttagtcccttgaatggatttatgattgtggagaagaggatatctagcttagacacccaaaaatgttcttgtgatgctagaatggcgtgtgtgattggaactttttactcgtgttgtgcacgccaaatgttcgaccaaatgtcggcatctcagcagcttgttgcctaa

SEQ ID NO: 73721 - DNA, 351 bp, Glycine max
  Peptide Sequence Number=SeqID_190499
atgttaagtgaaatatgcttacccaaggttttcagaaattacggaagcattacggaagccccggaaaacatttttcaaaaacgtggaggagcttgccgcccagttgcttcctccttaagcaacccaacttccaaaatgttatggaagggcctagagtcaaattgctatttacaccccaatcttgataagtttaccccctatttttgcatttttggctgttttctttctggaatgttgcgaaactttacggattacgcaacaatgctctttttgacttccggaatgttgcggaactttacagattacctaacgatgggggttaagtacctcgaggcggtcaagcgtgtgaat

SEQ ID NO: 73722 - DNA, 171 bp, Glycine max
  Peptide Sequence Number=SeqID_190500
atgatttctaatgacagggttcaagaaggaggagaaaagaagaaaatgagaagccagtcgagcaggtacgaggcttcacccaatcctacattgtccagtagccaaagacattgccttcctccatcttctgtaattaatgcttctccgtcctcaaccttaaccgtaaagtaa

SEQ ID NO: 73723 - DNA, 156 bp, Glycine max
  Peptide Sequence Number=SeqID_190501
atgttgtgtaaactggttccggtgccgcgcaagaaaaaacccggtttgaacccggtttaccttaacgtctacgacctaaccccaattaacggttacgcttattggcttggcctcggagtttaccattctggtgttcaagtttgttgggttacttga

SEQ ID NO: 73724 - DNA, 321 bp, Glycine max
  Peptide Sequence Number=SeqID_190502
atggacctcctctacaatggaaggtggttaccctcgatgccggcattaaagataaaagcattgtccgaccatgctattagttcctcaaggaaaatgactttcatcatggagatgaattgtgccttggtgacttgttggtcatgggttcgaatccggaaacagcctctttgcatatgcaagggtaaggttgcgtacaacatccctcccccataccttcgcatagcgaagagcctctgggcaatgggaagtttgatcactcaagattttgtggggaagggatggtgcggcgttgaaggacgaagttggctagcactcacctga

SEQ ID NO: 73725 - DNA, 375 bp, Glycine max
  Peptide Sequence Number=SeqID_190503
atggcaacaacaagtggcagcagcgccaccgtcgaccatggaaaacgaccacaaggacaagaatccaccatactggggatgcttgccacaagtgaaccttcaaaaaggaaactcggcttatgtggcaaatcgcttgcattaggaatagagtcaaaggattcgtgggaggtggaagctcaaactcggcgtgaaagcattatgtctacaaccttaagtttctactcgatcacaacaaaaaagaatattctaaagagtctccctccaataatgttcatggacgaagattttgagggtaaagagaaatcccataatgatcctatagtggtcaaagtggaagtcgccaactttttggtgtgcaaggtcctaattgactag

SEQ ID NO: 73726 - DNA, 185 bp, Glycine max
  Peptide Sequence Number=SeqID_190504
atgaaggactgcaaaaaacttaataaaatgtgggatgggacatggattcaattcatggaatgtgtgaaatgcattggggcatgtgcttgtgggatgcaagccaaatcatggatgtcagttggagaagtaaacatgaaagtagtcacgtgggaagttctgcttgtgttaagtgtgaatgatgagag

SEQ ID NO: 73727 - DNA, 933 bp, Glycine max
  Peptide Sequence Number=SeqID_190505
atgggatcaagtcaggcgcctttgcttaaaaagaggttctatcaagtcaagatcaagaacctcggagtcagcaatctgaaagatttaggacaatttataggtcaactccaacgacaagcctttcgcagggcctatggtaagatctgggacctgactatggcagaggtctccacgaaggccattgcctccctcacccagtattatgaccagcctttgagatgcttcacttttggggacttccagttaacacccacgatagaagagtttgaagagatcttgggatgccctctaggaggaaggaaaccgtatcttttctcagggttctatccctccttggctaggattttcaaagcgagaaccttggcgagccaagacgaatgggctccattcattgatgtcctggcactcttgatctttagagtggtcctctttccaaatatggatgagttggtggacctgacagtaattgacgcttttctcgccttttacgactgcaaggaaagcccggtcgtcgctatcttagccgatctatatgacatattcgaccgaagatgtgagaagaaccatgcaaggattttttgctgtacaccggccctctatgtatggttggtctcacacctttttcgcaaaggggagagacacattttccagctagaaggtcaccgctcgtgcgccaagaagaaggaggcaaactgggaccaactcttagcaagcaaagaaagatcgtccgtcaattggttccctcgatggaaggaaggaataaccgacgttctcatctcatgtggggaatttccaaatgttcctttgatggggacgaggggttgcattaattataatcccgtcctcaccataagacaacttggctaccccatgaggggggcacctgttggatcaagtggcctcagaataattaagaagggggggttgaattaa

SEQ ID NO: 73728 - DNA, 261 bp, Glycine max
  Peptide Sequence Number=SeqID_190506
atgttacaagaagttgaatctcgaaagaaggccttaaaatctgatctgaaaaaggcaaaagactcgaccaaggctctccaagatgaggtcgagcacctcaatcaggaattcgctctcttcaaagtcaatgctgccatggctaaggaagctctgaagattgatctcaacttattagaagttgagatccataagactcatgaggagaaagctctttatcaggttaagttcattttgaaagacactgaccttttccctctttaa

SEQ ID NO: 73729 - DNA, 411 bp, Glycine max
  Peptide Sequence Number=SeqID_190507
atggattctctcgcaatctcatctcggatcgtgacccacttttttattagcgctttctggcgggaactctttcgcctatgcggcacacagctccgaatgagcacgacttatcatccccaaatagacggccaagcggaggtgctcaactgcgtcctagagcaatacctccgttcctttgtccatgaccgcccttctcaatggttcaagcaccttgccctcacagagtggtcctacaacacctctatacattcaggaaccggcatttcaccttttgaagctacctacgggaagccaccaccgtccataccacagtatctccagggcacttctcgagttgccgtcgtcgatgacatcttaactacccgcaccaaacttcatgctaccttacgccgccgcttacacaaggcctag

SEQ ID NO: 73730 - DNA, 282 bp, Glycine max
  Peptide Sequence Number=SeqID_190508
atggtggctacattgtcggttgctactccttctcatgtcgaccacgatatgctaagggaggatggtcctaaggcctccaaggatgccattgctcattttcaagcaaggacttgggggattgtcgagttttggtcggacgagtatgagaaggcctttcacgagtcccagaaagctcaagaagatcttacaaaggctgagatggagttagttgaacccaacaacactactgaaacccttatgcaatcaactgaggaatctcataagtctcttgaagatacatag

SEQ ID NO: 73731 - DNA, 396 bp, Glycine max
  Peptide Sequence Number=SeqID_190509
atgtccatagtggattggaaatgggatttttctacctcccctccaacgaagctggtgttggtccgatgggaaggcgctgcacccgaggataccacctgggaagactgggaacaactctggacttcctacgaccttgaggacaaggtctttctcccggatggaggtgatgtgaacaatctcgagcccaatagacccaagatatactccacgaggtccaaatacctcagtgacttcgtggatttgaaggctaaagttcaggagaagttttacgagtacttggatgtgaggggagtgaataatgagcttgcagttttcttgcatgaatatatgatgaacaaggatagaattgagcttctgcggtggatggatagtctcaagtcttttatggaaagatag

SEQ ID NO: 73732 - DNA, 495 bp, Glycine max
  Peptide Sequence Number=SeqID_190510
atgagtacgacaaaatttgaaatactctcaagacaaccaaaggttacgcctctcctcaaccgtcgtttcatgaaggggagaagtgatatgagggtccaaccaaatgcatcttttgactttgagaggcttttaaaagcctatataaaggggataatatttcccctatttcttcatcttctttatgtttttcttctccctagcgcaagcttttcttctttggttgtctttgttttatttggtcagcctttcccttttgacattcttcctttctattctctagtcatttccatcaatctagggattctaatcattctaatggagatgtctcgtcgaaagttcacgccaatgacaacgacaacgtgtctagtgtccccattggcaatgccactatcgccaatggtaatacgattcatcctaatgttagggagggagaggccaagtcacctctgcccattccatttcagggtgttgtcgacattgattcgaagaccatag

SEQ ID NO: 73733 - DNA, 753 bp, Glycine max
  Peptide Sequence Number=SeqID_190511
atggcagcggaatggagaaggaagagagagaggagacgccacttcaaggagaagatgagtctagaagaagctcaccaccataggaggtcatggataagagcttggaggaagaaggagatgaatgaagggaaagggagagaagagcatgaatttttgtgctctaagagagctctgaaatctgaacaaatccttgcgtccagtgaggccgatagctgctccaaaatcgctttgacgatcctctccacaagggagtcctcaaggtttcctagcttcacttggcgttggagcacaatgacactcgctgccgaggtgagagaagacttgtacttcaaaacattgtctctcaaccacttacagccagcgacaaccaagggagacatcctcatatctccaatgttgctacctctcttcacacccccaaaagaagaaagggggaggatcacagtgaccaggactagctccctaatagtagtagaaggtcgcacccttccgcgagggcgagaagcacccctactagtacgaagcgaggcccgcaccctttctgaagaggaggactcgctgtcagaggcacctcgacgagtatcctttgacgaggaaccacctatcgagatgacctcccgatctatgatgggttgctcaatcgagctcctagagtcactgccactgccacccataccaatggcagaatcaaacaaaagggaagacattctgaaagatgggagtaccttaagcaaggaagcaagaagacaatga

SEQ ID NO: 73734 - DNA, 936 bp, Glycine max
  Peptide Sequence Number=SeqID_190512
atggaaggactaagcatgaaggagccatgcttttgtgacagaccgacaagttcaagcatcttctcttcttctgctcctccaccagaggctcccccaagtccaagtaccccacttcagcatccacatgaaaagaagaaacagctatgtgttgaggaattagaagaggaattagaaaataaggagccaaaaaagcagcatgttagtgttacccttttggatctgaatattatctcaggtggtgaagatgaatcatgcactctagaagaaggaccagaactcaaccttatcacttgtttggatgcggggtcatcatccgataatgcaaattcttcatcagaaacaacaacaacaacaacaacaaaccctcttggtaattctgatgctactgagcctagagtgttctcttgcaactactgccacagaaagttctacagttcacaagcactaggtggccaccaaaatgcacacaagagagagaggtcaattgcaaagagaggacacaggtttggatctcagattatggcctttggccttccccttttgcatcataacaacaacaacaacaacaacaatcgttttgcaagcatggcttctctacctctttatcatagcaatagaggaactcttggaattcaggcacactccttgatccagaagccttcttcttcttctcatcatcatcatgtgaatggttttggaggctcttatgcacaccatcatggttggtcaaggccaatcattgatcaacaacccggaatagcaaagcttgctgtgccagattttcatcacagaacaaaatcagcattatcagcatcacaaagcagtgttgccagtaataaagaaatcggtggatgtgtggctagtggtggaacttgtttgaagactactactaatcaagaagaaatgaagcaccttgatttgtccctcaagctctga

SEQ ID NO: 73735 - DNA, 3368 bp, Glycine max
  Peptide Sequence Number=SeqID_190513
atgtccttcaatcaatcaaagtccgataagagcgacgctgtgtaccgaaaatccgggcgatccggcagcttcaatcagcagcgcggtcccttcggcggtgcgtacggtaagggcggcggcggcggtgccggaccttctccgtcgctctcctctagccggagttttaacaagaagtctaataataatgcacaaggtgggcaatctagggtaaaccctactccggtgaattcgaccgagtctaatagtacttatgcagcccggactgtaccaaacggttcctatgtacagccgcagattcatggaggatcggatgcaccaattacaaatgcaactgccaagtcatctgaactgttggctgcacagaggagctccagagctgttccaaaagctcctacttctcaacctccctccatgagtcctgatccagcagctcctacaacccctgctaaggcagatgcatctaaggcattccctttccagtttggatctattagtcctggctttatgaatgggatggcaattcctgctcgcacaagctctgctcctcctaatatagatgaacagaggcgtgatcaagctcgacatgattctcttagacctgtaccctcaatgccaacacctcctgttccaaagcagcatctggtgaagaaggatacaggtgttgctgaccaatctaatgctggggagattcatactgggattagggcaaaaaaggatactcaaatgtcaccattacccccagcaagccagatgcagaagccttctgtcatttctttatctggaatgtcaatgcctatgccatatcaccaccagtcacaggcatctgtacactttggtggtcctaatccacagattcagtcatcggcacctcttcagatgccattaccaatgcctttaccgattggaagtggagcacaagtgcaacaacaggtttttgttccaagccttcaacctcatcctatccatcctcagggaatcatgcatcagggccaaagcatgggtttcactcctcaaattggccctcagttgacccatcagttaggcaacatggctattggaattagcccacaatatccaccacagcaaggaggaaaatttgctgctcgtaaaactactcctgtcaagataactcaccctgagacacatgaagagctaagacttgataaaaggacagatgcatattcagatggtgggtcatctggttcaaggcatcattctggcatgccttctcaatctcagcctgcccagcaatttgctgcttcccatcctattaattactatccatccagttcttacagtaccaattctctcttttatccaactaccagttctcttccattaacaagtagccagataactcctaactctcagccatccagatttaattatgcagtgaaccatggtccacaaaatgcaagttttataaattcatcatctcatagttctctgcctgtcaataaagctggcacttctattcctggcaatgctgaatctcctaatccagaaattttccaggatgtacataatacaatcttgtctgctccttcaggagtaacttctgtgtctattaagccaactggtggatctggtgttgttgtggactcatcattttccaattccagtactcaaaagagtggatcttctagttcttcattaacatctagtgatgctttcgaaacaactgaaatcacttcacaacagtctaaggtgtccagtgattcatcagttttgagttcattaccaagtttatctgctgcatctaccatgaagcctacatcagcttccttgttacttcctgcatctgctgtgagtgaagattccatttcagttctgcctaataatgaaggcggaaagaaggaatctcttagtaggtcaaattctttgaaggataaccagaagaaaatacagaagaaaggccaatcacagcatcaggttgctgtgcaatctccttctgtggttaatgtgcctttccaagctgttgacggtgatatccctgatgaagtttctgaaactgtaggaactaaaacaaaccattctgcggcaattaccagtgaagatctctccgctgctgcttcagacacgttatcagctaccattgagagcctaacttgtgctgttgaaatgaaaactaatgattctacacaagtttctgcttgtgcttcagctgaaggacctgttacacaagtgatggataatttgaacaatcataagattgctgagctagatgaattgtcacaccaggataaacccttacagccaaatattttggaaatgggtggtaaaacagaaaatttgtctcttcaaggaagtaaacaaagtgttagtgatggtggaacagaattaaaacaacctaagaaaggtactgtgaagttaagcactgagtttgtaaccttgaaaaccaaagaatctaccagttgtagtgcagaatgtgacacaacggctgataataacggcatgtctgtctctaccaaattggattccaaagatgtttgtttaaatagaaatgatagtgtagttagtaatgaagcggtttcttcaaattctggcacatcagatcagcagtctgctgatctcctagaagcaacttcaaaacagtgcaaggatgatagtgcagagaatgctggcagtgtttcagtgtctcttccagcatcaggtaccaaggacagaccaatttcagagtctagtaaggtgaaacctacatcaaaggggaaaaagaaacgaaaagagattcttcagaaggccgatgctgctgggtcaacatctgatctttataatgcatataagggacctgaggaaaagaaagaaactattataagttcagagaaaacagaaagtggttctacttctggaaatttagagcggttgccaactgatactgctcagccagatgctgtagcaaatgagcaatctaagcagagtaaagctgaacttgatgattgggaggatgctgctgacatgtctacacctaaactagaagtttcagatgaaactgaacaggttagtgatggaagtgcaattactgccaaaaagtactctcgagatttccttttgaaatttgcagagcagtgcactgatcttcctgaagggtttgaaatcacagcagacatagatgaggccttgatgagtgttaatgttagttcccatgtaattgaacgtgattctcattctactggaagaattattgataggtcaggtgggatgtctcgtcgtgggagtggtgttattgaggaagacaaatggagtaaagtttctaatgcatttcattctggtatgcgtttggatggtgtaggaggtaatgccggatttcgacctggtcaaggaggcaattttggtgttttaaggaatccacgcacacagacacctctgca

SEQ ID NO: 73736 - DNA, 231 bp, Glycine max
  Peptide Sequence Number=SeqID_190514
atggatggatggtttgtttggaagcagaacttgcagaaatcgacaggcctgaaagcacctgatggccttatgtggaagaccattttggattgccatccggcagctcccatcaccatgtctggaacatgctacaacagattccctatacttgcgaagaaagtgtctgagcacatgcattctcctcatccaaaggattttagtggggaagcctttcctcccttgtacccttaa

SEQ ID NO: 73737 - DNA, 2028 bp, Glycine max
  Peptide Sequence Number=SeqID_190515
tggaggaatgcaaagaaatagccctgatggagaaaggtggcagcgtgctactagcttccagcagaggggtttaattccatctccttctactcctcaaactcctttacagatgatgcacaaagctgagaagaagtatgaggtgggtaaagtgacagatgaggaacaggcaaagcagaggcaattgaagggtatattaaacaagttaactcctcagaattttgagaaactttttgatcaggttagagcagttaatattgacaatgttgtcactctcaatggtgtcatctcacaaatctttgagaaggccttgatggagcctaccttctgtgaaatgtatgccaatttctgttttcatctagcagctgcgttacctgatctcagtcaagacaatgaaaagataacttttaagagattattgttaaacaagtgccaggaagaatttgagaggggtgaaagagagcaagaagaagctaataaggttgatgagggtgaggtcaagctgtctaatggggaaagagaagagaaacgtaccaaggcaagaagacgtatgttgggtaatatcagattgattggagaactatataagaagaaaatgttgacagaaaggataatgcatgaatgcatcaagaagttattgggtcagtatcaggatccggatgaagaagatattgaagctttgtgcaagctgatgagtactattggggagatgattgaccatcccaaagccaaggaacatatggatgcgtattttgaaatgatgagatcattatcaaacaacatgaatttatcttctagggtgaggttcatgttgaaggatgtcattgatttgagaaagaataaatggcaacaaagaagaaaagttgaaggtccaaagaagattgaggaggtgcacagagatgcttctcaagagaggctggcccaagctagtaggctgggtcgtggtccaggcaacaatccacctagaagaatccctatggattttggtccaagagggtcatctatgttatctcccaatgctcagatgggtggactgcgtggattgcctactcaagttcgcgggtatggttctcaggatgctcgcatggaagacaggcaaacttatgaggctaggacattgtcagttcccttgcctcagagacctttaggtgatgaatccataaccttgggaccacagggtggccttgccagaggaatgtccattagaggtccacctgcagtttcaagttcaactggtcttaatggttataataatttgtcggagcgcacttcatacagctctagggaggaccctgcatcaagatatactccagatagatttgctggttcgactgcttatgatcaatctagtgttcaagatcgtaatatgaattatggcaacagggacttaagaaatgcaaataggattcttgataaacctgttgtaacttcacctgccagagcacaagggacagcagcctcccagaatatttctgcagagcgactgcaggacatgtccatggcagcaatcagagaatactatagtgctagagatgtgaatgaagttgttctatgcatcaaagatctgaactacccaggctttcatccttccatggtttctctctgggtcacagactcgtttgagagaaaggacaccgagagaaatcttttggcccaactgcttgtcaagcttgtgaaatctcaggatggaccattgggtcaagcccagctcatcaaagggtttgaatctgttctcagcactttggaagatgcggttaatgatgcccccaaagcaccagagtttcttggccgcatttttgccaaagctataacagagcatgtagtctctttgaaagagattgggcggttaatacatgagggtggagaggaaccggggagcctcttagaagctggacttgcagctgatgttcttggaagcaccttggaggtaataaaaatggagaagggtgatgctgttttgagtgagatctgcacgagctccaacttgcggttggagaccttccggccgctggaacctcttacatcaaggaa

SEQ ID NO: 73738 - DNA, 324 bp, Glycine max
  Peptide Sequence Number=SeqID_190516
atgactagttcacatgggaatatagatgatgttgagaagactgtggacgagatcaacgaacaaacagagaacatgaaacaaattcaggtagcattgtctactccaattggtgcaactacttactttaatgaggataaattggaagtagaacttgaagacctagagggtgttgaattggaagaacagcttcttcagcctgcaactacagctccaactgctacagtgcatgttccagctgggctacaacccactcgctctgtgtcttcgaagcccactaccgaggaagatgaattggcagctttgcaggataagatggcactttga

SEQ ID NO: 73739 - DNA, 495 bp, Glycine max
  Peptide Sequence Number=SeqID_190517
atggaaattctggtcgttgttgttttggttgatgcctatgacacatttgaccgaagatgcgagaagagtagcgcaaggattgtctgttgcacacccgttctttatgtatggctggtttctcacttttttggtcatgaaagtagacctgtttgtcacctacaaggtcaccacatgtgtgccgagaaagggaaagcaaattgggagcagctcttggctggtatgctgaaagctaggacacaagagataacttggctcccaaagctaaagatttcaagtgaggaagaggctaaagtccctgaggaaagcaaagacgtgcaagccttgaaagtgaaacttgaaaggacacaagtggtcaaggaaaagttcaagacgacagccatcagggtcaggaaggaatgtgatgagctgagggatgtcaatgtggccacggctgaagcattggaacgagaaacgaagagggcccgaaaaaaagaatggggtcgaaacaagttctga

SEQ ID NO: 73740 - DNA, 1314 bp, Glycine max
  Peptide Sequence Number=SeqID_190518
atgacaaatagaagttgtactggaagtgttaatgcctcaattcctctatcgtcggttactccctctcaatgtcctattgaactagcaggagctcctttactatcagaacgagtgttagagattcctaaagaagtaacacaacaagggacagaagctccatctccatttggacaagcaaaggtacaaaatagaaaaactactagagccttttctaatgtctggatgcaatacaatagggtaaataatgatgctttttgcaagtattgtggtaaatcatataaggctaacaattctaaatatggaaccactaacttgataaggcatgcgagagattatatgaataaccctaatagggaggttgataagaaacaaaagacaattaatgttggaaagaaatctaaggatgaccctaatgttgttagtatgaaacttgttgaattcaatcaagggcggattcttatagcacttgcaaagattattttagatgaaatttctcttaaatttgttgaaaatgaagggtttaggaagtttatggaagaggctgaaccctattttaaaattccttctcgttcgattattgctagatgttgcattcaagtgtttaatgatgaaaaaaagaagttgaaattggataatgcaagtgctaataatgtagccatttcatatttagttagaggtctaagtgtttggaatgatcatactttgttgaatggagagtttatgcatatgcgatgttctgctcacattttgaatttgattgttagtgatgggttgaaggaaattgactcctcaattagtaaagtaagggttgtatgcaagtctgtgaggtcttctcctagtaggttgacaacttttaagagctgtacggaggaatttagtgtaaattctaaagcaatgttaacacttggtgtaccaactaggtggaaatccacttatttgatgttagatgttgctgaaaaatttgaacaagcttcttattgctttgagtatgttgaggctgcatatgtgctcaatcttcttactagtgaaggaggatatcctaaagatgttgattggaaacgtgctcgtgtttttgaaatgtatgatgttgagaaaagcaaagagatggtgaaaaagtttgatgatctcatcataaaattgtttgcggattatgcaatacaacatcccatttccattgaaagtagtactttggcttcaaacattgactcgcaattgaattcagaccaagtgtttgagcaactgcccagcattgccgcattggatcttatgactctccaacaaactgcaccgttgttttcacttttagacttttag

SEQ ID NO: 73741 - DNA, 246 bp, Glycine max
  Peptide Sequence Number=SeqID_190519
atggagcatgtgagtaatccttggatccaacctattctaatatttacaaagaagagtggatccaaccttgacccatgggctaaaaaatctaccctaaggttcatgagaaccctagggccttctttagtagctctagcccaagcctcttggagtcttctatccaatacccttgggggggtaaggtctgaaaacccttttcatggacatcttgccatgagggaacatggttcctcaccaactcaatga

SEQ ID NO: 73742 - DNA, 303 bp, Glycine max
  Peptide Sequence Number=SeqID_190520
atggagttagagcaactcgatgtcaaaactacctttcaccatagaagactggaggaagacattttgatgccacaacctgaaggttttgaggtggaaggaatggaaaattctatctatagattgaagaggtctctttatgggttgaagcaatcaccaaggcaattgtacaagagattcaatgagttcatcatctctcatggatacatcagaagtccctataactcatgtgtttatcttaacaaggtggaagatgattctcacatctatctaccactctatgtggacgacatgctcattgattga

SEQ ID NO: 73743 - DNA, 765 bp, Glycine max
  Peptide Sequence Number=SeqID_190521
atgcccttacggacactattcctacttccccatcaggctctgataccagagatcagcggagagggatcaaatggacaaataggaaaagaggatgaagatgagtttgatctaaaagaaatgcgagagaaagaacgtaaaaggcgagacatattggattcatcctctagtatctttgctgtcatatggttccatagaaatgtttccataagactaaaaaagaagttaagaaaccttaacttagaagcagcaattgaagagcaaataaacaatttgcttatagaaacctcggaggaagaaacaaaaacttcatcctctgtgctctccgatgaaaacctaaacctaatccaacaagatgaccaactatcatcaacagatgatgatgggcaaataaacactctaacgagagaacaagatctcttgtttgaagcaatcaattctatacctgacccccaggaaaagaaggtttttctggaaaaactcaagaaaacattagagataaaacctagacaaaaggattttattacaaataataaatttgatgtaagcaacatattcaagagattagaaaactcttcagccaaaccaacaacaatccaagatctccaaacagagataaacaatttaaaaagggaagtgaaagaacttcgtcaacaacaagaaattcatcagatcattctttctcaacttgaggaagatagtgattctgaaagtgtcaacaacagtgaggaaaaccaaccagataatctagaagatgatatcttttag

SEQ ID NO: 73744 - DNA, 798 bp, Glycine max
  Peptide Sequence Number=SeqID_190522
atgtcacctcatagcatgtttgtgaatgaagtttgtaaggttgggttggacatgaaggatgttgtgtgtgataggaaccttatagaaaatatggtcaatgatttcatgggtcacgggaaggaagagtttctgaattcggcacgggaagtggctatgttggctaaccatagtgtgagggtggacgtcggtgctgtcatgttctcggataggggagcttcctccattattattagaccatatgaagatgatgcttcaaatagtgaaagctcactccaacatcctgaagctatttctcaattagttaacttaaaccaaaatgtatatgaaaatccaaatcagggaaccgtgagtcatgaagaatatttcagagttttggatgagatgaaaaccaagagctactcctatgacactgataaggatgcaaacatctatgatggaaacacctcatgtcttgcaacaagtgatccattgttccctggaacaagtgatgtagatcagctcagcagaattgtaagtgtattggggaacattaatgaggaaacttggcctagttgttccaagcttcctgattatggatcaatctcatttggtaatgtggaaaatccaagtggtcttgaagcatgcatgcccaattgctcccctaatgaagtttccctagtgcaaagattggtttgttatgatccagcaaagagaaccacaactatggagttacttcaggacaagtactttagtgaagaacctcttcctgttccaatttctgaattgcgggttcctttgactagaaatggacaagactag

SEQ ID NO: 73745 - DNA, 879 bp, Glycine max
  Peptide Sequence Number=SeqID_190523
atggagcagcatgaaatgggttttcacaaggccattaggatggtcgagttcttcgcaaagcaccttgacttgggtcattttgacctattcaaggacgtgaaggataatgttttgcttgacgaggaagatattgttgttgaggagaaggatgtcggcaaggagcaggattttaacatccacctggttgaaggtcttgatgaccactctagtggtagtatatttagacttgtggaacctggacctttaactatggttcttgtagttctcaaggaggcgaaccttgggtttttgatgcaccgacagacttgtattcctgcatggataaaacctttagcaatgcgagactcaccaaggatggaccttgggttttgtgagccttttgtgatgcgagactcaccaaggacgaaccttaggttttgcgagcctttggagaagcgagactcagcaagggcggaccttaggttttatgagcctttagagaagcgagactcaccaagggtgaaccatgggttttgcgagcctttggcaatgcgagactcaccaagggcaggccttgggttttgcaagcctttggcgatgcaagactcattaagggtggaccttgggttttgcgagcctttggaaaatcgagactcaccaaaggcggatcttgggttttgtaagcctttgatgatgcaagacttaccaaggacggaccttgggttttgcaagcttgtggagctgcgaccagagagggtatgcatccttgggacacaccctgttcagatcggtgtagtcggtgcacattccccatttgccattggcctttttgaccatgacgacattggtgagcctggtggaaaagctgaattctctgatgaagttgactttgaggagctt

SEQ ID NO: 73746 - DNA, 186 bp, Glycine max
  Peptide Sequence Number=SeqID_190524
atgaactccacaatgtcattgcagtcacagaagcgtagcccagtttgcgacaaagacgaactcaggcagaaggagaaagaagaagaacgccctaggagtcttaaggcgaaccacaatggacttccaaaatcgattcccaccctttctgggactctttcctttcctagttttcttcgacctgcgaaa

SEQ ID NO: 73747 - DNA, 2205 bp, Glycine max
  Peptide Sequence Number=SeqID_190525
atggcacatctggggtgttgtaatcttgggggccctgggagtagtggaacttctctaccggaaaaaggtttgaaggatgatgatctctatagagagctatggaagctgtgtgcagggccattggtggatgttcctcgtactggagacagagttttctacttccctcagggtcacatggaacaattgcaagcatctacggatcaggaattgaaccaggaaattccccatttcaatctcccggccaagattttttgccgtgttgtgaacattcagttgttggcggaacaagacactgatgaggtttatgcttgcatcgctttgcttccagaatcagatcaaactgagcctacaaatcctgatccaaatatttctgagcccccaaaacagaagtttcactcattttgcaagatattaactgcctctgatactagcacacatggaggattttcagttttgcggaagcatgctactgagtgcctgcctgcattggtatttagcccttttgagcttcctttaactgagactgaatgggtgaatgtagaggacatgactcaagcaacccctactcaggagttggcagcaaaggatcttcatggatttgagtggaagtttaagcatatatataggggtcaaccaaggaggcacttacttacaactggctggagtacatttgttgcatctaaaagattggttgctggagatgcttttgtgtttttaaggggagagcatgggcaattgagagttggagttagacgtttagcgcggcagcagagtcctatgccttcatctgtgatatcaagccagagcatgcatcttggagtgcttgccactgcttcccatgctgtcatgactcgtaccatgtttttggtttattacaagccaaggactagccagtttattgttggtttgaacaaatatctagaggcagtcaacaataagttttcactcggcatgcgattcaagatgagattcgagggagatgactcacctgagagaaggttttcaggtactattgttggggttggagacgtgtctgcaggatggtcaaattcacagtggcgctcattgaaggttcaatgggatgaaccagcaacaattccaaggccagatagggtttcttgctgggagatagagccttttgtagcttctactgctttgaatgtcacacaaccagcagtgaagggtaaaaggtctaggcctgctgatgtatcgtcttctgctgcttcaggtttctggtatcatggttcttccaatgagcttagtcaattaggtgctgccactgctgaagtccaaagcaaggaaaatcaggttgttccatgttctctgaggcagaaagacattattaatagcaatccaattgatgctaataactctagcatcagctctagagtccggatggaaggagtatggccttcttcaccacatttgaatgtcactccaaaccttttttctgatcccaataacaacagtgttttggcacgatcaccgatctctggttatcttaatgttccatctagatcaagtgatggtcccacatgtgagcatgtggaagacgggaaaaagattgagaattcccttgattgctggttatttggagttaatttgactaacaattgtagcaatgttataattactactccttcagagagggaactgagaggtccaataagctcaagtgttgctcctagtggtcccaaagaatctattcctgcagctgcatgtgaaactgagagggttcagactcccaactattcactgtccaacaaggggcagaagcaaattatttctgaggcatcaccaaatgagtggcagaacaagcaggccactgtaccatccatgaggacgcggactaaggtgcaaatgcaaggtgttgctgttggtcgtgcgtttgacttgaccacattgagtggctatgatgatctcatagaagaactcgagaaattgtttgagatcagaggagagttgcattcacaagacaaatgggctgttactttcacggatgatgaaaatgacatgatgctcgtgggtgatgatccatggccggagttctgcaacatggtgaagaggattttcatttgttcacgggaggacttgaagaagatgaaatgctgcaagctacctgcttcttcatcagaggttgaagaggttctattgagtccagattcacagaatagggatgagactcaacagtctcacatgccttag

SEQ ID NO: 73748 - DNA, 774 bp, Glycine max
  Peptide Sequence Number=SeqID_190526
atgggtattggccccattgacgaggatcacgacctcgtggccgtgacggtgcccgtgacgcgcaaagtagccgaagctggaatcgacaaggtcctcattttcaaaggcaacgaggaggaaaaaatttgcacgacatttatggagaggaaggagttgtggtgggggcagagacaaaatgggagatggcaaaagggaaggggagggggacaacagttgaagggagaggacctcccggcgaatgtccgtagacatattggaaataaagcagctaaggaggagtggcagagggaggccgacgacacgattggccaaggcttcaaactcggaaagtgtgtcgcggggattttcgtagaaggagggcacaaaacacatctccaaggcttgaagaaaaccagaccaagaaggcagttggtcgttgtagaacatccattgaaaccagttgaggattggcccgtcgaggtagaaggaggctacctggagtcgttcgttatcaggggtaccatggtagtaaaaaatttgactaatcttgaatatccaaagacatggcatcagtcccgtcgaagtgaggaacctcaaggttcatacgaggagggtgtgaagacgagaaataacctcgtccaatttggagtggaggaagctctgggtgaaggtgagtgcactctagttctgagtcaagagggtcacaacctcctgaaggcgagacaaggagtgagaacgtgtattatcggccatgggaagggatcaatgaaagcaccaaatgatggtgctctatga

SEQ ID NO: 73749 - DNA, 1803 bp, Glycine max
  Peptide Sequence Number=SeqID_190527
atggaccttgcacaaggtttccatcagattcgaatggtggaatccgacattcctgaaaccacattttgtactcatcaaggacactatgagtatgtggttatgccattcaggttatgcaatgccccttccacattccaagccacgatgaatgacctaattcgaccgttcatacgaaaattcatccacgtcttcttcgacgacatattagtatatagccacaacttcgatgaacacctcgaccacttggaccaagttttgcacactctacaacaaggggagttcaaccttaagctctccaaatgcgtgtttggccaacacagtatcgattacttggggcacatcgttttgacgaacgatgttgagccagaaccgtcaaagatacaagccatgctggattggccttacgagcttctaccgccattttttcaagaattatgcccaactcgcttatccattgacccaacttttgtgcaaggatcagttttcatggagacagacgcttccaatatgggaataggttttgtgttaatgcaaatgggtcatccaattgcttactttagcaagcaattttgcccaaagttgttgcgttcttccacctatatttgcgagttacacgcgattacgatcgctacaccagagcagcatatttacatcgccaagttattggggtatgattataccatccaatacaaggcagggcatagcaatgtcgtggctgatgccctttcgcgcattcgcgaaccatcaccagaggctttatggattatgaatgtgcctcattttcagttccttgatgacctcaaacacgagctgttccaaatggaggaatcaatctccttactcaatgttaacttcttctggataggcatgaaacaagacatccggcagtacatcacacaatgtttagattgccagcaaaccaaatacatcccacaaaggccagcaggtttacttcaaccaattcctcctccgccgagcccttgggaggacatggccctcgattttatcactggacttcccaattaccagggcgccactgttatcttgacaattatcgtttgcaagctccatggatttcctaagagcttgatctctgacagagatcccatcttcatgagccgcttctggtgcgagctattcaagctcaacgacactaaattgcgcatgagcatgacctatcaccccaaagtgacggccagcccaagatgcttaaccgcgtggtgtaacaatacctgggcagcttcgtgcactagaaacctttctagtggggaaagttttcatgtcttgttgaatggctcctcatctatggagacaatcgatttccttcttacttctcgacaagatatgttcatacacctcaagagaaaaattgagcacacccaggaaaaaatgaagagttctgtcggtagccaccgctgggacatctccttccacgttgatgattgggtctacgtgaaactacgaccataccggcaaacttctttggctggcaataactatcaaaagttaggcaagtgctactatggaccatatcaggtcatagaaagggttggcctagtagcgtacaaattggctctccctgcttccgcgaagatccaccctatgtttcattgcttgttgttgaagccgcacagcgaagattcaatttgggaaaattggactgagttacaagccagttaccaccttgaggacaaggtgattctcgaagcaatagggaatgatagtaaccctgaatcagaggctaatcacatgcccaaaagaattatcaaaaggccacaaaggtgggaagagtttattcactag

SEQ ID NO: 73750 - DNA, 174 bp, Glycine max
  Peptide Sequence Number=SeqID_190528
atgcccgattctgatgaagaaggcaacattggggcattagaactgcctgctgaaaatttggaggagcagcagcagcaccaggaggagctaatgcagcagtacctggaggagaacaccctgatgctgcagatgatttggaagagcaccagcaggctgctactagcgaaggcttag

SEQ ID NO: 73751 - DNA, 351 bp, Glycine max
  Peptide Sequence Number=SeqID_190529
atggaggcgacgcgtgtagcaatggaggcacttgcgggaacagcaaggagaagacgtagaagagttgttcttttggcttgttgggtcgcgtcgcgcgtgtcctactgttcaatcatgtctggtgacaatggaagcaacggacaacgcgtcgcaccggagtcgtacccgcatgcgtgtctggtgcgagtccgacgcgggacatgccgccaaataacggaatccaagattctgaaagcagaacaaaacgttgattggataagtccatcagtgcatttgctagaagaccttttccagcatccatcaatgatggtgcgccccagaccactagttttcgttgacaggaaacattga

SEQ ID NO: 73752 - DNA, 471 bp, Glycine max
  Peptide Sequence Number=SeqID_190530
atgtcggtcagtaatattttttggccaacatcgactaggggttttcaatcagtattgaccatgactgaaaaacaagaagatcgacacactaggccggatgttgaagaaaggacacaaaatttaaaaagtccacactattggccaactgttcaggtgaagctaggaaggggccacattcaagtgctccggcagagaacactgaaatgcggtcaagggcaaaatgacacccaagacctcaaacaaacatctatacataaagaacaagggcggatggctaggcgccgccctaaaaatcgggaagtcatcactcctgcaagcttgaatgaccagcttgcaaatgtcctcagggttcaccagcatcacttagcgttgaagcgcaatgacactcgccgtcaaagtcagataggacttgtacttcaacacgtcttccctcacccagtcctagccaggaacggctgggatcgacgatga

SEQ ID NO: 73753 - DNA, 304 bp, Glycine max
  Peptide Sequence Number=SeqID_190531
agggctttttccggaggagccctggtgcttaccaacatggatggcgaagagctaccttcacccggattccccgtctactgtatctctcgttacaatctttaaaagaaatgaacctggattcgaggctttagtcctcacgggcaggatcatattgagctaccttctggggtggggacaaaccatgaacagtagaaaccaatcaaggtacttaggaacggatgcaagtggggatggggtcacaaccgaccgatcgttgccccttctctgcgctaaacaagcagagaacgccgcgcaaggcagccca

SEQ ID NO: 73754 - DNA, 180 bp, Glycine max
  Peptide Sequence Number=SeqID_190532
atgtctgataaaggtgatgagtattacaaaaggtatgatgaaattgggaaacactcaggttcatttgctaaactcattcaaaaacatggtatttgtgcacaatacacaatgccagggtccctagaaaggcaattccgaagacaccttttgaactgtggtttaataggacacctaacataa

SEQ ID NO: 73755 - DNA, 324 bp, Glycine max
  Peptide Sequence Number=SeqID_190533
atgcagaaactattcagtcaagtaatcaacactgcaaaattattggagacagaaagtggtggaattttagtttcagttgataaactgaaagagggccatgctgttattgtctaccgtggaaaaaactataaacggccttcaagaaagttagcaaaaaatcttctaaccaagagagaagctttgcgtagatctcttgaaatgcagagaattggatcgctgaagttttttgctcgtcagagagagcaggcaatctccaagttagaggtaaaacaggaagacctgcagcaggaaaaggaaattgcgctgagagaatttgaaaattaa

SEQ ID NO: 73756 - DNA, 2463 bp, Glycine max
  Peptide Sequence Number=SeqID_190534
atgttgtccctctcctccactaccaccatcatcacagccaccatcctcgtcttctatctccaccatacgacgtcattaccaccccatgcacaactctctacctgccacgtgacctccttcaactgcggcaccatcaccaacctttcctaccctttcaccggcggtgaccgcccctccttctgtgggccaccacagttccatttgaactgccaaaacggtatcgttcccgagttgatcatctcatcagtgagttaccgagtcattcatgtaaactcggaggctcacactctcaacttagcaagactagacctttggaacgagacatgcaccaatgtgtacgttaactcaacttttgatggccccacattcagctacggttcggggaaccagaacctcactttgttttacgagtgcgaagcctcttcacggatcaccgaaacgccagaaaatttgtttcactgttggagtaacggggataagaataactcttattctttggttggtccgtttcctttggaccctattcttgaggttgttgaatgcgatgaacatgttaaagtgccaattcttatagagctggcagataggctcgtgaaaaaccggtctttgcttggggaggttttgatgaaggggtttaatgtgaactatatgaatccttatgagactgagtgttttgagtgccttgcttctggtggcgtgtgtgggtttgactctgataacgatgaacccatttgtatttgtggggatcagttgtgtgcaactccaggtagcagcaaagtagctgttgcaataggcgctagtgtaggagcagttggagcccttgttgtcattcttggatgtgtgtactttgtgttgcaaagaaggagaaaaattgcttataataaacaaagaagcagcatggacctcttcatgcctccttcaagcggagacacttttgcatctacaactaacacgtctcaaagtctatcttcttaccaatcctccaacactgacccaatgccgccgaggagtaactactttggagtccaggtctttacctatgaggaactagaggaagctaccaaaaactttgactcttctaaagaacttggtgagggaggttttggcactgtctacaaaggtgaactcaaagatggacgtgtagttgcagtgaaacgccactatgaaagcaactctagacgtattgagcagttcatgaatgaagtccagattctagcccggttaaggcacaagagcctggtgacactctttggatgcacccatagacatagcagagagcttctccttgtttatgaattcatacccaacggaacagtggctgatcatcttcaaggaagaagcacaaaatcaactaatttactcccttggcctataagattgaacattgcagttgaaacagctgaggctctagcctatctacatgcaaagggtgtcatacaccgcgatgttaaaaccaacaacattctcctggatgataacttccgcgtcaaggttgctgattttggtctctcaagggatttcccaaaccatgtcactcatgtgtcaacagctccacagggaacacctggttatgttgaccctgagtattatcagagctaccagctcactgataagagtgatgtttatagctttggagtggtcttagttgagctgatatcatcattgcaagctgtggacatcaataggaatcgcagtgatgtgaacttggcaaacatggctatcaataaaattcagaaccaggaactgcttgagtttgttgatccttatcttgggtttgagagggattatgctattaggaggatgacaacaggagtggcagaattggcctttaggtgtttgcagcaggaaagagagatcagaccctccatgaatgaggtggtggagatcttgagaggaatcaatagtagtgatgggcttggcgcacgggaagagacaaaagtattggaagttaggacagatgaagctatacttctgaaggtttccccggtttcaccagattccgttgttgataaatgggttagcgatctcactctctctcctcaatgcccactctccacaaattcaagttcctcgccacccaatgcgccgtcgccggcagccccacccgcagccctaccaccagccccatcatccacctccgccgccgcaagaccctacgcatgttcctcgcccgccgccgcttccgtcccccgccgcaagatccgcctcccctccccgactccgaggcccgcgtccgccacaagctcaaggacctcttcgtctcatcgccaccgcctcctcccctcaaggacgaaaaaacaatcttccaccatcagcagcagcaacaacaacaacaacaagatcagcacgaagaattcctccctaactccgccgtcagcgtccggttccgcgccggatctcccttccggcgcggcgcctccgctctccggccggtatcgtcggtcttccgctaccggttactga

SEQ ID NO: 73757 - DNA, 207 bp, Glycine max
  Peptide Sequence Number=SeqID_190535
atgttttgcaaaaatcaagtgtttatgcttcatgagagtgaagcgcttttcactcatgttcagccactatcatctttctgtaagttgaagctgaatcctttgaagaggcataacttgcatgtagaagttcaaaaatacttctacaaggttgttccttccgtgaaatgttctataacatttataacagagaaacttgactacctctag

SEQ ID NO: 73758 - DNA, 225 bp, Glycine max
  Peptide Sequence Number=SeqID_190536
atggaatcagccaagcgttacaaggcggttttgagattgaatggatggggaattatgaggagtgcgagaaatgttctggttccggtggagagtgtggagtcgctgatggtaaattccaatgtttctgcaaggatggatgcaaagggaaggacggatagtgtggcttcagtggagaataattccccaaagctagatggagctatgagagaatccttaagaaaataa

SEQ ID NO: 73759 - DNA, 294 bp, Glycine max
  Peptide Sequence Number=SeqID_190537
atggtgtatccagcagacggtctttcatcagagatttatgagaagaggtctcataaatttttagagagcaaacaaattgtgtttgtatatttctcaagtaactgtcataaatcgatgctcactggcgttgcaccttcacgggtgacacctctactggaaaagtctcatattccattgtcttatgtagcggcattactgcctttaccatttgggactgaccatgagacgaacatttcattggtgctttcaaaagtggaggaatttcatgatgatttgatatgcatcataatttaa

SEQ ID NO: 73760 - DNA, 117 bp, Glycine max
  Peptide Sequence Number=SeqID_190538
atgaagcataggatgccttcaaagtttttaaggttgaagttgagaaccaatgtgacaagtgagaatatattaatgggtatttctttggatatgccaaaaggtctaaaggttatatag

SEQ ID NO: 73761 - DNA, 236 bp, Glycine max
  Peptide Sequence Number=SeqID_190539
tgaggagctagagaatgatgatgaagtctgctatgtgtgcagtggtggttgtagcacttcttcttctggcggagcaatcacttccggtgctaaaccttccaatgcttgttgcacgaagctgaagcagcaaaaaccatgcttatgtggctacctcaaaaacgctagcttgaagcagtatgttaactctcctaatgcccgaaaaaccgttgcttcttgtgggattccctttccaactt

SEQ ID NO: 73762 - DNA, 285 bp, Glycine max
  Peptide Sequence Number=SeqID_190540
atgccaaaacgaaggagacttaatatggatttcaaaaacaaagctaacaacaatgctcttggtcaaacacccacgtcactacatgaaagggctgagggcatttcggggtttttcagaggaagcgtaaaacatgcaatagcggtttccaaactcagaaatgatgcaaagattagggcttcgctctctaccgaaaccgcgagccaagtcggacggttccacttcgatcgatgggttcctctcgttgtggagtttcaacggatgacaacggcacttcatggtggctaa

SEQ ID NO: 73763 - DNA, 1179 bp, Glycine max
  Peptide Sequence Number=SeqID_190541
atggcgagcgctgtagagaaagagggtggcgcgagagaggaaactttctctttggagcttcctgctccacctggttggaagaagcagtggtcaatcgcactgcgattacggggtggagtggaatggccccccactgctcttgaggcacttgtttcggagcatctggccattgcgctcccatttgtggcacaaatcacggtgttttgccgctgctcatctgtttgcgctgttgccagacagcctctgtcatcaccatctgtgttctcttccatcttccatagagaattagggtttcagttgcactttcataacagcggtggcactcatctagcacttagcagagaattcatcccaaagaaagctggcacccccaagaaaaatgagattgtgttcactgcagcaacaggagaggagatccataacaggaagcagctggaaaaatatttgaaagcacaccctggtggtccagctgtatcagaatttgactggggcactggtgagaccccaagaagatctacaagaattagtgagaaggcaaaggcagctcctccatctgtaagtgagcccccaaagaagcgtactaaaagatcatcagcctcacaaaaggaaacttcccaggaagaaaaagaacaggagataaaggaagcggaaatgcaagaagctgatgacaccactaaggatgataatgatatagggaaggaaaaggatgttgtaaaggaaaatcaagatgacaagtgtgtggaagatacagatgtcaacaaatccactaattctggagaagaagctaaagctgtagaaaatgttgaggtacctattgacgagaagtccaatgctgctgatggagaactacctgcattgaaagataaagttgatgacaaaggaactgagggctctgaagtttttctgagaaaggatgaagtaaagattgagcaaccacaggaagagacaaaagaatatcgtggatctggggagccagagaaatcggaaacatgcactactgcagacaaaacggttgaagtggaaggagtggataaagaggaacacgtcaaaagtactcatgaatttgaagttggggaaatggaaggaacaaaagtgattggtgaagaacatcacaagcttgatgagataaacaagaaggctgaaacagagttgactgtgaatggaaatcatgggagctga

SEQ ID NO: 73764 - DNA, 1276 bp, Glycine max
  Peptide Sequence Number=SeqID_190542
ggggcaagttgaatggggtgcctttgaatggatgcatgttgagtgctttcctaatttgatacagctggcttgtttgttacctcagaaagaagataacttacgaagtcgaatttcaaagtttttgttatctgtttctgaaagttttggggattcctacgtgacatgcataatgcttccagtatttttaatagcagttggggatgatgccgatctgacattttttcctacttccatccattcaagaattaaaggtttgagaccaaggtctgctgttgctgataggctctctacaatgtgtgtccttccgcttctattggctggggttttgagtgctcctggaaaacatgaacaattagcagaatatttgaggaagctgctactagaagaaaattcgatgcagaatcaatcaaccaagcacactcctgagattattaatgctatccgcttcatttgcatatatgaagaaaaccatggtatgatatttaatatactatgggaaatggttgtcagctctaatgcgagcatgaaaataaatgctgctaagttgctgaaagttattgtgccacacattgatgcaaaggttgcttcaactcatgttttgcctgcccttgttactcttggatctgaccaaaacctgactgtaaagtatggtagcatagatgcatttggtgctgtggctcaacacttcaaaaatgagatgattgttgacaagatacgtgttcaaatggatgcttttcttgaagatggttcccatgaagctactattgctgttattcgtgcattggtggttgcgatttcccaacttacagctatgccaaattcatcaagtgatttgatgcgtcgacgagaacgagccaatgcattttgtgaggcaatccgtgctctggatgctacagatcttcctgcaaatagcgttcgggacttgttcctgcctgctatacagaatctcttgaaagacttggatgcattggatccagcacacaaagaagcccttgaaattattatgaaggaaagatcaggaggaacttttgagtcttttagtaaggtgatgggtgctcatattggccttccatcatcagtgaccagcttctttggtgagagtggattgcttggaaagaaagaaaccacagagccaccatcagaagcaacagtgtctcccaaagctgctgcaccatcaccagcagaagacacaagattcaagcgcatcatgctgggaaattttagcgagatgcttcgtggcaaggcaaaagccccagaggaaggtcagaaccaataa

SEQ ID NO: 73765 - DNA, 246 bp, Glycine max
  Peptide Sequence Number=SeqID_190543
atgatgcagtgccccaccgacatcgacaattgcgccgccgggttcctcacccactcccgctctaacttcgtccttctccagcccgacgacatcgacgccgagtggccctcccgccctcgccaccacgtcggctccctccccaacctcgttgtcaccgtcctcaaagtctatgttgtccgcctcgaggaggaccaaccgcccaaggccgccgtcgactcccgctgcggtgccctcctcgacggcatc

SEQ ID NO: 73766 - DNA, 237 bp, Glycine max
  Peptide Sequence Number=SeqID_190544
atgggaagtaaggttgtggcagaggactccataccagtggcaacagttggtatgattatgattccaagaccaaagcctattggaaggatctatgagattattcttaaacttcaaaagtgtctcacgctcacttgggatgcacacactctctctgcatgcttacaccatcaagtcaatcttaaggttttccattttttcatcttgaacctttggacactccacaaagtccagccatga

SEQ ID NO: 73767 - DNA, 1395 bp, Glycine max
  Peptide Sequence Number=SeqID_190545
atggctggcagtggcacctttgcagagatcatagatggtgatgtgttcaagtactatgcacaaggccattggaacaagtcctcttctggaaaattcgttcccatcatcaatccaaccactaggaagacccacttcaaggtccaagcttgtacacagaaagaggttaatagggtcatggaatcagcaaaaacagctcaaaaatcatgggccaagactccactgtggaaaagagcagagttgcttcacaaggctgcagcaatactgaaggagcacaaagcacctattgctgagtgtcttgtaaaggagattgcaaagccagctaaggatgctgtcactgaggtgatcagatcaggggatttggtgtcatattgtgctgaggaaggggtgagaattcttggggaaggaaaatttctggtctctgatagttttccgggcaatgaaagaaccaaatactgtctcacttccaagattccactgggagttgttttagccattccacctttcaactatcctgttaatctggctgtttcaaagattgctccagcgcttattgctggaaactccattgttcttaaaccccccacccagggtgctgttgctgcactacatatggtgcattgctttcatttggctggtttccccgaaggccttattagctgtgtgacaggaaagggttccgagattggtgattttcttacaatgcatccgggggtgaactgcataagtttcactggtggggacactggaatagcaatatcaaagaaggccggcatggttcctcttcaaatggaattgggtggaaaagatgcctgcattgttcttgaagatgctgacttggatttggcagctgctaacattgtaaaaggaggcttttcctacagtggtcaaagatgcacagctgtaaaggttgctctggtcatggaatcggttgccaacactcttgtaaagagaatcaatgataaaattgcaaagttaactgttggacctcctgagattgacagtgatgtcacaccagttgtcaccgaatcctccgctaacttcattgaagggttggtaatggatgctaaggagaaaggagcaacattctgccaggaatacgtaagggagggaaatctcatttggccattgctgttggataatgttcgtcccgatatgaggatagcatgggaggagccatttggaccagttttgccagttatcaggataaattctgttgaagaaggaatccaccattgtaatgctagcaattttggccttcagggatgtgtcttcacaagagacattaacaaagcaatgctgatcagtgatgcaatggagacaggaacagttcaaattaattcagcaccagctcgtggacctgatcactttccttttcagagattgatgggtcattga

SEQ ID NO: 73768 - DNA, 192 bp, Glycine max
  Peptide Sequence Number=SeqID_190546
atggcctatcacagatattcaataagatatgatcacattatcatgccatcttattcgttaatattatgtggcaataagggtctgaaggatagtggaattggttctcaagggatcaccaacagtattaacatgatgacaaaggttaagactacaataatcaacttgccagcaccttcttacactatgggatga

SEQ ID NO: 73769 - DNA, 576 bp, Glycine max
  Peptide Sequence Number=SeqID_190547
atgaccacgattttgcacctatacccaataaggcagctattgtccgataatcatagttaccatttgcgtggggtattcttggatgcactgcgtgacttgatgcagagtgggacttacgcttggggtgctactgcacttgtgtacatgtatgataatttaaatgaggcatcaaagagcacggtgaggcagcttgcaggatatatcactctattaaagtgttggatctacgaacatttcccatccattggttccgccttagctaccgaggattacgacgagagaagactgtgtgcatgccaatggacctcaggcaaagcattgcctgtgtcgatgtatcacaggtgtctggacaaactgacccatgacgtagtgtgctggattccgtatggtgaccaccgttcatttagagaatttgaggtcatctcattatttttcggtcatctcagattgggtcccttgacggtcattcaccaatcgaagagggttctacgacagtttgcatacatccagactattctgccacatcctactgcgccttcggtctctattgaagaaatggatgatagatggatgtag

SEQ ID NO: 73770 - DNA, 294 bp, Glycine max
  Peptide Sequence Number=SeqID_190548
atgtgtaactttcatgcttttaaagaactacataggttgtcgtcccttgaggcggatgcgtgtggtgctaataccttccctgcacgtaaacaactcccgaaccttttattcttaaaattcgtaggcccgcttttggtttttctaacgtttttctcaaataaacgttggtggcgactccgcgcgtttttcttccttgggagacgcacccgtgagcctcgcgtcgccctcccgccgaagggtaggttgcgacaattggtgactccactggggagttttttttttaaaaagagttaa

SEQ ID NO: 73771 - DNA, 192 bp, Glycine max
  Peptide Sequence Number=SeqID_190549
atgatatgtccatcacgatgccatgaagagatgcacaatgtgatcaaggaacaagccaagggtgttgcccttgctcctatgtatcctcagcccataggcccacctaggccccctaggaagcttagggatgaagtaaccagcttgcctgagcgagctgctgtgcaacctccacccctcatttcctataaatag

SEQ ID NO: 73772 - DNA, 1668 bp, Glycine max
  Peptide Sequence Number=SeqID_190550
atgttgctaagaaacccttctttatacacaaacccagaaccctgccagcaccttgctgagtacaagctcaagcatggcttcgatggctacaaagccatccaaaagctccttgtgatttctccaattgggaaagccagtgtcaagaaacccaacacaaaggtacccagatgcggtttctgtaatgggtgtgaagggagattctatctatgcctgatttgttcttcattttcatgtttggatcacacccttttgcaccctcaatcagaaacaggtcatgctgtctttgtggacattgaaagggctgaacttttttgtggggtgtgccgtgatcaattgtatgaccctgattttgaccaagttgtgatgtctaagcactcattgggggtggcaagtggtgtcactgggaatgaaagcattggccagagattgatcaagaggaggagattggcttctggtgttgttggattggatttgcagaaatctaagtgtagagtttccaccaaagatctgagggaaaaatcgtgttaccctgtggggttgagggggttgaacaatcttggtagcacgtgcttcatgaattcggtgttgcaagtgttgctaaatgcacctcctttcagggactatttcctgagtggtggacaccggttggaggcttgtcatcacagaagaaccgcggatctgatgtgttgtttgctttgtgatgtcaatgctattttttcggctgcgtattcgggggatcggagtccgtatagtcctgctcagtttctctacagctggtggcagcattcagcaaatttagcatgttatgagcagcaggatgctcacgagtttttcatttcgatgttagatgctatccatgagaaagagagcaaaacaaggaatggaagcaaaggtaatggagactgtcaatgcattgctcataaggtgttctatgggttattgagatcagatgttacctgcatggcctgtggattcacctcaacaacctatgacccttgtgtggacatttcacttaacttggataccaatgtctcttcaacagaaaagggtaaaaaacttaccaaacaaaatgaggatggcagtatgtctacactttttggttgtttagatttattcacaaggccagagaagttggggtcagaccagaaactttactgccggaattgtcgggaaaggcaggactcgttgaagcaaatgtctattagaaagcttccattagtacttagtttgcatgtaaaacgatttgaacactcctttgttaaaaagtcttcaagaaaaatagatcgctacctacacttcccattttccttagatatgtccccatatctgtcctcctcaatcctcagagccagatatggaaatagaatttttaattttgggggtgatcaatcagatatgttttctgagtttgagatttttgcagtggtgacacattcggggacgctcgagtctggccattatgtttctttcgtgcgtttaaggaatcagtggtacagatgtgatgatgcttggataactgtggttgatgaggctacagtcagagcctcacagtgttacatgattttttatgtgcaaaagttgcagcacaataaagcaaatgaagacccgagtcatgtgccaaattcccccggaagagagctatttcttcctattgctggattttgctag

SEQ ID NO: 73773 - DNA, 255 bp, Glycine max
  Peptide Sequence Number=SeqID_190551
atgtccttgtctttgtgcttcataggacttgacgtcctccgtttctatgctttgaagaaagaagaagaagaagaacttcagatgtcttctactctacaaaacttcaatgccctcattgtgaaaccgatgatcattcaatgttttgatcaaaaatgcaaaaaataccgaaaggaagggcaaactggtcattttaagcatttttctgaaccctggctcacccaggctagcctctggctcgcctggggccccaaatag

SEQ ID NO: 73774 - DNA, 174 bp, Glycine max
  Peptide Sequence Number=SeqID_190552
gagaaaggaagtgaaaatgatgtgtcttatgctaataaactcctaaaacctataggaggaaacatggatgatgtagttcttatggacggagtgaaggataatggtgttctagaggaagccccaaaggagagtctaagcattatggatcagaaacttggagggagcgaattctag

SEQ ID NO: 73775 - DNA, 219 bp, Glycine max
  Peptide Sequence Number=SeqID_190553
atgatattagcaccaaattatgataaaggaagccacaatgcttttggaaggttgaagaagtctctgcaagatactacgaaaattaattgtgatgactcttaccttgcctcattggctcttgtcgcttgtggtgttgtgcttcgaaatgataaaggtgattttctgaaagcattttcaacgagacttggacattatactattttggaggttgagctttga

SEQ ID NO: 73776 - DNA, 1965 bp, Glycine max
  Peptide Sequence Number=SeqID_190554
atgaccgtggtggagaatcatacaatggatgatctcagagaccagtttcctattggaatgcgtgttcttgctgttgatgatgactcaacatgtctcatggttttggagactctgcttcgaaggtgtcaataccatgtaaccactactaaaaatgcaataacggcattgaatttgttgagagaaaacaaaaccatgtttgacctggtaatcagtgatgtccacatgccagacatggatggatttaagctgctggagcttgtggggcttgagatggacctacctgtcataatgttgtctgtaaatgatgaccctaagatggtgatgaagggaattacacatggagcttgtgattatcttctgaaacctgttagaattgaggagctacagaacatttggcagcatgtaatcaggaggaaaaagattgattcaaaggagcagaacaaaaccagcgactatgacaaaactaattctgatagtggtaatggaagagggtcagcagcgacaggaaattctgatcaaaatggaaagccttcaaaaaagaggaaggatcaggatgaagatgatgatgaggagaatgatactgaccatgacaatgaggacccatcaactcagaagaagcctcgagttgtttggtctgtggagctgcaccgcaagtttgtttctgctgtcaatctattaggcattgacaaggctgtacctaaaaagattcttgacttgatgaatgatgaaaagcttacaagggagaatgtggccagccacctccagaaatatagactttatctgaaaagaattagctgtggggcaaaccgacaggctaatatggtggcagccttaggtactgcagattcatcttatttgagaatgggttctctgagtggcgttggacatttgcagacattgactggtccacaacagtttcataacaatgctttcagaccctttccacctggtggaatgattggtagattgaacacttctgttggtctgaataatcatgggttgtcttcttcagaagctcttcagttgagtcatgcacaaaatttaaacaactccataaatgatccacttaagttccaatcatccatagcttgtggtaatcaaaatgctatccagggaatgccaatgtctataggccttgatcaattgcaacataataagggtgttagtgttagtgttggtcctattcaaaacatgtcccctcttattgatgccagaccaacttttgctgtgtcaaatagactctcagatcaaataccaaaagtaacaatgggttgctcaccctctccggtcttggacgtctcaaacaatgccttggtattgaaagcagatagtgaaaacacacaagggagaggagtatatgagaatttaacttcagtagcatctcagcattcacaattttcgcttcctttgctgggtcatggtaggtgtagtgatatttggtcaagtcctatgcggtcatctgggacaaattcttaccctccaagtgaaactttgcaaggggggaatctgagtggtgcttcatcaattacttcactgtctaatcaatcccatgattcacagacggatatgcactctcaaggactcatttttacaaataattcaggacaaattagcaataatgtgccatttctcgggtgggatgaccataatcatgatagtagttaccattcaaatgttattggtaactcaatagactctctgattgatccagaaggtcatacttctattaactcaacctacaacagaaacttggacttcaatttctgtgatcccttacaaatgaagcatgatggaattatgggattgagtgacgaaaactcattgaaacaacaacacaggtacatcatgaaccagcagaagtctcaaaacagtcgcgcccctaataatattggttcattggaagactttgtcagttcgatgatgaaacagggcactgacattgctaaatttgggcctacaaattga

SEQ ID NO: 73777 - DNA, 162 bp, Glycine max
  Peptide Sequence Number=SeqID_190555
atggaaaagaaacttgaaagaaaagaagttaggaacaagggatttgaacaaggttttgtttttcaatccacaagaattgaagacaggtacacccgacaacatctaatccggttcagctcacctggagccagattttcaacttcccttatgagctcacactga

SEQ ID NO: 73778 - DNA, 357 bp, Glycine max
  Peptide Sequence Number=SeqID_190556
atgaataacgtaactttgttaacatcggttcttcgaaaaatcaatattaacttcactcgtctccctcacaaaccctttgtcactctcactctcactctcgtagtgctgaaaccactgtcatcactgtcgcttacggtctcggttagtctcgctcatagtgaaagcactctcagtgttagtctcgctcttggtctcactctcaatcacggtctaggtgtcattgtcactctcactctcacgatttattggtgctttggttgttttcgacagtgtaggatttttattggtgttttggttgttttcgacaaagtaggtcttccaaagtacccaagtcatactacaaaacaaataatgtag

SEQ ID NO: 73779 - DNA, 220 bp, Glycine max
  Peptide Sequence Number=SeqID_190557
ggctaaaaggagcagtcgcgcaaagtggaccctgtgggctcagtttgcatccaccgctaagcgcagctttagcgcgcttagcatgacaagggaatctagaagagcacaagaatcaaggtcgcgcgataagtgtgagatcagcttgctaagcgagacatttgtctcttgtcaggctcaacgcacgattggcgccaagcccaaaccaacttactcgcgctaa

SEQ ID NO: 73780 - DNA, 417 bp, Glycine max
  Peptide Sequence Number=SeqID_190558
atggacattgacgaagatgttgatatcccattgatcttgggacatccattcatgctgactgcaagttgtgtggagtttgaggagaaggttctgaagcctcactatgatactcatagattcacctctgaggacgcctggaaccgctacgctgacaacgttcttggccggaacatccttctggaaaggaacgtgaagctctttgtcacagagtttgatgagttcaggacagagctagtcagaaggaactggcacaagacgctgaccaacctcatggaggggagcatagatgtggctctcgtgaaggaattttatgctaatctttatgtcccgggggataagcctccaaagcaagttagggtcagagggcatttaattaattttgaggcggattccctcaacactttcctggagactctg

SEQ ID NO: 73781 - DNA, 208 bp, Glycine max
  Peptide Sequence Number=SeqID_190559
atggtgaacaacattttcacactatctaggtacaaggaaaacatggtgcagcccaaaccaagtgttggccttaaggggaaacctcaccaacatgctctcactcatcatgccttcttgtatttcaacaaacaaaggcttgggccccctaggcctaagtcatgttttggcatttatcctaattctcgcaagctatccgcatccaaaaatg

SEQ ID NO: 73782 - DNA, 651 bp, Glycine max
  Peptide Sequence Number=SeqID_190560
atgagggcatttgggactatggcagctcgcctaggcgagctgatgcttagtccagaagaaattggctcgcctaagtatcacaaactgggagctcattgctttggtgtgcaacctaaagagaagccatcatcggatgaagttaatcacaagacaggttgctactatcaaactatcaatcacaatccctttgtggttgactcaccatccaaccgcgtctgtcaatggaagagagactttgttgttgtgtttgagcgcaatttctcattcactactgaacttccaaactctaaattctccttcattcatcaagaacaacccatcattgaagaggcaaattttgataatgaggcccatgctgcttctactgatatggccatggaagtctacaatagccatcatccatcccaagagtatgttagatttattgagacaactctactcaaaacaagggaggcacttgccaaagctcttcaaaatagggtttatgttgaaagagaagccaaaagatggaagatccttggagagtacctttttaagaagtgtgttgacactttcttggatagttcatctgatgatgaatctagggatgagttcttttgcatgcttgaagagaaagaagaagctacaaaacaaaagaaggagaagaagtaa

SEQ ID NO: 73783 - DNA, 2565 bp, Glycine max
  Peptide Sequence Number=SeqID_190561
atggatggtgcagagcttggtagcaaaagagttggatcagttaaagctgctgttaacttctatgatgataagaagccctcttcaagaacaagggaactccacagagcaagaagggatattggaaggtacaaagagagcaaatggactgcagaatctgtaacagctcaagcagaacctgagctttcgaatgcgaagaagacagcagaacatctttcttctatgattgaggagtcaagttacaaggcaaaaacacaaatgatagatgtagaaagcctagagaagagggggaagagccaacacggggcaattgttgttgcaaagagaaatgagaattatgagtatgcacaagtcatgagagagttggaatatctcaaaaaggaattgttcaagcttaagcttgatgtggcttctgtgatggatcagaaatccagggcagagaaggaaattgaagcatcgaactctaagatgttatcatgtttaacaactgcagaagagcttagaagggagattgaggaggccaatgaggagcaagtacttgctgaactagctaggatcgaggcttcgaaagaacttgcagatattgaggcccagagagaaaaggaagcaaatcaattttcattcaatttggaaattgcgaggagaaagttgaaggaggccattgaagagattgatgagtcaaaggagcttgaaatgaaattggctgtgacaatatcagatgttgatttcttgcagaacgagttaaagtcagttaaggatatgaataaaagggttcaaggagatgggagtgtaaagcaattggaaggaattttcaggaaaggggaggaatcagaatactctatagtgttacaaactataacggaagaattggaggcagctaggaaagaattagctttggttagagaagaaggttttcagtttatggcctctatggatgtcataagaaatgagttgaagcatgtcactgctgagacagatcggttgaagaagaaggaagggaaagtggactcaacagttcaaaatctcaattccaagattttgagagcaaaatctaaattagaagctgtgtctgctgcagaggaaaaggtgagatctatagtcatgagcctgtctcatactcttgaaaagctgaagacagaaacagcagatgcaaaaaaggaaaatgaggatgtaagccaagaggttgcagccagcaaggaagagattcaaaaagttgagtttgagatagacatgacagaggaaagattgcaaggcatcatgcaagagctggaagtagccaaagcatcagaagctctagccttagagaagctgaaaactcttactgagaccaccatgagagaaagagctttaacaacacagcatagttccatgatcactatctcaaaatttgagtatgagtatctaacaaatcatgcagcctcagcacaagaaattgctgataaaaaagtagcagcggctgaggcatggattgaagctctcaaggccagcgagaaggaaatactgatggaaacaaaaatagctcaaagagaactcaaagaaacaaaactggagcaagaacaggaggtttacacgaaagagaagatgctttcaagaagagtagttagtagtagtgaggagtttgacaattggccaagaaaacgcgagaagagttcatccaagaacttccagagagccatgtctagaaagagcatcaaacttaatggcactataactcctgcaaggggagcaaagtttcagaagactgcttcacctgcagctcggcatatcagtccttttactattaagaagagaaagaaggaattcaggacgagggaagtccaacttggttcacatactgtgagttctcatggatatgcagttgcgagaacacacaaacatgattggctcattctcttgctcctcgtgttgattgttattggcctgtacgttatccatcctttccatcgctttgttgggaaggatatgatgactgatctcaaatatcccctgaagagtaatacagttcctgtatgggcggttcctgtttatgataaatggggagatgtcatttgtcatggtgacaaaaaggtcataaaggaaggatataagagtttcccaagcggccatacttcatggtcttttgctggtctgggttttttatcattgtacttatctggaaaaataaaagcatttgatcgcaaaggtcatgttgcaaaactttgcattgtttttatgccactactttttgcatcacttattggcatttctcgagttgacgactactggcaccactggcaggatgtgtttgctggaggtcttttagggcttacagtggctacattttgctatttgcagttttttcctcctccttatcattctgaaggctggggtccttatgcatattttaggatgttggaagaatcacgtggtatgacccaagttcctactgttcaaaattctggtcaagagctgttagcagaggctcaggttgagagccaagaggaacaaggtctccatgggtgtatggggttaactttatcacgggatcataatgcaacatttgatgacgttgaatctgggaggggataa

SEQ ID NO: 73784 - DNA, 153 bp, Glycine max
  Peptide Sequence Number=SeqID_190562
atgacaaattttaaagatgtcatatttgtgtcggacaccgatacgaaaagcttaaaagtagagaatacgcggcatcccttctctcaagcaaaacacacaaaaattcgtgatccagcaagcagcacgacaagtgatcatgtgtataaacagtaa

SEQ ID NO: 73785 - DNA, 2559 bp, Glycine max
  Peptide Sequence Number=SeqID_190563
atggacgtggagagatcttcgctgtgcaattgcgtggtgaactttctgttggaagagaactaccttctcaccgcattcgagcttcttcacgaacttctcgacgatggccgcgacgaccaggccattcgcctcaaacagttcttctccgatcccaatctcttccctcccgatctcatctctcgcctcaactctctccgagtggctgatcctcaaactttgctggaagagaaagaagcagcagaagaaaagttagctattagtgattatgaattgcgtttggctcaagaagatatctcaaaactcaagagtgaattgcagaagaaagcagaaaatcataatgaactaaaggctgaaaagataagtggagatgtttcagtgaatgatgggcagcaaattcagcaaaagaagaattcttccttcaccgatttgggtccattaaaagaaacagaacgtcgagatcttaattgtgctgtaaaggaatatttgcttatagctggctatcgtcttactgcaatgacattttatgaagaggttacagaccagaacttggacagttggcacaacacacctgcatctgtacctgatgccttacgtcattattattatcaatatctttcatcaacttcagaggctgctgagcatgtttctcattgcatactacctaaactagtgctgagattgtactcaagaaacaaaggtgctgagaaattgtttgactatatggttttgctccacatgactctgttatatgggcttcgtgtacttatcttgatgatcagtctgagtttggaaactataatccaaccttccaaacttctctttcacagacatttttctttatcacatggtttctatatgttatttgtcacaaaccaactatcccaaaagctgttaggtcttcaatggcacatcgatatcatggccatgctaactagttcattggttttcaagttgaattggtcagtctatgtaggttttagaactactgaacaggaaaaattttccctacttagagaaaatgaaactttgctgaatgcaaataagaggctgaatcaagaaaaggagaacttgttgaagaacaaagacatggcggatgctcaaatagtcacattaactaagtccttggatgcaatgcagaaagatcttaaagacaaagaaaacctggtgcaagttttgaagcaatccttggagcaccaaagaaaggaactcaatgattgcagagctgagatcacttccctgaaagtgcatattgaagggtctcacttgggaaataatctggttatcagtgatgttaataatgttcaatctgaatctcttgaaaaatataaggaagaaatgaagaaattgcagatggaaaatgaatggttgaaggaaaagaatataagatctcctgaacctggaaattttgttggttctgaaaaggaaaatttgcagataaatgataaagtgattgagattcatgaagaccaaggtgcaatctctgaccctattgatgtggctttgggtgctgtacacaatgaagatgctcaatcaccagttgttcaaactcttgctcagtatgctgataaacatgaggatacattgcctgagttatttaatcctgcaaatacaaataatgcttttaaaaatataaaaaatgtctctgaacaaaatgttgggcaacaagcagaggatagcagcttgcttgtaaaatcagacagtgtgaatgatggagcaatatctgagaggacggcaagttctttgtactcttggcttgaggaaatccttaaacattattacttgttggggttaggaaccattcagatacttgcagatgctttgcctaaaattgttccctatgtcttgatcaaccatcgagaggagctccttcccttaataatgtgtgcaatcgagcgccacccagatagcagcactcgagattctttgacccacacattgtttaatttaataaagcgacctgatgaacaacaaagacgaataataatggatgcatgtgtgaaccttgcaaagaatgttggagagatgagaacagaaacagaattgcttcctcagtgttgggaacaaatcagtcacatgtacgaggagcgtagactgcttgttgctcaatcatgtggagagcttgcagattttgtacggctggagattcgcaattctcttattttgtctattgtgcagcaactaatagaagattctgccagtgttgttcgagaggctgctgcccgtaatctggccatgcttcttccacttttcccgaacatggataaatatttcaaggtggaggatatgatgttccaattggtatgtgacccatcaggagtggtggtggaaactactctcaaggaattggttccagcagttattaagtgggggaacaaattagatcatgttttgagagttttgctttctcatattgtaaactctgccctgcgttgtccacctctttctggggttgaaggatccattgagtcaaatctccgtgtcttgggtgaaagagagcgctggaatatagatattctgttgagaatgctggcagaattgctttcttgggtgcaccagaaa

SEQ ID NO: 73786 - DNA, 849 bp, Glycine max
  Peptide Sequence Number=SeqID_190564
atggagtcactatctcctatgtcaatctacgatggcataaagagctacctgagaaggcggcgctaccggcgtctccacggaggcaccaccgtcgttagaaggaagatggcgatcatccggttgagaggcccacgtaggaattggagggtcagagcaattccaaggcttagatgggtgatgagatcaccattgaagatgttgacaaagctcaagaatgcttatatgaactttatgttgagactgtcaaggaacgtaggtgctatcaacagtgataacatctttgaagtgaaacggattccaaaggctcgtcaagtgtataagggttattccagtgatgaatttgaggctaggctcatttttgagatttctaagacattggttgcttcctatgaacttcatcccatagttgacaaatcttatccatccatcagcactcagcagccgcagcaagtgagcaaagcaaaagtgatggaaagcagaactaatgctgactctttctggacctggaatgccaacaacgacaacaaccaaaaacaattctcagttaccaagttcctgggaaacaacaaaccccccaaacctcaaacatcagtgttgggtcctggcttcggagctggcatcggatgcggcgccggaataggtttgggtttggttggtggcttcggctacggaggctggcccttcaaccatatgcacctcgtttttggtctcggaatgggttgtggagttggtgtcggcttcggcttcggccaaggcattggatacgattttaatttccggacccgtaagtctagaaaatccaagaaaaatttctcagatccccaaaacacaattgttattcagatatga

SEQ ID NO: 73787 - DNA, 336 bp, Glycine max
  Peptide Sequence Number=SeqID_190565
atggatattaaaagtggttttttaaatgactttattgaagaggaagtgtatgtcagacaacctccaaactttgtagaccatacacttctagaccatattttcaaacttcaaaaggcttcatatggtctgaaacaggcaccttatgcttgggcttcagatcaagaaagacaacaaaggtttctgcatccagcaacaaaatacactaaggaacttctcaagaagtttaaaatggaagatgctaaaaccatgaaaactccaatgcatgcttccaatcttctaagcaaaggtgaattagatttcaatttgatcctcgagaatcacatcttaagattgtaa

SEQ ID NO: 73788 - DNA, 303 bp, Glycine max
  Peptide Sequence Number=SeqID_190566
atggctgcccatagcgctacacaacactcctcatttgaaattatgtatggattcaaccctttaacccctcttgatttgtttccattgcctaacaattttgttttaaagtataaagatggtgatgaggagctcaaatcgaggtcaaattcactcaaagaaggaagggatggtgagaatcaaaaaaggaacaaggacactgaagcaatacaaggactaggtggaccaatgacaagggcacgtgctaagaaagaaaaggaagccttgaaccaaatggtagcaactttcattgaaccagattcataa

SEQ ID NO: 73789 - DNA, 225 bp, Glycine max
  Peptide Sequence Number=SeqID_190567
atggctaagcgcagcactagcgtgcttagcgagcttagcacgagattggcgctaagctcaaattcacttactcacgctaagcgcaataatggcgctaagcgcctgaagagtgtgaatttcagagagtgtagagcagagcaaggggccaagttttcatcttttagggagattagtgagtttttgagtgattgtgagattcctagaggtggaggagacatcccctga

SEQ ID NO: 73790 - DNA, 141 bp, Glycine max
  Peptide Sequence Number=SeqID_190568
atggacctcataacctccctctcagctcctcttcatgcttatttatatcaaaacaaggcatttgaggtcatgacagctcgcccaggcgaactattacttcatcctgaagcaaccttgctcgcccaggcgagctggaattaa

SEQ ID NO: 73791 - DNA, 582 bp, Glycine max
  Peptide Sequence Number=SeqID_190569
atggcagtgttttgcctagtgcctgatgtcatcatccctccgaagttcaaggtgtcggattttgctaagtacaaagggactgcttaccccaagaaccaactgaagatgtattgtcagaagatgggggcatacacgaaagatgagaaactattgatgcatttcttccaggaaagtcttgttggggcagtcgtcacctggtacactaatctggaatcttcccaagtctattcttggaaagacctaatagttgccttcattaggcagcatcagtacaattctgttattgctccagatataatgcagctacaaaacatgtgtaagcaggagcatgaatctttcaaagaatatgcccaaaggtggagggatctggcagctcaagtagcgcccccaatgatggagagggagatgataacaatgatagtaaacacattaccagtgctttactataaaaagttggtgggttacacaccttcaagctttgccgatttagttttcacgggcgaaaggatcgaagtgggtttgagaagaggcaaatttgattatcctgtgatcgaggccgtacccaaatcaaataaacattaa

SEQ ID NO: 73792 - DNA, 462 bp, Glycine max
  Peptide Sequence Number=SeqID_190570
atggaagatgctaagcctatgaaaactccaatgcatgcttccaatccttttagaaaagaggaatcaagtaagctagtacaacagacgatctacagagactatgcaagagatggagtagaaagaaagagctcaagtggaggatgccattatattggacattgtctaatatcttgggcaagcaagaagcaaaactccatttctctatccacaactgaggctgagtatgggtcaattgcaagctattgttctcaactattatgggtaaagtatcagctggaagactactctagtttggaaaacaatatcctcgtgtattgtcacaacactagtgcaatcgacctatctaaaaatcagatacaacattcaaaggctaagcatattgagaaaagatatcatttcatttacaattatgtgcaaaaagatgtttttgatataaaattcatagacacatatcatcaatag

SEQ ID NO: 73793 - DNA, 1116 bp, Glycine max
  Peptide Sequence Number=SeqID_190571
atgaagagattaatgagaagaagacatgttccttttcattatcatagagaccttcacaacaagcttcaaagacttacacaaggaaataagagtatagatgagtattacaaagagatggaggaggatggagagattatgagtgatttttcttcagattttgtaccatctagtgatgaagaagagcatgaagaggaaaaagaagcagaaggagatttgttcatggttagaaggatgttgggcagtcaagcggtggaattggatgagtgtcaaagagaaaatattttccacacaaggctcaaattgagagaaaaactgaaaaagtatgcaaaacatgccaataaaggtcgaaaacaagttgtctttgaaccaggggattgggtttggatacaaatgaggaaggaaaggtttcttgcacaaaggacatctaagctccaacctagaggaggtgacccattccaagtgttgtccataattaatgataatgcttacatgattgatttaccaagtgattatggtgcagatggattcaattcgaggtcaaattcactcagagaagaaggggataatgaggacaacgtcaagagcatggaccttgaagcagagcatggatttgatggaccaatcacaagagcacgtgctaaggaaatgtacaacaagatctacagactaagaaatgccaaagagatatgggactcattgagcataaactatgaaggcactgaggatgttagactgaggaaggtcacgaatctgaccaaacataacaaaagcttcaccaagaaagatggagagttaatggatgatatgtttggaagacttcatgttcttctaaacaatctagaagctcttggacaaacatactccaaggcccaaataaacttgaaggtgttgaccaaatttatcaagaagaattcctctaccctcaagtctgaagaaataagcttcagaagaaaagaaaagaaaagctcatctaaagctcttaaagtgcaaatgcatgaatttgatggatcaaacaactttgatggatccaaagataatggcgtggacctcatgtctagaaatttcaaacaaatgatgaagaaaaaaggaaagtttcaacactcatctagacgttaa

SEQ ID NO: 73794 - DNA, 876 bp, Glycine max
  Peptide Sequence Number=SeqID_190572
atgcagggaatgctaactagtttgcttggaaacttgtctctgctttcatactttgccaagaagagagaaaaggaagccatggtagtgcagacgttgggtgtggtttcaacatacgtggtccttgttcagctggcattggctgaaaccatgccgttgccttactttttggctacttcagttgttgtcatctctggccttgttctgaatttcttgaattactttggtatactgaatgctggaatctggcgcttttgggaagatttcattacaattgggggtttatcagtgcttccccaaataatgtggtctacatttgtcccctatgtacctaacagcatcttacctggggccacttcctttgtgatagctgtcttggccgttaccttggcaagaaccggaaaactttctgagaaaggtgtcaaatttgttggaggaatatctggatggacagctacgttactctttatgtggatgccagtttctcaaatgtggacaaattatctcaatcctgagaacatgaaaggcttgtcagctttttctatgctccttgccatgcttggaaatgggcttatgcttccacgtgctctcttgattcgcgatttcatgtggttcactggttcagtgtgggctactcttttttatggatatgggaatattgcttgcctatactatttaaacattatcagcaaggaattcttcttatcagcaaccgttggtctgatttcgtttataggttactctcttaatcctatagcactcataaacacactgtcacatgtatctgttgccatgcctaggctgtgttatgtcatatttgagccatgtcctcataggttgatgtacaatatctccatttctcctgttgttatgcaatga

SEQ ID NO: 73795 - DNA, 486 bp, Glycine max
  Peptide Sequence Number=SeqID_190573
atgcgggtggtctctaatcgggtgcctcaaaatcatcaagatagagaggaggagaaactccgatcattctgggagaagcagttacttaatattcaaattgctgaagcatttaagagccagcaaaagttgccgctagctagaatcagaaggatgatgaaatcagagcccggagttcagatgatcagttctgaaatccccatgctgatgtcaaaagcatgtgagattttcattcaggagctcacttttcgtgcttggatgcatgctgaaaagaacaacaagagtattgtgcagccttgtgacgttgccaaagttatcatgcaaactgataccatgaatttcctcactgagattattccaaacaacctcggcgatttcagtgtttttgatgccaaggaagagaatattgcaaacattgcagaagaaaacgaagtttctctgtctttcactgctggttttatgggaaatcctatgatgaagatggacagt

SEQ ID NO: 73796 - DNA, 831 bp, Glycine max
  Peptide Sequence Number=SeqID_190574
atggctgttaagacttctgatgaaccgaatttagctcatgattttgatgatgatgatgatgatgggccggtaatttacaaaaggtactcatcatctaagaaaaatcaactgcactcagatgtaaggaagtcaagttctcacagtcacgatggacagatttctaatgctccttctgctaagccatcacccgtgaagccttctgtaggcatctcaaatgcttcaaattctcttatcaacacctcctctatgaagttgcctgtggcaaatccaaaatcaccttcattgggagataaacagaaaatgtccattgatgttaaggagaaatcaaaatctatcgattactgtgctaaagattactgtgaagattcagaagatgatgaggataataaaccgtttattcaacaccttttaagatcaagcggtagttcagaatattctaaagctacaaaacttcttcctagcgctggtgatgggcaaaataaacggactactttggttcacaatgctgtcattttccctccataccagccgcatggggtaaagatgctctacaagggtaaaccagctgagcaagaggagccatgcgagatacagacagactacatgccaaaagataggttcaaggaaaatttctggaatgactggcgaaagttgcttggaagaaatcatgttatccagaacttgaaagattgtgattttattccaatctatgactggtaccaaagtgagaaggaaaagaagaaaggaatgactgcagaagttgggaattttagagttgaacaacctaaatctgaattttcagatacagtcatttcatataaagaaatgtag

SEQ ID NO: 73797 - DNA, 624 bp, Glycine max
  Peptide Sequence Number=SeqID_190575
atgaagaagaaagggagactccacatgctgcaatgctttagtctatcattgaagtatcattgcaaagaagacatcttaagacttgaaagcatctatggagctactgagtttgtaccttttgatgcaatgaaggaccttgcatcaaagtctgaagatgaagactcaataaattggttgctgatgcaatcttaccccccaagagcattggatagaatactccaagaagattggtccagagatgtaggaaaaggccctagggttctcatgagccttaagtggcatctccaatcacctttcctccttcttcattctgctaccattaatcttcaagaagcaaaggactccaataatgaagaagatccaaggcctacaagctctacatggaggaagaatccttcaaggaatccctctcctccaaacctaaaaagcatcatctgcgaacatagaccatctaaaaggaaggtctaccctctaggagctacagtctggagaagcaaagaggttgtatatgatgaaatgcccttctctactcctctagaccttcatcaacttcttagtttgatggccatcttcaacgtggttcttccttggaattgtgctaagtctgggagatcttccaagtag

SEQ ID NO: 73798 - DNA, 495 bp, Glycine max
  Peptide Sequence Number=SeqID_190576
atggcctcctatggtgctcactactctggtctggaatctgaagagaacccaccatcaaatggagttcatcacataataagacgttgctttcagactatcaatcataatccctttgtggttgattcaccatccaatcacgtctgtgtatggaagagagattttgttgtgtctgagcataacttttcattcattattgatcatccaaactccattttcaccttcactcatcacatcaagccaatcattaaagaggtgaattttgatgatgaggcctctgttgtttctgaagacatggtcatggaggtcaatgatggtcctcctccatcccgagagtatgtgcatttgattaaggaagcactactcaaaaccaggaaggcatttgttgaagctcttcatgatcacactcatactgaaggagaagttaagaggtggaaactctttgaggactacttcattaggaaacatatagaagcccctagtagatatctcctctga

SEQ ID NO: 73799 - DNA, 414 bp, Glycine max
  Peptide Sequence Number=SeqID_190577
atggcaggcatacatgatatttcaaggcatgtgcagaatagaaagggaatggatgttcaggaatacaaaggtccccgtgaagtagatggcatcgttgactatttgaagaaacaaagtggtcctgcttcaactaaaattaaatttgctgatgaacctacttcttttgttggtgaaaacaaagttgttattgagtttgacaacttttctgccttagcagagaagttgcattctgattatgactttggtcaccctctaaatgtcaaactccttccaagaggagagtcatcagtttccgggcccatagttaggctctccaagccattcactggactttttgttgacttccaggttattatttatattgtttatcattattattatatagtcccttacaattgtgttcttttatcctga

SEQ ID NO: 73800 - DNA, 555 bp, Glycine max
  Peptide Sequence Number=SeqID_190578
atgcaagaaaagactagctctataaagtgcttcaaatgtcttggaagaggacacattacttctcaatgcctcaccaagaacaccatgattatgaggagtcaagacatttatagtagccaagatgaggctactacttcaccttcctctagtgaaagtgaagaagcaaaaggggaagaatctagtgaagaaatctacccccaagaagaaggacaacctttaatagttaaggaggagtgtaaagaggtaagtgtctcctccaagaggttagctaagaaggaaaggaattttgaaataaagacaaattttaaagaaatttcccctcttagacaacctccacattttctcctttgtaaaaagacacttgttagcattgccacacctcttgggcttgagcttattcctcaagtaaaggagttgttggatgagggtttggttcgcaagagcttaaatccttatgctttgttggtgcccaaaataggtgttgaggaaagaatccctgtgatcgaggccgtacccgaatcaaataaacatgaaaatgcagtaactaggaagtga

SEQ ID NO: 73801 - DNA, 726 bp, Glycine max
  Peptide Sequence Number=SeqID_190579
gaagagaatgttggaaacattacagaagaaagtcaagtcgtcttgccttacactgatggttttatggaaaatcatatagatatgatgaatatgagctatgacttggaggcaggaaaccaactgattcctcaaccaaacatgatgcagccaccctttatgccttcagatcaattgccttacaattttcaacccaatactcaactggagctaattaaaattaagtatgcattggattctgtacaatttagacaaaacactagtcatagaaaagtgttctcctcaaagtgttggggaatcttacatgaagcctttgagcctttaactttaagtaaagcaatacttttaagagcgtggctgaggcatatatataaaggagttaatgtggatcactactcattcaattcacagagtgaatacgaagagctgggaacgggagattggagcaatcagaatttgtgggaatgggctgattgggaagcaatgtgtgctggtgcaagaagcaataaaggaggtgcaggaagtagttgccctctaaaggtgattggcagtgttctacagccaggcccaaaagtagtatttgtggccttctttttatttagtcaagaggcgtggcgtgacccttctttaaggaagagttttaaactcaattgccatcctgttcaacaaccggtttcaaacaacatgtgtccagaggaatttcccattttcaattctagttatccatag

SEQ ID NO: 73802 - DNA, 1266 bp, Glycine max
  Peptide Sequence Number=SeqID_190580
atgggcgacttctcttggaggcccttggtcaagcaggttgaacctgatgatagggttgtgccatcgtctgctgtcgagccacccatcgtagaaagggggcaacctactgataaggttgaccataatgataatgaatttcttgagggttcgtctttggcttcattggtcgttcaagcttctattgttgctcctcctccttcttctttgcccactcaagaagtttttgtctctcctcctactatggttactgtgccagtccttttagccaccactatcatcgctccacctttccccattgttgctccctttttgagcatgctaagcatgggatataggtcagagaagggaactctagttggctttgtgtcttcttttgacaagaaccacattcagttagttggggtccaaaatgcaactgattctgtgaaggttgaggttgataagtggagggacattgctcaaacattttggagactggagcgtcccaaggtggccaacaccattgtcacctttgctgaggccatcaggtccaaccaacatatgtcttccaagattggtgatgcccttgccaagctactacacaccaaactagatggtgataagatgtttgagcgatgcaaggataagttcgccaatgtggttgttgacctccaagcccgatcgaaggagttggagtccaagatggaggagtctgagcttggggcgttagaggagatggtgaacaataaggagctagaggaggagctattggccagcttcttcaccaaggaacatgacttaggtctttttaacccattgaaagacatgaaagatgatgaaatttttgatgaagaagaaatagttgcagcagaggagtatgctgacaaggagaaagccaatatggccattgttaaaggtcttgttaatcatcttggtgatgcttccttttggagagagcttaccaagggtgtaccttgggtttctgtaggagcgcttaccaaggttggaccttcagtttcttgtattccaaggctggaccttgggtttaacaagctttggacaaaggaagtgttcatccttgcctttgaagaagcgagactcaccaagggtggaccttgggtttgtgagctttttggagatgtgagacttactcaggcagaccttgggtttgatgcacctttggagaagcaaaactcactaagggtggaccttgcgtttgacgatcctttggagatgcgaaactcaccaaggttagaccttggatttgacgagcctttagaaaagtga

SEQ ID NO: 73803 - DNA, 225 bp, Glycine max
  Peptide Sequence Number=SeqID_190581
atggggaaaggtggagcgatgatagtggtggctaaaaggactggcacagttgccccctttctacgatgggtggctcgacagcagacgatggcacaaccctatcatcaggcaagatatgtaggtgttcttcaaggagttgggagatttgatagttcaaggggctacaaattttcaacctatgtgcagtactggataaggaaatcaattttaagagttgtggcatga

SEQ ID NO: 73804 - DNA, 426 bp, Glycine max
  Peptide Sequence Number=SeqID_190582
atgaagaagcgcactgagtggtccaccgacggacctataattttacatgctaaaggaggcaagtgcatatttcgaagcattctgtcttctcttccgcgaaaaagcttccttcctcttctctcttccgcaaaagcaagcttccttggtggtcttcttctccgcgaggcttctccgccttcatcttctccgcgaggcttctctcttccatttgcattcgagatgaaccttagggtagaggaaaccggaaaaaatggcggaaggttggtgacggtgagccttccagaagacccgttaggggttcttccggaagtttcggaagaagatcttccggaagatttccgtaagaagggttctttcggaagtaatgaaacgacttccggaagaacaggtcttccggaaagctctcggaacacctcttctggatga

SEQ ID NO: 73805 - DNA, 347 bp, Glycine max
  Peptide Sequence Number=SeqID_190583
atgggcataaacgatgtttacattcaagttaaattgtcgagggtgtggcaagggaacgaagaaattgagattatgagaggtgttcttgtcaaagaaaagttcaaacaaacagtgaagtggcgaaactgcccttcagcaattcttctttcggaagaagattttttccagaaaatttccggaaagcctctttccggaaattttccggaagaaccttcttccggaagaagtatttgtgatttccggaattactcagaaactacttctggaagaacgtcatccggaatgtttccggaagaagcttcttccggaagatttccattttcttctggaaatttgttcttcttgaa

SEQ ID NO: 73806 - DNA, 117 bp, Glycine max
  Peptide Sequence Number=SeqID_190584
atggagatggaacgttctgagggtattatgttccaagacattactactctattgctttctgttgttgcaggtattatgttccaagacattactacgttttgcttcactggttggtga

SEQ ID NO: 73807 - DNA, 363 bp, Glycine max
  Peptide Sequence Number=SeqID_190585
atggctggtgttggttcttcttcttacaaaggcaatgacagcattctcttctgctttcactgcaagtcgaagacaacaaccttcattaacggatggcagcttcgaagtggcggtttagctctgctctgtcaaaactgcggtattcaaattttatactgggagcttcagctgcctgacaaagttctgacaaatgtgggactaattcatcccaacatcctagccaagagcaacatgggagccgcacgaacgcaggctcccactaccacaaattatgacgtaggctctgccacttgggcagaccttaggaaagcacccctccaaagtgcaatggaagtcacttccctaggccatagaccttcttga

SEQ ID NO: 73808 - DNA, 315 bp, Glycine max
  Peptide Sequence Number=SeqID_190586
atgaagttggctcactttgaaaccctgtcattctctcgaacttcacttctccgttgttgccactctcttgttgatcaccgccaccgcgtcaccatgtctctcgaaccagctatggtagaggcgttgtgtcttgacgacaaccattactggacctgcaagcacatgcatgaagtagggagggaatgtcgggctgacgtggacacactcacagagagcgacgttgactatatgcagagactgactgttgaagtaactggtcacaaggcccatggacctgttccacagcctggatctgtagtcattgctcgtgtataa

SEQ ID NO: 73809 - DNA, 1236 bp, Glycine max
  Peptide Sequence Number=SeqID_190587
atggaggagacattgttgccaaaagaaaacaagagggtgaccttaacaaactcaaagagtagtagtggctttgtccaagagttgaagaatgtgagtttgatggcagcaccaatggtggtggtctcagtgtcacagtttttgctgcaagtggtgtcattgatgatggctggtcatcttggtgaactctcccttgcaggggttgcattggctacttcctttgctgatgtcactggctttagcatacttatgggaatggctggtgctttggaaactcaatgtggccaatcatttggagcagagcaatttcataagcttggaaactatgtcttctgtgcaatactctctctcattttaagtagtgtcccaatatctatcatatggattttcatggataaactgcttattcttttggggcaagaccatgctatttcactaatagcaggaaactactgcatttggctcattcctgcactctttggttatgctgttcttcaagctttgaaaactaagatagccttaggtagcaatgctttaagaagcatcaaggagttcttcttcttagccatcccatctgcacttatgatttgttttgagtggtggtcatttgagctggtagtaatacttgctggacttttaccaaatcccaaacttgaaacttccgttctatcaatctgccttaacatttgcaccttgcactatttcattccatatggaaccggtgctgcagtaagtacccgggtttcgaatgaattaggggcacgaagaccacaggcagcgcgagaggctgtttttgctgtaattgttctagcattcacggatgcagttgtctttagctctgttctcttttgcttccgtcatgtgttgggatttgcatttagcaatgagatggaagttgtacattatgttgcaaagatagttcctgtgctttgtctctctttcatggtggatggctttctaggagttttgtgtggaattgtcagaggcagtggatggcagaagataggggcaattaccaatcttgtagcatattatgccgtgggaatccctgtgtctctcttgtttggttttggtcttaacttcaatggtaaaggcctttggattggaatattaaccggatctacactacaaacaataatactggctttgctgacagcatttacaaactgggaaaaacaggttcttaattctgtgctttacctgttgttttatgttctgacttactcaaaaaatcagtaa

SEQ ID NO: 73810 - DNA, 225 bp, Glycine max
  Peptide Sequence Number=SeqID_190588
atggtgtctgaaatgtctaagcaagatggcacgccgccatcgctaagctccgacttggcctgctgctgcaacatggtggtgttgaggaggaaaaggctatgccagggaagaaggaggatcagtgctgggaagggacggacatggaggagccgaaactacatagggaagggtaaagggaggaggtggagcatgaggcggtttcttggtcttctttcttccaagtag

SEQ ID NO: 73811 - DNA, 219 bp, Glycine max
  Peptide Sequence Number=SeqID_190589
atgaaagctgagaaatttgaccgtgactggaaaaagattgaagcatttgttggatcaaagacagtcatccaggtggctatttttgtccctctccttctcaattacaatttccaccttagaatagctctttttggagctttattattatgctcagcacttaggttacaatttcccttctccgccataggtttaaaggcaaattcaagttcatccatataa

SEQ ID NO: 73812 - DNA, 1119 bp, Glycine max
  Peptide Sequence Number=SeqID_190590
atggccaaaatacaaggcccaaaagaaggaaaacctattctaatatttacaatgaaaagtggaccctaccttggcccatgggctcagaaatctaccctgagcgtatcttttaacttgttggatggtgaggttccaactaaaggtgtcttccaaaatgcaagtggttttgtggttacatcaacattaatctttgtggaggtatttcaaaactacatctaccaccatgccttgtcaaagaggaaaaggagtaagaaatcatatttggattcaccaacaattgaccgactgcctaaagtttcataccaaagcctacacaatggaacccacaggttctcatctacaaacttgtttgggtttagaaattttagctctgtctacaaaggaactcttgagttagaagacaaaggtgttgccatcaagtacatgaaaaatggaagcttagaacaatggttgcatccagggacactaagtgcaaaacatttgagaacactaaaccttgatcaaagattaaatatcatgattgatgttgcttttgcattagaatatcttcatcatgaatgtgtgcaatcgatcattcattgtgatttaaagccaagcaatgtccttcttgatgatggcatgattgctcgtgtgagtgatttgggcgtagcaagaattatctcaaccattaatggtactagttctacacaaacaagtatagttgggatgaagggaactactggctatgctcctctagagtatggaatgggttctaaggtgtctatgaatggcgacatgtatagtttcgagattcttatgttagagatgcttactggaagaagacccacagatgaaatctttaaaaatggtgaaaatctgcatcactttgtggaaaattcttttcccaataatcttttacagattttgcacccatcacttataccaaaacaaggaaaagcaataatagaagaagaaaacacttgcattcttgctccaactattggaaagtgtttagtttcagtctttaagattggacttgcttgttcagcggaatcaccaaaagagagaatgaatacagtggatgtcactagagagctaagcaaaataagaaaagtcttttatcctggtaagataaattaa

SEQ ID NO: 73813 - DNA, 357 bp, Glycine max
  Peptide Sequence Number=SeqID_190591
atggctttggctaaagaacttgcagcattaaaattgagttacaaagaattgatggccaattgcactattcttggaagaggtaaggctcgttatagcaaaaagcttgagaaggttaaagagaagatcacaaaactgaagcaacgtcacaacaggcacgagaagaggagcaaagagtgctttggtgccaatggctgcaaggaaagcaacgtcacagtagacacgaagcaagaaaacttaccagagcgcgacgatggcagtgaaaagggtggctttgcgaccagagcacaaccagggtggctttgcaagactctgcgtggtgggttaaggacaatagaagtgaagagggtggctttgtga

SEQ ID NO: 73814 - DNA, 225 bp, Glycine max
  Peptide Sequence Number=SeqID_190592
atggcttgcacccacattccgccttcaaaattgccccatgtgtggcatctcttgtcaatgtcaggatttacacgcgattctcctcaaatttcagccagcccgcatcaatttgaccttgcaccttacgcttcagagccctacaatgctcaatggaacgccccggggcttctccgtgacaagcacacgttgcgtttcgagtcgtattctcggagaaatggaggttga

SEQ ID NO: 73815 - DNA, 324 bp, Glycine max
  Peptide Sequence Number=SeqID_190593
atggttgttcaactactcgtattagcacaaaggaaaatgttgtcatctggttttgacgatactccacaaagtaaatccaaggctactgctaggtggattgttgctaaaagattggaggtgcttcgcatccaacaggcaagctactatttgaaagttaaaaatgaaacaattagtgttaaatgtcgcaacctacccttcggtgggagggcgacgcgtgactcgcgggtgcgtcttccaagaaaagaatacgcacggagtcgccaccaacgtttatttgaggaaaacgtcggaaaaaccggaaaagacgtggtctatgaattttaa

SEQ ID NO: 73816 - DNA, 795 bp, Glycine max
  Peptide Sequence Number=SeqID_190594
atggtggcaaggcatgtgatgagcgactcttttatgatgaaagttgcttgggagtcaagtacaaggatggatagtctgtgggttagagtggtgaaagccaaatatggttgcgggaatgacttgaagccaatgatcaataaagatagacatgggtcaaatctttggaggggcataaaagcagtgtgggacagctttgatgagaattgtgattggaccattttgggttcgaatggagttttggctttggtggctaatagagagttggaagatgtcgtgaagaaagtggatgatgtgttttctaatggagttggttgtgacacaaactatctccataactctcgagtggatattgtgtcttggaaactggggtctgatggaagtttctctctcaaaagtgcttatggctttaacgccaaagtcgatcctaaagggaggtggcgagttcccttcttccttgaaccaaatatttggagtagtgctggatttgctttggcagagcagaaacaacaaggtttttggtggcaatatatttggagcaacgagaccttgttggctcaactatctcacatgaacatgccgtggaatgcaaacaaaaagctgcaagatctgcttcctgatgtttcagttcgtagtcaaggtgttttcacttggataattactgagggagggaatataatcgtcaattgtgatggagttgtgtcccactctacacgcaaagttgtttgcggaggtgtgctaaggaattcaactgctacattccttggagcattttctgaatgcggagctgctagatag

SEQ ID NO: 73817 - DNA, 1440 bp, Glycine max
  Peptide Sequence Number=SeqID_190595
atggctgcaccacatgataatgatccaagaaacattgtttccatttcaaggattgtgtctgtgcatccaaagcttgtgcaacctcagagggttttgaccctttcaaatttggatagacagtgtccaaatctcatgcacttggtgttcttttacaataaccttcctcaccaaactctgaaggacttgtccctcaattcagtgttctccaacttgaaatctggcttggaagagaccttgactctgtggtatcctagtgcaggtaggcttgggacaaatcaaagtgatggcaagctcaatttgtggtgcaacaaccagggtgcagttctggcagaggctgaaacctgtgttaaaatatcacaacttggaaacctctctgagtacaatgaattctttgagaagctggtttataagccagattttgataagaatttctcaaacatgcctctgattgttgctcaggttactaaatttggttgtggagggtattcaattggtattggaacaagccactcattatttgacgggccagcaacctatgacttcttgtatgcatgggcctcaaattctgaaattgtgaaaggaagaagcagatctgatgatgagcttccaaaaccagtgcatgagagagggataattctgagtggtagtcttcaagccacaagagggactataaattttccttcagattcaagttcaaatgttaagcaagttagggccatggcaatagatcacttatatcaacttataatgcaaacagctagtggacaaaatggcttccctatgcaaattggaggaccctctaatccaaagaagtgtgttcttaaaacctatcatctttcaggtgatatgattgaagacttgaaaaggaaacactttcccatgcaaagaggttcacttcctttctcaacctttgaggttcttgcggctcacctttggaaggcaaggaccaaagcattaggggtgaagaaagagaagctagtatgtttccaattcgcggtggacataaggaacaagatgacacctccattgccaaaatccttcagtggaaacgcttatgttctcgcctccattatgatgtcagtggcagaattggaacaaacaagccatgaattcatcgttgataaaataagagaagccaaaaacagtgtaaaccataactatgtgaaagcctacgttggtgccctagatggaccacaacaaggttcttcactccctccactcaaggagctaactttggtctctgattggacaagaatgccctttcacaacattgagttctttcgtggaaaagcaacctatgcatcccctttggccactcctatgccacaggttgcatatttcatgcaaagccctagtgaccacaagggcgttgacgtgaggattggctttgaagcggaaaacataagtgcttttagtgaatgctttttgagcatggcgtga

SEQ ID NO: 73818 - DNA, 180 bp, Glycine max
  Peptide Sequence Number=SeqID_190596
atggttggttcaatggaaactcctattaagggattcaatcatgtgcaatatgtttccaagatgagtttggatgatgaattcctacaatttacaccaaggactactctgcaagcaatgaaggaagcctaccgcaaaaatgatatgaaggaggattttacttttgtcatactactactataa

SEQ ID NO: 73819 - DNA, 1113 bp, Glycine max
  Peptide Sequence Number=SeqID_190597
atgacaggtttgaagggggcaaaaatatggaaggaggagcatgatttggtgttactgcatgctgtgctgaagcatggctatggaaggtggcatgatattgttgatgataaggatctgaagattcaagaggtcatcactcaggagttgaatattccatttacaaaattaccagttcatggacaagtttgctctcaagtgtacaatagtgcaaatatgacaaatgtggagtccagctgcaacccttctgctgaaactgataagagtgacatagcagatgatggtgcaaatatgacaaatctgcaatcgagctgcaaccaatctaaggagagtggtgtgagtaacattgctgctgaaggggcacatggttctggtgattctgggaatcaagcacagtttagagacatgcagagaagacatattgagtttataaaaaaaaggtttcttctcttggaaaaaggtctaaacgccgagtaccagaaagaatactttagtgatttgaaagtaaatgaggtggaaaatgatgaacctaaagctgacattcaaatgattggtcaactgcctcgaatcgaagcaataggttcagaagaaatttctatttctgcatatgattgtgatcctgatcgattgcaattagtttgtctttacaacaagatgtgcaagactgtggaggaaaacaccatgaatttaattcaggagttatcggcaagagaactaacagaagtcaacgttattaagaacttccatcaactggaaatcatttcagcggatgtcaacagaattctaaatcaacaaaataaatgttcagctgaaacgcaagtactaaattctaacaaatcgaatactttatcacagactgaagttgtgggctctggactgctgtctagttctcaagataaatgcaaagctgaagatgttgtaatggtgtgtgaacctaaaaaagaaagtgatcagcttacatcaagtagcgtggaagtcggctttgtagacattgtagaaggggccagggagagagaaaacttgcaagaaggggatggaaatgagccgagtcgattgtcaagggtctatgactcggctcgtcttggcttgtttactataaaggatgaagtggcataa

SEQ ID NO: 73820 - DNA, 273 bp, Glycine max
  Peptide Sequence Number=SeqID_190598
atgaaaaagaagaagattgcaatttacgggagtcgatttgatgaagaaatgagtgagataggaaggtttggaggtttgggaatggaggaacgtcgcaaggaggaaggggctgcgcaggggtttctggaaaatgtgatatttatagagcaggacgcatggaggaggcagcctactggtaatcgattacatgaatactgtaatcgattacaggccatctgttctagtgtaatcgattacagtattcatgtaatcgattaccagaacataaaatag

SEQ ID NO: 73821 - DNA, 261 bp, Glycine max
  Peptide Sequence Number=SeqID_190599
atgacaaaactgaaaactgagggctggaacagactcagaagaggccgacgaagagaacgttggcggcgcggcgcgattccggtgccgggacggtggcgcgtgggcttcacgtgccggagatcgcgtgggacaaagacggcgagcctaaccctagtctcgctggagaaaatggccgctagaaatgacggcggcggcggacgacggcggcggacagtggacagaacccgctctgatgccgacttgaagactgaggtgagttga

SEQ ID NO: 73822 - DNA, 645 bp, Glycine max
  Peptide Sequence Number=SeqID_190600
atgtgggctcttcgtcgagcttcgattcctctcaggacccgagggtttaatgtgagagcttcctgtgtcaaattagcgggaactagttctgttgaagaagaggatgttatcaatgaatctcatggaataacgtatggtggatttttatcgccgaatatgcgattccattcggtacataatgcctccctgaattttactgtgggaaaacgtgcgctttcttcaagtagcacgaaagaggaggatgatttggaggatgggttttccgagctggagatgcctgccggcagtggatatgaaagtgaggatctgttaacttccgatgatggcgacctatcggatgatggtcagaaggaggatgttgaggagccaccacacaatgaggttgatgaggcggccaaggagaaaggaaacccgcgtcgtggaagggttgaatcaaagctattcaatgagatcatgaatgcacagggtatctctcttcattcggttctggaaaaatggttagaaaaagggaatgagcttaccagagaggaggtttcgcttgccatgctttatcttcgaaagcgtaagctgtttgggagagctttgctgatttgtattgagaaacaagcttttattgttttttctgtttcctatacaaacctttga

SEQ ID NO: 73823 - DNA, 1281 bp, Glycine max
  Peptide Sequence Number=SeqID_190601
atgattcttgtcttgcatattgatcagttgcaaatgctctcagaatggctcgagtcaaaaaaggagtttgagtttattgaaagagattatgcaagtcggcttgatttaattgccaaattgcgtggcttacataaggcagaggtttacattgagactattccagaatcttgtagcagagagataatgtaccggactttattggctaactgtgtcagtcagaataatgtgaagaaagcagaggaagtttttagtaaaatgaaggacttggattttcctattacagtatttacttgcaatcagttgctatttctgtataagaggaatgacaggaagaaaatagctgatgtgttattgttgatggaaaatgagaatatcaacccttcttctcatacttactcgatcttaatagacacaaaaggccagtccaaagatattgatggaatggatcaaattgttgataggatgaaggctcaaggcattgaaccagacatcaacacgcaggctgttttgattaggcattacatctcttctgggcttcaagataaagctgaaactttattaaaggagatggaaggggaaaacttaaaacagaatcggtggctatgccgaattttgcttcccctctatgcaaacctaggaaaggtggatgaagtgggaagaatttggaaagtctgtgagacaaaccctcggtatgatgagtgtctaggagcaattgaagcttggggaaagttgaataaaattgatgaagcagagaaagtttttgagattatggtaaagaaatggaagctttcttccaagacctgttccatactgctgaaggtttatgcaaataataagatgctaatgaagggtaaggatcttattaagcgaatgggagatggtgggtgccgaattggcccattgacctgggatgcaatagtgaaactttatgtccaagctggggaagtagagaaggcggattctgttcttcagaaggcagcccagcagagccagatgaagccaatattttctacctacctaactattttggaacagtatgctaataggggtgacatccataactcggagaagatttttcttagaatgaaacaagctgattatccatctaaagcaaagatgtaccaagttctaatgaatgcctatataaatgcaaaggttccagcatatgggattagggacaggttgagagctgatagtatatatcccaatagaaatttggcaaaccagttggttcaagttgatggatttaggaagaatccagtctccgatttgcttgattga

SEQ ID NO: 73824 - DNA, 126 bp, Glycine max
  Peptide Sequence Number=SeqID_190602
atggaatgcaaaaagttgtggcagattaagagtgaggatgtcgaggcaaatttggagcagatacaagagtcaccagccggtggaggacagtggcagttgtcagaggcaaagatgtggccaaaatga

SEQ ID NO: 73825 - DNA, 450 bp, Glycine max
  Peptide Sequence Number=SeqID_190603
atgatggcacatcacagtgcctctcctttccctcattttcgtttttccctttctcctctcaaaaccctttctttttcccgcaacccacaaaacctgtctcggaaaaataacgatctcaagctcattaaccatttgatcgtcgtgaaatttaagcaccaagtttgcaacccaattcctagcattctcaccgttgggaattgcaaaaacatgtcagagataagaggaatacccttcgcaccgtactccgcacaccttctaacgtttggattttgcgagataatattcaaggagaaagaaaaacgaattgcacgaagacagtacatatggaggcttcaatccattctccgtctcgttgacatttgggaactctatcaaagcagtcggaggaaaaacttgaggaatctcagggaaccgctaaagatgccgctattgttgtcggaagacacgtga

SEQ ID NO: 73826 - DNA, 876 bp, Glycine max
  Peptide Sequence Number=SeqID_190604
atgaaggaacttcctccaaaaaaggaacttattttgcgtgttgagttatgcagcaaacagaaagaatactacaaggcaattttgacccgtaattatcagatattaacccaccaaggtggtgcacacatttctcttatcaatgttgttatggaactgcgtaagctctgttgtcatccctatatgttacaaggagttcaaccagacctaaaggatgaaaaagaatcatacaagcaatttcttgaatcgtctgggaagttgcaattgttggataagatgatggtgaagcttaaagagcaaggacatagagttctcatatattcccaatttcagcacatgctggatttgcttgaagattactgtgtttacaagcattggcagtatgagaggatagatggcaaggttggaggagctgaaagacaagtacgaatagatcggtttaatgctaaaaattcttcaagattttgtttcattctttctactagagctgggggattgggaataaacctaacaacagctgacacagttattatatatgacagtgattggaatcctcatgctgatttacaagctatggctagagctcatcgacttggacaaactaacaaggtgatgatttataggcttataacgaggggaacaattgaggaaaggatgattcagattacaaagaagaaaatggtgttagaacacctagttgtagggagtctaaaggctcaaaacattaaccaggcttcaatatgctctcggtccctcaaatttcaggaaatatcagtgttactaaataccacatcagccatagtaaatagtggtattggatttgagtctaaactgacatcaaaatgcaattgtgtggtaccagtgccatggcctccctaa

SEQ ID NO: 73827 - DNA, 612 bp, Glycine max
  Peptide Sequence Number=SeqID_190605
atgggagatgggtgcgtgattgagggcaccacggggaattccaattccaataacaataataacaataagaagaagaacaagaagaagaagaacaggggtgggagcaagaagaagatgacccacaaacaggatcacccttctgtttcgtcatcatcttcatcttcttctgctgctccccgtgttgttgatgattttggtgttcagaagcttctagggagaggcggggaaaagctcctctttgaattgcattcgcactccaaattcagtgatggcttcttctccccttctaaagttgttgaaagagctcacatcaacgccatgaaagttcttgctttgacaaatcatgaaactatgtcaggcattcctgaagctgtagaatcagcttgtaaatatggcatcaagataatcccaggtgttgaaattagtaccatattttctccaagaggagactctgaagtagaggaaccagttcacattttagcatactacagctgtattggaccatcaaggtttgaggagctggacaagtttctatcaaatataagggatggatgttttcttcatgcgcagaacatttgtcttaaaactgaacaagctcaagttgcctcttaa

SEQ ID NO: 73828 - DNA, 600 bp, Glycine max
  Peptide Sequence Number=SeqID_190606
atggctgaagtagatgaggtggaagagcggatgaaggccgacatggaggccatgaaagaacagatgaccacaatgatggaggccatgatgagcatgaagaagataatggagaacaagcatgttttcccgccatatggtttgcctccaaactatactccacccaatgagaatgtcaataactccactcctatactcattgaaagccaacaacctcaatctgatcatgcacatgtctctcaacccatgggggagacacatgaaataccccatcaaaatctagccaactttgagcctcaccttggatatgccatcgaagggcaagcagttagtgatatacccctgcaaaacactttggagggccctcagtatcacccacaaccacaccccttgcattccacagcgggtaaaaaccctcatgctatggcagaaatgggaaagttggatcatctagaggaaaggctcagggccattgaaggaggcagagattatgcctttgctaacctagaaaagttgttcctagtacccaatatcgtcacccctcccaagttcaagtgtcggactttgacagtacaagggactacttgccccagaaccatctaa

SEQ ID NO: 73829 - DNA, 420 bp, Glycine max
  Peptide Sequence Number=SeqID_190607
atggtcctggttgagttcagtcttacaagaggaatctgcggattatgcttgatcaagattaggctaaactatcatgaggaatcagggtttagtatctcaagagacaccataaaaacacatgagcattatagtttatacacctattcatattcacacttacctttgcacaccagacacctatttgctgaaatagcttaccaaataacacaggacttagaaattgaggctacattgcgaaggaacaaggccgagaggagaaggaaacttctgcaagacataacagttgcatccattcttaaggaggagactcatttctctgacttattatcacctgattcaccatcatcaagggaatccgccactcaattacctgaagtcattaccatggcagaagagcatgaccaaaggattaccctttag

SEQ ID NO: 73830 - DNA, 291 bp, Glycine max
  Peptide Sequence Number=SeqID_190608
attggagggtcagactatcatgggacaggagggcacaatgaatctgagctgggaagtgtgaaccttccagtgatagtgttgcatgacttccttaaggtagctcggcctatttggtgcaatgccatcagggagatattagagtgttatgctgaggagccttctgattctaacctagcaacaattactaggtttgggagaacctgtagttttaagggaggttcacccttgagttgtggacaggacttgattgatcatttgtctagccaagagatggaaaaatgcagagtttga

SEQ ID NO: 73831 - DNA, 1086 bp, Glycine max
  Peptide Sequence Number=SeqID_190609
atgaaaacagttacaggaagagtttatatagttgacatatatattagactcccaaactggagtagtgatggtaatagcttggcagaatgtatagaaaacagtaccaaaaggggtcatgatgataagaaggaatatcttgtgaagtggaaagagcttccatatgatgaatgctattgggagctcaagtcagatatctctgcatttcaaacagagatagaaagatttaacacctttaagtctagatcaaggaaacttttgtctagtaagaaaaagcgtagtgttgaggatgatgctgaactgaataagcagcagaaagaatttctacagtatgaacatagtcttcaatttctttcagggggtgcactgcattcatatcaacttgaaggattgaacttcttgcgattctcatggtacaagcaaactcatgttatacttgctgatgaaatgggactcggcaaaaccatacagagtattgctttcctagcatccctttttgaagagaatgtttctccacatctggtggttgctccactttcaacattacgaaactgggaacgtgaatttgcaacttgggctcctcaaatgaatgttgttatgtattttggatctgccaaagctcgtgcttttattagagagtatgaattttactttccaaagaatcaaaagaggatcaagaaaaaaaaatctagacagatagttaacgaaagcaaacaagaaaggatcaagtttgatgtccttttgacatcatatgagattataaattctgatacatcatcattgaaacatataaagtgggagtgcatgatagttgatgaaggtcatcgtctcaaaaacaaggactctaaattattttcttcattgaagcaatattctagcaaacatcgtgtgcttttaacaggaactccacttcagaacaatctggatgaactttttatgcttatgcacttccttgatgctggaaagtttggaagtttagaggagttccaggaagagtttaaggatatcaatcgagaggagcagattttgagactacataaaatgttggcgccacatctcttgcgaagtatacatctatcttattcttga

SEQ ID NO: 73832 - DNA, 1701 bp, Glycine max
  Peptide Sequence Number=SeqID_190610
atggcgagcacccacattgggaatgccggagacgccgacgcgaaggccttgaagggtcgccccaagaagccctccgacgacttcatctccctcttccatggctccgatccgaaagatagagagcttggggatgcacttgcggaaattaagtcattgaggaattcagagcgtcttaaggaaaagggggttgaagagctaacagatgagctgatcaaggtggatgaaaagctaaaagcagctgaagctcttctggaaagtaagaaccttgaaataaaaaaaatcaatgaggagaaaagggcagcactggctgcacaatttgctgcagaagccacacttcgaagggttcatgctgcacagaaagacgatgaaatgcctcctattgaagcgattattgcacccctggaggcagaactcaagcttgctaggatggaggatgacaacagagcactgggtcggctaaccaaatcgaaggaggctgctcttcttgaggctgagagaactgttcagattgctttggcaaaagcatccttggttgatgatctgcaaaacaaaaatcaagagttaatgaaacagattgaaatatgccaggagaacaaaatcttggacaaaatgcttcggcaaaaggttgctgaagttgaaaaactaactcaaactgttcgtgagcttgaagaggctgtcttggctggtggggctgctgctaatgctgtccgtgattaccagcgtaaagtgcaagagatgaatcgggaagtagcacgtgccaaagttactgcgaacagggttgcgactgtagttgcaaatgagtggaaagatgctaatgataaagtgatgcctgtgtttctagctcaggttttggagccaacacagaagtattgtatagctttctaccctggtgaaatgcaacaattacgtgataaattggctatagctgagcgcactgcaaaggcagaggcacaaatgaaggaaaaatatcaattgcgcttcaaagttttggaggaaagggttaagacatctaatggtaattccaaattcactgtatcagatggaagaaacattgccactgggccttcgcggagacagtcttttggtggagctgagagtctctctgcatcttcttccaatggatatcaatctaggaaaacctcaatttcgagaccagggtctctaagatcaaacagtgctaatgtgttactaaaacatgccaaactttcatcgagatcattcgatggtggtagtagaaacttggagagagagaggccaacttcagatgccaatgggctagataacatgccaagaaactccaacattcagaccatcaccagtgaaacaattactacacacgaggagagtgcaaatggtactccagtcaaaaaatctaaatcagaaaatgaagactatgtttcaggaatgctgtatgacatgttgcaaaaagaggttatatctctgaggaaggcttgtcatgaaaaagacctgactcttaaagataaggatgatgcaatagagatgttggcaaagaaggttgatacattgagcaaggctatggaagttgaggccagaaaaatgcgtagggaagttgcttctatggaaaaggaggttgccgcaatgcggattagcaaggaacatgatcatagggcacggcgagcaagtgctcctaggggggctattggtgtgttaggtacagagtggatcagcattcatcattga

SEQ ID NO: 73833 - DNA, 1416 bp, Glycine max
  Peptide Sequence Number=SeqID_190611
atggcacatgttcttctgcttcgccctcctctgcttcgcgtcatgtcctttcgcttcatcacctccttttccttccactcgcgcctttcttcattcccttcttctactctctccaaaaccaggacgagttttcctctgagaaaattttgggctccctgttcggttccaaatgcggtcactccaagggcgtttatgtcttctatctcgaccaccgaagcttttcacaatagtgaaagtcccacagcttatagttctgatcaaattcaggtgcttgaaggcttggaccctgtgaggaaaaggcccgggatgtatattggaagcaccggcccacgagggttgcaccatttggtgtatgaaattttggataatgctgttgatgaagctcaagctgggtttgcttccaagattgatgttgttttacttgcggatgattctgtgagcatcacagacaatggtcgcggggtcttgcatgctggtggaaaattcggtggtgccaacagtggctactctgtttcaggaggtttacatggtgttggtttgtctgttgttaatgctttgtctgagttgctagagataacagtttggcgtgatggaatggaatacatgcaaacatattctcgtggaaagccagtgtcaattctgaaatgccttgtgcttccagatgaaaggaaagatcttcgagggacacgtgttagattttggcctgacaaagaagtattcaccactgctattcagtttgatcacaacacaattgccggacgcattagggaattagctttcctcaacccaaagaaagctcttcatgatgttctgagttttagaaaagaaacagatggcatcacagttgatatagcttttcaatggtctgaagatgcatattcagatacaatactgggatatgctaatagtatacgcactattgatggtggcactcatattgatgctatgaaggcttctataacaagaactcttaatagtcttggaaagaagtccaaagttattaaggagaaggatattactctaagtggcgagcatgtgagagagggtctaacatgtgttgtctcagtcaaggtcccaaatcctgagtttgaaggacaaacaaagacaaggttaggaaatccagaggtgcgaaaagtggttgatcaatctattcaggaatatcttactgagtatttagaattgcatccggatgttcttgattcagtactttctaaagctcttaatgcttttaaggcagctctggcagcaaaaagagcaagggaattggtgagacaaaagagtgttttgagatcttcatcccttccaggaaaactagctgattgttcatctacagatcctgaagaatgtgaaatctttatagttgaaggtgattcagctggaggaagtgctaagcaagggcgtgacaggcgcttccag

SEQ ID NO: 73834 - DNA, 312 bp, Glycine max
  Peptide Sequence Number=SeqID_190612
atgaccagcaatctcgagccattcggagcttccaagtgccttcacgcacagatacaaccagtacctgtttctagcacaagcaatccaagcgctgtcattaagggtgttgtttgcattagcaacacggcttgctcatataggatcacctatctcttctacccgcattccacaaatcctcacaatttcaaacaaatgctcaacgcttttaagactattagagaatgctcacggctatcaacacagttggcacaagtaggatcacccacctcttatgaccatgttcgtcacacaattttggtcaaaccctcatga

SEQ ID NO: 73835 - DNA, 429 bp, Glycine max
  Peptide Sequence Number=SeqID_190613
atggatatgaccccaactgatgggtccacttctaacaactcgataagcttgtttaactcaccatcaaggtgttttgcaaaactcaacatgcaaggtggttggtttaaaacggaaacagagaggcaccctaattacaagaagatgcaaattaataaggcaggttgggccacgttgattttaaaaattactagaaaaaacagcaaaaagctcgtaatcagttacgttttgccaacaacaccctttctgtacactcgggatgagaggggagtggcggttggtgctcttggcccttacatgggaatctgtactgctttggaagcggagatgctagcagtttttcttgccattgaaacactgttggagaagaagcttgaactaggtgtagaaaaattgtgcatgaatcttgagaaatctctaagaccccactga

SEQ ID NO: 73836 - DNA, 1878 bp, Glycine max
  Peptide Sequence Number=SeqID_190614
atggctgttgagacttctgataaaccaaatttaccccatgattttgaggatgatgatgatgggccagtaatttacaaaaggtactcatcatctaagaaaaatcaatcgcattcagaagtaaggaagtcaagttctcacagtcatgatggacagtcttataggcagatttctaatgcaccttcttcaagtggccaaacttcctgccttcagaaaggtaatactgtcccatctgccaagccatcacctgtgaagccttctgtaggcatctccaaagcttctaaatctcttgtcaacacctcctccacgaagttgcctgtagcaaattcaaaatcaccttctttgggagatagacagaaaatgtccgtagatattaagggggaaccaaaaactattgaacaccatgctaaaaatttcgttgaagattcagaagatgatgaggataataaaccgttgagttttaggttgaagaattctaaccatgataacaaagtgacctctgttattgccaaaaaatcttctgaagactctgatgatgatgtccctttggcaaaaaagttataccgtaattccaatttgggaacaactagcagtaaccatgatgactccaatcagaagaagcctatttctaaaattcagaaagagcagaaaaatggttctggtatgagtaataaactagataggccatctccattgccagctaagagaccactagataatagtaattccttgcacccctctgttaagaagtcaaaggtcttagatccagttgcatctatcaaatctaaggcagtctctgtgaaacatgaactgaaggtagaggatgatgatgatgatgatgatattcctatttcccagagaataaagaaatcagcaatgtcaggtgataaatcatcttccatgaagaaggtgctgacaaaggttactaaagttaataagcctggttcaaaaccttttaagaaacagataaagaagacagttaaaaaatcaggcagtggttcagaatattctaaatcttcaaaaattcttcctagctctggtgatgggcagaaaaaatggactactttggttcacaatggtgtcattttccctcctccataccagccgcatggggtaaagatgttatataaggggagaccagttgatttgactcctgagcaagaggaggttgctacaatgtatgcagtcatgcgagatacagagtacatgcagaaagataaattcaaggaaaatttctggaatgactggcgaaagttgcttggaagaaatcatgtaatccagaatttgaaagattgtgattttactccaatctatgactggtaccaaagtgagaaggacaagaagaaacaaatgactacagaagagaagaaggctttgaaggaagagaaaatgaaactagaggagaaatacatgtgggctattgttgatggtgttaaagagaaggttgggaattttagagttgaaccaccaggattgttccgaggccgaggagagcaccccaagatgggaaaattgaaaaaacgcattcatccaggtgatatcacaattaatattgcaaaggatgccccaattcctgaatgtcctattcctggcgaaaggtggaaggagataagacatgataatacagttacttggttagcctattggagtgaccctatcaatcccaagctattcaaatatgtgtttctggctgctagtagttccttgaaggggcagagcgacaaggaaaagtatgagaaagctaggacgttaaaggattatatagggaatattaggtctgcatacacaaaagattttaccagtaaagatattacaaagcagcaaattgctgttgctacttatcttattgataaactagctctgagggctggcaatgagaag

SEQ ID NO: 73837 - DNA, 858 bp, Glycine max
  Peptide Sequence Number=SeqID_190615
gatgatgatgaagctgatactgttggttgctgcacattaaaagtagagaatgtgacaagagaaccccccaacaaacttaagtttaacttccttggtaaagattctatcaagtacgaaaatacggttgaggttgagcttcctgtttataatgcaattttgaagttccaaaaagataaaaagcctggtgatgatcttttcgataagctggatacaagtaaactaaatgctcatcttaaggaactcatgcccggtctaacagcaaaagtcttccgtacattcaatgcatcgatcacattggatgttatgttgaataaggaaactaaagatggagatgttggggaaaagattgttgtttatcaacatgcaaataaacaggttgctatcatttgtaatcatcaacgcagtgtttcaaaatctcatactgcacaaatgtcaaagttaactgaaaaaattgatgaacttcaggctgttctgaaagagctgaaaacggatttagacagggcaaggaaaggaaagcccccttcgaagagttcagatggaaagagaaaaaagaacttgagtcccgaaatgctagagaaaaagatatctcaaaccaatgcaaaaattgagaaaatgcaacgtgatatgaagacaaaagaagatctgaaaactgtggcattaggcacatccaagataaactaccttgaccctaggattacagttgcctggtgcaaaaggcatgaggttcctattgaaaaggtgctggcttctttctttgttcagattaagttattgatagtgttgttttatcaatttctagcaggggcagagggatgggttgatctgttagggccatgttcactcccattttttttttag

SEQ ID NO: 73838 - DNA, 144 bp, Glycine max
  Peptide Sequence Number=SeqID_190616
atgcttgcatctggccaggtatatatggaagtactaaacaaggtcatcaaagacacacttagaatggcaaacactcacaatattcttgagttcaatcgatgcgatgcacgattcttggtccaagagacaattaacccgggggag

SEQ ID NO: 73839 - DNA, 402 bp, Glycine max
  Peptide Sequence Number=SeqID_190617
atggataacaatccatgggagcttctcgacattgatgactcaaacctcccatcctttgttcggctaactaatcaatcatcctccaattcaacaacacttattcttggtccggccggggccgtacaagttgccatgatgtatcgacaatctaaggagccactcccagctcaagaattcataatgtgcccccaccaagtaaccatacgtgaatttaacaaaaatccatggttatgtgctttagatttcgttcgatccaaagatgttgatgacacacctcacgggacattgtcagggttctttgactatacttttgatcatgtacctttaacgatcgtcattatcaagttataccctcaacggttttggcgacatgagagtgacgctcaaggtaatcgactttaa

SEQ ID NO: 73840 - DNA, 237 bp, Glycine max
  Peptide Sequence Number=SeqID_190618
atggctttaggaagagaacccaatcaagatatcctctgtcacataaccatatatccacccaacctggcaaagacggtacctgaaacaatgatgacacctgtgatggaaccatcccttgctgggtctattattatggttgttgttcttactgaggttgaggttgaacatgaggaggtggcggtggcagtggcgctggcggtggagagtgagagggagagtgagatacaagaaagttag

SEQ ID NO: 73841 - DNA, 1542 bp, Glycine max
  Peptide Sequence Number=SeqID_190619
atgaagactagcggcatggcgcaacagggatgggatgggaaaattgtaaaggataatttgattctcaaagccatatgtaacgttctattttctcccttccctcctgggcctcccaaatgcagctttagattgctacgacaatacctcaccgatcccaagaccattcttcaaaagctccatgcaaagtatggttcaattttcgctgttcactttggttattctcacgcagacattttcattgcaaatcgctttcttgcacaccaagctttgatccaacatggcaccgttttcgctgatcgccccaaggctaatcctacaaacaagattatcagtagcaaccaacatgacatcctttttagcttctatggccccaaatggcgcctccttaggcgcaacctcacttcaagaatccttcacccctcacaggttaagtcctatgcacatgcacgcaaatgggtcttagacatgctcctacaaaaccttaaatctgattcagatgcaagtaaccccataagggtcattgatcactttcaatatggcatgttctgcttgctggttttgatgtgctttggtgacaaactcgatgagaagcaaataagggaaattgaggacagtcagcgtgacatgcttgtgagctttgctaggtacagtgtcttgaatctttggccatcaatcacaaggattttgttctggaagaggtggaaggagttcttgcagaagcggagagaccaagaagctgtgttgattcctcacatcaacgctcgaaagaaggctaaggaagagagattcggcaatagctcaagtgagtttgttttgtcatatgttgacactttgttggatttgcaaatgttggaagatgaggttgggatcaagcttgatgatggtaaaatttgcaccttatgttcggagtttctgaatgctggatcagatacaacttcaactgcattggaatggatcatggcaaatttggtgaaaaaccccgaaatccaagaaagggttgtggaggaaattagagtggtcatggttcgtagagagaaggataaccaagtgaaggaagaggatttgcataaattgccttatctcaaggctgtgattttggaagggttgaggcgtcacccaccattacactttgtggctcctcatagggtaactaaggatgttgttttagatggttatttggtgcctacttatgcctctgtgaatttcttggtggctgagatagggagggacccaacagcttgggatgaccctatggcctttaagccagagaggttcatgaacaatggtgaacaaaatggaggcacaacttttgacataatgggaagtaaagagatcaagatgatgccgtttggggcagggaggagaatgtgtcctggctatgctttggcaattttgcacttagagtactttgtggccaattttgtttggaattttgagtggaaggctgtggatggagatgatgttgatctgtcagagaagctgaaattcacaaccgtaatgaagaatcctttgaaggttcatatattacctaggcaacaatag

SEQ ID NO: 73842 - DNA, 1296 bp, Glycine max
  Peptide Sequence Number=SeqID_190620
atggcaaggtcagtggtggggtccttaccccttttttctcgcccatacaataacaatgtactattcacacccctccacttgtccttctccgcccgccacgtcacctcctccgccgtaaccatgccctccttcgaagtcctcggcggcgcacgtgaccgttttctccctgttctcccccacttgtctcgcccctatcatgcttttcctcttctcgccgccaaccgccacatcgaaaccatcttcgcctccttcttccgctcagtccccgacgtcaggctccgccgcgagtgcctcaggacccaggacggcggcgccgtcgccctcgactgggtctccggcgacgaccgtcgcttgccccccgattctccactcctcatcttgttgccaggtttaaccggaggtagtggggatgcttacgtgagacacatgttagttagagctcgaagcaaaggttgtcgtgttgtcgtgtttaatagccgcggctgtggagatagccctgttactactcctcagcgcttaaggagaaatttatccaaagaaaaccttactatttgtgacactgatttgcagttctattcggcttcatttttgggagatatgcgtgaggttgtttcccatgtcactggtagataccccaatgctaatgtatatgccatagggtggtcacttggggccaacattcttgttcgttacttgggtcaggaatcgcacaattgtccactttctggtgctgtatcgttgtgtaatcctttcaatttggttgtggctgatgaggacttccgaaagggctttaacattatttatgacaaggccctttcaaaggctcttcgcaagattttcaacaagcatgttttactctttgaagatattggtggtgaatataacattccactggcagccaatgccaagtctgttagggagtttgatgatgcactgacccgtgtttcttttggattcaagtctgtggacgaatactattctaattcaagcagttcagattccataaaacatgttagaacccctttgctttgcatccaggcagccaatgatccgattgctccaaataggggaattcctcgtgaagatatcgaggaaaatccaaactgcttgttaatagtgacacccaaaggtggccatctagggtgggttgctggtgatgaagctccactgggagctccttggactgatcctttggtaatggactttattcaatatttggagagtgaagcagttaagactccagaaactaatagtaatcctggtagtaaagagaccttgtaccatcttgaagtataa

SEQ ID NO: 73843 - DNA, 891 bp, Glycine max
  Peptide Sequence Number=SeqID_190621
atggtccttgtttctcctcctctaaatgccaacaattatcacacatggagcagaggtatgattagagctttatggtcgaaaaacaaactagaattcgttgacggtacactaccaatgccaaaaaaggaagatgcaaattataaagcatggctgagatgcaacattatggtagtctcctggatcactcgatccctttcccctcatatttcacaaaaattaaagattttgtgggatgagttggatatgctaagtcctactccggattgttcatgtacaatcaaatgtacctatgatttgattaaatcaatccaaaagaaacaggaaattgaacaagtgatatgtttcttgaaaggtttaggagaagtttatggtactgcgaaatcaaatattttgatgatggatcctctcccttccatcaacaaggcttatgccttggtcttgcaacaagaaggacaactgcaaggaaatggaactagtgactcaaagggaattggaggccacaagggagaagaggtagcaactttggtagaggaagaggtaatggaatcttgggcagaggagatgaaaatgctggaagagaaagaggacacaaatatacaagcaaacaatgcacatattgcaataaatttggccacacagttgaccaatgctactcaaagcatgggagaacaaagtcaatttgaaattgataattctcttcaaggttcacaaggtggaaccgtcacctcttcgggagttcagttcaaacctgaacaactacaacaactgctcgctatgttgcagcagtcctacactaaatcaagtcactcagtaagtcagatcagttcagggaatgttgatgaatcttcctcacaacaacaaaatcgcctttcagatgattgggcatgctaa

SEQ ID NO: 73844 - DNA, 573 bp, Glycine max
  Peptide Sequence Number=SeqID_190622
atgaccagacccgatattttgtttgttgttccacatcttagccagttcatgcagtcgcctaggcaacctcattttgatgtcgctgctcgtgtccttcgatatattaaaggttgtcttgctcaaggtcttttcttcccagcagattttgacttacaatttaaggcttttagtgactcggattgggcaacttgccctaccactcctgaatattgtgccttggcctccaccacttgtgagcttcaatggctaacttcattgctacaaagtctttatgttccccatatcactcctactcttctctattgtgatagccagtccgtaaggcatattgcttctaatcctagttttcatgagcgcaccaagcacatcgatattgactgccacattgtccgcgagaagctgcctcgtgtgaagctctatgttgataaagagataagaaggaaaaagggagatgctttggttacatatgttaaggaatcttctgtggccttagcaattcaaatattggatggaacacctcttcaccctggtggcaagattcctatgtctgtcaaccaagctaaatatgagtag

SEQ ID NO: 73845 - DNA, 147 bp, Glycine max
  Peptide Sequence Number=SeqID_190623
atggtggatttcagagacccaaacgacggcaaggcctatgaagatggtgaaattgttcgcttcggggcgcgctttgaagtaaaacatcatcgtgtcgtgttgctttgctttcacacacacgggaagaaacaggtggggtgtggttag

SEQ ID NO: 73846 - DNA, 507 bp, Glycine max
  Peptide Sequence Number=SeqID_190624
atgggaaacagtcatcttcttggtaacagaggtcctcaactaattccttgccggttacagctgggaagatctgctgcaatcgacgtgtccagacgcgtggatgaaggaattaacgaggtatggactctgttatacaccataaaggaatcgtggtggaatttcttttataagtattcaactaattgtatgctcagcttgacaaaatatgttgacagtgacggtaatctctgcatggtaaagttgagcctggatgaaactgatgtgtattcaaactggggtgatttcagctttaccatacaaagaactggaacatccagttttcttcagatgcaccccaacatggtgtgggcggattttcaatccattatgtcgatgaagaccaacaacgccgttgatgcatgtggcgtctctacgcaaacggtactttacttgtataggagaggaaagagggggggtcttgttgttacggagtgcaagagaaatagaggggataaagaggctaatgcg

SEQ ID NO: 73847 - DNA, 810 bp, Glycine max
  Peptide Sequence Number=SeqID_190625
caacacggctcagatcattggctaccaacccgtcgggatggcgagactagtggttcatgtggatcctgccattgggaaagtttatggtccccacaaaaagaaattaaggacgtatttggggatcgtcgctcgagacaaggtgaatgttacatttgttaaccgaaaagaagttcctgcagctcaaaagaatttgatttgggaggacattcaggctctagcacaaggcaaggaggagggcgatgacattgtctgtgagaagtacgatatcaaccaaggaaaatggaaccaattttggcagagtcgtagagacccttcatgggaggattcctttgcagagcagtcagcacagggcaactttgtcaaccatggacatcaggatgtattgactgccaccattgggcaaccagagcactccgatcgtgtccgtgttgcaagagccagtgtgacaattagacaatactttggaccagcttcagcaagctcccgcaccataaagagaagttgtgtcgatccctcgggacaggacccagacacaggtgcattagacatgtgtgtattgtatgttgatgacaatcctcctcgcctggttgcccttggaagagtttatgagggattgacaatcgtccacaacgtccctttgggcaatgatcaagtgaaggttggtgttggggaagttcgagatactgttgcccgcgcccctaataaacatgaacctgagggaccgacgaaacctatagataggctaaaacctgatgacgatcccctataccagatgacattgatgatcccacagcttttccttaagcctat

SEQ ID NO: 73848 - DNA, 228 bp, Glycine max
  Peptide Sequence Number=SeqID_190626
atggcgcaaggctcatgggaaatgatcgccggtcaatgtttttgcagcccgaggacgacgacactgacgacggcgatggagttcgatttccacgatgtagtggcaacatcagtgttaacattgctcaagagcacaagttattcttccagcctgctgctaatccctttatcaacaatgataatggctaggcgccttaacctccaacaagctaagttatctttgagttga

SEQ ID NO: 73849 - DNA, 606 bp, Glycine max
  Peptide Sequence Number=SeqID_190627
atggaagaggcaaaggcattgcaccagcaacaacaacaacaacagcagcagcaacaacttctgctacaacaacagcagcaacaacaacatcaacaacattatctgctcttacagcagttgcagaagcagcaacagcaacaacagcaagctgccgccatttctcgcttcccttccaacattgacgctcacttgcgtcctatcagacccctcaatctccaacaaaaccctaaccctagccccaatcccgctcccaaccctaaccctaatcccctcatcaatttgcatcagaaccctaattccaaccatctaccaccgccacagcaaccgtcgcaacagcagcagcagcagaagattattcgaccgggaaaccagatggagctccagatggcgtaccaagacgcgtggcgggtctgccacccggacttcaagcgacccttctcttctcttgaagatgcctgcgagaggatgggagaagaagtgatatctcgcaacacttggccattcccaaaatgtgggctatctgcagtgtggtttagatcaggaactatgttcatggccttgcaatcactttattgcagcttattcagaattattttttggacttaa

SEQ ID NO: 73850 - DNA, 246 bp, Glycine max
  Peptide Sequence Number=SeqID_190628
atggtttcgcttttacttcgtatcagcaatctttctgccagggcaatatggttcatagagagcgttctttctggtaaaatggatgcatttcgtttatcacttccatttcgatgcagcaacattcgaggtggagcgattagccctcgacgcagagacccgatgagccatggcgcggcggctgccgaccctaaggcttggaacaaagaaaaggaaagtagaagaaagggggcaattaaggaaagataa

SEQ ID NO: 73851 - DNA, 915 bp, Glycine max
  Peptide Sequence Number=SeqID_190629
atggcagggaaggaggagaaggaggggaaacttcagaagggaatcgcggagttctacgacgagtcttctggcttatgggagaacatttggggcgaccacatgcaccatggcttttatgacccggattccactgtttcgctttcggatcatcgtcttgctcagatccgaatgatccaagagtctcttcgctttgcctctgtttctgaggagcgtagtaaatggcccaagagtatagttgatgttgggtgtggcataggtggcagctccagatacctggccaagaaatttggagcaaccagcgtaggcattactctgagtcctgttcaagctcaaagagcaaatgctcttgctgctgctcaaggattggatgataaggtttcctttgaggttgctgacgctctaaagcaaccattcccggatgggaaatttgatctggtgtggtccatggagagtggagagcatatgcctgacaaagctaagctttccacttggtgcaaccgacagtttgttggagaattagctcgggtagcagcaccaggtgccactataataatagtaacatggtgccacagggagcttggccctgatgaacaatccttacatccatgggagcaagatctcttgaagaagatttgcgatgcatattaccttccagcttggtgctcagcttctgattatgtcaaattgctccaatccctgtcacttcaggacatcaagtcagaagattggtctcgctttgttgctcccttttggcccgcagtgatacgctccgcgttgacatggaatggcctcacttcactcttgcgcagtggacttaaagccataaagggagctttggctatgccattgatgataaaaggatacaagaagaatctgattaagtttgccatcattacatgtcgaaagcctgaataa

SEQ ID NO: 73852 - DNA, 1128 bp, Glycine max
  Peptide Sequence Number=SeqID_190630
atggccaccgtggtgaggatcccaacaatctcatgcatccacatccacacgttccgttcccaatcccctcgcactttcgccagaatccgggtcggacccaggtcgtgggctcctattcgggcatcggcagcgagctcggagagaggggagatagtattggagcagaagccgaagaaggatgacaagaagaagctgcagaagggaatcgcagagttttacgacgagtcttctggcttatgggagaacatttggggcgaccacatgcaccatggcttttatgactcggattccactgtttcgctttcggatcatcgtgctgctcagatccgaatgatccaagagtctcttcgctttgcctctgtttctggtattttcattttctacaagcccactcatgctagccgagtagcttccactgtctttgttacatgctcacagaatgaggagcgtagtaaatggcccaagagtatagttgatgttgggtgtggcataggtggcagctctagatacctggccaagaaatttggagcaaccagtgtaggcatcactctgagtcctgttcaagctcaaagagcaaatgctcttgctgctgctcaaggattggctgataaggtttcctttcaggttgctgacgctctacagcaaccattctctgacggccagtttgatctggtgtggtccatggagagtggagagcatatgcctgacaaagctaagtttgttggagagttagctcgggtagcagcaccaggtgccactataataatagtaacatggtgccacagggatcttggccctgacgaacaatccttacatccatgggagcaagatctcttaaagaagatttgcgatgcatattacctccctgcctggtgctcaacttctgattatgttaagttgctccaatccctgtcacttcaggacatcaagtcagaagattggtctcgctttgttgctccattttggccagcagtgatacgctcagccttcacatggaagggtctaacttcactcttgagcagtggacaaaaaacgataaaaggagctttggctatgccattgatgatagagggatacaagaaagatctaattaagtttgccatcattacatgtcgaaaacctgaataa

SEQ ID NO: 73853 - DNA, 634 bp, Glycine max
  Peptide Sequence Number=SeqID_190631
atgaagaaaaagaggctgatactctatccaagtggtaatatcaaaagcaatggcaatggttacgtgtccttatacttggcaatagcagataccgagaagctttctagcggttgggaggttgacgtaaacttcaagctgttcgtctttaatcagaaaaataacaattatttaaccatccaagatgcggatggcaccgtaagaaaatttcaagaaatgaaaacagaatggggttttgagcaattaatttcgttggagactctcttagattcatctaatggataccatgttgaagattcttgtttgtttggagctgaggttttcgtgattagtcgttctggcaaatgggaaagtctttccatggtcaaagagcctcctcatggcaccttcacttggaaaattgggaaattttcaacattggaggagacttactaccactccaaatcctttaccgtgggtgagagagactggaatttgagggtttatcccagaggaatcgagtccgagagaggcaaaggtctatctgtttatttacagctcacagattgtgaaaggttcccagcgaagagaacagtgtatgcaaaattcaagttgggaattttagaccagctcaacaataaatatcatgagagaacag

SEQ ID NO: 73854 - DNA, 291 bp, Glycine max
  Peptide Sequence Number=SeqID_190632
atggaggccatgaaagaccaaatgaccaccatgatggaggccatgatgagtatgagaaaagtgagggaggtcaacatggctgcagtcgctgccacaagtgccgccactgaggtggacccgactcacccagctggcctcaatcaaagcaagcattccttcccaccatatggcttgcctcccaactatacaccacccaatgctatacatgcttctgatgagaacgtcgataactctactcctatacccatcaagagccaacaaccccaatctggtcatgcacaggtcccttaa

SEQ ID NO: 73855 - DNA, 363 bp, Glycine max
  Peptide Sequence Number=SeqID_190633
atggtgattggcaagcctacatttgtgtcagttcaggacttggagatggggtttgaaaagatagtaaaaatagctcattcttctggagtatacaagcaggagagaattggagaaaaattgaaagctgagagaaagcagttagtgcaaggaatgaacttttacctcaaggtggttacatccatcccaggcattgacaatcacgatgccaatgcgcttagtcaagctattggttctgtccaagcaattgccaaggcgtcaaaagagcaaattctagagaacacagatctttctactgacaaggcagagatggtttcaaggtttctcagggacccgaagttttacttacgtcccaagattaactga

SEQ ID NO: 73856 - DNA, 123 bp, Glycine max
  Peptide Sequence Number=SeqID_190634
atgaaggttgctgcgacggcagcgcctgatggttacggccacagaaatcagagcgaacgaggcggtgatacgagttggatcgccagcacgcaatgtagattcaatcaaaacgagtgtatttga

SEQ ID NO: 73857 - DNA, 690 bp, Glycine max
  Peptide Sequence Number=SeqID_190635
atggtcacttatctgtcatacagtcttaagtggtgggcctgcgagatacttgttttgttagctggactttttccaaacccaaagttggagacatcagtcctatctatatgcttaacaatctctacgttgcatttcaccataccttatgggtttggggctgctgctagcactagagtttcgaatgaattaggagctgggaatccacaagcagttcatgtggctgtttctgcaacgatgttccttgcagtcacagagggtttcattgtaagtgcaacactattcggctgcagacatatcttgggttatgcctatagtgatgaccgtatggttgttcattatgtggctgttatgatccctctgctctgtctctctatttttactgacagcttacaaggagttctttcaggggttgctagaggaagtgggtggcaacatctaggagcctatgtcaatctgggagcgttttatctggtaggaattcctgtgggtatcctacttggctttgttgcacatttcagagcaaagggcctctggattggaattgtcactggctccattgtccaatcgattctcctttcccttattactgctcttaccaactggaaaaaacaggcaattatggcaagggaaagagtatttgatgctaaaccaccagacgtaaatggatcatatcacatgacgagtgcttaa

SEQ ID NO: 73858 - DNA, 570 bp, Glycine max
  Peptide Sequence Number=SeqID_190636
atgataaagaggaggttcttcaagctcgatcacggtgatcgagaggcctccgatccgtcttcttcttcttcggactccgagcttgaagccgtagctgaaacctctgaagaagaatcagaggaagatgcaatagcagaagtgaaaccgaatgatgatgaagctggctcaaattcttctgtgttattagcccttgcctctgcctgggatagaattgcattagctgattatggaatcatgcagagttcaatatttgaacaacagatattagttcttatttataatgggtatgcaagtgaggatagttctgcgaatgatgttgatgtcaactcagcaggtctgctatttagtgaagatgatgctggagctataaacgaaagacaaatgcttattaacagagagttgctgagtaaaggtgataccgaaaagtctaatgtcttggctgaaaagaaatccttaccgacagatttgccatcccatgtcttaaaatgcaaatcagtatttaagtgcaggctgtgtccccggattatctgtttatctgaggaaactttgcgggatcatctgcaatcaaag

SEQ ID NO: 73859 - DNA, 408 bp, Glycine max
  Peptide Sequence Number=SeqID_190637
atgactgctgctgggacagcaaagcgaaagaactctccaacaccaaccaaagcattcttggagaaagagatgcgtgttttctcacaagcagaggaatacctcacaaaggacaaaagcattatcacattaaaccaaacgcaaaggctgaaggagattgcggcaccaacatgtcccaaccccagtttaaaaacaagggtccaacatgttactacgtggaagcacaaagctatagcggaggttagaatcatgggagaaatcaaactctgggtctggaaaaatcgtgttagaggtttgagaattgcggaaccaaatagagcaggtttggatgatgctgaaaagaattcacttgataatgattgtcatcatcaaaaaggtggagaatgtaaatatatgaatacagggttttag

SEQ ID NO: 73860 - DNA, 180 bp, Glycine max
  Peptide Sequence Number=SeqID_190638
atgactgtccatgaagctgaaggtcctaccagttgctattacttcatgcatatcagagagggttcatgtatagttgcgtgggtgactgaaaaagataacgcaaagttgtgtttagttgtgatgatacaaaagaggacaaaggtagaggcagagccaaagaaggataagatcgacatatag

SEQ ID NO: 73861 - DNA, 189 bp, Glycine max
  Peptide Sequence Number=SeqID_190639
atgaaaggaagaggtctgaatagactacgtgagcctagtgctgaacgaagaacaaaggtaaagctgagcaaggaagacaaaggccctaactttcaggttatgagctttagcattggaaaatgtactgcatccttagaactggatagggcagggctaggttatcgaactgccggacacggagtgcggtaa

SEQ ID NO: 73862 - DNA, 225 bp, Glycine max
  Peptide Sequence Number=SeqID_190640
agacatgctcgatctgaaaaactacttagcgaaggtagactgaaggctatcctcaacagtgatggtgaaattgagaaccaagagatctcagagatccaaactaaagattcggaggatgatgcggagaagaatcacaaagggaagaagcagcataaaaagagattgagaaagaagagcaaatttttccgccactaccacttgccttcgtgtgcaaagcctgcgtag

SEQ ID NO: 73863 - DNA, 933 bp, Glycine max
  Peptide Sequence Number=SeqID_190641
atgaggaagtactttacctggctggttgatgagactgccaacaagcaggattttttaaggggttttcattgtgtcccttgtgagaagggtgaagtgggtttcaaggctgagaaggttgttagtgatgctcgggagccagggcaagacatggacaaagaagtcaatgcattggagaagacagaaggtgatataggtattggtccagatgtggctttgttggatctgatcagcatctcagggagcaatgtcgttgaagctgtttctaatttctataaacgtgaaactgaatttcatgagcaagtgatttcttgtcaaaatcctgtttcaacacccaagggctgctcattaaataccgattcacttgcaaaaccatgtcttaatacaaacaacactggcaaaaatattaacattttttcaagtcaagactctaaactaaataacctgaggcatacagtgcctagtcccatttctcctgccaaaaggaagagaagtagtgacagtaagcaaaaaaaaaaaaaacctaaagtcaaagcaagatctgaaccaagtggttcaaagcaggccacaatcacgagattcttcagtaaattaatacctgagatgcctggtggtgctcattcttataattctgaaccaaagcttgaccaaagctctaaagttgaagacttattgccaactgatgataggcaattgtacaaggatgaaattgatcaatttatgcaaataataaatgggaatgagtcattaaaaaaatatgccatcactataattgagaagacaaaaggtgatatcaataaggcattggacatatattacggtaattctgaatatcttggtgaaaataaaatatcagtggagagcaaaattgatagacctgtagtgaagaagcatgcatcaaaggaattgagaattaaacttgatattttttactag

SEQ ID NO: 73864 - DNA, 165 bp, Glycine max
  Peptide Sequence Number=SeqID_190642
atgcaattagaaaagcgaaaatcgctgttgtgggcgtacctaagggcagtggtgtcatcggtggcgcgggggatgaagagggactggacggcactgggacaggttttgagggcgatgaggaatagttgggtggagtctagggtttcgaaatccatggaagagtga

SEQ ID NO: 73865 - DNA, 609 bp, Glycine max
  Peptide Sequence Number=SeqID_190643
atgtttcatagtcgcgagctctttctgcaaacccttgcttccatggttgtctttcttgttctcctttctcaagggtcagcaccaacccaaccaccgaccaccacaggcactgccagttgtgccgccaccagccaatgctcgtgccatcaccagtcgccaccaccaacttcctccaactctcaaactctcaaacctctcttctcgcctagtctctctcacacacttggccctcaaacccacttatgtgtcggaggaataaggtgggtgcatttgatccaaggcccatcactgacttcgcagctgccccgatctgtaataactgctagatcgagagatccaaatcggtcttatttcggggttttggagaagcaacaaagatgggggaaggggtggcagcatcgattgtgtggagctggtagagaagttggtcaaggattggtggggttgtttggggggttttggagaagcagcaatggtgtggagttggacatgtatgtaaaggagactagcatagctgaccccgactccatttttctaagttggggaaaacctgaaaccaaatcaatccaagtcaagagtgtttttccagcaaagtcaagaggggcttga

SEQ ID NO: 73866 - DNA, 300 bp, Glycine max
  Peptide Sequence Number=SeqID_190644
atggaggctggtggtttgcttctcaaacacctttatatagtttggaacctaaggattggggcaatgcttagaactatttttcctgcattggctcatgctattgatatgaattcttgccctactttgcaccaagaaggaactgcaaaaaatataaaggacaaactccagatgaagctgcatgcaaggttgtgggttttatctgggctgcaatgcttaattggatttaacacgaatagtttgttgcaggttctttctatggcagttgttgaagcatataacatactgccaaacttagactaa

SEQ ID NO: 73867 - DNA, 114 bp, Glycine max
  Peptide Sequence Number=SeqID_190645
atggatggaagtttgagaaaaaacagcttcaagtcccacatcgctcagggtggctttagagtgacttttcaagtctgcttgcacaatttttggcagtgccacgaaacgtcttaa

SEQ ID NO: 73868 - DNA, 171 bp, Glycine max
  Peptide Sequence Number=SeqID_190646
atggtgggaatcattatcgtggacaaatatttcagtgcattaccacaaaacctgagacaacacttcctccagcacatgttagggagggatagtggcagcagaggtatagtccatttcttatggcatgtttcaatcctgaagcaaagaagtatcaaagtgtatgttgtgtga

SEQ ID NO: 73869 - DNA, 198 bp, Glycine max
  Peptide Sequence Number=SeqID_190647
atggataagagcttgaaggtagaagaagataagtggaggaagaaggaaagaagggaacaaaattttgagagagagaagagggagaatgagcctctgaacccaaaatttaccctaaggctgatgagaactctaggatcttctcctatatctctgcctcaatcttcttggaggcttctattcaatgtccttggggaataa

SEQ ID NO: 73870 - DNA, 180 bp, Glycine max
  Peptide Sequence Number=SeqID_190648
atgttctcaaaaacattatggaactcaatgagagaaagagacaatgcaacaaagaaaatacactcacaggaaagaggtgtgagcgacacagaaagaaagcaggagactagggacacgagtggctgcgagagtggagggcgacaaccgatgcgaatcaatagagcagacgacggcgtgtga

SEQ ID NO: 73871 - DNA, 1220 bp, Glycine max
  Peptide Sequence Number=SeqID_190649
atggcgagtgttgttgttcttcaatgccaggtgaaactaacgagccatgaggactcttgcaagttagccattcatgcttgtaggagtgatgacttcccgttcttgaggatgctgactgacaagattggtcaggtctctttgaatgatgtgtccaagaagctgcttaactttgactcaaacatctttcgtcattttaaggaccgtttctttaaggtcatgtctattgatgttgtggccattttgtctcttccttcagcgagcgatcccctcgctgccttggatgtattatgggtgacttcacctggagccactcatgaagcaggtcggacctacggatgggactgttgttgctgttgttggagaaaaggtcaacctgctgaagtcgaaggcccctataagccttcatgccctttgatcgtgcaggatgtgccttcagctccactggccattgaggctcctattggtgatacgattactcctactactcctgctccttcacctcctcctatcctggttgttcaggaggtcgctcttggtgttgctgaagttagtgtgctagttgttttggctggttttgttgtgatgtcgtcgtccatcattgttgtatctttgttgagtgttagtctggtgactagtagcgctcttatggtgtcaacaatgatggaagacaatgatggacgaagacatcgccaaatggaggaagcaacaccttgtcgatgtagaggtaggactgtggtgatcttgaaaaaagtagatgacacgaaatcatctcaggtcgtcttgacctacgaagcttcccctctgatggttatgaggagtaagtatgacttccacctatttgaaggtctaccaaatagtctggtggtagttcgtgttgttgaacttgggcctttgatgttggtcgtcatagtcactacgagtgagcggaccaagtgttgtgctctagtatacatggcacttgtcatgggtgacatgtactggagaccatgggtgacatataccggagtcatagtagtgtgcttgtgcgttcattgtgctcgtgtgtacatgtcgctctatgtgggtggtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 73872 - DNA, 234 bp, Glycine max
  Peptide Sequence Number=SeqID_190650
atgtgtggacaacaacgacccagtgctatggctacatcgcatgcggggagacaccctgacatctccaccgccactacctctcctcacaccccagaagcaaaaggggggaggatcacagtaattgggataggctccccagcagtagcggaaggtcgcaccctcctgcgagggcgagaaatttcaagaaggaacagtcccaaaatcaaacatccactccatttaaaagggagatag

SEQ ID NO: 73873 - DNA, 411 bp, Glycine max
  Peptide Sequence Number=SeqID_190651
atgaaacagaaaaagaatgaaatagcaagcctcaaactcaaactggtagagaacaacatcgttcgggatagcctctggtggtgggggctcctaggcgaggacttcctaacagaccagagccccaacgacgccaagggacgcgacaacgaaaggcctagaagtgatgagaagcggcgacgaacggacctagaagctgttagaatatgggacaagcgaggagaagcgacagtggtgacaacaagaggcggcggtagtgctgccgtagagcgcaaccactctcactttggcgttggtgtagatctgggaataggatggtttgtttctagagacagagaagagaaagaggcagagagaggaaagaagcacgaccagtgcactgcccgatgcaagagagagaaagtgggagaataa

SEQ ID NO: 73874 - DNA, 2280 bp, Glycine max
  Peptide Sequence Number=SeqID_190652
atggacctgatgcttcaacgtggcttaattcagcccagcacaagtccattttcatcgccggtgctactcgtcaagaagaacgacgactcctggagattttgcgtagactaccaagcactcaacgctgtcatggtcaaggaccgttttcctattcctacaattgacaaactcttggacgaattgggaggtgcctgctgcttttctaaattagatttattgcagggttatcaccagatacgaatgcatgatgccgatatccataaaacagccttccgaactcatcacggccactatgagttcaaagtcatgccttttgggctatgtaatgccccgtcgtctttccaggccacgatgaacttgctgtttggcccatatctatgccacttcattatcgtcttcttcgacgatattctggtgtatagcacctctttcgatgaacacttgcgacaccacgaaaccacatttcaggcacaggttgaatacttgggacatgttgtctcaaacaaaggcgtggaacccatcgcttctaaaattgatgcaatcaaccaatggcccctccctcagtcaacacgagctctacgtagtttccttggccttgcgggattctatagaaggttcattcgaaactatgctacaatggcagccccactggtcaatataaccactttgccttccttccaatggtctgaggaagctcagcttgcatttgaccacctcaaggacgctctttccacagctccggtgttggccttgccggacttcactacccctttcacgttggaaactgatgcctccggggtaggcatgggagcagtcctttctcagaagggccatcccattgctttctttagcaagcccttcacccctaagctattgcattcgtccacctacatgcgggagttgtgtgctattaccacggcggtgcgcaaatggcgccaatacttgctaggccgccatttcactattataactgatcatcggagtctgaaggagctcctgacccaggttattcagacgccagagcagcatatgtacatggcaagactgatggggtacgactatgacattcaatacaggtcagggtcccacaatcaagcagctgatgcattgtcaagaattcaacttcgacaagctatagtggcagacccttccaaacaccccgggttctcggtcactcaaaacctcattatgcataaaggttgcatttggatacctcgcgacttacccatcattaacactttctgcatgaataccacactacccccactggtggtcacgccggattggtctggactcagggacgatgtggctcactttgtggccagttgtgtggactgtcaattgacaaaatatgaagctaagaagtctgcaagattgttgtgtcctcttcctgttcctcagaggccatgggaggacctctccatggattcccatatggcacatatggttgcttccctgtttttgaacatcgtgatcaagctccatggattccctcggagcatagtttcagacagggatccattattcattagccatttttggcaggatttatttcgattgagtggcactgttttgcgaataagctcagcttaccatccgcagactgatggtcaaactgaggtgctcaatcgcgtgattgaacagaaaccttttacatttcctgagtatctcctgggcacttcgagaattgatgctgtggaggaattccttgtggacagggacacgactttccaatctattagaaagaaactcctcaaggcacaagaagttatgaagaaatatgcagacaggggcaggagggaagtcacttatgagtcaacggcgagaggatctcaagggagctccggtaagctggccaaacgatattttggcccattcagagtcatagaacgaattggggtggcagcatatcgacttgaattacctgagggagctaagatacatcctgtcttccattgttcgttgcttaaacctttccaagggactccgacacaacttgaccttacttctctgccttcacagttcgttgatggcatcccagtagtactcctcttgctatcgtcagttatcgaaaagccaataacacttgggaagtgcttgttcagtggcagggaatgtcccctgatgaagcatcttgggagaattgggcaacactatgccaagcttaccaccttgaggacaaggtggatttttaggggccatggaatgataggaatacgcaggaagcaccaatggcaagggtgcaggaggaaggagagaccaagaataagagaagggtga

SEQ ID NO: 73875 - DNA, 528 bp, Glycine max
  Peptide Sequence Number=SeqID_190653
atggagaaaatgaaaaaatggaagagagaaagatgggaaaagtgcagaacttcaaacaatagtcaataccttcaaaatcttcaaaaacatttaatcaaacaccctgtaggcaaaggaaaattgggtagtgctagacatggagagaatctcgaggttctatttttgataatggaaatgctagtggtgctgattctacagcgtggcgagaaccgacatgagcagaggagaggcacagaacggtggtcttcagggttttttgtcatctatgttctcgactctcgacagtgtttttggggtcaacatttcaagaaccgcatcaaagtgtttttaaggcttccagattggaacaacaacaacaacccatcaatattggtggtgagaataagcagaaaaacatgggtggtgaaggaagaaacaaaagggtgctgtaggatattgggaatattctatcttgcaagatttcgattaatgcttctggccagtctaaaggccatggttttgtgcagtttaagagtgaagaatctatag

SEQ ID NO: 73876 - DNA, 417 bp, Glycine max
  Peptide Sequence Number=SeqID_190654
atggaaagcatgaaaattctaagatgcttctgtggtgcgggccgaagggccagtgtaattttgacgaggtgcattagtgtagcggcagcactgcttttcagattggccggtgaacgtgagctagtgataagtacagcagtgtcacccccaactccagttggtgactatgatattgggctcgaacaacttgtttcaatgtctacggatcagaatatttctgctttacatcaatatggaggggcaagtcttcaacatattagaggcttatcaaatttaataaaatctaatccggataaaggtattagtggagatgatgctcatctgttaaaaaggaaaaatgcatttggaactaatacatatcctcggaaaaaggaagaagtttctggaggtttctatgggaagcttgacaagatctga

SEQ ID NO: 73877 - DNA, 276 bp, Glycine max
  Peptide Sequence Number=SeqID_190655
atggaaagagctacggctagaggggttgctgaccttgactatgttctccatagggatgagccagctgagcttacgaattctagcacttcaaaagaaattgcattatacgaacgatgggaaagatctaactgtctttccattatgttcatcaagacacatatctctactagtatccgtggttcaatttcagaatgccaaaaagtcaaggatttcaagaaggccttggctagcaccctaatgtctaagttgtcatctatgaggctcattggagtctaa

SEQ ID NO: 73878 - DNA, 273 bp, Glycine max
  Peptide Sequence Number=SeqID_190656
atgcattatgaaattcctttcaaggttgcccgctctaaaggcttcaagatgatgattgaagctgttggagattacaatcaacaattgaatcctcctacacaagaaatgaacaagccacatgatgatcagataaagcaaactcaacatggagagacgattgaagatgaacaggttgttgagccgtcgttgacagagaaaatattagtggaggaaataataggttggaatttggaattagggccttgggagagattaggcctcttgaacacctag

SEQ ID NO: 73879 - DNA, 606 bp, Glycine max
  Peptide Sequence Number=SeqID_190657
atggctcgcacgaagaaaactggtcaaatgacgtctgaggcaacaaaggaaattgcagacaagattgatgtactgactgcttccattgggcgaccagagcaccctggacgtgtccatgctgctagagccagtgtcacaatcaaacattactttggaccagcttcaaggggctcctacacctcttcgtccatggcttctaaagacctagagcagttggcacaaaagatcagagaccagttggaggagtcgatcacacaaaaatctcagatgcaatcacaaagactcgcattgcctcctgaggctgaggttggtccttctattgcttgtgccatcacaaaggaaatttgtatcgatccctcggggcaggacccagaaagggaaacttggacaaatgtgggtttttatgaggggtcgacaactaaccacaatgttcctttgggcaatgatcaagtgaagttaggtgttgaggaagttcaagatgctgatgctcgtgttcctatacccactcaagaggataaacaagtagttgaggcaccgttgaaacctgtagatacgtcggatcctgacgttgatcccctgtacctgatgacattgaccatcccataa

SEQ ID NO: 73880 - DNA, 693 bp, Glycine max
  Peptide Sequence Number=SeqID_190658
atggcgaagaacaaacttataaccacggtggggctggctgctaaacttgctaatgccaggaaacttgtaggaaatgttgcgaagaccaagtcaaaggtggatactggtccatctaagcgaagtaaggctacacccactgttcaaggtgaaactgccttagttgtgccccaaaataatccaaatctttttgaatgtgtgaaagatgaagtggaaatacttaagaatccccctacaaacaagtccacaatttcttccactcaatataagcctattcaaaaagaacctcactcaaaacgggctaagaccatgttaattgggatatattgggaaaatgttgacattaaggacgtagatgattttcttggtaatggtcaatggaaagatgtttgtcacgaattcgaaacggaatgtagtcattctatgaatgttactttcaacttaaggatgcttgttgaaaaaatggctcccacttacgagcaagtgcacaaaaatgtcgagattgagggccttaagcggactaaggaggagtatgaaaatttaaaagcatttgtgaccaatgattcttgtttaaaagagatggagaaggtgaagaaatttgagcttgatgcaacagagtctacaaagaagaacatcgaaatccaagctccgatggagtggagcaatgttgatgcggtggcggataatggaagttag

SEQ ID NO: 73881 - DNA, 225 bp, Glycine max
  Peptide Sequence Number=SeqID_190659
atggaaaccttctgtgcgaacattgtttggtggcgaattgaagaaaccttctcatcctattcatggagtcccaacagctatcaattgcctagcaccactgcatacaggagcatgtggaaggagcttattattaacgaagatggaagaactccatgctcctgggatgcctttgccaactctggctccttcttttctctcattacctttgctaactattgccactaa

SEQ ID NO: 73882 - DNA, 209 bp, Glycine max
  Peptide Sequence Number=SeqID_190660
tgcttcgggtgacacacgggagagagtttccacaacaacggagacgatcgacaatgagagagcaaatgtcagtgaaagggcgtgacagaggcagtgagagggcgctgtcatggtggactttgtctgagagtgaagcatcaccgcacgagaatgagggcgcggtcgcagtgagctctaagagagagggcatgagagtgaggggttcgtag

SEQ ID NO: 73883 - DNA, 462 bp, Glycine max
  Peptide Sequence Number=SeqID_190661
atgaagaagttggatgatctcttggagctaccaaaggcagatgaagtgatttctgaattgatgaagaccaaaatggagctagacaagctcgtgtatgttcagtatccagcagataagcaagagaatgcaatgagcaatgaagaactcctagatatcaattgcagcagcttgacttggggagctgttggtgatgcaattgaagctagtgagccatctagactcatcagacaacatactaaactcactattgaagctcctattgaagaggaaaaggaggaggaaaaacatgatgagaacacaaagcctatcaagcaaaaaattaaggagaaggaggaggttgaatgcacttgctcaagtttaggagagagaaattgcttaattaattttcaagttggcattagtagtaggcataaggcatgtgaattggttgtgcagagagtggaggaaatcattggggggtag

SEQ ID NO: 73884 - DNA, 468 bp, Glycine max
  Peptide Sequence Number=SeqID_190662
atggatttctttcctgatgagagtttcgaatgcattcaagcatttcaaaactcaaatctcattccttttatgtctttaaaattgcctgtgtattctgaattggtaaaagctttttattctaaccttgaaattcaagaaagtaccttgatttctgaggtctatgggataaagatggtcattgaccaatccctcttctatgatttgacccaattgtctagtgacggtgtaccatttgaaggtgcactagatgttgattggaagtttgatttttctgtgcatgatgcctgccggttggtttgcaccaaccaagcggatatgaccggaaggctgcttgccggttcattggctcttgaaagccgcatccttcactatcttattattcgtattttactcctaagatcttcaaaccttgcacaggtttctgaagaagatcttatagtcatgtgggcctttcataccggccgataa

SEQ ID NO: 73885 - DNA, 396 bp, Glycine max
  Peptide Sequence Number=SeqID_190663
atgaaagaaaagattgaaagattttttctctaccgaatccttgaggtggattttgaagattccactccaattaaaatgttcctctatgtgtggtggtccaacggtaagcaacgacggcttgtggtggccaccagtggtcgtgggtggaggagaataaggtttagggtttggggcgttacaataggaatcatctacctaaaatggattctattgccctcaaaactagagaaaccagctcaagacgagaagaaagaaagagctttgtctaaaggtctgaaagtgcagatggctaagtctgacaactcagataacagttttgaaggatccacagacgatgaagtagctcttatgtccagaatgttcaaacagatgatgaagaagaaaggaaagttctag

SEQ ID NO: 73886 - DNA, 207 bp, Glycine max
  Peptide Sequence Number=SeqID_190664
atggtcacttgggatgactcaaacaatgagaagactaccagctcagatgacaagcaagacaacatatgtctgatagccaatatagatgagatagttgagatatccttggtaggaaaaggggaaagatttaagctggtacaaggacaatggttgcttatgacacatgacaatggaaaggtctatgttcctcaaactaaagccaattga

SEQ ID NO: 73887 - DNA, 267 bp, Glycine max
  Peptide Sequence Number=SeqID_190665
atggcaacaagggttattgttgaggccttgaaaagaacagagtttaaatgggtttcaagacaagaagttagagatgctgctcgtgcatacattagtgacacaagtttggtagattttgtgttgaggtcactaggaaaccatgttgaaggaaactacttggacatttctgatgtgtacccttataatgaaggcttggttatgagtaacaaagtgaaggacaagtataagaagggctcaactaatgaaggacatgctttatttgtataa

SEQ ID NO: 73888 - DNA, 201 bp, Glycine max
  Peptide Sequence Number=SeqID_190666
atgtgctccacaaaacaaatcaaacttagcaaatacgccacgtgggcaggtgtggatcaaggaagtttcctgtgggacccatttgggttttgtcagttaggggccataaccatgttggatcagttgaatctgattggagggtatatttacgttacggtagaagtgctcacaagaaacgtgatatgcgaggttgaaaactga

SEQ ID NO: 73889 - DNA, 1512 bp, Glycine max
  Peptide Sequence Number=SeqID_190667
atggcaaactaccaccgcaacaacgtcgaaaacgtcgtcctcggccgccaccaccaccacagccaccgttccaagtccgcctccgtcgccggccacaccttccgcctatggaatgccgcctccttccgccgcatcatcttcgacgccgtcagctgcggcgccagctcccgctacgccgcgagatccaacatctccgacgagaaacaacacctccaacaaaaacaacaacatcataagacgacgtcgatgaagaacaatgcgaagtcggagaagctctcggatctgctgagcattgcggaagccgaaaccgacgtggaaacgaagaagaaagaagagaagctggaagacttgaagcgcctcgtgaaggagcttcagcagcacgaagaagattcgacgaagaataaaaaaagtgaagctgcggcgaaagtgaggttgctggcgaaggaggagttggaagtaagaggaacgctcgctatgttaggtgccattcctcctctcgtcgcaatgctcgatgaaaccgaacaaaacgacgtcaattcgctcgtctcttcgctctacgcgctgctcaacctcggcattggaaacgacgcgaacaaagcagctattgtgaaagttgggtctgttgagaagatgctcaagttgattgaatctccagatggtctagattcttcggtttctgaagcaattgttgcaaatttccttggattaagtgctttggattcgaataagcccataattgggtcttcggcttcaatttatttcttagttagaacccttcagagtttagatgatgagagtagtccccaagccaaacaagatgctctccgagcattgtacaatctttcaatcttcccagggaatgttgcattcattttggagactgatttggtagtgtttctggtgaactcaataggggacatggaggtaactgaaagaacccttgcaactctcagcaatatagtgtcgacccgcgagggtagaaaggcgatcagcgctgtgccggattcgatcccaatcttggtggatgtgttgaattggacggattctccggaatgccaggagaaggcgtcgtacattttgatggttatggcacacaagtcctatggtgacaagcaggccatgattgaggcagggattgcgtcatcactgcttgagttgtcccttttgggttccacattggctcagaaaagggcatcaaggatattggagattctgagggtggacaaagggaagcaggtttctgggagctatggattgggtgcagctgtctctgcccctatttgtggctctttgtcggggaagccggacggaggaggaggaagagagtgttttgaggaggacgaagagatgatgagcgaggagaagaaagcagtgaagcaattagtccagcagagcttgcagaacaacatgaggaaaatcgtaaagagggccaatttgcctcatgatatcgtgccatcagatcattttaagtcactcactttgagttctacttcaaagagcctgccattttga

SEQ ID NO: 73890 - DNA, 426 bp, Glycine max
  Peptide Sequence Number=SeqID_190668
atgacttcacaaacaatagcttgttcttctcccccatcgcttcctcaccatcgcctgcacccccttgttctactcccccatcacctcgaacagcggcttcacgaacagcccacagtccccatcgtcacaaacaacggctttaaatattgcacaatgagggcacccacgatgttgtggcaggctttgcggacagtggggtcagtgtcattgaggcggcggacgacgtgggcaatgatcttggtgagattggccgtcgcggtgatgaagtgtgcgacgcagacgatgctaagcagagtatatacctctattcgaggatctgcaaaaacacagacttggggcagcgaggctatgtggtggagcggtggcatgatgtcgctctatcaagaccacgtgactgccaacaagtatgaaagggaaactttgtaa

SEQ ID NO: 73891 - DNA, 894 bp, Glycine max
  Peptide Sequence Number=SeqID_190669
atggttgaggcctcaccatatgatatgaaatggttttcattttcttcctctttttctactagtgaatgggttgtcaaggtaccaatcatcttcatatttggagttgcaacgacagtggatgcctccagaaacattctgccatcacatgctcttgagcgtttgtgtccctctaggtttatgcttggaacaccagtcgagagaatggatgcaattgttgaggctgttcttctgaaacattgcaccacgtttagtattggttataaagtggcagtcttcctaagaaactacttcatcaaccaggatgggacagtgacatcctttattagagctttgaaggtagcttgcttattacatttctcaatggaacctctaagtgtcatacatgggcaaacactcgctgaagatcagaaagagggaaaatctgcactatcacccgagactctcttgaaatacatagatgaacttccattgtgtgcaaggaatcaaacagttgatcatccgactcaaaaaagcatgtctgagggtttgtcagaattggtgacagtgcagaagctatggagcactgcagttctgtgcctatatgaagctggaaagtatagcagagtgcgactattggatttgttttgtgaagctctcagtcaagatttatacctttcaagggtttctgattgtcatgtgggggatgaaaaagatcgtgatttgtcctcaacaaatgatcccagacaacaatattccatcatgaaaagcggtggtattattggcaaaatagtatgcaaagtgagggatatccctacagggatgctatatcagttgattgagagttgggaaaaacttactgctgatgtttcagagtggcttccaacagaaggtcagcaagctaagtgtactcattga

SEQ ID NO: 73892 - DNA, 324 bp, Glycine max
  Peptide Sequence Number=SeqID_190670
atggaaagagttcacgcaagagttccaaggacaattccaattatatctaaaagcatccgtcctatccttcagaacctgtgtgaggggaatgagagagtgaagagaccccattttgagtttcaggggagatatccagtaaacattgacaaggatgcgagaatgttaaatttacaagctatcgcatttttagattatctacttagaaattttttgaagcccgttgaaggcatgcctttccatgaaattttctgcttcaagaatgttgagaagcttcaattgcctgatatagcaactgccagctcatacacaactttgactaactga

SEQ ID NO: 73893 - DNA, 210 bp, Glycine max
  Peptide Sequence Number=SeqID_190671
atgtacaaaataatcagagttttgggggggggggggggggggggaagcaaaggaaaggagaagagagaacctgaaaatcgttctctacgacttcggatgttgttgacggaggcgttgaatcagcgacactccgagaaggtgccatctgatgaagatttggaatctgctatcaacacacgcgagagcgaagagagagaaggccctgtttga

SEQ ID NO: 73894 - DNA, 204 bp, Glycine max
  Peptide Sequence Number=SeqID_190672
atgacttacaaagaacataaaaagcattccctggaggtcgccgaactagtgctcttcgacggcacgtgggaaatcgaatcccgacagcacaacatgataaagtggttagaagacaaagccatgctgcctcattattcaattttcgtaattgaaatgaatatcagcccaaggtcaaatgaaccatatgtatggaccatgctttaa

SEQ ID NO: 73895 - DNA, 615 bp, Glycine max
  Peptide Sequence Number=SeqID_190673
atgtccacccacgctctccacgtcgaagccacagttcggggtgcaaaaattggtggcgatgatggcccttgttgtaccggagatgcaccaccgccagttgaagttagagtcctcctcatggcactagagctcgaagtaggcgttgcagatctggccacgctcgaagagagcctcgctaagagctacgatggccatgccataacgccattaaggaggtcatcatatccacacacactgccgaccgaagagaaccttgtggaaacagttgactatggtggccgaagagacgacatagcaattttcgacaaagactcttcggtgacatcagagctcgatcatgtatcaagacttgcagaaaagggagatcgagcctgggtccttgtcgcactcgatgaaggagaacagatgctccagcacctccccagcgaacgagtaatttattctccttctcctgcatgcttaccaggtcctctccatcacgagctatgcttcgagagaaaaacatatcgtgagagtgagagtgacacctacaccatcagtgggagtgaaaccgtgagcgagagtgagatcgacagtgatgataccatgagcgacacgacagtggtttcacattga

SEQ ID NO: 73896 - DNA, 669 bp, Glycine max
  Peptide Sequence Number=SeqID_190674
atgaacatcagtggcggaggaggaactgtgatgggtttcagtagtaatgggaggtccccattcacagtgtctcagtggcaggaactggagcaccaagctttgattttcaagtacatggttgcgggtcttcctgtgcctcccgatctcgtcctccccattcagaagagcttcgactctactctctctcacgctttctttcaccatcccacactgagttattgttccttctatgggaagaaggtggaccctgagccaggacgatgcaggaggactgatggaaaaaagtggaggtgctccaaggaagcatacccagactccaagtactgcgagcgccacatgcaccgtggccgcaaccgttcaagaaagcctgtggaatcacaaactatgactcactcgtcttcaactgtcacatcactcactgtgactggtggtggtgacagtaatggaactgtaaacttccaaaaccttcccacaaatgcctttggtaatctccagggtactgattctggaactgaccgcacgaattatcatctagattccattccctatgcgattccaatgttgggtgatgctctgacatgtggaataggtactagatttaagagaccttcatcaatgaaaattgtctacaagctatgtcttgttgagtactttgtgacaaaattgtga

SEQ ID NO: 73897 - DNA, 327 bp, Glycine max
  Peptide Sequence Number=SeqID_190675
atggaactatgttgtgttgttaaagctctttctctgatggtactctcagtaagagttttcagcttccctaaggctatagcttcagatgctttggctaccacaaacagtcaaaagatctactgcttggcagcaaacactggcagcaagtgctggggacagatgtcgtacaggatgtcacgacatcacgcttcagaacatgcagattatatgtgtccgtatgaacagattaaacaagtaaataacacaagagaattgtttacccagttcggtgctacctcacctacatctgggggctaccaagccagggaggaaatccactctcaatag

SEQ ID NO: 73898 - DNA, 882 bp, Glycine max
  Peptide Sequence Number=SeqID_190676
atgatggaagcaatgatgagcatgaggaagatgatggaggtcaacactgctacaactgttgttgctagtactgctactgaaagggacttgattcacccatccgggttcaatcaagatagtcatccaatcatagatgtagtaggtcaaggaggcgagacagtggcaaatcaaatgggcctcattatgtccaggtctagaaatatcggtaattccacatccatattcattgtgaatcaacaaccccagcccgatcatactcatgcccatgtctctcaacctttggaggacacacatgaagctccccaagaccacactttgaccgatttcagggtttatccgggatataccactaaagggcttgtattttctagcgtcctcatgccaaatgctgtgatgggccctcagctgagggccattgaaagagtaggaaattatcgctttgtggacatgtcagaattatgcttggtacctaacgtggttattccttcgaagttcaaggtgccagattttgataagtacaaaggaaccacttgcccaaagaatcacttgaaaatgtactacaagaagatagatttggcaaatcaagtagtttccccgatgacggagagagagatgataacaatgataatgaacacactgttgatgttctactatgagaagatggtaggttacatgccttcaagttttacagatctagtgactatcgacgagagaattgaagcaggtctaaggaaagggaaatttaattatgttgtttctgtgaatcctggtaatgggggactcggaaggagtgatgagaggaataaggaaggagaaactcatgttgtggctgcaatgctggcatggccaaactttccactagctccttataatcccatgtag

SEQ ID NO: 73899 - DNA, 192 bp, Glycine max
  Peptide Sequence Number=SeqID_190677
atgtcagtgaaaaacctcgttgggcacctaggagtacatgacaagacaatccacacactagtaagtcaggtcactctcactaggcttaatggagcactcaaacatggtgtatttacccccaaggcctatactctaaagagttcatcagggcttctccctcttgattcaggtccaacccataaaacattttag

SEQ ID NO: 73900 - DNA, 435 bp, Glycine max
  Peptide Sequence Number=SeqID_190678
atgggtgtaaatggccagggtgactcgacccaacctgtgattatgcaatcgggttggaaaaccctagttgcctcacacagagaatggcgcgaccaaaggggaaaccaccacagagggtggtgcgccgccctcgctactgctagtgtagggcctggcaatacgagaccgccacaggggcggcggggggctgatgacaacagaggttttgcggtggtgcaaacaaaaaatgagaaaaaaatgaaaataaccaaggtgatggggcctttaactacaccggtgaaggacgcacaggtgcgaagctaccacgggatagggacaaatggtggcagtggcatgaacagggacaccacggcctcactagagttggcaaaagaaaaggaaaaaaaaaacaaaaacgcatcaaaggagaagcactcgaacaaccaaacaaaataa

SEQ ID NO: 73901 - DNA, 234 bp, Glycine max
  Peptide Sequence Number=SeqID_190679
atgtttctcaacaaggtcaatgccaacaaggaagctgctgcttattctcgaacttggagaggacacatgcagaatctacttggctatgcttgttctgtatattgtgtgtataaaatgatcaaggattttgactcattaaatctgagcccagataaggcttatgaagtaggattctgtgttttaacatctgaattgcaggagtttggtgaatttactaagagaggaatgctataa

SEQ ID NO: 73902 - DNA, 774 bp, Glycine max
  Peptide Sequence Number=SeqID_190680
tcattgcaaagtgttgttttcaaacaggatggttctgttgatcctgtgacaaggacaataagtatatttcttcagttctttgatataggaataaatgcagccttattatcacagtatatttccttgctattcatcggaatgttggttgtgatatcagtgcgtggattcttaaccaacctaatgaagagttcggctatgattatatctagtcctatatcatgtgtccagttcttttttgctgtttcaagagttggaagtggatcttcaagcaatgtagttctgtttttgtctgagataatgggaatgtattttgtatcttctattcttttaatcaggaaaagcttagcaactgaatacagaaaaaaagttgtcaacaaaagaaaaagtgagaacatgatgacatttttgctgctgactaaagtatgggcctgtcagtttgtggcacttgtcttgattgatgcaaatttggcatgcataaactgttattatttcatcaaacttccctggtttatcaggattattattacagaggtattgggtggtgatatccagtttgacttttatcaccgatggtttgatgcaatttttgtggctagtgcattcctttcactgcttttactttctgcacattatacatctcgccaaattgacaaacatccaattgatttgaatagcttgttagaacatctgatgctactggagctaatcaccagtgagagggttgatattgttatagttaatatcaacagatgcgcattgtgcaaaatcttttag

SEQ ID NO: 73903 - DNA, 1431 bp, Glycine max
  Peptide Sequence Number=SeqID_190681
atgagaactcacttagtagtagtttctgttcctgttattagccatcaaatagcaatttctgaattctgcaagagactccttcagctccatcccaccattagaatcaccttcatcattccagtgctagagtctcttccaaatgcctccaaatccatcattgtttctctttcagccctagacatagaaaccattactcttcctccagtgaacttgccacaagagatcactgttccagctctcaaacttccacttgcaatgtctctttctctgccttctatccatgatgcattgaagtcaatcacgtcaacttcacacgttgttgctatagttgcagattattttgcctatgaactgctcccatttgctaaggaacttaagattttatcatacgtattttttcctacagcggcaacaataatttcgctttgtttacattcatcaacgctgcatgaaacaatttcttgtgaatacaaagagctgcaagaaccaatcaagatcccaggttgtataccaattcacggtagggatctaccaacctcacttcaggataggtcaagcgaaaattacaagcattttcttctacggtccaaagcactacgtcttgctgatggtatcttggtcaatagctttgtggaattggaagctagggcattcaaagccatgatggaagaaagcaagagtaacccttcagtgtacatggtaggacctattgtaaaaaatgtttgtgacaccactcacaataataatactaataataatatcaatgggtcacattgtttagcatggttagatgagcaaacacctaactctgtggtgtttgtctcatttggtagtgggggcacaatctctcaacaccaaatgaatgagctagcattgggattggaacaaagttcccaaaagtttgtgtgggttgtgagagaaccaaatgacttacctagtgctaattattttggaggttcctcattaggacaagaccctttgagttttctaccaaatgagtttatggagaggaccaaaggccaaggtttggtgattccattttgggcaccccaagttgagatccttggtcacaaagctattggtgcattccttactcaatgtggttggttttctacccttgagtctgtggtgaatggggtgccaataatagtttggccactctttgctgagcagagaatgattgcaacaattctagttgatgacctcaaagtggctataaggccaaaggctaatgagagtggcattgtggaaaggtgtgaagttgccaaagtggtgaagagcttattggttggtaatgaaggaatgagaattcgtaatagaatggaagtgatgcaagatgctggtgctagtgcaattaaaaataatggattttccacaacaacattgtctcaattggccacaaaatggaagaatatgggaggctgcaagtaa

SEQ ID NO: 73904 - DNA, 1275 bp, Glycine max
  Peptide Sequence Number=SeqID_190682
atgactttgtctgaaactcagtgttcacctaagcacatggataaagagtccattgaccaaggtcacaatatggttagtaggaattttgatggcaaagaaactatttttgaccagacacatttgggtttacaagtaaacttagagagacaagacactagaatcaacaccaaatctacattagggattccgaccatcagtacacaaatttgtcaagaagtgaattccactggttcgtccctgagagacagtgtaccaaagcatcgacaatacataaagtctaaacctcctgaagcaatgggaactagtgtaagtagtaggattgtggaaacaaaaactaatcatgatatttctgttaagcaagagaactctttgtcttcggggatccattccgttggttgccaagagatagatactgcaagcaatatcagtaaggataaaattttggacagaacaaacaatggtgagaatcagcaaaggcctaaacggaaacagatggaagatgatctcgatattaacgtggaggcaacgtttcagagagacctgactgtgaaagccgtcaactgtcagctacctaatgataaaaaagttaagcatatagatctttcagatacagttgtggaggcttctgcagttagttgtcagaaaatgccttggaatgaggtaaatggcaaatttgaagacagagaaagttatagcagggagctgcgaacaagttttggtggaattcacggatgttatgattctggagcctgggaatcttttaatggtagttctgcatcacttgtaaatgatcttggttcctgttctttaggggaggacaaacggtgtaaagaaccttgtgatgagaaaatcatccacgaggactttggagcgatggaaagaaccttctttcctgttgatactcgtaaaaaaaatgacttggggatggtgctgaatagcgagtcactgaatgaacctcgtgagtacgtggaccaagttcaagttgggattccaaatctagagcttggtttggggggtgaaacgaaaccctcacacaagggtatgctgcctttctttgttggtgcggttcacaagaaaaataaccaggaaaagattccagaaatattgacatacgagcgagaggatgagaacgttgctgcatctctttccctgtctctatcttttccatcttcaaacaaggaacacgtcaaacctgttccaaaagctgagcctttgccgggtgggcataatgtgaattcgccgtatcttctttttaggagattcacggacaaataa

SEQ ID NO: 73905 - DNA, 2634 bp, Glycine max
  Peptide Sequence Number=SeqID_190683
gtatcactcaaatctggaaagaaatttgtcaaacattctatgattcggaacgctgatatgagactcgaatcagggacttgtaatgtgtgctcagctgcttgttcatcttgcatgcatcttaaccaagctctcatggggtctaaggctgaagaattctctgatgaaaactgtcgcttaggggaggctaatcagtattgtaatgagagtgatagatcttctcttgggagcagagcttgtgaaaggttgaagcatggtgtcagtgaaaccagtcacaggcctagtgtttcttccactcaagattctctatctgaaaatgctgagaacagtcaagccttatcagagaagtatcaggattccaagtgtttagaaagtctagatgatagcacttcatgtatcagtaggaccaaaggatctggaaatgggccatctgttgacatgtctagtttgtcagaatgttgtatggaaaatgttgactcatcattgaccaaagagagagtacctattattgttcctggcgaaaaatctctggcagataaggaaaacctaaataatggtacagccaaggtttctatagaaatatgtcaaaagtcagaagcagatactgaaaataattttgatgttgctgaagatgttgatcttaaattttctgcccatgatggactgcatgagaaggttgaggagctggttaaatcacctggcagggctgaacctcaatcggaagatgagagtgatgaatcagatgttgttgagcatgatgtaaaagtatgtgacatctgtggagatgctggtcgtgaggatctacttgccatatgtagtaggtgcagtgatggtgcagaacacacctactgcatgcgggaaatgcttgagaaggtccctgaaggggactggttatgtgaagaatgcaagtgtgcggaggagactgcaaatcaaaagctagcagcaaaaaggcaagctcttggatcgagcacaggatcaccaaaggcatcaagccccaagagaatagtcccactgttgcgggaatcttcattcaagagcatggataaaggaaagatgaaatctggtcaacagatccccatgtgtaaccacctcggtggcaatgacacagaacttgcccgttctctatccactgtccctcggggtcaaaatgcaaggagtacattgctgaaatctaattcattcaacaacttcaattccaagccaagagtcaaacttgttgatgaagttattccccaaaagcagaaagggggtgttgaacatatttctaagaatatggagacacctgctggaatgataagcaaatcaatgtcattcaaatcctcgaatttgggtcgttcaattgctgttgaatcaaaagttaaaatgatgtcttctaaacctggaactgctcgggatttgaaagcatcaagacatacaaaagattctgcttcatttgacaggaaatttctgtctaagattgatcgacctgtcatttgttcaaccatggttagttctgttgtttccacatcaaagggtgatcagaagcttacaccgcatggcgaaactgctaaaccttctacagtcaacaacaatcgagagtttaaggtcaaccaagatggaaaattatattcatcatcgaaatctatcaataatacaagcagtaaaagtccagaacctcaagttagttcagatagaacatcaacaagtgtcgatgaaactcaacaggataggctgcctcgatcacaagatacagctaatcaggttgacaaaactaaagatagttctagtgatcatgtgacatcaggtgttactaatgcttcaaaaagctcattctgtcgtaaatgtaaggattttggccatgctacagaatgttgtacagttagtggtacgcaggaatttggtgctgaatcatcagtcattgccacaagtagttcaaaagatgagatgcatgagggaaatagattgaaagctgcaatccaggcagctttgcttagaaggcctgaaatacacaagaggaaagaagctcctgaccaaactaatgagtttcctacatcaagcactggtttgaaacgagaagtcacttctcaaaagcaagtgttggtttccagcactttgaagaatggtatatctgctgaagaaagcaatatgaagcaggaaatcattgagaattctacatttgaaacctccaaatgtccatctgccaatgatctgaaacaacttgaattttgtagaactgatgtttgctctcagctgagaaagtcggattctgctggtcccacttctggaaagcctgtagtgagagacgactttcccaataatgccatggaaatatcaagtattctttcaaagatgtcagtcattccagaatatgagtgcatctggcagggtgtctttgtggtgcatagaaatggaatgcctcctgacttgtatactggaattcaagcacatttatctgcatgtgcttcccctaaggttcatgaggtagtgaagaaatttttacctgaagtttcgctaaatgaagtttctcgtttgagcgtatggccttcacaatttcatcaaggtggtgctaaggaagataatattgctctttacttctttgccagagacattgaaaggcaagaatatgaatatcactcttctattgagagtaggctttga

SEQ ID NO: 73906 - DNA, 612 bp, Glycine max
  Peptide Sequence Number=SeqID_190684
atggcctcagaggaccaaggtcatggttcatgcattttggaatttaaaaaagaaatcctcactctgaaggccgatttcgcgtgcaagagcctcaacgaaggtgaggaggttcccctccgctccccggaagccatcgaagcgttcaaaatgctaagccctaactaccgcaagaagaaaagggaggaaatgggactcaccaaggaagagttctacacaaagcagttcgagatcaagggcgacatttcggagcctctcatgacgacgtgggcgggaccactggtggtgcgcctcgtgccgccacacgactggccgcctcgtgggtggtgtgtcgaccaggaggagctcacattcatccgcgaggcacataaggtgcaggcgaggagggtgatgctagaggaggtggagagcggagtgaggattgacactgatggcgtgggcttggataggtatagggtgtttctcaagcaatataaggaatgggtcgaggctaacaaggatagtttggaagaggagtcttataaggttttgattttacatcacactaatgctgaactttctgctgcttcggattggattgggaaaaaggaagatgagagaagaagaaagacttga

SEQ ID NO: 73907 - DNA, 441 bp, Glycine max
  Peptide Sequence Number=SeqID_190685
atggcatgtcaacgacctggtagggtggtgaattgtttatctttgagaaccaattcatggagcttcaccgagaagaaacaactaactgctgcttatgatgataatgaagtcggacatgttacgagggagttcttaaacggggccttccattggctcgaatactgtaaaggtcttggctgccaaattattgttgcatttgacgtgagggaaaaagaattatcagaggttccgcggccacgcgatttacccgttgaatctgaagataattttatttatgatttgatcacaatgggagaatgtctttgtttatgttttgtgcgctgccagaacaggactagagtgtatgaaatgtggaccatgaaggaatacaaagttcaggcatcttggaccagggctgtatggtggataagtggtggacggacagtgctcgaactgaactga

SEQ ID NO: 73908 - DNA, 375 bp, Glycine max
  Peptide Sequence Number=SeqID_190686
atggaagaagagaccacaacacaagggcgtggttgggtggttccttattgggcatatcagattcaaatccttgctcatggtgcaattggtgggttcatatgccacggtggttggaactccacaattgaaggtgttgtgcaagggattccactaatagcatggcaactctttgctgggcaaaagatgaatgctgttttgctaactgaaggtctgaaagtggctcttagggctaatgtaaatcagaatgggattgtggaaagggaagagataggtagggtcataaagaaacaaatggtgggggaagaaggtgagggaattcgccagagaatgaaaaagttgaaaggtgttgctgctgatgcatgcattgaaggatga

SEQ ID NO: 73909 - DNA, 237 bp, Glycine max
  Peptide Sequence Number=SeqID_190687
atgcaatttcaactttctctctcatcgctttgccaaaatctcgccacctccatcgccagaaaagtagatcaccatgacatcaatactcatcgccgatctttctcagcctccaccaccacatttacctggcaaaatcaggaatcaacaataggggcaacgttcttttcacaggcactggcagtaaatggcgcgatagtaaagtttgagatttgggacacatcaggacaagagaggtaa

SEQ ID NO: 73910 - DNA, 1261 bp, Glycine max
  Peptide Sequence Number=SeqID_190688
atggagaaaataactcacatagcagttgttccaggtcctggatttagccatctaatcccaattcttgagttctccaaacggcttgttaaactccaccctctcttgcatgtcacagccttcattcccacacttgggtctctctcaagtgtctcaaaatcctttcttaaaacactctcaccaagcataaccccaactttccttccaccagtggaccccattgacataccacaggggcttgaaactgcaatccgaatgcaactcacagtgacttactctttgccctctttacacaatgctttaaagtccttgacttcaaggactccccttgtggccctagtggttgataacttcgcctatgaagcactagattttgccaaagagttcaacatgttgtcatatatttactttccaaaatcggcttttacactttcaatgtactttcacttgcccaagttggatgaagacacatcatgtgagttcaaagaccttccagaacctattcaaatgccaggttgtgtaccaatacacggccttgatctccaccaccaaattcaagatcgatcaagtcaaggttatgaacttttccttcaacgtgttaaacgtttttgcacagttgatgggattttcatcaatagctttattgaaatggaaaaagagcccataagagcattggctaaagagtggaatggctaccctcctgtttaccctattgggccgataattcaaacaggcattgagtccgatgggcccattgaattagactgcataaagtggttggacaaacaacaacctaagtctgttctatatgtttcttttgggagtgcacctagtagttcagctagtagtgcttatctcagtggtcaaaatgagaatccattggaatttttaccatatggattcttggagagaaccaaggggcaaggcttggtgattctatcatgggcaccccagattgaaattctcagccatagttcaattggtgggttcatgagtcattgtggttggaattcaacccttgaaagtgtcttgcaaggtgtgccattgatagcatggcctctctttgcagagcaaagaatgaacgctgttatgctaagtgatgacctcaaagtggcactaaggctaaaagggaatggcaatggagtggtggaaaaggaagaagttgctgaagtgataaagagtctaatggaaattgaaagtggaaaaatgagaaaaataatgaagaggttgaaagaagctgctattaatgcaataaaagaagatg

SEQ ID NO: 73911 - DNA, 156 bp, Glycine max
  Peptide Sequence Number=SeqID_190689
atggcacgcagtagggacctctatgggagagagctaaaagggattttaacgttaattcccaaggtggtcatatctctcttgatggtctctagaggaattaatgaaacattgggcttaatccggattttggttatggacttgaagagggcaaattaa

SEQ ID NO: 73912 - DNA, 411 bp, Glycine max
  Peptide Sequence Number=SeqID_190690
atgtcattgacatcagctgtatttgagatctcattttctgatttaattgattttgctttgctattaaagggaggttgggagaatgatgaaactgttgaggaggctgcagttagagaagctattgaagaagcaggagttcgaggagacctaatggattttcttgggtactatgaatttaggagtaagaccctccaagatgagtgtagtccagaaggtttatgcaaagcagcaatgtttgcattgtttgtgaaagaggaacttgagtcatggcctgagcaaagcaccagaaaaaggagttgggtggctgtatcagaggcactagcaaactgtcgacatgcatggatgagggatgccctgcattgtttctgtaaatggcatgaggagtgcaagggaggatcaagcctgaactga

SEQ ID NO: 73913 - DNA, 507 bp, Glycine max
  Peptide Sequence Number=SeqID_190691
atgacccttcggtcactttcccagggacccgcaaggccagggccagggaatctaagggaccatcttcatcagcgcctcctgcttctactgcaccagctcccctacctccagcatccatgctttggctcagcatcggcccatcatgagcatggaggagtttgcttcttaggtggcctggctaggagcctgaccttcttcttttggggaggtgaggcctctgcaacccagaagtctcagccggagccagaagctactcaggaggatgatccagatccagacatccaagagattgatccaactgctcaggaggacactgtggaggattcgctagagatgactccacaagcattaccagtgaccacacctgtgctggagttgtcttctttgcaagcatcgacggtggctacgcctgtgctagagctatctgaggatgaggatgatgccacagccatggattatgccccttctgcaccacatgatgacccttctgcaccacaggacccatga

SEQ ID NO: 73914 - DNA, 132 bp, Glycine max
  Peptide Sequence Number=SeqID_190692
atggccactcctatgagtactgcttgctatctggataaagatgaaaccgttcagttaatagacataaagaaatatagagatttcaagcaaatcccaaagaatctcaccttagtgcagttaaaagaatcatga

SEQ ID NO: 73915 - DNA, 234 bp, Glycine max
  Peptide Sequence Number=SeqID_190693
atggcaactgcctactttcctatgaatttttttaccaacctaatatttgatgagagttgggaagttgtcaaaggtataggaattccaatttgtggtcacagtttcaattcctctatttgggtgatgcaatggctttacatgaaggacactttcaacctaaaccagctatcccctgtgcttaatgaggaagttctatgtatgactgttgtcatggatttgttgactgctaagtaa

SEQ ID NO: 73916 - DNA, 126 bp, Glycine max
  Peptide Sequence Number=SeqID_190694
atgaaaagatgtagttcctataaaaaggccggtcacaatgtttgtagatgtccaaatggtgacgttggaggacattcatattacgcatcgacttacaacactttctatgaagagtttatggagtaa

SEQ ID NO: 73917 - DNA, 251 bp, Glycine max
  Peptide Sequence Number=SeqID_190695
tctggtgacatgcggggttaccttatggttatccacaactttggtcaaccaggggcaaacgagcccgttgacgcgtggaaactaacattgtcttctaaaccttttgtcgtcctgacccgtgaatcaggtgacatgcggggttaccttatggttatccacaactttcgtcaaccaggggcaaacgagcctgttgacgagcggggactaacatcgtcttctgcaccttttgtcgacctgacccgtgaagtcag

SEQ ID NO: 73918 - DNA, 369 bp, Glycine max
  Peptide Sequence Number=SeqID_190696
atggctgattcaaccattaagattcttagcatcgttcttttcctttgcttcgtttctcaaggttatagccaatgcttcttgagtgatctttctgtaagtcaaattcaaacaggagttaaaatgcaaggaaaaccagaatggaatgtgactatcaccaataattgttcatgtgttcaaaagaatgtgattttgagttgcaatggatttcaatctgttgaacaaatagacccttctcttttgaagatctcacccaatggatgtcttgtcaatgatggtcaacctatttatactgatgcgatcaaatttaaatatgtttggaaccagtcatttccgttaaatcctatctcctcggagattgcttgttcttaa

SEQ ID NO: 73919 - DNA, 315 bp, Glycine max
  Peptide Sequence Number=SeqID_190697
atggcacgcttggccaccacgttcctcccctcagcgccgatggtctacgcggtgatctccgatccagggatcgtggacaaccccgacatcccgagctaccaaccgcacgcgtacggaaggtgtgatcctccagcgttgatttcacttcagatgaacgcgattgagatggaagctaattgttaccacaaaaccgcttcagatcccacagccccagccgtcccctgcaaaggagccactgtaagggggttttggagcgccgccagaaccatcgcgttttgcggatctcggcggtggcagaggggagtatgccgatga

SEQ ID NO: 73920 - DNA, 417 bp, Glycine max
  Peptide Sequence Number=SeqID_190698
atggggcttttcgcgttcccgaggatctatttcttgatgatcaggagcctaacagctctggattcctctcgttcctcggcgggccgccgcttctgtcgtcgcagcgacagtcgcacgtgtaaacggcaggatctggacaacttgtctgttcggtggattcttctcagctatcatttcttcattgattatttgaagtatgaagtttcacggaagaaagcaacaagaaatggtaacaaggaaggagagaaagaaacatcatcgactttgtacgaggatgaaatttggaggccttgtttgaaaggaatcaaccctgtctggttgctcgggttgagagtttttgcctttgttgtgcttttggtgcttttcatactcattgctactgaggatggaggaagcattttcttcttttacacttag

SEQ ID NO: 73921 - DNA, 384 bp, Glycine max
  Peptide Sequence Number=SeqID_190699
atgatgagcaccagatctaaagaagtcggaggtgtcgctctccctcaagtgctacaaccatttgctcttcctgctggggggaatgatatagaaaataggagtgccagaatggatggtgcaaattttgggtcattcctagcatggaagtctattaatgtaaagtcatggatatggaagcagcaagcgatgcatcctgaattgaatgacaacagctattttcgaaagaaatgggtttgttgtgatcaccatgcagatgccttggaagtagctcataccattgaaaagtgtctcaataaaataaagatgaagagaaaagacaatcagaggttgcaaagagcagaggtgcatgcagcaatatcagttgctaggggttgcaattgttaa

SEQ ID NO: 73922 - DNA, 2988 bp, Glycine max
  Peptide Sequence Number=SeqID_190700
atgaaggtgatacttgggtatcaggaagtccttgagatcgtggagaaagggtattcaccgcttgaagaggatgctacaaaagaacaaaaggtggcatataacgagaataagaagaacgactgcaaggccctatgtttaatttaccagagtgtggacaatgcccattttgaaaagatcattggagcaaaaacctcatcgaaggcatggaagatcttggagaaaggaaatgaaggcacgaaacagttgaagaaggtgcgtcttcaaacgatatgcaaacaattcaaattgatgcagatggaggaaaatgaaagagtagctgagttctttaatcatgtctttactctgaccaatgcagttaagtcctatggtgagaaggtcactgatctcaccatcgtagagaaagtcatatgtaccttgaaccccaaatttgacaacattgtggtggccatagaagaatcaagaaatttagagatcttgaaagtagaagaacttgaaggctcactcgaagcccatgagcaacgatttcttgagcgctcagatgggaaggcaccagatcaagcactccaagcacaaacatacaaaaaaaaggaggagctcgtggcagaggaggaggacataaaggaagggattgtgataggggtacaagggaatcagaataatggaaaacaaggcaatgaagcaaatatgcccaaggaagcagattcaaaagatgacgttctcttgttaatgatgagtgatatgaaaggatctaggggctcagaaatttggtatttggattcgggatgctccaatcatatgactagtcatagagagtggttgatccactttgaaaaaagcaggaaaagccagataaggtttgctgacaacaggattatacaagcagaaggcattggagacattttgatcaggagaaagaatgacaaccaggcaatgatcaaagatgtcttgtacgttccagcaatgaaaaacaatctcatcagcattggtcagctgattgaaaaaggctttagtatgaacttgcatcaaggaatcttggagctgtatggccccaagcatagaaaggttctcaaaaccccattctcagccaatagaacattccaagtcaaaattggcactctaaaaccccaatgtctgtcagctgagtctgagatgaatgattcttggatttggcatatgaggtatgggcatcgtaacttcaaagatttaagtatgttgcatactaagaacctagtcaatggtctccctcgaactaagaatccacaagctgtatgtgagagatttcttgttagcaaacaacctagatcaacatttgggtcttatgtgcctagtagagcaactaagagtgaagtatttgatacctttaaggtgttcaagatactagtggagaaacagtcaagaagaagtttaaagatcctaagaacagatggtggaggggagttcacttctggagaattcgagaacttctgtagagataatggcataatccatgagatcatagctccatatacacctcagcataatggtgttgcagaaagaagaaatataaccattatgaatatcgttagaagcatgatgaaaggcacaaatcttccactgagtttctgggctgaagcagtggaggacaactacctatatactaaatcgatgtctaactcagactcagttttactagtactagaggaggtttggtcaggtagaaaaccatcagttcaacatctcaaggtctttggaaccttatgctacactcatgttccagatcagaaaaggagaaagctagatgataagagtgaagccatgatttttattggctatcatcctacaggctcatacaaactctataatcccaagaaaaaaaaagtaatctatagtagagatgtacaattcgatgaattaaaatacttgaaggatagagacaaccagaaggagcaagcaactattagcgtgcaggtgcctatggagaattcagttagacatttagaaaggctataccatggtatctatgtgaagacaattaaggatggtggagtcctgctaatatgcctctatgtggatgatttgctgattacaaggagtaatccagctgagatagaaaacttgaaggacagtctcaaatctgaattcgagatgtcagatttaggcttgctatcatatttccttgatattgagtttgctgaaactaaggatggaatagtactgcaccagaagaagtacgttaaagaagtattgaagaggttcaacatggatcaatgtaataaggtagatactccaatggaagggaatctgaaattggatacaggcgatcatgaagcttcagtagacgccacattgtttaggcagctagtgggatgcttgagattcgtctaccacagtagaccagaaatctcatatggagttggtcttgtcagcagattcatgaagaaaggtgagttataccttgtagcttattctgacttagactggtgtggggataaagtggagagaagatctacttctgctgagtacatttcagcttgtagtgttgcatgtcaagcactgtggattctgtcctttatttccgaactaaatctaaagactgatgactttgtggagctgcatacggacaataaagatcaagttaacaaagggaggataaggttgaaatattgtgggacagatttgcaacttgctgatattatgacaaaggcgttgaaggctaatagactcaagttgctgagaaatatgttggaaacgggtgcgttcggttcccttggtggatacattattgtcgtcatgcaacttgatggtgacaagggcagagagcgccttcttggtgcagctgacctggccatcatcgaagggcattcgtttgaggaccacgatgacgatctcggtgaggcaccgaagattcttaacggcatcgcagccgagggtgatggcattgcagaccttgagggacttgacgacgcgtttgagagagaagttcaaagacagactgagcggagtccatga

SEQ ID NO: 73923 - DNA, 180 bp, Glycine max
  Peptide Sequence Number=SeqID_190701
atgctgttggaaaaatcatttttcctactgattacggctaaacctcacctaagtgtgggaataaagaccctcaaaggaagaaagtcattccagaaagccctggaaggagtcaggaaaaaggagttggcaccaccattcaagctttgggctatggagtggatgattatattggaggattaa

SEQ ID NO: 73924 - DNA, 1242 bp, Glycine max
  Peptide Sequence Number=SeqID_190702
atgaccttgcaaatatttgtcatagctaatttcttaatacctaatggtttatgtacagtaatagtgattctctctggcacaacatactcaattttcctagactctgaaaatcatatcaaatcggctacttttgtgtctaaaagttttgaagtgggaccgggaaaaattgtgtcaaaatcattttatgatattgagtttccaaaaggtcatattggggtcaagagttttgatgccgaactagttgatgaagatgggaattctgtacctttgtatgaaacctatcttcatcattggtttgcaataaagtacaatgaaaatattaccatgtcacggtacattgagaaatctcatgacattagcaaaggtatcaattacacaagaaacgatggtgcatgtagaggctttttgcttccacattattggggcttaggaggagaatcacgaggaacatcctcaaatcttccagacccttttgcggtagaatttggtaaccctacaaatattccacatggatttaaggaaaaatggttgttcgacatcatggctatcgatacacgtggtgcatatagtagaaaaggttgcatagaatgtagatgtaacctacttaatcttccaaaggacttttataatgtcacaaaagacattaatgagcaaccattgtccctaaattataaaggaggactcttttgttgtaaagataacttacaatgcaaattaagaaagggtttccatggcccaacgagaaagctttcactaagatataaaataaagtgggttgattgggatgaacaccaagtgccacttaagttttatatacttgatacaactgatcgtgtgagaacaaatggctctacaacaattcatgattgccaggcagagtataccattccaagaattggtcacagtgactcccctcatgttaagaaagcaaacatcccaatgaaaaaaggtggttatcttatatatggcacttctcatatgcatactggtgttgtcaatgcaactctctatggacaggatggaagggttttatgtacttcaacaccaaaatatggaacgggaaaggaagctggaaatgaaagaggttacctagttggaatgtcgggttgttatcccaaaccaggctctatcaagattaaagatggcgaaattctcactctagaaactagatatcaaaacaagtttcgtactggagctatgggatttttctatattcacttggcagaacaactaccaaactaa

SEQ ID NO: 73925 - DNA, 441 bp, Glycine max
  Peptide Sequence Number=SeqID_190703
atgatgagcaggaacgcgatcagacttgaggtggctcctaaggatggaaattggggcttcaatatatcggagcgtaaggccatgcttctggcagggacagtggataagaatgtggaaagggtctataaagaggaacttcagttgcccaagtgggaagaagatcccaatttgcacacaaggccaagatataagcaaattgttaaggaccttgcagacaaatatcatactgagaacttgctgcttgtcacacacggggaaggtgttggggtggctctttcttcattcaaaaaggatgttgaagtgtacgaagttgattactgtggatatgtccaacttagacgcccaattttcaagaaagaccagtcttttactgcaggagaatttgaagttcttactcacaatggtcaaaccggcataaatttcatgtcaaataaggcctga

SEQ ID NO: 73926 - DNA, 936 bp, Glycine max
  Peptide Sequence Number=SeqID_190704
atgcacgggaaaaaggagcaagaagagtacataaggaaagggcaatgggaagcagaagaagatgaggtgctactgaaccacgtgaagaagtatggtcccagagattggagctccattcgatccaaaggtcttcttcaaaggactggcaagtcgtgtcgtcttcgttgggtcaataagcttcgaccaaacctcaagaatggttgcaagttttcacttgaggaagagagggttgtgatagagttgcaggcacaatttgggaacaggtgggcgaagattgcatcctatttgccagggagaacagacaacgatgtcaaaaatttctggagcagtaggcaaaagaggttggctaggattctgcaaacatcagcaacaactttcagatcacagaaaaataaaactaaagttccttcctttcttgatgttccaactttggaggctcctaagttcagttcatcgtcagagggagaaccatcatcaaagcctcagacatgcacactaccctacattgataattctgaggttatccaaatggtgtctttgccagatctcataaagtctgagttgcctagttccgacacaatccatgttgaacaagagtttaccctttttgagaactacaaaagcactgaacagattgcatttcctcagatcccagaactccaaaatggcctcacattctcaatggaaaaccaagatctcgtgcccacaattgaagagccatgtttcattgaagacttgtgtccctttgatgtatctgagtttggaataggtccacaacacccctttggttttcctttcttcgagccaccaggaagttgcagatttgggacaagggatgcaattgataacttcaaaatcagtgacagcttcttcgatgatttacctgtggacatgtttgatcacatggacccacctgcaagcccttcaaacctctga

SEQ ID NO: 73927 - DNA, 408 bp, Glycine max
  Peptide Sequence Number=SeqID_190705
atggcctttgaacacttatgtcaaccatggaggaagtgtttagttgtcaagattttagggaagagcatagggtttctacctatgcatgagaagatgagatctagatggaaattagaaggcaactttaatttgattgtcataaaaaatagatattttatggtaacttttggcatggaagtggatagggataaggaagttaatggtattggagaggatgtatggagattggtgaatgaagcctttatgtttggctacctagatgcaagcattcttgatattcttttggtgttaattcctaaagtggatcatccttcccaccagaaggaatttagcctaattagtctttgtaatgtgtcctacaagatcatcactaaagtcagtgacaaggttgcgaccatttttaaatga

SEQ ID NO: 73928 - DNA, 1375 bp, Glycine max
  Peptide Sequence Number=SeqID_190706
cttagacctcaacgaagatgtggcggccccgttcatcagcaccggcgcgcgtacgcgcgtggcggtactgcgcgagcagggcgtcaacggccagatcgaaatggccaacgccttcgaacgtgccggcttccgcgccttcgacgtgcatatgagcgacctgatcgaaggccgcgtggcattgcaggacttcaccggcctggtcgcctgcggtggcttcagctacggcgacgtgctgggtgccggccgcggctgggccacctcgatcctggagcgcagtgcgctgcgtgatgcctttgccgcgttcttcgcgcgcgaggacagcttcgcgctgggcgtgtgcaacggttgccagatgatgagccagctcaagggcatcattccgggggccgagcactggccgcagttccgccgcaacgccagtgagcagttcgaagcccgtaccgcgctgctggaagtggtggagtcgccgtcgatcctgctgcgtggcatggctggttcgcgcctgcaggtggcggtggcgcatggtgaaggccaggccgtgttcgacaatgccgtcgaccaggcagccgctcgcgtttcgctgcgctacatcgatggcaacggcaacgtggccagccagtacccgctgaacccgaacggttcgccggacggcatcaccggcctgaccagcagcgacggccgcgtcaccatcatgatgccgcacccggaacgcacgccgcgcgcgctcaacatgagctgggcgccggccgagtggcagggtgactcgccgtggatgcgcatgttccgcaacgcgcggttgccgttaacacttgaaccccgtttcagaagcattcatttcgcagtaaccggggacgttgggccggaaagcccagcggtggcgttgctttgcccaaaaccagtccaatcaggagccgtaccgatgaatcggatttatcgcaaggtctggaacaaagcattgggtcagttggtggtggcctcggaactggcttcctccgacagcagcagtggcggggtcgtcgaccagcgccgcgatgcgacgcaggccacgcccgcactgctggcggtggcactgggcctggtattggggttgggcgtgagcggcaccgccgcagcacagtcggtgcagatcggcggcagcgccacctgcgtggcattcagcggcaagctgctcgaaaagtgcctgatcgaaggctcggccagcgccaagggcagcaacgcggtggcgatcggcagcaacagcagcgccactgccgccaacagcgtagcgctgggcgccggctccaaggccacgcgggccaactcggtgtccgtgggtgataccggcaaggaacgccagatcaccaatgttgccgcaagcacccaggccaccgatgcg

SEQ ID NO: 73929 - DNA, 324 bp, Glycine max
  Peptide Sequence Number=SeqID_190707
atggaaaaattgaaacccaccatcaaagaggtgagtgtcaacaaccctatgaactggagagagttcagaatattatttaggctaagaatatggtggagttggtggaagagaaagttggagatatttttcttctttgacttgttgatttttcactttctacatctacaaaggacactccaaagttcaagtacaaaccacaaaaagaagcagagaaaaagagagtgtagaactgaagatccaggagcttttggaactgagaaattgttggaggaaacagtctttcaggttcatgcaatgtgcattgtagttaacattagtttgtga

SEQ ID NO: 73930 - DNA, 252 bp, Glycine max
  Peptide Sequence Number=SeqID_190708
atgcagttactacgtgagagagcttccatccatggaaatatatctcatacacacttgaaaaactttgtaagattatggaatgatgattatgtcaatgggaggtggtttatatatgcctccaatgatgttactagcaagagagagattggctgtgatataaacaaagacatatgcactcaaaaacataaatcaaaaacaaaagagacaagcctggattctggaaggcaacgagaagagacaaggctatcatga

SEQ ID NO: 73931 - DNA, 546 bp, Glycine max
  Peptide Sequence Number=SeqID_190709
atgttttctgactcaccaaaactgcaatttttcttctctctgcgatggcctgaggatttctccaaagtggtcgacgatgggctgaagctctccaagcgcatatacttcgggaaggacagggtggtgtccctgtcgaagcatctgtcgccgatggcacgcttgaccaccgcgttcctcccctcggcgccgatggtctacgcggtgatctccgatccagggatcgtggacaaccccgacatcccgagctaccaaccgcacgtgtacggaaggtgtgatcctccagcgctgattccacttcatatgaacgcgattgagatggaagctgatgttaccacaaatccgcttcagatcccacagcctcagtcatcccctgcaaaggagccactagagaaggatgccgatgaagatcgtggcggagatgagggacatggagaggctgtggacagcggggagtggcccaagagggatttgacggcgacgaaagaggagagaaagagagaggtggaggctttgcagctgcacagattgatgatcttgtgtgggtga

SEQ ID NO: 73932 - DNA, 186 bp, Glycine max
  Peptide Sequence Number=SeqID_190710
atggcatgtgatcctgtggttagatttagaaagtggatagaaaaaaatggctggtggaatgatatggctgagtcagagcttataaacaatttgagacagcagtctattggaaacgaacaagctggtttgcggattttgtctgatagatcgcgtaatagctttggaccccagcaccagtatctctag

SEQ ID NO: 73933 - DNA, 234 bp, Glycine max
  Peptide Sequence Number=SeqID_190711
atggctcgcacgcttgtgtcaatgaagaatttgctaaaattttttatcttcgcagccctggttattgttcaattctcacatggagtgagctttaaggacagatgtcatgaattttgccataatattccaaaggcaaactgtgatgcctactgcaaggacaaccactatcagaaaggggaatgcatcccatcttatccggcaggagatagcttatgttgttgctctggtgattaa

SEQ ID NO: 73934 - DNA, 537 bp, Glycine max
  Peptide Sequence Number=SeqID_190712
atgagtcatcattcatctagtgttaatggcgagggtactaatcataaggaccctctatctagaatcttagatgagttaagttccctcaagttatggaaagaaaaactagaaagaaaagaaaaaggaaaagagagaagcctaagtgaagaacttcatgactattatgaaggaaggcataggtcacatcttagacctcactcccataggagagaaaaggaaagaaagcctcaagaggctaacattaacctcccatacttccatgggaaggacaatgtagaggcttacttaaattgggaaataagggtagagcaacaacttaaaagaaagtctactttaaaatcttatggatctcacttttatccaaagaaagaccaaggtctaggcatcttaggggcagcaccttctaagcccaaagatgataaggggaagacaatagaaaagcaagtccctaaggctagtatgcaaaagaagactagctttataaagtgctttaaatgtcttggaagaggacacattacttctcaatgccccacctag

SEQ ID NO: 73935 - DNA, 690 bp, Glycine max
  Peptide Sequence Number=SeqID_190713
atgagattgaacactgttactggctcgactcatctttgttttcatatatttgagtggcatccacttgagttgctagaggcagtggtgaacatttggatgcaacacacgggtctttgttctcaggcttttgagcattgggatgaaataagtcatatgctactggtggaaaagctacagggctctcgtaaacaagcccgtgagagacagggagaaatacttggtctttgtaaacaagcccatggaaaagcccgtgagctacaggtgatccgtaagcatgttccggatcaacttgatccggtgttacggatcaacttgatccggaaaatgcttatggatcacctgatccgtaagctcctccaagcttccctactccgacatcaacggcggaaaggacaatggtgcttacctcgacggtcgacgctgacgatgctccctcgacggtggacggtggttcgtggctcctcttcacggcaacacggctcctcttcacggtggttcgtggctgctcgtgcttcgttgtttgtggccgaggaagaagaagaagaatcaaacggagaagaagaaaaaggtagcgcgaggaagaagaagaatggctctggggaagaatcaaatgctttgagggagaagaagaatcaaaagttgtgcgaggaagaagaaaagaaactgcaacgaagaggagagagagagtag

SEQ ID NO: 73936 - DNA, 186 bp, Glycine max
  Peptide Sequence Number=SeqID_190714
atgacagcaacctcctcaacgaagaagaagaagaagtgctctgaggtgaaaagaatgaagcgcaaagaagaagcagctgatgacgacaggggcattatggacttttcacaactattgttgggtgcaccagcaaaattgttgggtgcacctagcaacactctaaaaacattagtcaaagaagtctga

SEQ ID NO: 73937 - DNA, 283 bp, Glycine max
  Peptide Sequence Number=SeqID_190715
atggggccaacaatggtggcagaagcaagaacttgtgagtctcagagccatcgtttcaaggggccatgtttaagtgacaccaactgtggctctgtttgccgaaccgaaggtttctctggaggacactgccgtggcttcagtcgcagatgcttctgcaccaaagaatatgacaattattacaagtcttccgatgtaataaggtgtaaagatggatccggaaaattcaccaaggcgcagttgaatgatgatatgtgcgattgtgttgatggcaccaatgaacctg

SEQ ID NO: 73938 - DNA, 540 bp, Glycine max
  Peptide Sequence Number=SeqID_190716
atgaagacgagggtggagatggaagtggttctgctaccccaaaatattaactcagttcatgagccaatgtgtgtaatggctgtggcaatgtctagctcattggccaagctgtcctgccatgaattaacagaccaatatgtgtgtatggtggctgatgcagcaataatggctgggtcaagagacgaggtggttgctgtcacacaaccccatatcagtggcaaacattggaagggagaagaagctaggggcaagaacaagctttttcctgatttaatgggttgcaatggttatcatcttgtacctcttgccatggtgcaattcacaagggagccagggaatctaactgcagttgcagaggcattaatactgcttcgtagtcaagaattgtacagaaacaaagcattagagaagaatagagtgccaatttggcttgattttcatacttcaaatagttggaactccaatggagcttgcggctttttttttgctgagggggagagattgttgggagttgaacaacataaatgcatttctgcataa

SEQ ID NO: 73939 - DNA, 1377 bp, Glycine max
  Peptide Sequence Number=SeqID_190717
atggcgggagtgggagctgatgagggaagaagcatatgtggttatgaaacatgtgatgtatcagacttctacatttctgacatgatcgttacaagcttaccctttgggggaaattcctttgatgatgatatcagcgaaaccaactgcctatctgattatggatctgctgagccatctatgtttactgcatctgaacagtacatgatcctgcctgctcttgaagatgatattaaagttggtacttctgatatcatatcatatgaagaagccgtgatggttcgagaaagtgctagtttgtattcagcaataggtcagataagatcctgcaaccaggagtctaatgttaaaagtgacttggataaatcagagtgctttgatcctcagtcatttatcaagaatttaccagaactatcagaaatagaagtaaatgggcagccaaccctaattcctaagcaatctccaagaagaaagtcaataactctggtgctggacttagatggacaaaaaattggtgccagatcacatttgcatcaaaaacaggaagaggccagactgcttctaggactgagatcgaggctgtataatatgagaccaaaaagttgggtccagatagcattttggacaaaaaatttggaaggtggcactgtgcacattgtccagaaaggtgttgagacatattcacatgtggtaaacaccgacattgcatacagaaatcaagctgaagaaatcatgtgtgtctggacatgtgcaagcttgaatgaggatggaaccagtggggttgggctggcctttgagggagtattccaatctggtggtcggcagcttgaatcaatgacagccagtggtggtggccagaaaagtgtgacaggaagtcgaaaagagacacttgttcattctacactggaaccctgtgatgatgcggatttcacttttactgtctttttcaatttgaaagagtacacagtatatgtaaaacagaggccttatctccacgcattcttggagagagtatcagagatgttcgaagtagtaatttttactgccagccaaagcatatatgcaaagcaactacttgatatattggatcctgatggaagatttatttctcgtcgcatgtatcgagaatcatgccttttttcagatggaaactacacaaaagatcttactatattaggtgttgatcttgcaaaagttgccataattgataattcacctcaggttttccgattgcaagtgaataatggtattcctataaagagttggtttgatgatccattagattgtgcactgatgtcattacttccctttctagagaccttggctgatgctgatgatgtccgccctatcattgcaaagagatatggtaacaaagaataa

SEQ ID NO: 73940 - DNA, 99 bp, Glycine max
  Peptide Sequence Number=SeqID_190718
atggataactgcaaagatcttacagaaattggcaaagaacacttagatcatgaaccaactatagatccagattctagggcttatggtgaattgtcctag

SEQ ID NO: 73941 - DNA, 393 bp, Glycine max
  Peptide Sequence Number=SeqID_190719
atgaggagcctagggagcaatgaattaagctgggaagtaaaaacactagctttttttcatgctcagactgtggtgcaaagaaagaggagtaagattcatggcttattcctacctgaagggaattggtgtacggatgatgaaatcctccagcaggaagttattttcagagcttgtttggtgagacagaagagctgcccagttacgaaggaggaggtctataaagctctcatgggaatgaaatcttataaagcggctctccaacctaatgggttccaaccagctttttataagatgttttgggacaagataggggatgatgttcgccattttgttaaagatgtgtttgaatcaagtatctttgatctgcaagctgctgagactatgattgtttag

SEQ ID NO: 73942 - DNA, 270 bp, Glycine max
  Peptide Sequence Number=SeqID_190720
atgaaaaagagaataaaaatacatgaaacaaaatgtggaccaccacggggaaataattttcctcagcaatttcgagagagagaagtgccaagaaggctgaaccctttcttcttcactcctccccctatttatagcaaaataggggaggagcttgccacccagctcgcccaggagagcaaggttgctttctccagaagcaacagccttctggaggaaggatctgaaggcccaagtgagccagatttctattcgtaccaccctttttactaa

SEQ ID NO: 73943 - DNA, 243 bp, Glycine max
  Peptide Sequence Number=SeqID_190721
atgaagaaagaacacagagttacagagttagtaaagataccggtttctgcgttgaatctctggtctagttgtgcagaagctcaatgtggttctgatttgggacaaattagtaaagcagagaaacagattcagaagatagggaaggacgacgaaaacgagtttactttaaaaagccgacggtgcctaatctcctcggatatcatcggccatcgttctcatcgatgtgatgaccagattatgtag

SEQ ID NO: 73944 - DNA, 462 bp, Glycine max
  Peptide Sequence Number=SeqID_190722
atgataaagaacaatagagaaatcaaattagttgtcatcagagcatccatattatcgcgccgtcctctcacccacatcatcacaccaccgccgttgagcccacaccgttatcgctcacgccgccacacacttgctctcatgcccttatttttaattatatgtcaagctctctactttgccttttatatgataatcgatgaaggttctcaaccctatatctcatttgggtcttgcggacctgtaattgtgcttagtggtactcagcctctatataacatagctgggaaggacagcatgatagaaccaggtggtggatctgtaattagcaaacaaaattctcatttctcaggcaaagataaaaccgaaccctccaattcctctgaattaaggaacaaaccaacacaaggatggctagcaagaactcccttgttgaagaaattgagagtagccagggagacttaa

SEQ ID NO: 73945 - DNA, 735 bp, Glycine max
  Peptide Sequence Number=SeqID_190723
atgacgacacttgctcagacatggagtgtcctttcttattacgatcttgcgcccacttctcacacatctgatgttaatcttgacagggcccgcttgatctacggtttggtgagccgcatggacatggatgtgggcagctttatatcacagcagatcagccagattgcccagtccagcacctcgaggctcgggttcccagcgttgattacagcgctgtgcgacattcagggggtggtttctgataccctgatctttgagtcactcagccctgcgatcaacctagcctatgtgaagaagaattgctggaaccccgccgatccatcgatcacgttccctgggcctcgccgcacacgcaccagagcttcagcatcagcttccgaggcccccctacctacccagtctccgtctcagccatcccagcgaccgcgacatccacctgcttccacctcagcatccatggacacgcatgggcagatgctgaggtcccttcacgttggacagcagctcatcatggagaatatgcacaggctgtccctacacctgcagatggaccccccgctcaccactccagaggcctatcgtcagcgagtcgcctggccaggagaccagccctccactgacaggggggaagagccttctagagtcgctgaggatcctgcagtcgatgaggacctcattgctgacttagccactgctgactggggcccatgggcggacttgggcggaggcagttga

SEQ ID NO: 73946 - DNA, 749 bp, Glycine max
  Peptide Sequence Number=SeqID_190724
atgacgcgcattctggttgccgcgtcatctcttgtcgtcgccgccttcgcgggcttctcgtattatatcgacagccttcagcatcgggtcaccaccgaagcggtggcggaaaatatcgattcttccggcaagcaggccgcccagagcatcgcgaattggctgaatggccgcatcatgctgacggaaaccgtggcaaagacgcttgccaagcttcccgaggacggtgcgaagctgcagttcctggagaatgaggtgctgaccgcgcaattcatgtccacatattttggcaatgcggaaaccggcaccttcaccaccttcccgaagacaccgctgccggaaggctacgacccgcgcaagcgcccgtggtacctggatgcggtgaaagccggcaagacggtgctgaccgagccttataacgacgcctccaccggcggcctcatcatcacggctgccattccggtctccgtcgacggcaagcttaccggtgtgaccggcagcgacttctcgctcgactccctggtcaagatgatcacgtcagtggatgccggcaaggacggttacgccttcctcgtcagcaaggatggcaagattctcatccatcccgatgcaaaattcgtcgacaagccgctgaccgatctcttcaaagtcgatacgccggtgatttcttctgcaatttcccagacggaaatcaacggcaagggcaaaatcaccagtttcattcccgttgccggcctgccttcggtcgactg

SEQ ID NO: 73947 - DNA, 165 bp, Glycine max
  Peptide Sequence Number=SeqID_190725
atggcctctggtttccatgttctgaagctatgtaactcgagtttggcctctggtaatcgattaccaatgttgtgtaatcgattaccagagaagaaaacccttgaggcataccttttaactacatgtagtggttatgggacgcattgtgttgttacccgtagttag

SEQ ID NO: 73948 - DNA, 435 bp, Glycine max
  Peptide Sequence Number=SeqID_190726
atgacacttgcagccaacaaggacagtgtgtatgacactgtttgtgaaaaatacgacattagcaaggagaaatgggtccagttttgtcagacccgcagagacccctcgtgggaggatgtgcgaaaaaaggcacaagccatccagaagcaaaacgccgccccccacgtgttgtctcgtgggggttatgaatacttagaacagaagctgatggcggagaagacaaagaaaaaactggaggaagctactcaatttggaagcactgaggtcttgattgaccctccatctcccatcagacgacacgtgaagtggaagatggcccgcaccaagaaaagtgggcagatgacgtctaaggcagcaaaggaaattgctgagaagattataagattctttggaggagcaggcgtcatagggttcctttgtcccccatggacgtga

SEQ ID NO: 73949 - DNA, 210 bp, Glycine max
  Peptide Sequence Number=SeqID_190727
atggtccaaaaggctattaatgaaggaaaactgaaattcgaggaaaaaccaatgaaagtggacatagacccatttcacattcaaggagaatcattagtcaattttctattgaagaaacaaaaagcaaataaagaggttatgttatgtcctcattgtagcctcatgtttgataggccgatggataaagcattcgaggcgtcgaaaatttga

SEQ ID NO: 73950 - DNA, 415 bp, Glycine max
  Peptide Sequence Number=SeqID_190728
atgaggagagatgcaatattagcaatgcaacatgaaaatgttgtaagaccgtcagtctttgatagaattagggaaggtccacctcttgggttcgaaaagaaaatgtcaatcaaggatcaggaggagaaagaaatgataacagactttttcgagtatggtgattatgctagagaggattacttcaatgatccttctctgagtcccaagccactccatttgactgctatggtagaggaccaaattattaataagatcttagttgatggaggggttgcatttaatatcctgccaagctctatgttgcacgtgtttgggaggacggttaaggatttgagtcctcacaatatagtggtgtcaaactttgttggaaaaccttcagattttgaaggagtgatttgcttagatgtttcagtag

SEQ ID NO: 73951 - DNA, 789 bp, Glycine max
  Peptide Sequence Number=SeqID_190729
atggttcgtccaaaattaatcttaaagccaatcccaaatgggagagatcgtgatttggctttcacgaagagaaagaaggcactaatgacgaaaatgactgaattttctaacgtgtgtggagtcaaagcttgcatgattatgtatgatggcaattatggtgatgctccaccactgacttggccccaagatgaccctattgaggtgcactccatcattaaaagattaggaagaatatggttgacaatgatatttccaaagtccaaaaaagagaccctcaagatcaaatatccaacttggcattcaagcttcaacaacctaggtgtagaggagctgaggaatttcattgataggttggactttaagcttgaagcttgtaaacaacaaattgaaatgtcgaaacacgagcatcaaaatgaagccaacttcagtttcatgcaaagcatggttcaatcagagagtgctgctccaatcccaggccaactcaatttcatgcaggaaacttctcaaaatcaattttctcttgttcctatgaggccacctaatgatggtaaccagcttgatgaaattgaagatttgactattcaacttgatgagattgtgaattggggtagtcaacctgggaagtccattgtcattgctgtagtacttgtcctcaaattcatggagatgaacacaaccaagagtcctcactttgcaattacaatggacttgtgcaatcaatgcaaccctataactatgatactgcattgcagaatattgcttctcggtcagaaaatgtgcagcaaatag

SEQ ID NO: 73952 - DNA, 330 bp, Glycine max
  Peptide Sequence Number=SeqID_190730
atggattgtcataatccaagacaaggtttgatgcctactagttttaaggttaggacagttcctttggacagtgatgattctgcaacaaaagaggttttggatcctaactttggagaagcatccattgggcgtgttgctccagttgattcaatttgggagagagttgatgtgcaaataggaattaagatgatgttgaagttatgtcttgctgatggctttgacatgttcccaaccttattagtaactaatggttcttgcatgatagatcaaaggatgggaattcatgggcatcctttggagattcagatggtagtggtattagtcaattag

SEQ ID NO: 73953 - DNA, 1227 bp, Glycine max
  Peptide Sequence Number=SeqID_190731
atggatcgaagttggatgaaagcatgtcgcataagtgatgagtatgacaatgaagttgaacaattcttgcaatttgctgaacgatatgcaccgattatccgtgggaaatatttttttccatgtgtcaaatgtgggaatgggagacgacattcactaaatgaaataagaccatatcttatatcttctcatactaacccagttgatgaagacatcgaagatcgtatagaagaaatgatacacgatcttggacaagagggttttcggcaagcacatgcacctttgtatgagcaattacaagttgattctaaaaagcctttgtatctggggtgcactagttttacatggttgtcagtgatgttagatttggtaaacttgaaggcaagacttagttggagtgacaaaagcttcactgaattgcttgttgtgttgaagaaaatgttgcctgaaaataatactttgctgaaaaatcagtatgaggcaaagaagatcttaagtcctgtgggcatgaagtaccaaaaaatacatgcatgccctaatgattgcatattgtacaaaaatcaattttccgacatgcgtaaatgtcccacatgtggtgtatcacggtacaaagccaaggatgatgaaggtagtcatcatgcaaccacaaataatgaccgtccaacaaaggtatattggtatcttccaataattccaaggtttaatcaattgtatgccaatgcacatgatgccgaaaatcttacatggtatgcagatggcagaaaaagtgatggattgctttggtatccagctgattcaccccaatggaagactgttgatcgattgtttccagattttggggatgacccaagaaactcgaggctcaggcttgcttcagatgaaatgaatccttttgcgggtctaagacaaccaagaaatgatattgatgtttatctgactcccttgattgaagacttaaaaacattgtgggtagacagggttgatgtgtttgatgggaatctccaacaaacgttcaagttgcgtgcaatgacccaaaagaaggatgcatctgacaagaacatatggaagaaaatgtcaatattctttgatcttccatgctggtctgatcttgaagttagacattatatagacgtgatgcatgtggagaaaaatgtctatgatagtttaattgacacccatcttaacattaaaggcaagacaaaggatggtttgaagtctcgtgattgttaa

SEQ ID NO: 73954 - DNA, 3363 bp, Glycine max
  Peptide Sequence Number=SeqID_190732
atgagttttggaagtagagggaagctgaaagacacaagcttgagcacatcagctgaaagcaacatgaacagcaagagggacaagatactggctcagtacagtgcagatgctgagattctggctgagtttgagcagtctggtgtgtctggcaaatcatttgactactcaaggatggttcttgatcctcccaggttagtgtctgagcagaaaatgactgcatatttgtccaaaatccaaaggggtggccttatccaaccctttggatgtatgcttgcaattgaggaatccacttttaggatcattgggttcagtgataattgttttcaattgttgggtttggagaggcaaattgactctaagcagttcatgggtctgattggggttgatgccacaacccttttcactcccccttctggggcttcccttgcaaaagctgcggcttcaagggaaatttcgcttttgaaccctatttgggtctatgctaggacaacccagaagccattttatgccatactgcataggattgatgttggggttgtgattgatttggagcctgcacggatgagtgatccggcattgtcacttgctggggctgttcagtcacagaagctggctgttagggctatttcaaggctgcaatctcttcccggggaagatattggtcttttgtgtgacactgttgttgaggaagtgcagaagcttactggatatgatagggttatggtatataagtttcatgaggatgaccatggtgaggttgtatctgagattaggaggtcagatttggagccttacttgggtttgcattatccggccacggatatccctcaagcttctcggttcttgttcaagcaaaaccgggtcaggatgatttgtgattgccatgcaaagccggttaaggtcattcaaagtgaagaattaaggcaacctctttgcttggtgaactcaaccctaaggttacctcatggttgtcacactcagtacatggctaacatgggctcaattgcctctctggtgatggcaattgtagtcaatggaaagcatgcaacaaggctttggggtttgctagtttgtcatcacacttcaccacgctacgtgtctttcccggttcgctatgcttgtgagttcctaatgcaggcttttggactgcagctttacatggagattcaattggcatcacaaatggcagagaagagaattcttaaaacacaaaccttactgtgtgacatgctccttcgtgatgcaccgttaggcattgtgaatcaatccccaagtatcatggaccttgtgaagtgtgatggggctgccttgtattatgaaggaaactgttggctgttaggcacaaccccaactgaggcacaggtgaaagacattgcagaatggctacttagtaatcatggggactcaacaggtttgactacggatagtttggctgatgctggttatccaggcgctgcttcgctgggcgatgcagtttgtggcatggccacagcaagaatcaattcaaaacatttcttgttctggttcaggtctcacactgctaaggaagtgaaatggggaggagccaagcaccatccagaggataaggatgatggaggaaaaatgaacccgagatcatcgtttaaagcttttcttgaagtggtcaaaagcaaaagtttgccttgggaagtgccggaaatcaatgctattcactcattgcaactaataataagagattcattccaagacacggagaacactggtccaaagactttaacttatgtacagaaaagtgacactgcaactggagggatggatgaactcagttcagtagcacttgaaatggtgaggttaattgagacagcaacagtcccaatttttggggttgatttaggtggcgtaatcaacggatggaatacaaaaattgctgaattgacaggtctacaggccagtgaagctatgggaaaatccctggtaaatgaaattatacatgcggactcatgtgacacttttaaaagtactctaagcagagccttgcaaggccaggaggacaaaaatgttgagttgaaaataaaacactttgggcttgatcaacaacaggaagttgcatacctcgtggtcaatgcttgcactagtagggaccacactgatgctattgttggggtatgctttgtaggtcaagacatcacttgtgagaaagtggttcaagataaattcatccagttggaaggtgattacaaagcaatcatacagagtctcagtccactgattccacccatattttcttccgatgagaatgcctgttgctctgaatggaatgcagccatggaaaggctaactggttggaaaagagatgaagtcatagggaaattgcttcctggtgaaatttttggaagtttttgtcgactaaaaggtcaagatacactgactaattttatgattttactataccgtggaataagtggtcaagattctgagaagataccatttggattttttgatagaaatggagaattcatagagacttatataacagcaaacaagagaattgatactggtgggaatatgcttggctgtttctgcttcttgcagattgtaatgcctgacctaaatcaaccctctgaagagcataagcctagaggcagggaaagcatttctgaatctaaagagttggcatatatactgcaagagatgaagaaacctttaaatggtatacgattcactcgcaaacttttggaaaatacagctgtctcagaaaaccaaaaacaatttcttgacactagtgatgcatgtgaaagacaaatcttggcaatcattgaggatacaaacttaggaagtattaatgaaggcactttgcagctaaatatggaagaatttgttctgggaaatattttagatgccattgtcagtcaagtcatgatgttgataagagaaaagaacttgcaactgtttcatgaaattcctgatgaaataaaaatgctttctctatatggtgaccaaattaggcttcaggtggtcttgtctgattttttgcttaatgtagtcagccatacagcatctccaaatggctgggtagaaatcaagatttcacctggtttaacgctacaggatggcaatgagtttatccatctaaagttcagtatggcacattctggtcaaggtattccttccaatgttcttcacgatatgtttgaaggggggaatcaatggactacgcaggaaggtctaggactatatatgtccaggaaaatcctcagtaggataagtggtcatgtccagtacgtaagggaacaaaataagtgctattttctcattgatcttgaaattagaaaaagaaaagaaaggaaaaggaacttgcatgcagagacaagcatgttaagttag

SEQ ID NO: 73955 - DNA, 225 bp, Glycine max
  Peptide Sequence Number=SeqID_190733
atgatcttcttcttcaagaaacatcgtctgagctctcatggagcatcgatcgagtgtgggcgtaagaggacatatagaactgcacccgctagtcaggggagcagtcgttgctacccatcatgcgacaaaggtgctcgtcgacacgaagagcctgggccatgccttgcgtcgttgactatggttgaatgtggtggtgtaagttgcagtatcctagttcctctatga

SEQ ID NO: 73956 - DNA, 548 bp, Glycine max
  Peptide Sequence Number=SeqID_190734
cttcggtgaaggtgtcggtgtttgttgttgctgtggttggttcgtcgtcagcgacatacgagatggacggagatcaatggatgtatgacagtatgatgtctgaagaagttgatatggattatcaaaatgaagaagaatgtggtgtgaatgaatcacatgtgtttgacagccgagatgatgttttgcagtgggctcgatccgttgctcatgaaaacggatttgtggcggtgattataaggtctgacacaaacactggttgtagagaaaggatttcgtttgtgttaattggccgtgaaaggagtgccgagtataggtgtaggaagaaagaatttgttagaagagatactgggactaggaaatgtgggtgtcccttcaatcttcgtgggaagccattgatgtgtgggattcataatcatgaattggccaagtcattagttggatatccatatgctgggcgattgactaaagctgaaaagacacttattgctgatatgactaagtcaatggtgaaaccaagaaatatcctgttaactttgaaggagcattga

SEQ ID NO: 73957 - DNA, 327 bp, Glycine max
  Peptide Sequence Number=SeqID_190735
atgggtgaagtagaggaggtacaagagaagatgaaggccgacatggaggccatgaaagagcaaatggccacgatgatggccatgatgagcatgaggaagataatggaagccaatgcagttgtagttgccgctaccagcactgttgctaagattcaaaatgagcacgccttcccgccatacggcttgccacccaatgtggcatacactcccaatgagaatgtcaataactccactcctttacccattgagagccaacaaccccgaactatcatgcacatgtcttttaaaccgtgggggagacacatgaaattccccaccacaatctag

SEQ ID NO: 73958 - DNA, 2709 bp, Glycine max
  Peptide Sequence Number=SeqID_190736
atgaaacgacaccaatgggagaagaacgcttacctctacggtcaacggtggcgtaggttctgggtgcacgtcctcaatgcaactcctcaaagcaactcctcaatgcacggacagacacggcagtgcaacgaccacgacagcgaagcaagaagagcagtggcgcaggggctaaagaagaagaagaatatcaaaagcgtaggaaatggaagcgctgggtcaaaactaatgcacacagcaacaacaagcatctgcaacaataataatgttatggcaaaaccagagaccctagattctctcacaacccagttggaatctttgttccgggcttgttcggatgcttccatggttcagcaagctaggcaggttcacactcaggtcattgttggcggcatgggtgatgtttgtgctccgagttcaagggttttggggctgtatgttctttgtggtaggtttagggatgctgggaacttgtttttcgagctcgaattgcgctatgctcttccttggaattggatgataagagggctttacatgttggggtggtttgattttgccttgttgttttacttcaagatgttgggtagtaatgtttcacctgacaaatacacgttcccttatgtgattaaagcctgcggtggtttgaataatgtgccattgtgtatggtggttcatgatacggctcggtccttggggtttcacgtggacttgtttgctggtagtgctttgatcaagttgtatgctgataatggctatattcgtgacgccaggcgggtgtttgatgaattgcctctgagagacaccattttgtggaatgtcatgctccgtggttatgtgaaaagcggagattttgacaatgcgatagggactttttgtgaaatgaggacctcttatagtatggttaattcggtgacgtatacttgtattttgtctatatgtgctacgagagggaatttttgtgctggtactcagcttcacggtcttgttattggtagtgggttcgagtttgatccacaggtagcaaacacactagttgccatgtattcaaaatgtgggaaccttttatatgcccggaagttatttaatacaatgccacaaactgatacggtgacttggaatgggttgattgctggatatgtacaaaatggatttacagatgaggctgcacctttatttaatgctatgatctctgctggtgtcaaaccagattcggtcacttttgcaagtttccttccttctatcctcgaatctgggagtctcagacattgtaaggaagttcatagttacatagtgcgacatagggtgccttttgatgtctatttgaagagtgctcttattgacgtatacttcaagggtggagatgtggagatggcacgcaagattttccagcagaatattttggttgatgttgcagtttgcacagctatgatctcgggttatgtacttcatggactgaatatcgatgctataaacacttttaggtggttaattcaagagggaatggtgactaattccctaaccatggctagtgttttgccagcttgtgctgctgtggctgctctgaaaccagggaaggagttgcattgtcatattctaaagaaacgattggagaatatagttaatgtgggatctgccatcacagatatgtatgcaaaatgtggaagactggatcttgcttatgaatttttcagaagaatgtctgatagagatagtgtttgttggaactcaatgatttcaagcttctcacagaatggaaaaccagaaattgccattgatctttttcgtcaaatgggaatgagtggagccaagtttgattctgtgagcctatcatctgctctctctgctgccgcaaatttaccagcactatattatggtaaagagatgcatggctatgtgattagaaatgcatttagttctgacacttttgttgcaagtacactgatagatatgtattctaaatgtggaaatctagctttggcttggtgtgtgtttaatctgatggatgggaagaatgaagtttcatggaacagcatcattgctgcctatggaaaccatggttgccctagagaatgccttgacctataccatgagatgttaagagcagggattcaccctgatcatgttacatttcttgttataatatcagcttgtggccatgcgggcttagttgatgaaggcatacactactttcattgcatgactagagaatacgggatcggtgctaggatggagcactatgcatgcatggtagatttgtatggtcgtgctggtcgtgtgcatgaagcatttgataccataaagagcatgccatttactccagatgcaggtgtttgggggacattgctgggagcttgtcggctccatggcaatgttgagttggctaaactagcttcaagacatcttcttgaattggacccaaaaaattctggatactatgtattgctttcaaatgtacatgctgatgctggcgaatgggcgagtgttcttaaggtaagaagtttaatgaaggaaaaaggagtccagaagatacctggatacagctggattgatgttaatggtggaacccatatgttttctgctgctgacggaaaccacccagaatctgttgagatctatttgattctgaagagtctccttcttgagttaagaaagcagggttatgttcctcaaccttatcttccacttcacccacaaatcatgggcaagaattga

SEQ ID NO: 73959 - DNA, 129 bp, Glycine max
  Peptide Sequence Number=SeqID_190737
atgtgggttattcaaagggcttcaaggattaacattgaaatgatcttgatggatgagaaggctcataagattgttgctcaaattaaaaatgttgatcctggtaaatggaatgatgttaaagtgggttag

SEQ ID NO: 73960 - DNA, 231 bp, Glycine max
  Peptide Sequence Number=SeqID_190738
atggctgatcatgatgaccttttagcttcagagatggctgagcgttcgacccctccaactgctgtctccaacactgctaatgtgttaccaccttgcactcgaggtcgtagaaatcagtctcgtgtttggactgttagtatagttatttttgctgtgtgcttaaggttgaatgacacaatcaagcaaacaaagggtctgaaagggattgtaggccaacaaataggaaagtga

SEQ ID NO: 73961 - DNA, 734 bp, Glycine max
  Peptide Sequence Number=SeqID_190739
atgtcgcttattggaaaacatctacagtttttaatagatagagaaagtgctgaaggaagatgtcttcgagatgctgttaattatcttaatggatatatggtacattatatctgtcatgacaagcaagtgctaaggatgtttcatgccaaggagttcataacaatggcacaagagttaggtgcaaagatagttgcacacaaatcatcaattgaaaatgctaagatgattattgcacaacctgctccacttgtagtgttaattgaatggattaaaaagcaaaaagaggacctaagatatgaaggaactgttaatgtagttggaacaagtggcaacagccaaagaaattttcaaatggcattagcagatgtcactaatactcagccaaacagtcaacacgtgccaaccagacaaaggaaaactatcaataacatatgtaggcttcatagtaatttgtacaatgactttgtggctgcatcttcaacttctactggactactaaataatgaaatccatgatcattcctttgtacctcaacatgcaaatgatccacttcatcatactaatgaagcctctttagataacaatactgaaaatgcagaaacatatgacagtgtactagatgatgagaatgagctatcagattatgttgatgattctactcatgacattagcacaggatatgttgatctaggcgacccttatgaagcatgtgcatattgccaagttgctatgtg

SEQ ID NO: 73962 - DNA, 114 bp, Glycine max
  Peptide Sequence Number=SeqID_190740
atggaagatgcgaccaagacagattttcagaacccgccctgcccccctcatttcttggatgttgtcatggacttgggtgattgtagaggccatcaaactagtttgcatcattag

SEQ ID NO: 73963 - DNA, 243 bp, Glycine max
  Peptide Sequence Number=SeqID_190741
atgaaaacattactatgtctcctaatcctaagcttatgtctcctaatcctaagcttttgtctccccgaggatgcttttttcaaaagaaataaaggcacatgtaatggtggtattcttccacattattggggatttggagttgaatcacgtgaaacatcgtcagacattcttgatccttttgttatagaacaaggatggaaggacattatgtacttcaacaccaaaatatggaacaggaaataa

SEQ ID NO: 73964 - DNA, 954 bp, Glycine max
  Peptide Sequence Number=SeqID_190742
atgggcaaaatttgcaaaaagtcgccgaacccctacttggcagaaaaaaaactattggaggaaaaaaggaagacacgagaacaacaagcagaatttactgaaaattcttcattgagtctcgacccaccatcattggtttcaagacatgtgaagtggaagatggcccgcacaaggcgatataggcagatgacctctacagcgacacaagaaatatcagacaaaattggactagtgtcacaattagccagtactttggacagacatctcgtggctcaaatagttcttgtagaggaagaaaataaaaacttacaggaagcatggaggaggacggtagaagaggaacaattgagaaaagaagtagaggaagaaaataaaaacttacaagaaacgtggaggatgacggtagaagaggaaaacaaacgcagtttggaattaattaaacaacagttgaagcaagcaataaaattagagttatcccaaattgcatcacagcactcaccgccacttgagccacctgatatacaagtggtagttgcaggtgtgagcaccaaggggagctgtgctgaagcttacacaattccattagctaaaaagccttctgatctgcacatcgacattatgggcttgtacgtagttcatgaccagtgtactaaactagttgcattaggaaaagtgtatgacagtgcgtttaccatacacaatatcccttatgcagatgatgtggttagggtgagtgttgtcaaagtttaccacggtgacgcttatgggtccccattgcagttactttttgtgcatttatatctcaaggaaatttcaatgggggtttatcggaaagcacaccagatcgtcaagtatttaaaattaaaacggatgaatccgagtatcgaacacagagaactaatgttagccaaaattaagttcagaattgaagcattgttgatagaacatgtataa

SEQ ID NO: 73965 - DNA, 498 bp, Glycine max
  Peptide Sequence Number=SeqID_190743
atgtccatcaagtatttattcaagtacattaataaaggttatgatcgcataaccacgacttttatgcctgtccaaaatgaagatggaacaactgaacagattgttgataagatgaagcattatcttgatggcttcttggttgatgataaggaatatattgagactttaagaggagcatgctattggggttctggccaattccttagaagattgtttgtaacaatgctcatatcaaatagcattgagagaccaaatcatagacatatctttggtagtatcatcaatgttgtcaatagacaggctggtggaatgtttttcctgtatcggtatggaggtactaggaagacttttatgtggaagacattagcttctgcattacattcaaaaggtgatattgtgttaattgttgcctcaagtggcatagcctcattgttattaccaaattctaacctcacattgacaaatgcacaagaaatcaagagttttcccaatggctga

SEQ ID NO: 73966 - DNA, 1230 bp, Glycine max
  Peptide Sequence Number=SeqID_190744
atggagcctgttccaagtggaaatttgcctcctggttttgatacgtctgcatgccgtagtgtttatgtaggaaatattcatgtaaatgtcaccgataaacttcttgcagaagtttttcagagtgctggtcctcttgctggctgcaagctcataagaaaagaaaagtcctcgtatggttttgtggactaccacgatcgagcatctgcagcccttgcaataatgacattgcatggacggcaactttatggtcaagcacttaaggtgaattgggcatatgccaatagcagtagggaggatacgacagggcacttcaatatatttgtcggtgatttgagtccagaggttactgatgcaactttatttgcttgcttctcagtctatcctagttgttctgatgcaagggttatgtgggatcacaaaactggtcggtcaaaaggatatggttttgtttctttccgtgatcatcaggatgcccaaagtgccataaatgatatgacaggtaagtggctgggaaataggcaaatacgatgcaactgggcaactaagggtgctggtggcagctccaatgaagagaagaacaatgacagccaaaatgctgttatgcttacaaatggatcttcagatggaggtcaagataataacaatgaggatgctcctgaaaacaatccttcatacaccacagtttatgttggcaaccttcctcatgatctgtattggactgcattttgcagtgtgtttgatgtaacacaagctgaacttcattgtcagttccacgcactgggggctggggtgattgaggaggttcgagttcagagggataagggttttggatttatcagatacaacactcatgacgaagctgctctggccattcagatggctaatggaagacttgtacgtgggaagaatatgaagtgttcgtggggtagtaaaccaactccacctggaacagcttcaaacccactacctcctcctgctcaaccatatcaaatacttcccactgcagggatgaaccaagggtattctcctgctgagttgttggcttatcagcgccaactggccttgagtcaggctgctgtatctggtctttcaggtcaagctcttctgcaaatgactggacaacatggcctagctcctgcttccatgggcataaactctggggcatctcaagccatgtatgatggatataccggtaattcatcgagacagcagcttatgtactatcgttaa

SEQ ID NO: 73967 - DNA, 273 bp, Glycine max
  Peptide Sequence Number=SeqID_190745
ccactggagtggcctctagaactacctccggctgaggctctggctctaactgaggctcttgggctgcgaaagcctcactttcccccaaaggagaaggctagactcctggtcaggcataagccacggtataggctctgcagcatcggctctgtgacctctgagcattggcactatgctggaactaatgatggtggagcagagggagttggagtagaagtagaagcagggggagcaggagcagaagaagatgggccctcagatcctcgagcttga

SEQ ID NO: 73968 - DNA, 307 bp, Glycine max
  Peptide Sequence Number=SeqID_190746
ggccatagagaaaggcacttttgctgagatgttggatccatcagtggttgattggccaatggaggatgccatgaagcttgctaagatgggactgcagtgtgccgaattaaggcgcaaagacagacctgatcttggcaaggttatcctaccagaactcaacaggctaagagaccttgctgaagataataatctcatttcagttttggataactctatggatgcccctcttgcgaaacaagtttctgtgcatttggatggagggggtccatcatttactcagtcgagggaaattagagcaaacaattca

SEQ ID NO: 73969 - DNA, 1374 bp, Glycine max
  Peptide Sequence Number=SeqID_190747
atggaaactggcactcctcctgaattctcatccctctcatttgagagtgacaggcattcatcttctacatcacaagccgtggatgacatggaggctgaaatgaggagattgaagttggaactgaagcaaaccatggaattgtataacactgcctgtaaagaagcattcacagcacagcagaaggcagtggaacttaagaagtggaaactagaggaagagaggagactggaagaggcaaggcttgctgaggaaacagcactggcagttgccgaaaaggagagagcaaagtctaaagcagccattgaggctgctgaagctcaaaagaggattgcacaactggaagcacagaagagactcactgcagaaatgaaagcacttagagaatcagaagagaaaaaaaaagtgcttgatgctttagtaaatgtagatatcaggtatagaaggtacacaatcgaggagattgaagctgcaacagatttttttgcagaatccctgaaaattggagaagggggatatggtccagtttttaagtgccttttggatcacacacctgttgcagtcaaggttctacgccctgatgcacaacaaggaagatcacagtttcaacgagaggttgaggtgttgagctgcatacggcatccaaacatggttctcctcctaggagcgtgtccagaatacgggtgtctagtgtatgagtacatggcaaatggaagcttggacgattgcctctttcgacaaggcagcactcccccacttccttggcagctaaggttcaaaatagcagctgagataggcacaggcttgctgttcctgcaccagacaaaaccagaacctctggtgcacagagacttgaaaccagccaacatcttgctagacagaaactatgtggccaaaatcagtgacgtaggtttggccaggctagttccaccgtctgtggcggacagtgtcacgcaatatcacatgacatccacagcaggaaccttctgctacatagatcctgagtatcagcagacagcaaaatcaccaatgggtttgacccatcatgttgaaagggccatagagaatggaatttttactgagatgttggatccatcagtgcttgattggccagtggaggatgccttgaagcttgctaagatgggactgcagtgtgccgaattaaggcgcagagacagacctgatcttggcaaggttatcctaccagaactcaacaggctaagagaccttgctgaagataataatctaatttcagttatgggtaactctatggatgcccaccttgagaaacaactttctgtgcatttggatggaggtgtccatcatttactcggtcgggggaaattagagcaaacaattcagtcggttttttactag

SEQ ID NO: 73970 - DNA, 1683 bp, Glycine max
  Peptide Sequence Number=SeqID_190748
atgttttgcatcccacataaaattggaaaaaaagactcaggatttttaaggacattggattctagcattaagcgcaacactgctgttattaagaaactgaagcagattaatgaagaacagcgtgaagctctgatggacgagttgcgaagtgtcaacttaagcaaatttgtcagtgaagccgtggctgctatatgtgatgccaagcttagaagttctgatatacaagctgcagttcagatctgttctttgcttcatcaaaggtacaaggactttgcaccaagcctggttcaagggcttctgaaagtcttctctcctggaaaacctggtgatgaatcagatacagacagaaatttgaaggcaatgaagaagcgcagctctctaaagcttctactggaactcttttttgttggagttattgaagatggtggcatttttatcaatatcataaaagatcttaccagtggggaacagctaaaagatcgggatgctgcacaaacaagtttgacccttctttcgagttttgctcgccaagggagaatttttcttggactttctgttagtgggccggaaattcatgaagagttttttaaaggccttaacatcacagcagatcagaagaaagttttacggaaagcatgctattccttttatgatgctgcagctgaattacttcagtctgagcattcttcacttcgcttaatggagcatgaaaattctaagattttgaatgcaaaaggagagctcagtgatgaaaatattgcttcatatgaaaagcttcgtaaatcctatgaccatttgtaccgtaacatctcatcattagcagaagcacttgatatgcagcctcctgtaatgccagaggatggccacacaactagggttaccagtggtgaggacggtatttcttctgcttctggtaaagattcttctgttgttgaacccatatgggatgatgaagatgcaaggactttctatgaatgtttacctgatcttagagcttttgttcctgctgtgcttttgggagaaacagagcctaaaagcagtgaacaatctgcgaagaatcaagaccaaacaactgaaatattacctgaatcagacaaaggtcaacagaccacccatgaaagtggagaggtctctacagagtctagtgctttgccagaggcagaaagcacagaaagagtgaaggataaggaggaaaaagacaagtctaaagaattggacagagagaaggaaaaagaaaaagaaaatgacaaaaagggagaaaatgaaaaagacaaactcagaagtgttgaagggacaaatttggatgctctactgcagaggcttccgggttgtgtgagccgggaccttattgatcaattgactgtggagttctgttatctaaattcaaaatcaagtcggaaaaagcttgtgagggctttgttcaatgtaccaaggacatctctggaattgttaccatattattcacgcatggttgccactctctcaacttgtatgaaggatgtctcgtccattcttttgcagatgttggaggaggaattcaacttcttaataaataaaaaggatcagatgaacattgagacaaagataaggaacatcaggttcattggagaactttgcaagttcaaaatttcccctcctggcctagtcttcagttgtttgaaggtacaagagattaataattga

SEQ ID NO: 73971 - DNA, 330 bp, Glycine max
  Peptide Sequence Number=SeqID_190749
atgtgtgccacttgtgccattgatgatggtaatggtagtaatagtgatgacgataacggtgttgacactagtagtgttagtagtagtgttgatggtgataatattagtagcaatgataagaacaatggtaatgatgacaatgttaatgacgatgataatgatggtgcatgtgaaagtaataacaatgttagtgatgataataataatagtgacaacattgataagagtgataacaacgaccataatagtaattgtgatattagtgatagttgtggtgataacgataataattgtggtaacaacaacgatattatgaattactataattga

SEQ ID NO: 73972 - DNA, 704 bp, Glycine max
  Peptide Sequence Number=SeqID_190750
atgtggttgccaaagcatcactcagagaagaaggatggtgtgaatggattagtcgcagtggcaattgataaagaaaaagggagtcaaaatgcactaaaatgggcagttgacaatctcctcacaaaaagtgcaactgtaattctcatccatgtcaagcttcttgcacctattctatctccatcaccttctctttttaccccaaggataagtgctctccttggtgatgatacttcactggtatctaaagaacccgaaggcaataacaaaaacgttttcctcccatatcgtgtcttctgtacacggaaagatatacaatgcacggacgttctactagaagattcagatatatcaaaagcactaattgaatatgcttcccaggcgggaattgagcatctggttcttggctcttcaacaaaaactagcttgctcaaaagattcaaggtatcagatactccaggagcagtttcaaaaggggcaccagatttctgtacagtctatgttattgcaaaaggaaagattcaaacaatgcgatctgcttctcgtcctgcaccggccattgtccctaacctgctcagtcaagctagtgtcaggaaagattcagacccaaatgttctattagctcaaagcataaaagaacaagaaacacgtcattcctttgatgctgcactaccgcgtagatcgcaggatgaatcagaaacattcag

SEQ ID NO: 73973 - DNA, 423 bp, Glycine max
  Peptide Sequence Number=SeqID_190751
atggacgaagatcagtggatgtatgacaatacaatgtttgaagaaattgatatgaatgaagaaaatgaagagaaacctggtgtgaatgaagagaatggagaggaatctagttgtgaaaggaatggaaaatatagagtcaggaagaaatatttagtacgaacaattactgacaatagaaaatgtgggtgtccttttaagctgcaagcgaaactagtggtgggaggtgaaggatggatgatgaagttaatatgtgggagtcataatcatgtattggctaagtcattagttggacatccatatgttgatcgattgactaaggatgagaagattattattgttgatatgacaaagtcaatggtcaaaccaagaaatattcttctaacattgaaggagcacaatgccaacagttatacaacaatgtga

SEQ ID NO: 73974 - DNA, 1929 bp, Glycine max
  Peptide Sequence Number=SeqID_190752
atggctaacatgttggagatactgatgcggttgaaaaatgtaaaaaacttggatccgagacatagcactttggtggagaatgcatactacctttgcaagccaccagaaagatctgcacgagtagctaaagttcgtcctccattgcatcagtatatcagaaaattacttttctctgatcttgataagtctaccattgagcatgtgctgaggcaactccgtaagttaccttggaatgaatgtgaaccatatcttttgaaatgcttcatgaaggtctacaaaggaaaatatggtcagatccacctgattgcatctcttgctgctggattaagtcgctatcatgatgagtttgctgtagctatcgttgatgaggtactggaggagattagagttgggctggagttaaatgactatgggatgcagcaaagacgcattgcttacatgcgattcttgggggagctttacaactatgagcatgtagactcatctgttatttttgagacactatatctcattctcatctatggccatgggacacaagagcaagatgtactggatccacctgaagattgttttcgcataaggttgatcattactctgcttgaaacttgtgggcattactttgatcgtggctcttctaagaggaaacttgatcgattcctaatacacttccagaggtatattttaagcaaaggggcactgcctctggacatcgaatttgacttacaggatctgtttgtggacttgcgtcccaatatggttcgtcacaattctattgaggaagtgaatgcagctctcgtagaactcgaggaacatgatcgaattgtttttgctgataaggccagtagtgaaaaacattctgacactgagaagtctttaagtaggaccacttccactactacagtggttggcaatggacaaagcattgataatggtatggaagaaaatggagtgcaagatgataatgacagtgagactgattcagggagtgacacaattgatgttgagggacatgatgatgaagagttggatgaggagaatcatgatgatgggtgtgaaactgaggatgatgacgacgacgacgatgatgggcctggacctgcttctgacgaggaggatgaagtccatgtgagacaaaaaatgacccaggtggaccctctggaagaagccaattttgatcaggagctcaaggctgtagtacaggcaagggagagtatggaacagcgaaggcaggagctacgaggtcgtcctacattgaacatgatgattccaatgaatgtatttgagggatctgccaaggatcaccatgggaggggagttggtggggaaagtggtgatgagcccctggatgaggatactggaggaaacaaagaggttcaggtgagagttcttgtgaagcgtggaaacaagcagcaaacaaagcagatgttcatcccacggaattcctcactggtgcagagtacaaaacagaaagaagcagcagagcttcaagagaaagaagacatcaagaggcttgtcttggagtataatgacagagaagaagaggagcttaatggattagggacccaggcaacaaactggatgcagagtgtaggttacaagggtggtggccgtggcagcagtttggaaggaaacagtggcaggggtagtggatcaagacatcggcatcataattattctggcagtggaatctattacagtagaagaaatgttggagatgctggcaggggttatagagtggtgtacacaccactttggtttcctgatcttaagctgacatgcaggatctatctgtatggagctaaaatcacaatgtttggttttggtggtgtcaagttagccaaagactgctcaattggagatctagctgaagattgtaccatagtttgccattgggaatgtgttaagctttttcttgtagaaactccttag

SEQ ID NO: 73975 - DNA, 177 bp, Glycine max
  Peptide Sequence Number=SeqID_190753
atgacggcgacagtggcagcggggagtgacaacgacgacaaaggcaccaacgatggggtgttgacggcacgacgtgaagaagcaaaaatgaagaaagagtgcaccaacagcggggtaggcaattatgctgggtgcacgaagcaattgccttcatatacacttctatttgatatttga

SEQ ID NO: 73976 - DNA, 1032 bp, Glycine max
  Peptide Sequence Number=SeqID_190754
atgaatgctgagattcaggcattagaagctaatcatacatggacacttactgatcttcctccaaataagactgtcattggtttcagactattacttgctctagctgctattaacaaatggcacttaaggcagcttgatgtaaataatgctttcttacatggagatttaaatgaagaagtttacatggtgattcctcaaggtatgaatccaaaaaagccaggtttagtgtacagacttcaaaggtctttgtatgggttgaaacaggccagtaggcaatggtatgtcaggttatccttttttctaatatctcatggttacaaacaatgtgcttctgactattctttatttctaaaacatcaacacaattatatcactgctttgctagtttatgtggatgatatagtcttatctggaaacaattttactgagattcagaatatttcacacctattggataatgctttcaaaattaaggatttgggtgatctaaggttctttctaggctttgaagtggctcgtacttctactggtatcaatctttaccaaagaaagtatgcattagatattcttactgatactggcatgttgggttccaaactagtatccactccctctgattacactaccatattgcatcaacattctagttctcctctctcagctgaagatgcctcttcttataggagattgataggattcaatgtttgtcttggttcttctttaatttcatggaaatctaagaagcaagctcctgtttctagaagctcttcagaagttgcaatggctaacctttcttcagctttacatattgcttcaaatcctgtgtttcatgaaaggaccaaacatattgaaattgatttccatatcattcaagagaagatccttgtagggcttgtcaaattgcttccaataacttctgccaatcagcttgtagatatatacaccaaagcactcatgcctggtgcttttcagttcttatactccaagctaggaatgtccaacatccattcccatcttgaggggggatcttag

SEQ ID NO: 73977 - DNA, 975 bp, Glycine max
  Peptide Sequence Number=SeqID_190755
atggaaaagttggacccggttgagcaaccaacccaaagcccttgggcttggtccggttggtatagagagggcccgtgtctgataatgagagaaggcaacattcccgcgcgcgctccacttggcgattcagtgccactctcactgcgttcaggaaccacggattctcgtcgcacccgttgttcttatgcaagtgcagatcctggtactgatggaaatggtctgggacagatgatatcgctccgccatcccaaatctggaaatgcaacacaatatctgtttgtaaatggaatgcttcaggaacttcagtggtttaagaacttgtatggatcttggtttttgggagattatataactgaagatggtcggatgtatttatccacaccaattgatcctgttttcatcatgttgcctatatttgaggaagctagaatgaagaaaggggatgatcttgggaggttcaggcaactggatgagatattgtttattgatgggtatccaggatatatgcagttgatgtctgttgtggagaactgtatgctagtagtttctgaagtcaaagaaattggatcttcaaaatttttcagacttgatgactcaaaggttctacgttggctgtgctataaggtttgtcagctaaaacagacactacccaaattggacaaaaactatgctgttcaatcagagaaagacacattgattgatgcagtctccatattaggagagtatttgaaggaaaagccttggttgcagcttttgtgtgaccatcttaagttaaatatactcgaggttactggaaaagcacaagtaaatgccgaagaaagtaacccaggtttacgtaatgaattacaggaacagagtaatgataagaaggctacaactgcaaagaaaggtagacaagcaaagaaggtaaaattggagacagaatcacacaacatcaaagacatgttttcgagggcctcccgaaagaaaaactga

SEQ ID NO: 73978 - DNA, 1425 bp, Glycine max
  Peptide Sequence Number=SeqID_190756
atggttttggtgatagcttcaaattcaataatcaatcaaggctgtagtatggcagagaaaagcataaggtgttctgtgatatctagaagtaaaagtgatgtaacagcaatgagggacacgcttcttgcgcagcagcaacttctggaaaagctatatgctgaattggatgaggaaagagaagcttcagcgaccgcaacgagtgaagcattggacatgatactgcgtttgcagggagagattgccgtggtgaagatggaggcaagacactacaagagggtggcagaggagaagataggccatgctgaggcctctcttgaggcttttgaggaactaatgtatcagaaggaaatgcaaattgcgtctctcgagtttcaagtgaaggcttatagacacaaacttatgagcttggggtgtgaactccaagaggatcttctgctattgaataggagcgatcaaagaaatggagaaaatgggggtcagagtagctctgttagaaggctgcaatcaatgcctgcaattcagtttctgagttctttaagagctgctgcaaagaggggaagatcacctagtccagttcttgatgtgatccctaagataattgaggagagtaatactgacaaagaagttgatcaacctggcagtggaactcttgattcatatttgaaccagataaaggagttgaatgaacaagtgagggtgatttcagattgtgctgaaggagaaaagagtgcaaatttgagaagtagaagagggaggtcttgttcaattttaccacatgctagtgctaagatgacatgtgatcaaacacacagattgatctctactaacttagatgaagtgagtcaaggtgaaagtacatacaatagaggagttgctaatgattcttctcgcttgcttaatgttcatgatgtgtatgaagtcccacaaactagtgaagatcatgaggtcagtgaacatggggaaaagagggttgagaattggagttctgatgcagagaacaacagattaacaaaaccagattctgtgtctgagggaatggttgaatcacctcttaaaaatgatgcagaaaagaaaaaaggtgtgtttaaagtacatggtgaaatcaaaactccttgtcttaaagatatgatgatgactatcattggccagaagaaaggggggatgtgtgtggattgcaattctcaagccgagtttcaaaagctgaatcagagatttgagaggcttgagagggagagaattagtgcaaggcaagagattatcaatgaagggaatggtgaagagcagttgaggctgttaaaggacatacaaagtcaactccaaatgatacaatcagggatgagaagcttgaaaaccaaagaagtcactcctaaggatgatgtgtctttggcttctctccaagaggcaatgttgcacttttggctttga

SEQ ID NO: 73979 - DNA, 594 bp, Glycine max
  Peptide Sequence Number=SeqID_190757
atgtttcaatctcaaggcataccttgtagacatatactttgtgtcctaaaagggaaaggtttaactaagataccgagtagttatattgtgaataggtggacaaaattggcaaatagaaaaccgatttttgatattactaacaatgtcctagacacgttttctaagtcagaaaatgagagtaagctcatatcagatgtatggggacacactactaaaaaattgttcttttacgacgcacattctaagaaggagaaccaagagtctgatctacgcccggcagtggagcggcggttccaacagcactggttcctcgtcgccgacgatgttgccggctcatcctcagtcgcgcctcggtacaattttcgtcaccggtctctccaccgtcaagcgcacgcaaaacgtggcagtgaaagccgctgcatagcgacttactcacgtgatggcgtctcagaatatcaccgccaacgacagagaggacgcggcggtttcagttcaatatcagttggaagaccagcggtttcagttcgcttgcttgcaggtgcgcggcttctatgttttcgattacgcttcgtgtctaaaccgtttgatttgtga

SEQ ID NO: 73980 - DNA, 618 bp, Glycine max
  Peptide Sequence Number=SeqID_190758
atgctcggcatacgactgccgcgggcggttgggggtggtagagtactggatacggtacatccgcgccagctggtagagctcgtcgcacagcatgcggaacagcatctggttgccgctgcctttgacgatacggtagtggaaatcgtagtcgccttcctgctggtagtagccgatgccggcctggaaggcttcgtctttttcgtgggcgtgcagcacctggcgcacttcctcgacttccgccggcgccatgcgttcggccgccaggcggcaggccatgccttcgagcgattcgcggatttcgtagagttcggccagttcctgcgggctgagcgagaccacgcgggcgccggcgtgcggcacgcgcaccagcaatcgctggccctcgagccggtgcagcgcctcgcgcagcgggccgcggctgacgccgtggatgcgcgccagttccggttcggaaatcttgctgcccggggcgatctcgcccttgacgatggcggactggatcttgcggaagatctgttccgccagggtctcgctgtcgtcgtgcgcggagctcggcagcgtcagcactttgctcattgtgtcaacaatcggatggttttttgggtgaaaacccgataa

SEQ ID NO: 73981 - DNA, 657 bp, Glycine max
  Peptide Sequence Number=SeqID_190759
cttggtctggtcagcttgagctggcgcgtctgcgggtcggtggtgatgcccaggtcggccagcgagcggacggtgccttcgcccagcacggcctgcagcgcgttggtcacggacgactggatcgagcgcgtggtgccgtcgccggtcagcggctggttggtggcggcctttgcgtcgaaggccgtcaggttcttgatggtcgtctgcagcgcgttgtaggtcttgacgaagtcctggatggccttgttggcgaccgacgtgtcggattcgagcttgagcgtgatcggcttgccggcctcggttttctcggtcaggttcagcgtgacgccgtcgatggccttggacacgttgttcgaaccgctcttgaccgtgatgccgttgatgaccacttcggcgtcttcggccttggtgttggccatgccggtggtggtggtgccgtcggcggcggtgctgaaggacaggatgtccttgagcgactggtcgccggtgacggtgatgttcttgaccgaggcctggacgccggtgtccttggccgtcagcatcaggtagttgttgccgttgccgtcgttgatgacggtggcgcgcaggccggacttgtcgtcggcgttgatggccttgacgatgccgttgagcgaggtgtcgcccttcaggtcgatg

SEQ ID NO: 73982 - DNA, 258 bp, Glycine max
  Peptide Sequence Number=SeqID_190760
atgaggatcaaaaggtcttttaaggttgtaatggggccaaggacaaggcttgtagtgagcttcaaaacaaggaaagggaaacaaggctcaaaagggctatcaaaggaattaagtcaaggtaagtccatttggctagaagcttataagaacaaaattgcctcaatcatttccaaatatgcatgtgaattaggaagcaccaacaagaatcaagccaaggctattgtgcaagcaatcaatggggcaaaacacaccaaatga

SEQ ID NO: 73983 - DNA, 266 bp, Glycine max
  Peptide Sequence Number=SeqID_190761
ttagtctctccagacttgagggtaacataatatttcttttgcatattgtcgcaacgtgcccttcgcgggcgagcgaggcaaggctcatgggtgcgctttccaaaggaggaaagatgcgcagagtcgccaccaacgaaggtattagcacctctcacgtcgacaaaagcggggcttttgctcctacgtacccttcatcgaagaggaaatcagacctatgtagttctttcttaagcgtgaatcaagcgattcttttacttgaagggtga

SEQ ID NO: 73984 - DNA, 294 bp, Glycine max
  Peptide Sequence Number=SeqID_190762
atgacctacaaattgatcattcaacatcgtcaaatctacatcggttattggaaaaccaatatagtcgtcgctctccctccgattccatttttggctcctcctctcgctcctcttccccctccgactcccgttcctcctctcacccacgcaccctttctcggtcccgctctccctcgtgctccaaatcctcttcccccttatcctcttcttcgtcccgaagctcacgcagccgcaatcctcccccgcagaggcgtcgaaggtaccgctaatttcctcgattggagagcaatttga

SEQ ID NO: 73985 - DNA, 480 bp, Glycine max
  Peptide Sequence Number=SeqID_190763
atggggtcctttgtgccatttggtgggttcttttctacaccttctgagttcaagagtcccctaagctgtacgaatgcttcatctttaagtcggtgtgactcatgcaatgaaaagtgtgagcaagaagttgctgatattttgaaggtaggccctgctacttcggcatctggttactcctccacgagcttgccttggttacaaaaggttaatgtggactcagatagaagattggatgtggcaaaggtaattgatgcagcaaatgaggttattaacaatattgatagagaagagttaccaaaattttttgcactaaaaaatgatccagatgatgaggaagcggagctgctaaaaatctattttgatccctcactggctagggttgaactagaagctagagatgagagctatgatgtgataattggcgacttgccagaccaaattgatggaggtccttgctataaactttacaccaagtgttga

SEQ ID NO: 73986 - DNA, 372 bp, Glycine max
  Peptide Sequence Number=SeqID_190764
atggctaagaacgcaaaaaagaaactggaggaagctgtccagtctggaaccactaatggtgtcattgaccctccatctcccatcagacgccacgtgaagtggaagatggcccgcaccaagaaaactgggcaaatgacgtctgaggcagcaaaggaaatcgctgaggagatcgattctttggaggagcaggcttcacagggatcgtttgtccctcatggacatcaggatgtcctgactaccgccattgggcgagcagagcaccctggccgtgtccgtgctgttggagtcggtgtcaccatcaagcaatattttggatcagctccacgaacatcccacagctcttcctccctgcctcctgaagacctacagtag

SEQ ID NO: 73987 - DNA, 168 bp, Glycine max
  Peptide Sequence Number=SeqID_190765
atgatactccaaagcctaaatccaaggctgctgctaggtggattgtcgttaagacaaaaaggaagcactgagtgcggctattacatcatgcactggatgtccaccatcatcttaggaagtttcaggaaaaactgggaagcggtaattgtttatttcaacttgaactga

SEQ ID NO: 73988 - DNA, 810 bp, Glycine max
  Peptide Sequence Number=SeqID_190766
atgggtgaatttcttgtggatacaaaagtgtttgaagataagaaggagagatggtcctcattctctcctaacaagtacttggaagaggttgagaagtgtgccacacctagatcagtggcccagaagaaagcctactttggagctcattccaagaaggttgtcgcccggaaagccgaattgctggctcaggagaagcaaagagagaaagattctttcggattagaagaacatagtggaatagatctgagtggggttaagcatgaaaccagttctgttggtgagatccataggactcatgttaatgaatatgaggaggaatttgcagtttcaagggattaccaaagttcatcagttcagatagatgaacctgaaaatgtatgcaagaaacaagtggaaagtcctaacaacaacattgaagctgaagatgtgaaggaaatttcacatgttttgtacaaggagacaagaaaggcttcagaagttgaagtaaaagatgtgaaattgaatcatccaaaggaatctaaggttaagtctgtgagtaagggtagcaatgcagccaagactaagaagaaatcaatgctacctacttctaaggcatccccaatttcaacacctaaggcatccccaaatataattgagcaaagaacatattcacattattcaagacctatgacttcgtggcaacgtgtcatggttttgaagaagctgtacaaagaagctgaagaagatgtactcacagtcgcgaagaagaagaagaacaagcgaagaacagagcgcgaggaaagtagtatggctcgggttctgatattttga

SEQ ID NO: 73989 - DNA, 219 bp, Glycine max
  Peptide Sequence Number=SeqID_190767
atgactcttgtccaaggtcacaaatcatacacttgtacgcgtagtatacctttgtatacaactttggttactgagattaaagaaattaaagaaaagcagcagaaacaggatgatattattcagtctattgcagctggaaataaacaacctctaattccacatctagttttggttgctggttctacattgacagatgaagaggctgcaagagacctataa

SEQ ID NO: 73990 - DNA, 450 bp, Glycine max
  Peptide Sequence Number=SeqID_190768
atggccaataggaaaagagaagggatcaaattaatattggagcaacaggtgagcgttccatgcagcattttgtcaacagtggtgaccgtgagatgcggccactgcacaagcctcctctctgtcaacatgaagaaagcttccttggtccctttccaccttctagcttcccttactcatcttgagccaaaagaaggtgcttcagaagatggtgcaaacaagagtttgagcagctataatacatccacaatgaccaattcggattgtgaagaagagaacgtgacccaaatttccgatttcgtgcataaacctccagagaagagacaaagaacaccatctgcttataaccgtttcatcaaagaagagattaaaaggcttaaggctgaaaaccctaacatggcccacaaggaggctttcagcactgcggcaaaaaatgtaaggtttctgaattaa

SEQ ID NO: 73991 - DNA, 249 bp, Glycine max
  Peptide Sequence Number=SeqID_190769
atggaggaagagcagttcttcaggcacgatgtcaatgggaggcctactagatctaccttccaccaggatgtggcgccattgaagttcatgaggatgtgggatattttagtgatgatgaggatcccatgccatgcgagatcgccttctaccaggatgttattggtgaagagatacttaaggaagagattctttcaaccgaccaggaatgcgattccttgggagacaagagcgacccttctgaagatatga

SEQ ID NO: 73992 - DNA, 237 bp, Glycine max
  Peptide Sequence Number=SeqID_190770
atgggggaacaccactcctcttatccctttaaagatgaggttcaaaatctcatagagagatgcattctctttcacatgagccaagaccagtgcgtaagggcactggcagaacatgcagggattaagccacttgttactgttacagtgtggaaagagttgcaaaaggagaacaaggagttctttagagcatatttgcaagttaccactcccaggccattattcatgagtaagatctaa

SEQ ID NO: 73993 - DNA, 693 bp, Glycine max
  Peptide Sequence Number=SeqID_190771
atggacacgcccagtgcaaccataagttatcaagatgtaactgcattggctagcacctggcacctagcaacaggtttgtccatcaatagaggttacaccaacagaagcctagagaaacctttaaaatggaagaagcttgttcgtgctcctgatgcttacaataccaagaccttcaggaatcaaatcgtgtggatgggcactctaaaagcctccacctctaattatgatggaagtgacaacactgcgcatcatgatgatgcttgcaagatgactgaagagcagatgataactcatgtgactcagatccatgatgctcagaaaaagaagaaagctgaaaaagaagaagaagccttagttgttgcttctatgaaagagaaagatgcctctgtccaagctaaagatgtagatggtaccattgtacatggggtcattaatgatcttaccaacatcagtatcatggacaaaacacctaaggcatccaatgctgccataactattgaggttgttcaccacgtccaagaacttattgttacaagggatcatgtgcaagacatgattgggcaagctatggagtcatttgttgaacgccaacaccaagaaaatgagcaatttaggctcttcgtgcagaattccatcacaactgaagtctccaaccttattgatatccttatgcaaaaccttcaacaagcttag

SEQ ID NO: 73994 - DNA, 659 bp, Glycine max
  Peptide Sequence Number=SeqID_190772
atctgtgggatatggtggaaaatggagattatgttccatatgatgatcaattgaatgaactttctagaggacaatggacggaggagcaaaatcttagattcctgatcaactcgaagacacagaatgtgatgttgtgtgctttatcagaagaagagtgcaccaaggtacacaacttcagaagtgctaaacaaatgtgggacattctggcaataacatacaaaggaatgtcacaagtaaagaagaacaaactcaatctcctcactcataactatgaactcttctctatggaaaaaggcaaagacatacaaacattcgaagaacaagtcttgagaagttcgtccaaagctcttaaagttgatgattcatctgatggtggctccaagtggaaaaattcctcaagaaaaatgcccaaagaaaagaaagataaagaaaaaagctccataattttctacgaatgcaaaaagcctggacacttcaaatctgattgcccaaaactagagaagggtcaggacaagaagaaacactataagaccaaagaaaagaagggtcttttgagtacctgggaagatctggatgacacttcgcctaatgaagatgatgaagaagccaacatatgcctgatggcagatacaacttctgaggaatctgaatcagattaa

SEQ ID NO: 73995 - DNA, 465 bp, Glycine max
  Peptide Sequence Number=SeqID_190773
atggtggtgagcttgttcttgaagtggcatctccaatcacctttcctccttctccattccactgccatgatcttcaagaagcaaaggactccattgatgaagaagatcaaaggcctacaagctccacatggagctacatcgcttaacaagagtgttctccttaagaatttgccctttgatcttcctcatagcatctacaccaacattctaagaaacttgaagggcttatgtggtttggacgacatctattatgctactgtcatcaataagttgctctgggatcaaggcatgtatcatgtcttcaacaaaatggatgatgattctaaggacaacctagtagtcaaggatgccataaacaaaaggaagcagaaaaagcttgccaaagctatcactgatgaagatcgagaagaaggaagaagaggaggagctatttgcatgggagcacaggacaatgaagagacatga

SEQ ID NO: 73996 - DNA, 312 bp, Glycine max
  Peptide Sequence Number=SeqID_190774
atgcaagtgggatcagcaactttcattatcagagtaatcaagcacagcggtatctgtagtggcgacagcaaaattcttcaagttgcaagttgtttccaggatgtcaagacatctcacgtgacatcagctttctgctccccctgtctccatgctcttactgttgtgaagcagttcactgcggcattctgcaagttgcacatctacaagtcttttccaggatgtcaagacatctcatgtgacatcagctttttgctccccctgtctccatgctcttactgcagtgaagcagttcactgcagcatcttctattag

SEQ ID NO: 73997 - DNA, 720 bp, Glycine max
  Peptide Sequence Number=SeqID_190775
atgattgacgaagtagtacttgtcagaggtttctggccggaagcgctgatgtcgatctcagactggctctactttgaccgggagaaagggacgccagaaaaaatctctagagaagtacgcagcatgtacgacgcgttgctgccaactgatcccatagaactcgcgattttatacactcagggttggcaggtcgatctgcatgatccagatgctaagtatgaacgtggaagcggtaccaagcatgacttcgattatgcagcacgacaggcgaaattaacagcacagttgatcgcatctgacaaacagctcactaaacgatctgtggagcggatcgcatgcggtgatgggcacggtacgtttgtctttgcgagggagttgatgaagcacgtcggcgacccaattaagctaatgcaaattgctattacagtggctgagtgcagcgaaacgccgccaaaccgaagcttttttgccggtttgatcacaggagcggatgatcgtgattgcgatctagcaaaacgtctcatccgcttagcgctgcaatcacccaacctaaaaaacgacgcgatcgcactcattggctcaggccgtttgcagtctgatgatattcagctggtgatctcacttctagcatctgccgatattcaaccttggcaatgcaaaggtctcgggcttgctcagctgcatgggctcctcgcttactccgctactggaagaacttga

SEQ ID NO: 73998 - DNA, 240 bp, Glycine max
  Peptide Sequence Number=SeqID_190776
atggacataaatacattggggagtagtgggcgaagaggatcaaagagcctaagggaattagcaagtggtgactacccgacatttggtgcacgcttttggtgcagattgtatgtcttaattttgttttactatttcttgttgtttgtgctgtttgaggaaaagaggactcacccctacaaccaacatcttttaggtactaatgatgccaagtgcaccaaggcatatggaggctcagtgtag

SEQ ID NO: 73999 - DNA, 198 bp, Glycine max
  Peptide Sequence Number=SeqID_190777
atggccctcgatcgcctcctgcacatgggcatcaatctcgccgtccagcgcctccttgtcaccgagcagctcgtccaggctgcgtgcggcgatcgcctggcgcaggccgaactgcagctgccgatagatgaactcatcggcattgctgagcgtgcggagtgcatgcacccggtcgatcacctgcacgggcgcggccag

SEQ ID NO: 74000 - DNA, 1023 bp, Glycine max
  Peptide Sequence Number=SeqID_190778
atgggcgtgggcatcaaggacgtgatcctgccgggcgagatgaaggagatcctcaacggcgtggtgctggccgagaagcaggcccaggccagcgtgatccgccgccgcgaggaggccaacgccacgtgttcgcagctcaacaccgcaaagcttatcgaggacaacccggtgttgatgcgcttgaaggtgctggaggcgctggagaaggtcaccgagaagatcgacaagttcgccgtgttcggcggcctggatggcgttctgaagcagctgggacgcgccgccgccccatcaaggacattcaacaagacaatggacacgcaacagaactatcaatggctgcacgccgagggcaccacgccgatcaagggctgggtcaacggtgtaccgctggaggcacaggcccacgagcagctgcgcaacatcgccgcgatcccgttcgtcgggccgtgggtggcggtgatgccggacgtgcacctgggcaagggcgcgaccgtgggctcggtgattccgacccgtggcgcgatcattccggccgcggtcggcgtcgacatcggctgcggcatggcggcggtgcgtaccacgctgcgcgccaacgacctgcccgatgacctgcggcaactgcgcaacagcatcgagcgcagcatcccggtcggcaacgggcgcggcggcgagcatcaccgcatgcccgacagcatccacacccggttggtgcagtccgggctggccgacggcctggagaagatcaaggacaagcaccgcaggatccgcaccgataagctggaccgccagctgggtacgctgggcggcggcaaccacttcatcgaactgtgcctggacgagacggatacggtgtgggtgatgctgcacagcggctcgcgcggcaccggcaacctgatcggcacctacttcatcgagaaggcgcgcgaggagctggcacggcgcgtgctgggcttccacctgccggacaaggacctggcgttcttcatggaaggcgagccgctgttcgatgactacgttgaagcg

SEQ ID NO: 74001 - DNA, 405 bp, Glycine max
  Peptide Sequence Number=SeqID_190779
atgggagatcgcttggaggacatgattcgtgaccttggacaagagtctttccagcaagcgcatgcccctgtgtatgaaggattgcagagtgattcaaagaagcctttgtatacggggtgtaagaattccttaaccctgttgtctgcggtgttaagtctggttaatgtgaaggctaggtatgggtggagtgacaaaagtttcacctcgttgcttgaggtagtccataatctgcttccaaaggacaacacgttgcctaaaagttactataaggcggaaatatattgtgtccgatgggtatggagtatcagaagattcatgcttgccccaatgattgcatattgtacagacatgaattccaagaaatgtcgaaatgccctacctgtgggacttcacgttacaaagtga

SEQ ID NO: 74002 - DNA, 175 bp, Glycine max
  Peptide Sequence Number=SeqID_190780
atgaaaagagaaaaacatgtctcctatagtagtcataactcttgcaagagcctaagtgaagaacttcgtaactattacgaaggaaggcataggtcacatcctagccctcactcccatagaagagaaaaggaaagaaagcctcaagaggctaacattaacctctcatatttccagg

SEQ ID NO: 74003 - DNA, 1157 bp, Glycine max
  Peptide Sequence Number=SeqID_190781
tacacgtcctcaaatttagagggctacacgccctcgcctttagaggactacacgtcctcgcctttagaggactacacatcctcaaatttagagggctacacgccctcgcctttagaggactacaggtcctcgccttcagacgactacacgtcctcaaatttagagggctacacgccctcgccatcagagggctgcacgccttcgccttcagagggctacacgtcctcaccttcataggactacacgtccttgccttaataggactacacgtcctcgccttcagaggacaacacatccttgtcatcagaggactacacatcctctccttcagaaggctacacatcctaaccttcataggactacacgtcctcacctttagagggctacacgccctcgccttcagaggactacacgtcctcgccatcagaggactacatgtcctcgccattagagggctgcacgccctcgccttcagagggctacgtgtcctcaccatcagagggcaacatatcctccccttcataggactgcatttccttgcctacagaggactacacgtcctcgcctttagagggttccacgccatttcctttagagggctgcatgtcatcaacttcatagggctacacgccctcacctttagaggactagacttcctctccttcagaggactagacgtcctcgccttcagagggctgcacgccctcgccttcagagggctacacgccctcaccttcataaggctacacgccctcacctttagaggactatgtgtcctcgccttcgtagggttacatgccctcaccattagaggactacacgtcctcaccttcagaggactacacgtcctcaccttgagggagctacaggtcctcgccttcaaaggactacatgtcctcaccttcattgggctacacgccctcacctttagaggactagacatcatcaccttcataggactagacgtcctcgccttcaaagggctgcacgccctcgccgttagagggctgcacgtcctccccttcagagggttacacgccctcgccttcatagggctacacgccctcacctttagaggactatgtgtcctcgccttcgtagggttacatgccctcacctttagaggactacacgtcctcaccttcagaggactacac

SEQ ID NO: 74004 - DNA, 960 bp, Glycine max
  Peptide Sequence Number=SeqID_190782
atgaacacgctaagcacacctactgtgcttagcctgttcatcgcagctgttaaatttttggatttccagatgatcgcgctaagcggaccatgtcgcgctaagcgcgttcacccctgctggctaagcgccaatatgcttctgtttttcaatcctttgaataaggctaagcgcagttgctgcgctaagcccttgttttgtatcaaggaggctaagcacgtcctatgcgctaagcctaagggtcattctgctaaggctgagttaagcccaacatgctgcactaagcccagaccctcttttgttttgaaaattatggcatcaaagaagagaaaggcacctaccacaccttcccaggcctgggaaaggtacactgacattgttgtacctaggaagctacttccagaaagaaatgttgtaatctaccacagtgagtttgatgagttcaaggaagaattggagagaagaaaatgggataaggagttgaccagttttgatgaaggcagcattgatgttgccattgtgaaagagttttatgctagcctctatgatcccgaggataaatcacctaagcaggtgagggtgagaggccatttggtgaagtttgatgaggacacgctgaataccttcttgaagacccttgtaatcatcaaggatagggatacattattagcttactctagatttgcactcttgaggcctgatcctcaggagttggcagccatgctctgcatcccagggaggggatttgagcttaatgttgacggcttgccactgaagatcctcaggaagaacatgaccacactcgttcagacttggagttttctttcttactccaacttggtccctacctcccatacttctgatatcacactagatcgggccaagttgatttatggcattatcatgaagatggacatgaatctgggctacctcatctcccaccagatttctatcattgcctag

SEQ ID NO: 74005 - DNA, 417 bp, Glycine max
  Peptide Sequence Number=SeqID_190783
accaagaatctacatcatccagaagcatctattgttgaaaggtacattgcagaagaagccattgaattttgttcagagtacattgaaaaggctaaacctattggcctttctaagtctcgtcataacgacagagtgggtggtaagggttcaagaggactgcatgttatcactccaagtgtagaagatttattacaagctcacttaaagctagcagatgggcctaaaagaaatgttataacttggcaaggatacaacataaacaagtattcctttttcacaaaagcacaagacgacaaaagtacaatgcaaaacagcgaggtcaccctaagggctgaatgtcagcacttcgcaacaacaccggtgtgcagaccagtggtccacgttgatcctgcgactggcaaggccgacggtccctaa

SEQ ID NO: 74006 - DNA, 1044 bp, Glycine max
  Peptide Sequence Number=SeqID_190784
atgacattattatcctggcgagcgccctatgactggcaatggatgttcgcgtttctcagcgcgcgtgcggtggcgggaattgaaaccttccatgaagatcaatatacccgcagcttcagtttagatgggcatcgtgggttgattaccgttaaaccggatgaacgcagccaggggttccaggtgacgctttctcatgggctgttaccggtagcagaccagtgcctggcgcgtgtagcgcaactgtttgatttagcatgcgatccatttgaggtcacgcaaaccttaggcaaactggcgcagccgcgaccaggacttcgcttgccgggggcgctggatgcgtttgaacaggcggtgcgcgcggtattggggcaactggtgagcgtagcgatggcggcgaagctgacggcgaaagtggccgcggtctatggggaagcgttaagcgaagcgcctggttatgttatttttcccgaaccgcagaaactggcgcaagccgaccctttggcgcttaaggcgttagggatgccgcttcgccgcgcggaagcgttaattcaccttggcaaagcggcattgagcggagaattgccgttgacggcacctgctgatatggcaaccggcatgaaacaattgcagagtctgccgggcatcggtcgctggacggcgaattactatgcgctgcgcgcgttttcccggaatgacgcctgcgcgtattgcgcgttatgccagccgctggcaaccctggcgctcctatgctttgttgcatatctggtacaccgaaggctgggtgccggacgaggaataggcgtacagggcgcatatcactggtatcgccgccctgaaatccctataattgccgcgtttgacggtcaaccgtcaccctccatctacatccaggcatcgccggcgcatcggcttcgggcaaaagccttatcgccagcacactttatcgtgaattacgtgaacaagttggcgatgagcatattggcgttattccggaagacagctattacaaagatcaaagccatctgtcgatggaagagcgtgtaa

SEQ ID NO: 74007 - DNA, 918 bp, Glycine max
  misc_feature (9)..(9): n is a, c, g, or t
  Peptide Sequence Number=SeqID_190785
atgcacgcnttcgccatcagaaggctgcacgccctcgccttcagagggctgcacgccctcgccttcagagggctacacgtcctcgtcatcagaggactacacgtcctccacttcagagggctgcacctcttcaccttcaaaggactgcacgccctcgccatcagagggctgcacgccctcgccttcagagggctacacatactcaccatcataggactacacgtcctctactttagagggctacacgccctcaccttcagaggacaacatgtcctcaccatcgaaggactacacctcctcgccattagagggctgcatgccctcgccttcatagggctacatatcctcaccatcagaaggctgcacgtcctcgccttcagaggactacacgtcctcgcctacagagggctgcacgccctcgccttcagaggactacacgtcctcaccttcataggactgcacgtcctcgcattcataggactgcacgtcctcacctttagacgactacatgccctcgcctttagaggactacacgtcctcaccttcagaggattgcaagtcctttcatacagagggctgtacctcttcaccttcaaagggctgcacgccctcgccatcagagggctgcacgccctcgccttcagagggctacacatactcaccatcataggactacacgtcctctactttagagggctacacgccctcaccttcagaggacaacatgtcctcaccatcgaagggctgcacgtcctcgccattagagggctgcatgccctcgccttcagagggatgcacgccctcgccatcagagggctgcacgccctcgccttcataggactacacgtcctcacctttagagggctacacgccttcgccttcagaggactacacgtcttcgccttcagagtactaaac

SEQ ID NO: 74008 - DNA, 1069 bp, Glycine max
  Peptide Sequence Number=SeqID_190786
ttctccggctcgtcggagttccagggcaggccgatctccaggcgcaccgactgccactcgcggcccgtcgactgctccacgagcttcggcgtctcgcagccgactccctccgcgctcgggtccaccgggacggcgacggcgatcaggcgcgtgccctccgggacgtcgaggccggagagatcatcgatctcgccaccgcggacgggaccccagtccgcatccgccagttccgccgagtcgccgtccgccaccgggaccgcggtggcggcacgggcgccgaacccgaagtactggtaccactcctgccagcccaccgccgcggcagtcgccggcaggaggaaggccagcgccaccagcgcgaccaggttgctgcgccaccacgacgggcgtcgcgccgggacgacgggttcggccggttccgcgggcaggggaggaggggggatcgtcatcagcgtgcccatccgttctcggccaggagcacctcatcctcgatgggcagcgcgcccaggtcgatcgggagttcgatcacgccgtctcggaggacctcggagcccccggcccccggagcggccagacgcagggtcgccgatgcatcggcgacgccatccggaagctcgaaggcgagactccccgagcgcgggaccccggtgacgaggcgctgttggcggaacgtggtgccgcgctcggtggcggtgaacgtgcggtcgccgatcaggagctcggcgaccgcgagggtgctgagctcctgggtgagcacggactccgcctcgaggtcgacgaccaaccaggtcccttcggccgaccagccctccgcatccgtcacgcgctgggccagacgcacgtccgtcacggtcgcgacgaggctgcgcgtgctcgccggctcgtcgatcctggcgacctccgggaagggggcgttggccgcgtcatccggcagcgtgatcttcgacaccccccaggcgcttgcgatgagcgcgacggtggccatccagacgagcacgtgcttcttcatgacgcttccacctcctcgatcgtggcggtgagcgtcgcgccgacccggacgtccatctag

SEQ ID NO: 74009 - DNA, 558 bp, Glycine max
  Peptide Sequence Number=SeqID_190787
atgaatcaagttcgcctgaatgctggtgtctggcgcagccggatactcaagttcccggatgccgaaggcttacgtccgacgtctgaccgtgtgcggcaaaccttgtttaactggctggggcaggatatgacgggtaagtgctgcctggacttgtttgccggtaccggcgcgctgggatttgaggctttgtcacgcaatgccaggcaggtgacgatgctggagctggcgaaagcgcctttccaggcgctattacaaaatcagcgcctgctgggagcgacgcaagctgatattcgccaagccgatgccttgcagtttctggcgcaaaaccggcagcagtatgatgtgattttttgcgacccgccctaccataaacagtggctggataagttgttaccgcaactggccggtcacttgtctgaaaacggtatgctgtatgtggaagccgaatatgcgttaaaatctgacccagactggcaagtgatcaaatcaggcaaagcagggcaagtgttttatcatttgctccagcctgtgccagcattgattaatgacacaccttaa

SEQ ID NO: 74010 - DNA, 570 bp, Glycine max
  Peptide Sequence Number=SeqID_190788
ggcgatcggtgcgggcctcttcgctattacgccagctggcgaaagggggatgtgctgcaaggcgattaagttgggtaacgccagggttttcccagtcacgacgttgaattcgatgattgtgtctagcctccaactattgatcctggctcatccccggttgttttggtcaataccattgattgggaataaaaccagaatcaacccgctgtttatcacgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 74011 - DNA, 372 bp, Glycine max
  Peptide Sequence Number=SeqID_190789
gtacccacaaagagaagcctgctagagctttcttcacaaggatgcactgttggaacaaacaagctactagctaagcagctagaatcactgacagagacacttagtaagctgccaacccaattgcaagcaactcaaccttcacattcagcagttatgcaggttgaaggttgtagcatatgtggaggagcacatgagtctggctactgtatacctcttgatgatgctgcaaaggaggtgaattatatgggaaatcagcacagaccagggtttaatgcatgtggatttgtaggttaccagcaaggtgtcaattttaatcagaatcaagggcaatggaggtctcttcctgggaatcaattcaacaaggaccaatga

SEQ ID NO: 74012 - DNA, 516 bp, Glycine max
  Peptide Sequence Number=SeqID_190790
atgcacgccctcacctttagaggactacacgtccttgccattagaaggctgcatgccctaaccttcagaggactatatgtcctcgccatcagaggactgcactccctcacctatagaggactgcacgtcctcaccttcagagaggtacacacccttgccttcagaggactacacgtcctcgccttcagagggctgcacgccctcgccttcagggggctagatgccctcgcctttagaggactacacgtcctcgccttcagaaggctacacgccctcaccttcagagagcttcatgccctcgctttcagaggactggatgtcctcacctttagaggactagacatcctcacctttagagggctacacgccctcgcctttataggactagacgtcctcgccttcagaggactagacgtcctcgccttcagagggcttcacaccctcccctttagaggactgcacgtcctctccttcagagggctgcacgccttcgccttcaggccctcgccttcatag

SEQ ID NO: 74013 - DNA, 204 bp, Glycine max
  Peptide Sequence Number=SeqID_190791
atgcagggttaccatatggttacccgcacctttcatcaaccaggggcaaacgagcctgttgacacgcagagactaacatcgtcttctgcaccttttgtcgtcctgacccgtgaagttttactctcgtcatccggaaacattgaatcccgacgacgcgcgagattcttctttgctaggccgggaaaatcgagtgccatggtgtag

SEQ ID NO: 74014 - DNA, 177 bp, Glycine max
  Peptide Sequence Number=SeqID_190792
atgtcgcggaacttcacggattgcttaacgatgggtgtcaagtacctcgaagtggcacagaatgaccataatttgtctctgcgtgccatcggacacgatcgcatttggatggcaaaaggtgtgcggaatgaccagaatttgtctccgcatgtcatcgggctcaccgcctctggatga

SEQ ID NO: 74015 - DNA, 792 bp, Glycine max
  Peptide Sequence Number=SeqID_190793
gtgagggcgtgcagccctctgttggtgaggacgtgtagtcctctaaaggtgagggcgtgtagccctacaaaggcgaggacgtgtagtcctctaaaggtgagggcgtgtagccctacgaaggtgaggacatgcagtcctctgatggtgagggcgtgtagccctctgaaggtgaggacgtgtggtcctctaaaggtgagggcgtgtagccctacgaaggtgaggacatgcagtcatctgatggcgagggcgtgtagccctctgaaggtgaaggcgtgcagccctctgatggtgaggatgtgtagtcctctcaatgcgaggacgtgtagtcctctcaaggcgaggacgtgtagtcctctcaaggtgagggcgtgcagccctctgttggcgaggacgtgtagtcctctaaaggtgagggcatgtagccctacgaaggtgaggatatgcagtcctctgatggcgagggcgtgtagccctctgaaggtgaggacgtgtggtcctctaaaggtgaaggcgtgcagccctctgatggtgaagacgtgtagtcctctcaaggcgaggatgtgtagtcctctcaaggtgagggcgtgcagccctctgttggcgaggacgtgtagtcctctaaaggtgagggcgtgtagccctacgaaggtgaggatatgcagtcctctgatggcgagggcgtgtagccctctgaaggcgaggacgtgtggtcctctaaaggtgagcgcttgtagccctacgaaggtgaggacatgcactcatcagatggcgagggcgtgtagcccactgaag

SEQ ID NO: 74016 - DNA, 294 bp, Glycine max
  Peptide Sequence Number=SeqID_190794
atgttccaaaaatctcctttggtaattgattacaggatttgtgtaatcgattacagcgcatttacatcaaatcatcatgatcatcatcaaaacatcaaagtcatttgcttctacacagtgatgatgatggtggttgcggtggtgacaatagtggagtgtgacaacggtggtggtggttgttatggtgacgagggtgaagtggtggcaacaacaatgatgatggtggttgcgatggtgacaatgaagccctgtgacggtgatggttatggttgttatggtcgtagtgaaagttag

SEQ ID NO: 74017 - DNA, 144 bp, Glycine max
  Peptide Sequence Number=SeqID_190795
atggatgggagatgtgtgcataaccttccaaatcatgggttccagtgctacaagagatttatggttgtggaagcggaacctaacctgtctattcatagcaatgtgcaatggaagctggggaatgaggttcaaattctcttatag

SEQ ID NO: 74018 - DNA, 102 bp, Glycine max
  Peptide Sequence Number=SeqID_190796
atggctcaacctctaatcttgaggacttatcagatgaaaatgagacttgttggctcaaaagccatgatagtgatactgactcctcttccaggcccgaaggaa

SEQ ID NO: 74019 - DNA, 813 bp, Glycine max
  Peptide Sequence Number=SeqID_190797
atggagggtggtggaagagaaggttataatggagtcatcatgacgatgacacgagacccgaagccgaggctacggtggacggcagatctccatgaccggtttgtggatgcagtcacaaagcttggtggccccgataaggcgactcccaagtctgttctgaggttaatgggcttgaaagggctgacactatatcatttgaagagccatttacagaagtatagacttggacagcaggctcaaaaacaaaatgaggaagtgcacaaagagaatagtagatgttcgtatgtaaattttagtaatcgttctttggcaccaaacaccagttacagaggtgatgatgaagggggagaaatcccaatagcagaagcattgaggtgtcagattgaagttcaaaagcgattggaagagcagctaaaggtacagaagaaattgcagatgagaatagaggcacaagggaagtatttgcaatcggtgttagagaaagcccagaggagcctttccctggatggaccaggcagtcttgaagcatcaagagctgagttgactgaattcaactctgctttgtcaaatttcatggaaaatatgaataaagatagcaaacaaaacataatagaagtgaataatttttatagtaagagccatggctcagctttctataatcaggaagtaggaagagaacaaaatagggaccaaaagccaaaggttgaagggggttctatacagtttgacttaaacatcaaaggtagcaatgaccttgtatctgcaggtggggctgaaatggatgccaatatggtttcatcatatagggtataa

SEQ ID NO: 74020 - DNA, 266 bp, Glycine max
  Peptide Sequence Number=SeqID_190798
ctgtttatatggatgaagatgatgttgcaacatacacagtcaagacaattgatgatccaaggacattgaacaagatggtatacctaagaccaccagaaaacattctcactcaaagacagctaattgagaagtgggagaaactcattggaaaacaactagagaagtccagcatgaatgaacaagactttcttgcttccatggaaggttgtttgacaaactttgaaataggagaaggtggggaagaagcgccagagctttatccagag

SEQ ID NO: 74021 - DNA, 817 bp, Glycine max
  Peptide Sequence Number=SeqID_190799
gatcctttacatgtaagacctatagctcatgcaatttgggatcctcattttggtcaaccggctgtagaagcttttactcgaggaggtgctctaggcccagttaatatagcctattctgggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaagggcttttgctcatggagctatattttttattagagattataatccagaacagaatgaagataatgtcttagcaagaatgttagaccataaagaagctatcatatcccacttaagttgggctagcctctttctggggttccatactctgggactttatgtccataatgatgtcatgcttgcttttggtactccggagaaacaaatcttgattgaacctatatttgcccaatggatacaatctgctcatggtaaaacttcctatgggttcgatatacttttatcttcaacgaacagtccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtg

SEQ ID NO: 74022 - DNA, 157 bp, Glycine max
  Peptide Sequence Number=SeqID_190800
gtttactttagtcgtccgaagatattcaagcccaacgacgcacgagattcttctctgctgggcggggacgatcaagttcgatagcgcgtggaaacatcgtggttccgttggttgggatattgaccggtcaaatgatgttccgctcgaacgaaattag

SEQ ID NO: 74023 - DNA, 174 bp, Glycine max
  Peptide Sequence Number=SeqID_190801
atggataataaggatggtaaaaagagaacaaacagtgaggccgaaaagagatataatgatctgatcaaagagaagactcgtgccctgaaggcaaccatgaaaaaatgggatgccctgctagctgaatccagctcttctgaaaataacaatgaagatagtaaagaaaagaagtag

SEQ ID NO: 74024 - DNA, 109 bp, Glycine max
  Peptide Sequence Number=SeqID_190802
atgtattgcctactttcaaaaactggccccgacgggcgcagagaaacgcgagggactggaaccagaggaatagcacgcaaaccgaggcaggattttggcatttcaaaag

SEQ ID NO: 74025 - DNA, 240 bp, Glycine max
  Peptide Sequence Number=SeqID_190803
atggatttagtagccagctcaactccatttaacagctaccgagctgactcaactcaaggaagccggaaagaaagggcttcaagacagcttcggcaacagaaactcgagctgaggaatacggaagagaagcggattcaactcaatcttagcctaagagcagttcagagaagagaatcaaaggtcaacggccaatggaggatttctccctcccccggattcatcttaaaccgaccgagatga

SEQ ID NO: 74026 - DNA, 441 bp, Glycine max
  Peptide Sequence Number=SeqID_190804
atggccagaaaaaccaaagaggacgccttaagaacgcgtcaactcctgattgagtccgccattcagcagttcgcgcagcgcggcgttaccaataccacgctgaccgatatcgctgacgccgcgggcgtcacgcgtggagcggtgtactggcatttttccagcaaggcggagttatttaatgagatgtggcagcagcagccgccgctcagagagctactgccccatcaacagtgggagctggataaccaaaatccgttaacagggttacgtaaaaaatttattaccggattacaatatatcgctgagaattcccgacagcaggcactgctacaaattctttatcataaatgcgagtttaccagtgacatgctgccggaaagcgaaatccgcaaacgaattggcttcaattacgccataatccgtgacgtcctgcagtgttgc

SEQ ID NO: 74027 - DNA, 483 bp, Glycine max
  Peptide Sequence Number=SeqID_190805
atgacgagtcatgccagagtttctcttttatccagcctaattatctccgccgtattgcttaccggttgcgataattcaggcaaccagcaggcacaaccgcaggcgccacaggttagcgtacatgtagtgcacagcgaaccgctttccgtcaccactgaactcccagggcgaacgtcggccttccgtgtcgctgaagttcgccctcaggtcagcggtattatcctgaaacgcaactttgtcgagggcagcgatatcaaggccggtgaatcgctctatcaaatcgaccccgccacttaccaggcggcctggaacagcgccaaaggcgacgaggcaaaagccgaagccgcagcggctatcgcccatctgacggtgaaacgttatgttcctctgcttggaactcagtacatcagtcagcaggaatacgatcaggccgtcgctaccgcgcgtcaggccgatgccgatgtcgtggcggctaaggccgcg

SEQ ID NO: 74028 - DNA, 360 bp, Glycine max
  Peptide Sequence Number=SeqID_190806
atgttggtgcgcatgctccgcactcttctctttgcagcggcacgggtgaaatcttgccccagtatgcatagtagctgtgtgatagcctccctctctggttgtgctcgcacagttggccctcctccaatatcagggggtggcccaggaacccgacagaggaccttaaattatcttaaggtgtggatatggagcccactgaaagtgaggacgcgtagtcctctaaaggcgagggcgtgtagccctctgaagttcaggacgtgtcgcctttcgaaggcgagggagtgtagtcctatgatggcaaggacgtgcaatcctctgaaggtgagggcatgcccccctttgaaaatggggaacatgtag

SEQ ID NO: 74029 - DNA, 414 bp, Glycine max
  Peptide Sequence Number=SeqID_190807
atgccgatctcccccctgcggaaagtatcagttggtctgtgccgttccgacataggggtcgcgcccacaagacgcccaacgaacccggagaagtccaacagggccttggggtttccagctctagttacgggcctctgtcagtcctacagggcgcccgtccccccagcaaggatcatgcccgcaagacacccagtggacccgaagaaggccaatagggtcttggagttgctagctctaattacgggcctctcaaggtcatcaagtcctactaaccgagctttcatcaagaagtactgcgcccccaggcaggcgcagggcgaaacaccacaacagcctggggatggccggcagtgggcaataagcgcgccgccaccacctctagagttcacctcagcttatccacaaaaaggttag

SEQ ID NO: 74030 - DNA, 174 bp, Glycine max
  Peptide Sequence Number=SeqID_190808
atgagaacaaaaacgacgaagctaatggacggagccactggtggcaccgccgcgattcttggaggtcgtcatcatcgtcttgaactcctcgaattgaggttgaagtgtgaagaagacgaaggattattggcggtgaggaagaatgagtcaatctacacagcagtgcctctatga

SEQ ID NO: 74031 - DNA, 549 bp, Glycine max
  Peptide Sequence Number=SeqID_190809
atgaaagaaaccctaaaacctcaaaaagcctcattccacaaaatcactaaccctaaagcgttatgcggcttcgtcctcctggtcatcgaagcagcaaaccagtgttgttcatcggtgcctcatcagcgtcgctgcctcgtcgtcctggtgaagcttttggtgttgtccctaaaacccactgtttgggtgtcgtccgtaaacctcatcatggaaaggagttccttatcgtacacctcaaaggcccgaagtcgcgtggtgtgtttgtgtaacgtagaggctccactagtgacatcatggactgaggataatccagggaggcatttttatggttgtggtctatgtaggaaaaggtgtaattattttgagtggcatgatccagttaccaacattcgtcagaagaggatcattgtagcattgatgaagaaggttgatgaattgaagttgagggaaaaggatttgcaaaccaagatcagtgacatgaagatgaagggaaattttttaggaattggattagttttttcttgggggaatgtgatttattggtggtaa

SEQ ID NO: 74032 - DNA, 444 bp, Glycine max
  Peptide Sequence Number=SeqID_190810
atggcagaaccatcaaagaagagaaagggatcatcctccgccgccgctgctgctgcccatcgccgccacggaccatccgaagcacccacagcacttatccatccctctttgtcatctccaagatcatccacgttgttttcatccgatgatcagcgtctatggatggcattatttcttctgaggtgcatgggtattcccatgatcattgatcaatcattgttcttttctttaactcatttacccagtcaaggtgcaccttttgagggcaccattgttgatgactggaaatttgattattctagtcatgatgctcgtcgtatggtctgcaatgaccaggctgaaatgactggtagattgctggccggatcgactgggctcacttggttcggtaccgaatgcataaggcattacgggccaatgcacctctccctttacctcaattga

SEQ ID NO: 74033 - DNA, 243 bp, Glycine max
  Peptide Sequence Number=SeqID_190811
atggaagaagtggataaggagatcttggagaccttcaggaaagtagaggtagaggttgaggaaccctcctcttcttctcctaccctagttcctcccactgttcaaccaccacccacattagtgttgaagcccttaccagcaaacctcaagtatgcttacttggaggacaaggaaaaatttccagtgatcatctctgcctcccttgctaccaagcaagaggagaagttgttgctagtgctctaa

SEQ ID NO: 74034 - DNA, 348 bp, Glycine max
  Peptide Sequence Number=SeqID_190812
atggcagcgcagttgatccatgatcgtgttgtgatggagtgcctggagggtgtttgggagaccctcgaaggcaatgagaggtgccgattccgtggcacaattcgactcactgctacttcattaccggctcaagtgatagaggtgtcatcctctgaagaagatcttgaagaggatccagaggaattacctcttgaacctgctatggacgcccttgacttacctatgaatgatgaagacccgctccctgatgttgattccctagaggatattatgtcagcatctgaggcagactctacagaggagagtggccctggagggacagcgaatagtgatgactcttcatcgtag

SEQ ID NO: 74035 - DNA, 318 bp, Glycine max
  Peptide Sequence Number=SeqID_190813
atggaagaaaagaaagatgaagaagataacatctttaatgaaggtgaaactgaggttaccatggctcatgcaaagaaactagtgcaaagtggggtgcttccttctgatattggaattattactccatatgctgctcaggcacaagctttgtattttagtagttttatgaaggatagcaatatgcatcaaagttggactcaaactgcaaaggaagcgagcatggtcttagcatacacggcaacaacatgtgaccttgggttgttcttggcaatgttattggcttcacggagaatggtgccaccaatgtcacaatcgtga

SEQ ID NO: 74036 - DNA, 312 bp, Glycine max
  Peptide Sequence Number=SeqID_190814
atgagctatacaggttcgctaagcgcaccatttcatctcactaagcgtactgcttcagtttatccgttaagagagaaaggcgcactaggccaaaaatcaccaacatgcgctaagcggtccatacatgcgctacgtgcacgagccaaacaaggacacctatttaagcctgaaatcagattttgtgaagagagtttggactgggattcagagctttgcatgtctaaggtttctagagagagaaaggtccaagttccagagagttttgagagattttgctgtgtgaagatctgcagagaccaaagcttgaagtag

SEQ ID NO: 74037 - DNA, 1449 bp, Glycine max
  Peptide Sequence Number=SeqID_190815
atggttagaacacgaggcttaggtcgtgccttaggaactggtagaggcagagacatgagtcaagatgcacatcaacctgaagttcctcaacataggcctattgcttcaatgactggcattgtcgatgctgtggacgcagagggagtggctactgatggtagtgagggttcacctgctgttgatgagggatttcttggtgggctacgcgacccattggttttgattggttttgccgagcacgtggcacatagcatctggagtggagaggaacgacctaagcagaagttggtctctcacggtagaaaagtagataaatttggaagaccagcgcctgagatagaaggcatgattgcggccaccggattgagtccattgattaggtgttcggtaatcaccactgatcttggacttatatcctccttcgtcaagaggtggcatagggagaccagaaccttacacttgccaataggagagatgacgatcactctggatgacgtggcgtcactcctacaccttcctatcactagcgcactacatacctttgagccgctggttacttccgatatggtcatgctgttaacggagctgcttgagagcaggtgtcgggccagacgttgggttgtagcagcccacgcgtatctcctccacttggtcggttgcactcttttcgctaacaagagtgcaacacatgttcatgtcatgcacctggaggctttcagggacctggcacaggcagggggattctcttggggagcgacaacattggtgcacttgtacgaccatctgaatgaagcgtcgcagacccctacacgacagatggccggttacatgacattatttcagatatgcgagtactttccgatggtgcatcagtgcgtcgttgatgatgcttatgttgaggctagcccacgtgcctccaggtggcttacaagtaaggctcatatgacagggatcaagggagccccataccgggtacgtatagaagccctgactgtcacggacgcctattggatgccctatgcagagcaccggggagttaagggcttcgacctgatctcattctacacgggccaactcatatggggtcagatagttgtctatgttcgaccagagtgggtgcttcgacagttcgggtacattcagaccgtccctctaccgcctgttcgtgattcgttgacgggtcctgatatagatgaccggtggctgcacttttcagaccatctagtgcccgcgggggagatctgtgtagttttcgatctccctatgcattcagtggttgactgccaaggatgtcaagtgatcgttgaggatttggagctggtcatcaacctcaagatggtcactgaaggcactgagttatatgacatcatggctcgttgcctcaggatcgctagaggtaacgccgcagatggaagtcttaggtcacgacaaagacggcgcatagaatag

SEQ ID NO: 74038 - DNA, 330 bp, Glycine max
  Peptide Sequence Number=SeqID_190816
atgacttgttatgatgatgatgatgatgatgatgatggtggtggtggtgattctttgatcttgcctactatatggaatgcttgctggagtgatgagaataggcgtgagaaagcagtggaggaagccttggaagcattgaaaatcctgcaggaagcactgaaagacaagaaattctttggaggagacaacataggattggtagacattgctgccaatttcattgggtattgggttcccatattgcaagacattgcaaggttggagttgctcaccattgagaaattccctagttatataaatcgagtcaagagtttatcaatcaccctgtga

SEQ ID NO: 74039 - DNA, 903 bp, Glycine max
  Peptide Sequence Number=SeqID_190817
atgaaattggagcacaattgctatgcttcttataaacaggttaacagtgttcggttgcctcgccatgttggagacaaaaagttcttttgtggcactgcccttgatgagttctcattagatgaagaaaaggaaaaagttttgaagcaaagtctggtctatgcgggggctgagctagaattaaagccaaagaaggactttgatgcacaaagagaaaaggaattagaagagcatgaaaattttcggccacctgtgggttcaggtcatcagaataacacaaatacagaagcaaattaccctaagggcttacttatagccttcaaactaaagagcatttctgacgaagttccttcgagtcaaaataacattgataaacaagccaatggtagtaattttgtctccaaaacagatcaacaaaatccgtctgaaattgctgccaaggacagtgatcaaaagatatcagaaaatgttgagaattataaagaaaacaatggagtgagttttggaaaagagacacaaggtgaagaaaagagcaaagaaactgatggaaaaaattctgctgctgctcacaaggacaacaaggatgttgtctcacgtgaggatttgaagtgtgtctttgagaagtttggtactgtgaagtacattgatttcaagattggagaaaagtcaggatacatttggtttgaagaacctgaagctgctcagaaagctcgtgctgctgctgttctttctgaaaaggagggcttagttgtgaagaattatattgctactctagatccagtgactggtgaggctgagagagaatactggaccctgcttcgtggtaatcaagaaaagattcgaggatgtacaaaataccggggaaggtacgtggatgcactcaaccatgtctttagtttgacttga

SEQ ID NO: 74040 - DNA, 288 bp, Glycine max
  Peptide Sequence Number=SeqID_190818
atggcaccaatcctaaaatattaccttggcatattgaccaaagaatgtctccatgtcttcaagcttcacatcatattcaaattgatggaagcttgcttgtgtggcttctatggagtggaggtttttaccctccgcaaaataaattacggaggttttcaaaaacctccgcagttagattcgccacaagcaattagcggcggttttcgaaaacctctggtattgagaacattttgcagagattttttttgtagaggttttaaacctacgctaactgtggaggttttttaa

SEQ ID NO: 74041 - DNA, 486 bp, Glycine max
  Peptide Sequence Number=SeqID_190819
atggcgtcaattatgtccttatctcttagttatgtttccctccctaaatctcaattctcaatctctggcaggacggcaagttgttgttgtgcgccattgttccaacgaagaaagattcttttctcttccataggcatctttgccggaaccttgtgcaacattccactcaccggaatttctttggcagctgaatttgccgatatgccagcgcttagagggaaggattatggaaagacaaaaatgcgatacccagattacactgaaactgaatcaggactccaatataaggacttgcgaccggggaatggccccaaacccaagatgggtgagacagtagtggtagactgggatggctacaccagaggttattatggccgcatatttgaagcacagaataaaaccaagggtggttcctttgagggcgatgacaagaactttgtcaaattcaaaataggttataatgaggtgagagatctcgtcatttaa

SEQ ID NO: 74042 - DNA, 1410 bp, Glycine max
  Peptide Sequence Number=SeqID_190820
atggccggaatccgcttgcagccggaggactctgacgtctcccaacaatcccgcgcggtggctctctccgccaccgatctggtctccgacgacgaccgctccgtcgccgccgactcttggtccatcaagagcgagtacggaagcactctggacgacgaccagcgccatgctgacgccgccgaagctctctccaacgccaacctccgacctccctccgattacagttctgacaaggatgaacctgattctgaagcagtcacatccatgctgggatttcagagttattgggattctgcatatgctgacgagctcacaaattttcgtgaacatggtcatactggtgaagtctggtttggagttgatgtgatggaagtagtagcatcttggacaaaagccttgtgtgttgaaatttctcaaggtcacataccaaatggtgtcgatgaggttaaggctgaagctgacaaactaggtgataaagttttgtctacttggagtgtactagatattgggactggcaatggtttactgctccaagaattagctaaacaagggaatgaatccaagccagtgttgttaaatggcggcgccatggcggattttcatggcggtttttcgaaaaaacgccaccgaatagcggtggcgtggcgggtttgggatggcggcgtcatggcggccgccatagccatggcggtcgtggcggttatggcgggccgcgacgacctccggcagcgacgcaccggcacaagcggcggcgacgagctccggcagcgacgcatctgtcacgaacggcggcctgcagcgaggagttctcgcggagaagatgaagctgctgtcgcgaagaagaaggcgtcgcgaagaagaagaaggcgtaggttctctgatttaactgggactgattatagtgaaagggccatcagccttgcccaaagccttgctaatcgtgatggattttccaacgtcaaatttttggttgatgatgtcctcgagacaaagttggaacaagagtttcgacttgtcatggataaagggacactagatgctattggattgcatcctgatggtcctgtcaagagaatgatgtattgggattctgtttcgaggttggttgcatctggtggaatacttgtgatcacatcatgtaacaatacaaaggatgaattggtacaagaagtggagagtttcaaccaacgaaaaattgctactgcacaggaacttggggcagtgaaggacgaggaaccgctcccgtgttgcaaccgtggcattccttcgaaaatgaaaatgttgtcatttgttatgattaaggtctctggtcggatggatttgaagttgttcctaactgttgtgtcaaacagtaaatatctttttgcgatttatgtgaagttccattacctctccttcttgggtgaatag

SEQ ID NO: 74043 - DNA, 180 bp, Glycine max
  Peptide Sequence Number=SeqID_190821
ctgttgaagattatactgaaactgattgatcaaaattttgaattgattctcaaatatcaccgtcagaacattgaggtctacctatttacagaggataagaggatgcatgcaaacaactgttctgtagaaattttgttaatattgatatttgatgcttgcgtcaaatggcctcgggaatag

SEQ ID NO: 74044 - DNA, 684 bp, Glycine max
  Peptide Sequence Number=SeqID_190822
atgacgactatgaacctgtcgtacgactttctttgcggtttcctcgtccagcgacgtggtcaccattgttcaaaccgaaatcaaagagacgcggtgtcggagaacgtgaagggaggggagagagtgtggcaaaatgacgtcagaggggtagttttacaaactttttccctcagagggtttgtttgcaaacatattccagagggggtcttttttttaagggatcccgctagcaccaatagcaggttaaggtatcccgccattacgaacaacgacttcttcatgcatggggttccgccactcccattggtgagataccccatgcccaccatccacgtggatccaccagttgctctggcgagattgatgcagaaaaaaaggagctggcttggatccgccagttgctcaggcgggattagtgcagaaaaagaagaagaacaagttctaaagaaatgtattctatacttctcttcatttacaaacagtaacgttaacgcatatttctcaaagcctaaacatgtgctaccaatacatttcaaaaagaaaaaaaaggagctgttggatctgccaattgctttggcgggattggtgcagaaaaagaaaaaaaaaggagctggcttcatgcagaggggcagcaacaattccaaatgctatggtatgatggatgatggtgcgcaggatggatga

SEQ ID NO: 74045 - DNA, 351 bp, Glycine max
  Peptide Sequence Number=SeqID_190823
atgaatgatctggactatgatgacgtgtcaccacgtgcttgtcattggattgctatgaaggcttctttgaggtccatatctacatcgacatacatgcaacgtctagatggactcaggattcctgatgtttgttggatgccttacggtgaacatcgacccattcagaagttcgatttgatttcatgttactccgaaattgatgaccaatggatgcactactcagaccatcttgcactagcaggtcagatttatgttgtgccaggacggtgtgcactcgagtacatggttcttcctcatttctcattcattcatgatagcggcatagccatcagatccgctgacaacaagtaa

SEQ ID NO: 74046 - DNA, 306 bp, Glycine max
  Peptide Sequence Number=SeqID_190824
atggaattgatgtcactaaatgggacccgtcatctgataaacatattgcttccaactattctgctttcggggaaggccgaatgcaagatttcattgcagaaggaattgggtcttctagtgaggcctgattgtccaatgattggattcattggaagactggactaccagaaaggtattgacctgattcggttggcaatgccagagctcatggaagctgatgttcagtttgatactgttcataattttaatccatatattgaagaaagcaaagctgaaagcaccgagtatgttgtccatgagctttga

SEQ ID NO: 74047 - DNA, 207 bp, Glycine max
  Peptide Sequence Number=SeqID_190825
atgacttcagcggaacaacctgtgaagaagcgaaagctctacaagcctttaccagaaccgccaccgtcttcgccgccggaatccaaagcaaccccttcctctccgcaaagcgtacctacgccgtccactcccccactgtctcaggaggatattctcacgaagcggcggaacaaggatgaaattcgaattaggattaaagagatatga

SEQ ID NO: 74048 - DNA, 258 bp, Glycine max
  Peptide Sequence Number=SeqID_190826
atggttgcagatcctctgtcagagtccatcatgtccgggatcacgtgcggtggagattgttctagacaatgtcaaatcctttgtcaaattccactgcgttggaagtcgcatgcaaatctgttgtgcttcggtgcaaatctgcccccaagcagtagcagattcaaattgatgggatacacagtggaaggagaagggaggattgaaggaagaaaggatgaaggagaagggagcattgaagacaagaaggaagatgaataa

SEQ ID NO: 74049 - DNA, 459 bp, Glycine max
  Peptide Sequence Number=SeqID_190827
atgtcggatactaagaaaacgttggtggtgtgttatacattccatggtcacactctaccatctgtgggtacaaatatggttccgcttcaacagtctcccttcgtctggctacgccttgaatttcaacacttgacaggagaatatgaaactcttgtgctccaaattgatgttttgttgctggaccatgtgacacagattgttaagaaaatgccaaaaaaggaacttgatgaggagctttggagactcctggcaactcttggcgaacaaactgaaattacaaagggaaatcatggtgtggtgattagggaagataagaacccaacaaacccctcctctgatgcaagtgcatcaaggttcttaattagctgcattttaccattttacatttcttcgcttctctttgtgtatgttgtaagagataatatcatcgatcttgtcaaagatgaggatatcaagtag

SEQ ID NO: 74050 - DNA, 1536 bp, Glycine max
  Peptide Sequence Number=SeqID_190828
atgtatgattatttgtggggacattcgtcgctgcgggcaaagccagtaatggcgcggcctgcagcagggtttgttccagtgaggggaatgaatttgttggcgtttattgatctcactcacgaaaaaaggttcgcatatgaacatacgctttctgacgctcccgtaatgaggaagacgataatgacgccgtttatgactgaagattttctgttagataccgaatttgcccgccgcctgtaccacgactacgccaaagaccagccaattttcgactaccactgccatttaccgccgcagcaggttgccgaaaattaccgtttcaaaaacctgtatgacatctggctgaaaggtgaccactataaatggcgcgccatgcgtaccaacggcgtggctgagcgcctgtgtaccggcgacgctactgaccgcgagaagtttgacgcctgggcggcgaccgttccgcacaccatcggcaacccgttattccactggacgcaccttgagctccgccgtccgtttggtatcaccggaacattgctctctccagcgaccgcggatgagatctgggatcggtgtaatgcgctgctggcgcaggataacttctccgcgcgcggcatcatgaagcagatgaacgtaaaaatggtgggcaccaccgacgatccgattgacgctctcgaacaccatgcggccatcgccaaagacagcgcgtttgacatcaaagtgttgccaagctggcgcccggataaagcttttaatatcgaacaggccacatttaaggattacatggcgaagctggccgaggtttctgataccgacatccgtcgtttcgcagacctgcaaaccgcgctgaccaaacggctggatcacttcgcggcgcacggctgtaaagtgtctgaccatgcgctggacgtcgtgctgttcgcggaatcaaacgaggccgagctggacagcattctggcgcgtcgcctgtccagtgagtcgcttagcgagcatgaagtggcgcagttcaaaacggcggtgctggtgttcctcggcgcggaatatgcgcgtcgcggctgggtacagcagtaccacatcggtgcgctgcgcaataacaaccagcgtcagtttaagctgctgggcgcggatgtgggctttgactccatcaacgaccgcccgctggcggaagagctgtcaaaactgctgagcaaacagaatgagcaaaacctgctgccgaaaaccattctctactgcctgaacccgcgcgataacgaagtgctgggcaccatggtgggcaacttccagggcgaagggatgccgggcaagatgcagttcggttccggctggtggttcaacgatcagaaagacggcatggagcgtcagatgacgcagctggcgcagcttggtctgttgagccgctttgtcggcatgctgaccgacagccgcagcttcctgtcctatacccgtcatgaatatttccgccgcattctgtgccagatgattggccgctgggtgcacgcaggcgaagcgccggcggatatccagctgctgggcgacatg

SEQ ID NO: 74051 - DNA, 276 bp, Glycine max
  Peptide Sequence Number=SeqID_190829
atggttctcttggctatatggtcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgatgctacatagttggttctcatccttcagagactacgagtataataggagcatccgtcaacaaaaggatcaccctaagatga

SEQ ID NO: 74052 - DNA, 387 bp, Glycine max
  Peptide Sequence Number=SeqID_190830
atgccaccgaggaagctctccgcaaagagatctaggagggacgtcgcggccgaaggaaccagcgccgctcctgagtttgacagccatcgtttcaagagcgcagagcaccagcagcgtttcgaggccatcaaaggatggtcgttccaccgagagagacgcgtccagctcagggacgatgagtacgcagattttcaggaaaagatagctcgccggcgttggacgtcgctagtcactcccatggctaagtttgacccggatatagtcctagagttttacgctaatgcttggcccatggaggagggcgtgcgagacatgcggtcatgggtaaggggccagtggattccttttaatgcagacgccctcagccagttcctgggtgacccgctg

SEQ ID NO: 74053 - DNA, 279 bp, Glycine max
  Peptide Sequence Number=SeqID_190831
atggtgtttgatggatatggagtgagtaaggatatgatatttatctctgctaaccaagttgtgacatctttaaaagaatattgtcgcaacatgcccttttgcgagcgagcgaggcgaggctcacggatgcgctttccaaagaaggaaagatgcgcagagtcgccaccaacgtttatttgtggaaaacgtcggaaaaaccgaaggtcgacaaaagcggggcttttgctcctacgtaccctccatcgaagaggaaatcagacctacgtagttctttcttaa

SEQ ID NO: 74054 - DNA, 696 bp, Glycine max
  Peptide Sequence Number=SeqID_190832
atggatcttgcgaaagaccgtcgcctgcccacggagcgggccttcgcggaaaccttcaatgtcggtcgtcgtgcggttcgtcgcgcccttgaggttctggaagccgaaggcctcatatggcggcggcagggggccggaacctttgtgggtgaaaaaccggatgattggtccgcccaggtcacggaactggtcgccgggacggatttcatggaaatcatggaagtgcgcctgcgcatcgagccgcagctggcgcagctcgcggccatgcgcgccaagccggacgaggtggagcgtatgcgcgcccttgtcgaaaagacgggccaaagcacggatgcggatgccaaggaattgtgggacgggtcgcttcaccgccagatcgcccagagtgctggcaacaaacttttcctgtccatcttcgatgtcatcaaccgcgtccgtcaggacgatgcctggcagtcgatacgggagcttgcccggcgcagcggcgcaaacggcagggcgtctttcgaacagcatatggccattgtcgatgccatcgccgaccgtgatcccgccagagccggtgaagccatgcgtcagcatcttctcatgcatcaggaaaggctgatccgcgccacgtctctcggctttctggaggaaggcgctggggagggcaatgcggccaaagtcgataattcgctgaccgaggcctcttga

SEQ ID NO: 74055 - DNA, 675 bp, Glycine max
  Peptide Sequence Number=SeqID_190833
atggctctatatgaattagcagtttttgatccctctgaccctggtcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattccacgaaaaattagctttttatga

SEQ ID NO: 74056 - DNA, 678 bp, Glycine max
  Peptide Sequence Number=SeqID_190834
ctaatcaacttgaaggaaccattccaacttctttgggaaatttgacttctcttgttaaacttcaattatcacgtaatcaacttgaaggaaccattccaacttctttgggaaatttgacttctctggttagacttgatttgtcatataatcaacttgaaggaacaattccaacttctttggctaatctctgcaacttaatggagattgatttctcatatctcaaactcaaccaacaggttaatgaacttttagaaattctagctccttgtatttcccatggactcacagcacttgcagttcagagttcacgactttcaggcaatctgacagatcatattggggcatttaaaaatattgacacgttacttttttccaacaactcaattggtggtgctcttcctagatcatttggaaaactttcatcattaacatatctcgatctgtctattaataaattcagtggaaatccatttgaaagtcttagatcgctttctaagatgtcatctcttcagattgatggcaataattttcaaggagttgtcaaggaagatgatcttgcaaatcttacaagtttgatggagtttcatgcatcagggaacaatttcactttaaaagttggtcccaaatggcttcctaattttcagctttcctatttggatgtgacatcatggcagttag

SEQ ID NO: 74057 - DNA, 597 bp, Glycine max
  Peptide Sequence Number=SeqID_190835
atgagcattgtcatccctatccttcccccaaacacccatcgttcttacaacaaaacactttcctttgcgatctgccatccccaaatccatgtagaacacaagcccaacgaagagcaattagaagccaatgaactcatcatattgttaaatgaaaatcttgatggtgaggtaaaatatcacattcttaacaaagggtatgaaatcaactttgtttttgtcaccatctacgcaaaatgctgcaacatagatggtgacgaaggaggcggaaaggatggcactgaagtcgctgcaaaggacgacaaagatgttaaggacagtgttgtcgagggagtagaaggtttcaatttcaactatgttgatgtcgataacgattccaatgcaaaaaggagaaaaattggaaggtgcagcaactggtgtctcgctaagcctggaccatgcgctcagcgagtatcatccgctaagcgaaacatcagccctcttaatgaccaaagttcacttactcgtgctaagcgcataaatggcgctaagcgcaccttcgaggatagaaagtcctttttaaagcctgaaatgaagaaaaagagagtgcttggcggatag

SEQ ID NO: 74058 - DNA, 168 bp, Glycine max
  Peptide Sequence Number=SeqID_190836
atgcaagctaggatggacaaaaaacttactcagtctcagcttgctcaactgatcaataagaagcctcaagtgattcaggagtacgagtcagggaaggccattctaaaccagcatataattggcaagttgggaaaagtccttggggctaaactgcgcgacaagaaataa

SEQ ID NO: 74059 - DNA, 1035 bp, Glycine max
  Peptide Sequence Number=SeqID_190837
atgcaagaaaggattcaaggctggcttggtcttgatggttgtttcctgaaagggtactgtggcagtcatttgcttgcagcagtgggacaagatgcaaacaatgttttttttgtgattgcatatgcagtggggttgcttcctgtaatgcaagaagttatgctaggtgtgaaacacagaaataagccaattttgagtctatgtgaggatataaggacgtatataatgcgcaagatgacaagtgcaaaactaaaaatggctacaagattaggcccattggtacctatgcaacaatcaaggctggaaaaggagaaacttgaatccaacaagtggactgcaaattgggttggtgatcctgatggaactagatttgaggtctgccatcatgaaacaagaattgatgttgatctacaaaaccagtcatgcacatgtaggatgtggcaacttacaggtctgccttgtaggcatgtgattgttgccatcagatacaataaccacagactagaggactacaatgatggtatgttgaccattgtatcttacaatgcaacctatgaaaattacatacgccctaccaggagtcaacaatattggaaaactacaccgtttgataggctgacaccaccccatattaaaaagagacttggtcgacctaaaaaatgtagaagaaaagatcagaatgagggtcaagccagtaacagtagactaaaaagatcctacaaagaggttacatgtactagatgcggtctcaatggtcacaacagtagaggatgcattaatagtggtgttccaccaagaccaaaaaagtggaaacctattgttgaagaaggcaataacttaaatgcaaccacaacaacactagaaacaatcttcatacctccaccaatgccaactgcatttagaccacctccacttaggcttttagcaccaattcgaattataatgtcagatggagtatctcataacaagaaccaaccgaattatatgagcttcatacctacaccaggaatgcccagccaccaagattcgaataactaa

SEQ ID NO: 74060 - DNA, 111 bp, Glycine max
  Peptide Sequence Number=SeqID_190838
atggaaaaatcctcagaaaggtcttcgagcttcgatttgagacttggaagaatgaagggccaaaagggtgttgaagggaggctgaaagaatgtgtctttgttgctcgataa

SEQ ID NO: 74061 - DNA, 1290 bp, Glycine max
  Peptide Sequence Number=SeqID_190839
atgattgccggatactgtgataccgtgacatttgtagcggcagatgcccttttttcggcacatgttacagggaactttattgtatttgcctatcagtttgtgaagggatcggatattcatgcctgggtaaagctgcttacttttcctgtctttattctcgcggttatggcaggagggaagattgccgggaaagttatcaatcattacacgctgttattctgggaaggaacattgctttttttagccggaattattgttgccgttctcagttactacggaacgttttcagaagttatgatgtatactgtggctatgatgaccgtttttgcgatggggcttcagaatgctttcgggaaactctatgcaaaggaaacccatggtcctactaccatgatgacaggaaatgtaacccaggcttccctggattttggaacgcttctgtcaagtggctttcaacaccctgaagcctgggcaagcctgaagaagcagttggttaccatacttggatttctgataggctgttttttaggggcatatgcgggaaaacaatttggactcgaaacattgattttaccggggctggccatgatcatctgctatttttatcaccgtaaaaactatataaaagcacaaatccaagaaaatcctgcactgttgagaaaacagatttcctcttcccccaatattgctcagaaaaccgctttattgttgcggctgagtaactattatattagtaaaaaaggagaattgaaggctgatctcgacagtgccgctattctgaacagacaggcaaaagcactgaatatgaaatccggagatccgatgtctgccggaaagctcatatttctggatgctaaactagataaagaaagaggcagtaaaaacattgctttatccaaaatgaaagaagcacttgcttattttgaaacccatcaatttaaggaacagaccggagaggcatataacgagttatcgtatatgtatgacaataaacccgagtattttgatactaaaattagactgaaagaaaaagcattggaactttttaaaaattcaggatcaaaactgaatcaggcaggcgtcttaaaagatcttggagaactatattatatcaaagaaaatcctgataaagcgctcggtttgctcaggcaatccctttctgtttatcagtcggtgaaattcagagaattacagagtgtttataaccttatttcccaggttgaaattcagaaggcggattatggggaagcgctccgttatggtcttctggcagaaaaaacagcagaaagc

SEQ ID NO: 74062 - DNA, 675 bp, Glycine max
  Peptide Sequence Number=SeqID_190840
atgcttggcgggggaatcgccatccagagcagaatggcttatcagggagaatattttgcagaccgttatggttccggcgccgcggaaagtacaccacccgtaaaaaaaatgctggaaatgggagttcctgtaggtggaggctcagatgccacaagggtaagcagttacaatccgtgggtttccatgtattggctgaccgcaggtaaaactgttggcggacttcaattgtatcatgaaacaaagctggacagatcaacagcattggaactgtacacaaaaggcagcgcatggttttctcaggaacagcagaaaaaaggtgatatcagggtaggaatgtttgccgatctggcagttcttgatcaggattattttacggttgatgatgaagatatcaaaaatattgaagcggaaatgaccattgtagacgggaaaatagtctatgccaaaggaacattctcatcttatgcaccaccatctattcctgtgcttccggactggtctcccaccaatctttacaacggatattaccctgcaggcggacattttcagaaagaaattgagaaaaatgcgaaacaggatttaaaagccccgctgacctcacaaattcacagctgtgcaggaagctgcgatattcaccatcataaccataaccaggccagaatgagcaatgtgccc

SEQ ID NO: 74063 - DNA, 321 bp, Glycine max
  Peptide Sequence Number=SeqID_190841
atggaagggttagtggacctagcagtgattgatgctttcctcgcctttcatcatggcaaggaaatcttggtcgtcgccattttggccatgcatgacacgttcgatcagagatgtgaaaagagcggcgcaagaattgtttgttgtacaccggctctctatgtgtggctgctgaagccttggaacgagaaaccaagaaggcccgaaaggaagaacacgaccaaaacaagttttgaggggctttatagggcagcaatagtgagctcaagctccgaagaggtgaaaggaatcatcacgggtcaaaggcatgatctggaaggatga

SEQ ID NO: 74064 - DNA, 204 bp, Glycine max
  Peptide Sequence Number=SeqID_190842
atgtgggagtgtgttgatgaaatgaacatgatggttggcagttcaagaacttcaagtgtggctcacaaagttggtcatcacaagaagaagacaaaaattgatcattatatggttgaatttcccgatgagatgcaacaatacattctgaacatcgttgatgcgactgataattattgtgtagaaagtcatttgaatcacatttaa

SEQ ID NO: 74065 - DNA, 1265 bp, Glycine max
  Peptide Sequence Number=SeqID_190843
atgaagcaccccagaggaaagcttcctcttcccatcattgtcatcacaacctgtgttcttgcttttgtggctatcttgtatgtagagaggctcagtttcctctcttccaagtccattttcaagttcaagccatgtcctagaaaaaccaccaaaccaaagactagtgacaaaaaaacagatgaggaggttgtggttgtgaatgcatcatcatggattgatgacaggtttgattttgaccctgaggagtgcaatgttgcaaatgggaaatgggtgtttaaccattcaataaagcctctctactcagacataagctgtccatacatagatagacaattttcttgtgtcaagaatgggaggaatgattctgactatcgccattgggagtggcagccagaagattgcaccttgccacgtttcaacccagagcttgccctcagaaagcttcaagggaaaagggtgctatttgtgggggattcactgcaaagaaaccaatgggaatcttttgtctgcttggtagaatgggtcatacctcataagcataagtctatgcaactaggaagagttcattcagttttcacagccaaggcttacaatgctactatagaattctattgggccccatatcttgtggagtccaacagtgacattgacatcatagatataaagaaaaggataataaaagtggatgctatagctgaaagagccaaaaactggacgggtgtggacatccttgtttttaacacctatgtatggtggatgagtggtgttaggattaaaacaatatggggttcatttgccaatggacaagaagggtatgaagaatttgacaccccagttgcttacaagttagctttgaagacgtgggccaactggatcgactcaaccatcaatccaaacaaaacacgagtctttttcaccactatgtcaccaacacatacaagccaagactggggcaacatggaaggtgtgaaatgcttcaatgagacaaagccagtgaggaaaaagaagcactggggaactggttctgacaagagaataatgagtgtggtggcaaaagtggtgaagaaaatgaaaattccagtgacattcatcaacataacacagatatcagaatacagaattgatggacattcatcagtttacactgaaaccggagggaaactgttgactgaagaggaaagggctaatccacaaaatgcagattgcatacactggtgtttgcctggagttcctgatacgtggaatcaaatacttttggctatgtt

SEQ ID NO: 74066 - DNA, 120 bp, Glycine max
  Peptide Sequence Number=SeqID_190844
atgtcaacaaatttcacacttgcgttatatattctggcagctgttcagaagaggcaggagctagctgagcagatcaaggacatctcgaaaaatatggaggtttcattcaagaacaagtaa

SEQ ID NO: 74067 - DNA, 579 bp, Glycine max
  Peptide Sequence Number=SeqID_190845
atgccagaacgacaacatggaatgtattacacaccgccgacattcacccaagaaccgcctcagatgccgccgatgtattcatacccacatgattttcaactagggtatagttttgcaggcatatttgggtcctctccttcttcaacgggaactccttcatttacccaaagtggtcaagtatcgaccccaaatgccccacttactggtctgtggaatgtacctggagatatacccgacatggacgacttattaggggtcgatttacgtcatgatttctctgccgaggctgaccaagctggggggtgtgggaagaggctgggggggtgtgacaagaagaggctgggggggaggggtgtgggggggcaggcgcctggctgccctgcgctagcagtagcgcctgtagcaggggcgccaccagtggagcctgacccctgggcgctacgaaaggcgcccgcgtcaggggcgctacctgctgtgccacgtgtcacgtgcacagtggaggcgcctgtctggggggcgctttgtaataaaaaaacagacccccccagaaataatttcaaaatagcctctttttggtaa

SEQ ID NO: 74068 - DNA, 207 bp, Glycine max
  Peptide Sequence Number=SeqID_190846
atgtctcctccacctctagaacctcacaatcactcacaaactcatctcaagctctcaggacggcttcctcttcaagctcggttctctgcaggtcttcacacaacaaaatctctcaaactctctggaacttggacctttctctctctagaaaaccctagacatgcaaaagcttcaagaaaaggcccaaactccctctccaaaatatga

SEQ ID NO: 74069 - DNA, 289 bp, Glycine max
  Peptide Sequence Number=SeqID_190847
gattctggtaatcgattacacagttatatttttgaagagtcatgatttttcaaaggttttttcaaatctcttcattggtaatcaattacaggattctggtgaagacattgaacatcgcgtatgtgtcaagcatttatatagcaacttcagaaagaggcacccagggactcacttaaaggaactgatgtggcaagctgctagagttgtaactattgcaccatggaagagggttatgcaaaagctgaaaaagactgataagagtgcttggaagacgttggaagacctataa

SEQ ID NO: 74070 - DNA, 213 bp, Glycine max
  Peptide Sequence Number=SeqID_190848
atggaagacactgcacctacttccggagatcccaacggaaagatcttccagttaaccattagcacaccattgtcatcattcatttccactgcagttaatgttctgttgaacggagtgacggtttctgaagtgacttggttggaagatttccaacctcctgatgactttgtgatccggaaagggcagtacaggggtccagttattagaacttga

SEQ ID NO: 74071 - DNA, 2106 bp, Glycine max
  Peptide Sequence Number=SeqID_190849
atggaagaaaagcagttagattttaatcagcctcttttatcggtaaggcgaatctcgtcaacagcggcctctgaaaatgactataaaagaaaacctgataaaccagtacccaaacgacctcctcttcctttttacaaatcagagttaaaatcgggtccagtgactaaccctggaactgttccttttgtatgggagaagactcctggaagacctaagaatgaaagcaaacaacaaacacaggctgttgaacgtccatccgttgctccgaagcttccacctgggagggttttgaaagttgaacagcaagattccgataaagttcctaaaggtgcatccgttactcaatccagaacaggaagcagtgtttcagattctccgcgtactgcatctctagataataaagtgacaaaacatgaaatcccccaagtaattgaggaaaaagcaagttctgtttcaaatgatgaggatgagaactatctagatgctcttgatacactttctagaactgaatcattcttcatgagctgtagcgtgagtggtttgagtgaatgggatggtccagatgtccaaccatcaggaaatttttcaacagaccaacagacacgtgatttcatgattggcaggttcttgcctgcagcaaaggcaatggcttctgaaacacctcaaattcaacacaactctaggaagtcgcttgttacacaagaacaactgaaacaggcaaggaaagtagaaagtggagcaaattcccgtccccttaatccgaaatggcaaaaggttttgccacattatgctcaagatattggtagggaagaaagcgaagatgaaagtgatgatcatgatggatatgaaaactatgcacccaaagtttgtgggctgtttcctcggttctgccttttgaatccagttccaggattaagaatggagggtaggattccaagttctacagttcatggagtgcagggtaaatcaattacttctcacagaagaactgcaaaagagcatggtagaactgctacttatgggaaaaagtctgtaaactcccaatctggctatacagaagagagagattttctgagtactgcagaaaaatctaagcatgatattgatccacatcgcagagcttgcagcaaatcattagcctctgagagaactgaatttgaatcaagttgtgaaagccctgttattgagaaaactctatatgtagattctgtacataaggtcaaaacttcaatttcatgttcttcagacaccaatctcagaggggatgattttgatactctaagaaaagacactgaccttgataaaaacctttctattgatttttctattgaggatagcaaacacttgggaattgtggatgagaaggcagtatcagaacctgaaatttcagcttctcttgattcatctctcctggtttgttctgataattcaaatgacaatatgcaaatggaaatgaaaaatcattccaacaaaatatgcccagaaaagcaagaattgacaaagcctgattaccaaggaagtaacctagatcatgatttggttgcgatttcaagtccagaaatggttgcatgggagaaaatagagtctgaaagcaaaggttttagcagtaaggaaagttctaatggcctaatcaagaatcctattgcatggagaaacaggaaatttgctagtgatttgaaatttgattcaatgtgccaacaagctaccaaattggttgatcaagaatgcactatcagatctagcgaggatcctagaactttggctagctcgaaggtggtaggtgacagaaagatcaacttagaaagtcaattgcagatgaagttgggccatggaaagacttcaaatgcaagctcgttgaagcttcctcttgcccttccttcaccaaaagctccttcagagtcttggcttaagcgcactttaccgacagtttcctcgaagaatatatctttacggttgaatcttgctacccactatcatgcaccaactcaaacacccaagacagcattaccggatcctaagtgggaaagaattgttaaatcttctgaagttaatcatgggcatcttcagtttgctcaggaactacttccacccattccagaagcatga

SEQ ID NO: 74072 - DNA, 432 bp, Glycine max
  Peptide Sequence Number=SeqID_190850
atgcaaggattgcatccagacgctagtgtcgcggacaccggtggctcaacatcgaacctggaattagattccgtcaactcgttcgacaccagcgagcatatgttcttgatgacacgaaaatcacaaagactgtctcttgaaagtctttttatgttcacccatcaccgtaagagtaaaaaactaagcaacaagcttgaacctcgcaaaatattgggcaaatacccagagaaaccccctctgcctttcatccgtggctccaattttccggcttcgtcgacatcgttggttgccccaaattttccgactttcgaatcggagacctgtctgttccttcgccggccttggcttcttttctcagttcaccgtggtgtccactcctcttcggccgtcatggatattgggaagggaaaggttgaaaacggtagggaataa

SEQ ID NO: 74073 - DNA, 1644 bp, Glycine max
  Peptide Sequence Number=SeqID_190851
atggctgagagcagtgaccattctggtggtggcaactcacagtctcaagtgattcaggttcctgaacctcaaccacacccagtcatggagcaattacctgatgttgagtattgcattaacagtcctcctccttggccacatgcactgctattgggattccagcattatattctgactcttggcatgaccgttctgattccaactacgattgttcctgaaatgggtggaggccatgctgagaaggccaaggtgatacagaatctattgtttgtttctggattaagcacacttttgcaaacttggttcggaacacgattgccaactgtagttgttggttcatacagttacataatacccgcaatgtcaattatccatgccaagagatacactaaatatacagatccttatgagaaaaacttgtccaaatacgcctttattcactgtggacctgtggttctacttggggatgttcattccttgttattatatgttgttgatgaacagaggttcactcacacaattagaggaatacaaggcgccttgatcataagttcaattttccatgtgtgtatgggattcttgggcatttggaggtttgctgtcaggttcctaagcccactttctgtagtcccttttgtaactttcactggactcggtctctatcatcttggattcccaatgtatcttaatcgttttattagcaccaagaggcttatttatgagcgatatgggctgttgttttccatcgcaagtgcatggttacttgcacagcttctgacttcaagcactgcatataacaacaagccagaaagtactcagaatagttgccgcactgatcgttctggtcttattagtgcttctgaatggtttcatatcccttttattccattcccatgggggtttcctaccttcaacttcggagaagctcttgctatgatagccgcttcttttgttactctatttgagtctactggtacattttttgctgcggcaagatatggaagtggaacacccgtgccaccacatattatctgccgcggaactggctgggtgggagtagcttctatggtcaatggctttcttggttctgtaactggatgtacggcatcagtggagaatgctggattattggcattgacaaaagtgggaagccgaagagtcatccaaatatcagccggctttatggtttttttctctatagctggaaaatttggagcagttttggcttctatacctttgccaatcatggcagcaatgaactgtttattctttggctatgtctcttctgcaggtcttgattttctccagttctgtaacctcaacagtttcagaatcaaattcgtgttgggcctgtcattcttccttggcatctccataccacagtatttcgtagaatatttttatgtaaagcatcatcacggatggttcaacgatatccttaacgtgttcttcatgtcgcatacgacggtggctgtgttggttgcgttcattttggacatcacactctcacgtgatgatgatgaagtccgtaaggacattggtttgcaatggtgggagaagttccgtgtatatagtgctgatggtcggaatgctgatttctataagttaccttgcagactcaatgagttcttccccgccctttaa

SEQ ID NO: 74074 - DNA, 1236 bp, Glycine max
  Peptide Sequence Number=SeqID_190852
atgatccgttgtacccacattgcagagatgacacctggtgcatatgacgggttgattgctacgcccgaaaaaatcaatgattttgttgattgtgaagatgaaagagcaagttcaaagtttcggaagggagtaagactatggagaaaactaaaatatcagcttgtagaatacaattcactgccaccctacatgagggacaacgaatttatcttgggttattatcgagcagagtggccattgaaacagatcttccttagcattttctcaattcataatgagacacttaatgtatggacgcatttgattgggttcttcctttttctctttctcaccatatacacagctaagagagctccaatgattgtggatttcaattctgttcaacatttgtctgaaatgatagggaaagctgatttaaataagattcgtttagagctcttgaaatgcctgccttcactgcccaacatgcccgagattctcaaattaaatgacttgagtacatctctttattctttggacttctcctcattatcaggttgggctctagtggaacttctcaccaattgcttgcctgagcagttttccctaaatggtctgaaagatgacatgaacatggtatcccccttaatgcaaccgattacaaggtggcctttctatgccttcttaggtggggccatgttctgcttgctagccagcagcacatgccacctccttacttgccactcacagcgcctttcctacatcatgctcagaattgactatgctgggattgctgcattgattgcaacttcattttaccctcctgtgtattactcatttatgtgcaacccctttttttgctacctctacttaggcttcataacattaatggggattgctactattgtcttctctcttctcccatttttccaaaagtccgagttcaggaagtaccgcgcttccctcttctttttaatgggattttctggtgtggcgcccataatacataagttgatattgcacaagcatcaacctgaggccttgcaaactactggttatgagatactaatgggagttctttatggtttgggagcagcaatctatgtcacaaggataccagagaggtggatgcctggcaagtttgatattgctggccacagtcaccaactctttcatatcttggttgtggcaggggcatacacacactatcatgatgggttgatctatctaagatggagagattctcaaggttgctag

SEQ ID NO: 74075 - DNA, 1443 bp, Glycine max
  Peptide Sequence Number=SeqID_190853
atggcaagtccaggatcgcacattgttgtccttgcgttcgtgttgctcatttcatcaaaacttgcagaatgtcacaacatagttcgcttccttcctggcttccagggaccccttccttttctacttgaaactggaccaataatcgttgttgcgcttgatatcagttacgtggaagtgggtgaaactgaagcagaggagcacgcagaactcttctattattttatcgagtcagagaacgatcctaaagggaaccctctcctactttggctaaccgggggtcccggttgctctgctttctctggccttgtctttgaaataggtccactgacatttaaaaacgaggaatacaatgggagcctacctaatttgaccttgaagccacaatcatggacaaaggtaagtagcattatatttgtggatctgcctgcgggtactggcttctcttatcccaaaacagaacgtgctgttcagcaaagtagctctaagcttgttcgccatgctcatcaatttattaggaagtggctaattgatcatccggaatttctctcaaatgaagtctacattgctggtgactcatactgcggcattcctgtcccagttattgttcaagaaatttcaaatggaaacgaaggtggtatgcaaccatggatatacatccagtcactgcaaaagaattgtagaggagagtatcgcaacatagacccaagaaacgcgttatgtctaagagacatgcaatcgtacgaggaggccgcggaagcgcctgtacggaatcccggaccaacgggaatccccgccgtgatcgatccatctggaatcaattcatatggacaacactttgtgcctcgtaatgttcatatcagaggaattgaaactggccatgttttggcacccctttgcgacgagtccgatctgcgtaatgatatggaagtcacttggagaagaagttctcttgctcataaaacctcagcgtttttcagtcctcgtctcacattgccacccttatactgtcgatctcatgcatatgtcctctgtagctattgggccaatgatgataatgttcgcaaagcattgcatgttcggaagggaagtataggaaaatggacgcggtgtaacgatgacttaaaatctaagtttaatgccgatatccctagcagcttccaatatcacgtaaatctcagcagaaaaggctatcgttcattaatatacagtggggatcatgacatggtagttccattcttggctactcaagcgtggataagatctttaaactattccatcgtatctgactggaggcagtggtattacgatggccaagtagcagggacttactcaaatcggatgacatttgcaactgtgaagggtggaggacatacagctcccgagtacaaacctgaagaatgtttagccatgttcagtagatggatatctaatatgccattgtag

SEQ ID NO: 74076 - DNA, 630 bp, Glycine max
  Peptide Sequence Number=SeqID_190854
atggatatatcaagttcacaatacaatagtgctggtgagtctggttggacacgttacttggatcattcctctctctctgagagttatttccagaggagaggtgggatagaagactatggaggaaagggggcaacactggaggaagaggaagaagatttgtccatgatctctgatgcttcatctggtcctccacattaccatgaagatgatgatcaaaactactgtgtaaattggtatccttctacttctcactacaccaaagaatcagaaaacaacaagaacaagaaggtcaaagaatatggtaacaatcaacaaccttcatcacctcttgatgacactgccagttcccctgttcttaactgtcccaaggcaagtcaaaatgcaattaagaaagccagtttctcagggaatggagcagtggaaaatgcagtggattttcccccatgtttttcgggaacaagaattaagagaaagtctaaattccagaagcacttcagtttctttgagcgttctcttggtggaaaacaagcttcagaggaaccagtttggaacaacataagagaatataagaaactgaagagggtttctgattccattttcttggatgccatcagtgacaggcatgtctga

SEQ ID NO: 74077 - DNA, 264 bp, Glycine max
  Peptide Sequence Number=SeqID_190855
atggagtgctgggagggggggacaagcctcggggacagaggggaacttgggggagaaggagggagtggggtgcctggggtcgcgcctgcagcaggggcgccaccagtcgcgcccagtcctaaggcgctagcagacgcgtccgcgtcaggggcgttacctgctgctccctcgtgcgccgcgccgacgccacatgtcgcgtgcacagcggaggcacatatctgggaggctctttgtaataaaaaaacagacccccaggccaactaa

SEQ ID NO: 74078 - DNA, 300 bp, Glycine max
  Peptide Sequence Number=SeqID_190856
atggaatctcagcaagcaaaccgtgaagaacttgatgagaaggcaaggcaaggtgaaactgttgttcctggaggaactggaaggagccgtggagggcagacgaggaagcagcagctagggtcagaggggtatcatgaaatggggaccaaaggagggcagacaaggaaggaacagatggggagagaagggtaccaagagatgggacgcaaaggaggactcagcaccatggacaagtctggtggagaacgtgctgaagaggaaggcatagaaatagatgagtctaagtttaaaattacctaa

SEQ ID NO: 74079 - DNA, 345 bp, Glycine max
  Peptide Sequence Number=SeqID_190857
atgccgccattgttgccggcgggaaagcttgtaccgccattgacaactgcgggaacaaggatcccgccattggcaactgcggcactcagcctaaaccgccagtacgaacggcgggacaggctgagtaggagagagagaggctgtaccgctgatagttgtggcgggacgaggagagatggagccatgccgccattcctcctggcgggacatgccaacgtggcagtcccgccactgcctcctgcggaacaccttgacgggacaagggccagcgttcacatgcatgctgaatcatttttatgcaggctaggcatgctgaatcatttttatgcagtttatgcaggctag

SEQ ID NO: 74080 - DNA, 231 bp, Glycine max
  Peptide Sequence Number=SeqID_190858
atgaagatgaacaaaagaaggcccaaaagggtactcagaacacgcaagagttcactgaaagagcaaccagaaagaggtgttttgagtcacctactggaaaatgagacagaaaatggtggcaaaacagaaaccatgttgagtagagaagccattgaagattcagcagagcttgaagatgcttacttgggatacacagaaaaagacgcggattatcgatcctttcagtggtag

SEQ ID NO: 74081 - DNA, 273 bp, Glycine max
  Peptide Sequence Number=SeqID_190859
atgacgtggatgccgccattgttgccggcgggaaagcttgtaccgccattgacaactgcgggaacaaggatcccgccattggcaactgcgggactcagcctaaaccgccagtacgaacggcgggacaggctgagtaggagagagagaggctgtaccgctgatagttgtggcgggacgaggagagatggagccatgccgccattcctcctggcgggacatgccaacgtggcagtcccgccactgcctcctgcagaacaccttgacgggacgtga

SEQ ID NO: 74082 - DNA, 1665 bp, Glycine max
  Peptide Sequence Number=SeqID_190860
atggctccgtgggctttacctccatgtccatggccttctgactcatgggccaggcccaatttcggacaacagcggcagcgagtacaacctggtattcttgggcccagacctccacaagcatacataacaacaccgactccaaccgacatagaagcagcaatgcatactctcgggctcactccaccagatgtaaattggtacatggacactggtgctacgtctcacatgacttatgcacaaggtaacctcacgtcttattttaatatgagcaataaacgtggtataattgttggtaatggtcattcaattccaattcatggttatggtcacacaacattgtcttccccatgtcctcccttatccttaaataatgtcctacatgctcatcaacttgttaaaaacttagtgtcagttaggaagtttacaattgataactctgttactgttgaatttgatccatttggattttctatgaaggacattccgacggggatgccactgatgaggtgtgagagttggggcgagctttatcccatcactaagcctacaaatccagccacatcaccatatacttttgcagccttagcaccatctctttggcatgaccgtttaggtcacccgggagcacctgttcttaactctcttgggaagaataaattgattgagtgtaatcaaattaaggactcttctaatggtaaaaatcaacaggttggcatggattatggtgagacatttagtccggtgatcaaatcgaaaactattcgcacagttctcaatttagctctgtctaaagattggcctattcatcaacttgacgtcaaaaatgcgttcttacatggagaactcaaagagactgtttacatgcatcaacctttgggttttcgggatccagatcggcctaatcatgcccctcgggcttggtataagagatttgttgactatgtacgtactcttggcttctttcacagtacttcggatcattctctattcatttatcatcaaggtatctctatggcttacctattattgtatgtggatgatatcattttgattgcttcctcggatgagctccggagatctatcatatcctttcttagctccgaatttgctatgaaggacttgggacagttgagctattttcagggcatagcagtgactcgtcatgtaggtggtttatttttatcacaaaagaaatatgctgccgagattattgatcgagctggtatgtcttcttgtaagccatcttttacacctgttgatacgaaacccaagcttagtgctactaccaacacaccatttgaggatccctctctttataggagtcttgcaagggctctccaataccttactttcacaagacccgacattgcatatgcagtgcaacatgtatgtttattcgtgcatgaccccagggaagaacacatgtacgctctcaagcgcattttgcgctacattcagagtactctggattttggtcttcatctctatccctcttccacatccactcttctcttttatactgatgctgattgggatggatgcccagatactcgtcgttctacctctggttattgtgtttttctaggtgacaacttaatctcttggtcagccaaaaggcaggctacgctcactactacaaaatctagatttaacatcgatttttga

SEQ ID NO: 74083 - DNA, 504 bp, Glycine max
  Peptide Sequence Number=SeqID_190861
atgacaaagaactcctacctgcatgtaatatcttttgatgtacaaatgaacaacattaatggccacatacctgaagagattgaaggctgtgaagagctccaaaactttgcagcatcaaacaacattcttgaaggagacttaccttcccctatgggatctcttatatctttgaaaattctgaatttggctaataacagtttatctggatcaatccctacagctttgagtcatctttctaacttgacatacctgaatttggtagcattccaagtaacttctggctcaaaggttcaaagcttcaacaacttttcttggccagaaacatgctctctgacaagtttcccttggagctactcaactgctcctcaatccaatagttggaactttctaataacagctttgaaggaaaacttccttccatcttggacaaactgtagaacctcacagatcttgtgctcaacaacaacagctttgttggacaaccacgtaacattggaactgtga

SEQ ID NO: 74084 - DNA, 1383 bp, Glycine max
  Peptide Sequence Number=SeqID_190862
atggcatcaaatataagcgaggcatcaatgcgcttagcgagtcaagggaatccgaaagagaatctgccatgcatgcatgcatctagcacgccatcaactcgcccaacgagttgtttgtctcttcctgcgctcagcgcgcctgtcctgctaagctctaagagactgtttgtcttctgttggtggctaagcaagtcagtctcgctaagccacccagcctctgtagagtatgacgagttccatagagaactcaagaggcactactggcacaaggccttgaccaggcaaatagatgggcatattgatatggtcctggtcaaggaattctacgctaatttatatgatctggaggataaatctccgaggcaggtcagggtgaggggcaaacttataaagttcgatgatgagtccctcaacaccttcctggaggccctcgtgattctggagccaggggagcacgttactacatattccaggttctaccgtacatgcacagaccctcaggagcttgctgctaagctttacattccagggcgtgaatttgttttaaatgttgaaggagcgccctggaagctcctaaagaaggacctcaccaccttggcgcagacctgtagtgtcctatcttattctaacctcgcccccacatttcacacatctgatctgaatatggatcgggcgaggcttggctttcctacactcattactgcactgtgcatagccagaggagtggtattagattctctgactttcgagtctctcagccctaccattaatttgacatatataaagaagaattgttggaacctggatgacccttcggtcacatttccagggacctgcaaggccagggctcaaggatctgaaggcttatcttcttctgctccccttgctcctactccctctacatcaactcttccatcaccaccagttcacaccggcacctccacttcgagctccgatgtcacagtgccgattctgcagagcctccaccatggcttatgcctggtgatgcaaagtatccatgatctggctcagcatcgacctattattggcatggaggatttcatggcacgggtggcctggccaggagtccagccttctcctttgggggtaggtgaggcttccgcaggccatgagcctctatcgaaagtcacacctgaggttactctagaggccactccatggacttcaccggtcaccatatcagttgtggaggtctcagaggaggaggatggcgctgcagacatagattatgcagcaaacatgacaacaacgcagagtacctgggatccctggcctacagctacacaggagacacctcagccagcccaggacacttccttttcacctcaggatgagccaactgcaccacaagaggagttgtga

SEQ ID NO: 74085 - DNA, 1134 bp, Glycine max
  Peptide Sequence Number=SeqID_190863
atggaccttccgctcctcaggaagagtctccaattctctcgaagaaacaaaaagtaccttctcctaattgctttattcggcgcctccggttacggtgcctacagggcctacaattcaccctatgtcgctcagaaacgatgccgtatcgccaagctcctcagagccttcgtttccgtcgccgagttaatttccaactccgcggacaccgttaccgttatctctaacgacttgaaccgtttcctcgcttccgaatccgacgaaatcccaaacagtttgaagcagttagccaaaatagcaaaatccaacgagttctccatgtcgttggctagggtttccgaggctgtgacgcttgggattttgctagggtataaatcacagcctggtaacgataaaaaagatacgaaaatcaccgcggaagcttctggattctcggatagggtgttggagaggtttttctccaaggctggaacgggttttgtgtctgttgtggttggaagctttgcgaggaacttggttttgggtttctacgacgccgaaccggtcggtgcgagattccaatcggatgttcctggatgggtgaatgtgatttgtgatgagaggtgtgggaagcttataggggattgtgtgcagacttttgtgagtaccgctgttgctgtttttcttgataagacaatggatgtcaatacctatgacgaaatgtttgccgggttgtcaaatccgaagcaccaggaaaatgtgaaggggattttggtttccatgtgtaatggtgctatggaaacctttgttagaacctctcaccaggttctgactaacggaactgcgaggccgaatacgggtttgtctgtggctcctgttgttgttccggtgagtgaagatgggtgcctgaaaccggaggtgtttcagctcaaaattggaagcttgattaatggtgttcaggatgttgggtggcttgaacagatcaagtcagtgctgtcggtgcctgcaaaccggaggttcgtgcttgatgtcacagggagagtgacgtttgaaactgtgaggtcgttcgtggcgtttttggtttggagaatatcagatggattcaagaggagtgttagtaaggttcatgaagaggttatgggcaaaggactggaggtg

SEQ ID NO: 74086 - DNA, 1356 bp, Glycine max
  Peptide Sequence Number=SeqID_190864
atgtcatggctggctcgttccttcgcaagctctctccgactcgatgacgacgaaaacgacatcgtactggatccacctaccacgtcatcgagagaacccccgcaacagcaacacgaggcacgagaaaatgcattcggatcagaagaagctgaagaagaagaagacgacgacgaagagacgcaagagcgtggtggagtcaaagaggacctcgacgaaatcaaggaaaccctaactcgtcaattttggggaatggcctccttcctcgctccaccgccatcagattctcattctccatccgatccctcttcgttcgtttccgatcaatccaatcatcgcgctgtttctccgaacgaagtaccgcaattggatgacgctgcgatttccaatcactctaattcggtttcggtgggatccgattcggatggggattgtggtctcgcgcaacgcgcggttggaattaccgaagaggtgctggtcttcgcgatgaacattgctatgcatcccgagacgtggttggattttcctattgatgaggaagacgacaccgatgattttgacatgtctggtgcacaacaagagcatgctgcggttgttgaaagattgactcccagattagctgcgcttagaattgaactgtgcccttgtcatatgagtgaaagttacttctggaaagtgtattttgttcttttgcattcaaggcttaataaggaagatgcagggattttgtctacaccccaggtcatggcagcaagagcaatgtggatgcaggaattgcataaacaaacaaagcctgaatttgaaatttccggaagaagtgtttcctactcaagagacaatgcagcacaacacaatgatttttctcccgacttattagatgacacttattctgatgacatgcctagtcagacatatggatatagaacaacctctttgtccatgttgtcagattgtgagactgataagcacatggttgaaagttctggaacacatttcactgataagtctgttattgagaaaaattccattattaaaactgaaaacaaggatctaaaatgtggtcagccctctcaaattattattcaggattatgatgatgatgatggtgatgaatggccagaggaagattctgatttagggggatatggtggaacaactcatcccatggtgaatgaagaagacatatctttcagtgatctggaggatgatgattatggcattaaacccgttagttccagtacaggaccagtgaatcctcactcagcaccaagaacaatgaagagattgcctgatgtttggaaaaacacaagtactggtgtctggagcattcttttgtatataatgaatggcggtgaatga

SEQ ID NO: 74087 - DNA, 372 bp, Glycine max
  Peptide Sequence Number=SeqID_190865
atgctatattttggcacagatgacattgaaatagatgagcccatacctaaggcttctacttcatctcctgatgctaaaaataaacagaaagataagttgcaagatagagagaaattatttgaaggagggaccaataatgatgatataaagccaagacttagaacacctgaagaaattatggctacttatagaaaaactggggatgctgcttcagttgctgcccaagcaagaaacaagcttatggagaggcaggaaaaattggagagaatcagccaacgtactgctgaactgcaaagtggagctgaaaattttgcatcattagcaaatgagcttgtcaagaccatggaaaggaggaaatggtggcaaatatag

SEQ ID NO: 74088 - DNA, 492 bp, Glycine max
  Peptide Sequence Number=SeqID_190866
atggtgaagaagcattccaatttaatagggaaaacggtagttgaggagcaagatgcttctgatatcgaaatggatatgaggttttggcacgatgtctttgatttgtattttgtctgtggcaaggaatcaaggggacgccaagatgatgatcttgttttctttgtcagaaaattgggttcccatggttctggttccaacaataaaacagagagcgttgatccttattttgtacgcaggtgggcacctaagttgagcgacttagtggatgaaacttctatagatgtggactggaggcgttcgttttacttgaatttaattgctcatacatcattcagtgtaactgttgcaatttgcagtcaccaggatcttcttaaccatcgagctggagaggatacacctttatcccctatatataaggaagtggaaacgactcctgcttatccagatatatgtttcgcaattgatgattttgactccacttttgatgctgtg

SEQ ID NO: 74089 - DNA, 243 bp, Glycine max
  Peptide Sequence Number=SeqID_190867
atgtctaaactggccaccttcttgtatcttctcatttgcttcggcttaacctatgcctctcgtcctaacgttgagttcgacgcaatcatttcaccgcacagggatgtttcggcatacaaaacagccttagcagtgttggacgatgagagttgcgaaggaatagacgggagtgaggaatgtttgatgagaagaactctagtggctcatgttgattatatctacactcaaaagcataaaccataa

SEQ ID NO: 74090 - DNA, 359 bp, Glycine max
  Peptide Sequence Number=SeqID_190868
ggaaagggagggatttaagcaaccgaaatcgctgctggggttggcgatttacccacctcaagcaaatcgccaatcaaactggcgattccctgctcctctgtgcgctgcagctgctcagtctgcaccctccctcgaaaacgacttctgcgtcctgcacccctaggcctgccatttccgaaactccccagtcagagctgcggtttcagcagcagtggcgaagtcgccaatgcaagtggcgagatgcccttccacgtgaagtcgccagcaccactggcggtttagccttccatgtgtcgcatggcagcgaaatcgctattgccaatggcgatttgcatgaaaaatgcatgcagttcacataa

SEQ ID NO: 74091 - DNA, 180 bp, Glycine max
  Peptide Sequence Number=SeqID_190869
atggttgatgagatgatactcaaagccagaactgcaattttcaccataagcaggacaaattattgtcccaatgatcatcaaagggtaaagacaatgttcaagatcagaaacaccaatgatcatcaaagggtaaagacaatgttcaagatcagaaacatcacaagcttgtttctttggtga

SEQ ID NO: 74092 - DNA, 627 bp, Glycine max
  Peptide Sequence Number=SeqID_190870
atgtatagttacagattaatggctgctcttgttttgactgaaaaagatcattgctattgtgtagttctaaatgcacatgatggggcagcatttccgagtgaaaaggtgtccaatgattgtagtactagtgatagctcctctttgcaagtccacactatttctgcaaagaaaaaggatacaaagcttacacttttctcaggatttgtgagctatcagatggtccgagatgcttatgatgctggtaggtctagatttgggagccttttatcagtggtccattcttcgggcaaaacagacaggatttacatgaaaggtcctggaggccgaggggaagttgaagtagctgtttctggtgttgcagatcaaagccacgaagattcaggcccattttctccggttatatcaaagaaagggtttgggcttggtgtaattgtccgcaaagcagcatctgctgcatcagtagctgcaaggcatgcttatgcagctgcctctgcctctagccctacttttgatgagttgatacctttgaaatgcagcttaatgtccatatcattgccctgggaatatattgcgtatgatcttctgtttaaggtgaggttttgcattgaccagctagggttaaaatga

SEQ ID NO: 74093 - DNA, 435 bp, Glycine max
  Peptide Sequence Number=SeqID_190871
atgtttttccaccaagatgaagcggttcagtacccgtgcactccagttcacgagaccatgctgaccgaaagcgaaatagaagacttgttttctctcattaaccattcgacagacccggctagcccggggtccggttcccagggttcaaaccgggtggtttactcgccagaggaacgaaagctgagacgcatgcaatcgaaccgggaatcggcccgaaggtcccgctacagaaagaagcagcatatagagaacctcacgagccaactgaaccggttgagaatccaaaaccgattactcaaaaaccaactcgcctccaccatgcaccagaacctcctactatccctacataacgaccatcttaaatccgaatccgttgcccttatggccacactttcggatctgtgtgggattttaggcaccatgctttcacattaa

SEQ ID NO: 74094 - DNA, 1030 bp, Glycine max
  Peptide Sequence Number=SeqID_190872
atgacttcattgtcagttttgttcttgattgatggtgtacctagctctagttcaccaattacttcattggtttggaaacaagaagcatattttctaagtggtgtgaatagtttaaagcaatcagaaacagattcaggcaactctcttgaagaaatactatttgtgttatcccgggatggaaaaattaatatagttgatagtgatagtggaaaaattatctgcagtcggccattacaagtgaaggaatccactgcaatttcaatcatatcattggaaattctaatagatttttgtaccccagagggtagcatctcagcgtctgaagcatcaaatgacaagctgcaggaagaacctgtgaagaatactgctgatgctagccctgatgaggaggaagaacccttatcaactagggtaaattcatcagaagctggtctgccctcttcagaaagctcacactctggagatttactgttggatccacttgttctgctatgctgcgagaattcattgcgcttgttctctgcaaaatctttgatacagggacataagaaaccaattaaaaaagtgaaacattctaaatcttgttattggactacattttttaagaaagatgacaaagtttatgggcttctatcattgcttcagactggaacatttgaaatcaggtctttaccagatttggaattggttgcggaaagctctttattgtcaattttaaggtggaattataaagtgaatatggataaaaccatgtgttctgatgatcatggacagatagtactggctaacagttctgaattagcattcatgtcattactggctggcgaaaatgaattcagtaatccggagcatctgccttgtcttcatgataaagttcttgcagccgctgctgatgctgcctttagattctcttcaaatcagaagaaaaaacagaccgtggtgccggggattctaggtggtattgtcaaagggtttaaaggaggaaaaaccactccaacagatgtgactaaaattccaacctccaattttg

SEQ ID NO: 74095 - DNA, 204 bp, Glycine max
  Peptide Sequence Number=SeqID_190873
atgggccaatctaggtctaatgtaggtcccaaattcggtaaagaggatggtgacgaggaagagttaagaaaaacctctactttatctttgctaaccatcacatgggatatggtggaggttgcacttgtggtggctcaacaagttgaacatcctagtgtacaaaagggtcaattggtgaaagaaggaaaatggcaagtggattag

SEQ ID NO: 74096 - DNA, 261 bp, Glycine max
  Peptide Sequence Number=SeqID_190874
atgattgaaaatatgtgtgcacttcaaagcactggtacttgggatttgttaccttttccccctgggaaatccacagatggatgtcatttgttgtataccattaagtttgccccgatggtaccattgatcaattcaagcctcttttggtaccaaatgatatacacaagtgtacagatgtacatggagcaaccacaaggatttgttgctcagggggagtcctctactatggcatcgaaagttgctcaatccaaggatgattaa

SEQ ID NO: 74097 - DNA, 1734 bp, Glycine max
  Peptide Sequence Number=SeqID_190875
atgtttgccaagaggttgttgcacaaggctgtgctgcaccattccaaccataagttgcagcatggcggtttgcagggaaatgagttggatcccagaattgtgattcactatggcattccatcgactgcttcagttctcgcctttgaccccattcagcgacttttggctattgggactttggatggaagacttaaggtgatagggggagataatatagaaggacttttggtttctcctaagcaattgccttacaaatacttggagttcctgcaaaaccaggggcatttagttggtgtcttaaatgacaatgatatccaggtttggaatcttgagagccggagccttgtttgttctttacaatgggagttcgatattactgctttttctgtaatcagcggttcacatttcatttatgttggagaccagcatggcttattttctgtgataaaatttgaagctgaggaaggacaacttttgaagtcatcatacaatttgtctgcaaaatttctaagggaagctgcaggcttttcagaacccagtgagcaaccaatcattggagttcttttgcaaccttcttcttttgggaacaggcaagatataactagaattgtgttccttggtggtggaaaagatctccaattgaaggatgaagatggtaactcttcttccgaatcgggcgccaatcctccagctgatattgtagaacaaaatctaggtgacaaagagataactgctctttgctgggcatcttctactgggtccattcttgctgtgggatacttagatggagatatccttctctggaacttgtcatcagcagcaccttctaaaggccaacaaacttcaaaaaatgttgttaagctacaactttcaactgaagaaagaagactcccagtcatagtcttacaatggtcaaatagccataaatcccaaagtgatagtgctggacagttgtttgtctatggtggcgatgaaattggatctgaagaagttttgactggatttcaggttttaactcttgaatggtcatctgggatggagtccgtaaaatgcaccaatcgtgcagaccttacacttaatggctcttttgcagacttgattttactgccaagtcctggaacaatggggttgagcagcaaagatgaactttttgtactgacaaaccctggacaactacatttgtatgataatgatagtctgtccacattaacatctcagccaaagaggacgccatctgtttctgctgtggagtttccagtgctagtacctattgctgatccatgtttgactgttgcaatacttatcaggttgcccagtaagtcaaattcatcaaaaattctcactgaggtagcctcagcaatgagaactggctcaaggcctggatcagctccttcaaattggcccttgactgggggtgttcccagtctatcatccacggctaaaggtgctgtggttgagagagtttattttgtgggttattctaatggatctgtccttgtgtgtgatgccacacatgcagtcttatcttatatttgctacatagagggagaagtgaatggtataaaagtggctggttcagatgctcaagtgacaaaattggacttctgctctgtttccttactgttggctgtgggcaatgaatgtggtcttgttcgcatttatgacctcaaaggccactctggtggacgaaatttccattttgtcacagaaacaaaaagtgaaggtgatccctag

SEQ ID NO: 74098 - DNA, 387 bp, Glycine max
  Peptide Sequence Number=SeqID_190876
atggtccatgatgctccggaagggggccttgaggtggtcagcggggcagaagcaggcggagtcgaaaaggtagatggtgcgtgggcaggtgacatcatagagggtgaggccgaagacaaggacgacagagcaggtgaagacgttgtactagaggtggagccacaggtggtggaggtcaaagaagagaaggttaaagttgttgatgactcgcttagcgagacagattggctaagcgagcctcatccgcttagcgaggtagtcagctcgcttcgcgaatgggaaaccctaggagaggacaagtcagagatctgcatgcccaacgtgcagccagcccgcccaaccaagacgttgtctattctcgcgcttagcgcgcccatgctcgcttag

SEQ ID NO: 74099 - DNA, 324 bp, Glycine max
  Peptide Sequence Number=SeqID_190877
atgaagatgccgtcatattttaattttccagcacttgatgtttctgttgcatttccacaggccactccagcctctacttttcctccttgtgcttcagattattttcatttcaatgacttgttgaaaccggaggagcaggccgtgaggaacagagtgagagagtgtatggaaaaagaaattgctcctataatgactgaggcatgtttctctttcttgcttattgttttaaaagaagcagaaataggacaaaactcagctgaaattccttttgtttggataactgttctaaatgtacttttgggtgggaaacttttttttttttaa

SEQ ID NO: 74100 - DNA, 216 bp, Glycine max
  Peptide Sequence Number=SeqID_190878
atggcaaaaacagagtcatttggagcaaaacagagtgagcggtgttcagttaggaaacagagagatgatagaaatagtgggcgttgggactggtttcggtgcaatttgtcggcacatgcttggtttggaggcaggtgctcaattatggtgtgggggtgttggtatttgggatttgggtttttggattcacacttggtgcgaggattaatcaattga

SEQ ID NO: 74101 - DNA, 1041 bp, Glycine max
  Peptide Sequence Number=SeqID_190879
tactgggagaaggctgaattcccatttcatgttatcccaaagtttgctgccctgcgtattgctggtggcacaattaagggttatggttgtcctgatctttccatagctggaagtgctgttgctgcagcagaagttgctagagttgatgcaagctgctcaactttctttttggtccattcttccttggcaatgctcactattgcattgtgtgggtctgaagctcagaagcaaaagtatctaccttctttggctcaaatgaaaactatagcatgttgggctttgactgaacctgactatggaagtgatgccagtgctttgaagaccacagcaacaaaggtggaaggtggttggatccttgatggccaaaagagatggataggaaacagtacatttgctgatttgttggttatctttgctaggaatatgacaactaatcaaataaatggatatattgtcaaaaaggatgcgccaggtttaacagtaacaaaaatggagaacaaaattggacttaggatcgtacaaaatggagacatagttatggggaaagtttttgtccctgatgatgacagactagaaggagtcaattcttttcaggatacaaacaaggtacttgctgtttcccgtgtaatggttgcttggcaacctattggtttatcaatgggcatctatgatatgtgtcataggtacctaaaggagaggaaacagtttggagcaccattagcagctttccaaatcagtcaacagaaacttgttcaaatgctaggtaacattcaagcaatgattcttgttggttggcgcctgtgcaagttgtatgagagtggtaaaatgacaccaggtcatgctagcttggggaagtcgtggattaccctgagggcaagagaaacagctgccttgggaagagaattgcttggtggcaatggaattttggctgattttctagtggcaaaggttctcatgcctaatttcatttttgaaatttattttgttgaaccttctattggatctagattcaaatggggtaattttagaatggatttttag

SEQ ID NO: 74102 - DNA, 225 bp, Glycine max
  Peptide Sequence Number=SeqID_190880
atgcccttgcggggttggattgcatcatgtttgctagggcagcatgacgagtcagggaagagggagcgggccgtctattacttaagtaagaagttcacggcctatgggatgaactactctttgcttgaaagaacatgttgtgccttggtgtggggggcctatcgtctaaggcagtacatgctgagctacaccacttggttggtgttagtcatcttatacgactaa

SEQ ID NO: 74103 - DNA, 480 bp, Glycine max
  Peptide Sequence Number=SeqID_190881
atggaggccatgttgagcatgaagaaaataatggaaagcaatgcggctgtagttacccctacaagtgtcgccactcaagtagacccaactcacccatcgggcctcaatcaattaaatcctccaatctcggatatggtaggtcagggaggagaagcatttggaaatacaggtggcccctatgttgtgaagagcaagaattctttcccatcatacgacttgcctcctaactatgcaccacccaatgctgtaccagtgcttgacgagaatgccaacaactccacacctatacctattgagggccaacaaccccaatctgatcatgcacatgcattttgtggcgtacccctgccaaacactttgtggggccctcagtatcacccacaaccacaacccttgcattctgtggcgggaagagtccctcctgctagggtgaaaagggagaaattggatcatatagaggaaaggctaagggccatttaa

SEQ ID NO: 74104 - DNA, 272 bp, Glycine max
  Peptide Sequence Number=SeqID_190882
ggacctagaagaactggagctggtggtggtgaaggaagagcagaagtagatggagctgatgtagatggggccttagatcttctagccctggatttctgggttcctggaaaagtgactgaagggtcatccagtggtgagatctttcctcaagagcttccatggcagaccctcagcattaagaactgtagcaacctacccttcggcgggagggcgacgcgtgactcgcgggatgcgtgttccacgaaaggaatacgcgcggagtcgccaccaac

SEQ ID NO: 74105 - DNA, 117 bp, Glycine max
  Peptide Sequence Number=SeqID_190883
atggagagcctttgtcggaaacaacccaaggatttggacgagcttcaagcacgagtggtgggatacatccaaatggagttgtttactttctgcaaccagatgcgctgtacggagtag

SEQ ID NO: 74106 - DNA, 515 bp, Glycine max
  Peptide Sequence Number=SeqID_190884
ctcaacattttattggagacccatccttatggaaagataggtttgcagaattattatcaaatcttaagtgtagaaccttagcagattttaggtggtacagagatactttcctaactagggtttacaccagagaagatagtcaacaaccattatggaaagaaaaatttctagctagtcttcccagatcattaggagacaaggttagggataaaattcgtagtcaatcttccaatggagacattccatttgaaaacttaagctacagtcaattaatttcctatgttcaaaaggtagccttgaaaattttccaggatgacaaaattcagaggcaattagccaaagaaaaagctcaaacaaggaaggatttaggttccttctgtgaacaatttggcttaccaacctgcccaaaacaaaagaagaaacaaagaaagaaatccaggatcataaatcagccaatagaaggagattttcaaaaggaagatactctcaaaaaccctcaactagtaaggaaatag

SEQ ID NO: 74107 - DNA, 780 bp, Glycine max
  Peptide Sequence Number=SeqID_190885
ctacatgtccttgccttcagaggactacacgtcctcgccttcagagggctacacggcctcactttcagaggactacatgtcctcaccttgagagggctacacgccctcgccttcacagggctgcacgccgtcaccttcagaggactacacgtcctcgccttcagagggctgcacgtcctcgccttcaaagggctgctcgccctccccatcagagggctggatgccctcaccttccgtggattacacatcctcgccttcagaggactacacatgctcgccttcagaggactacacgtcctcgcctttagaggactacacgtcctcgccttcagaggactacacgtcctcccttcaaaggactacacgtcctcacgactacacgtcctcaccatcagaggactacacgtcctcgctttcagagggctacacgccctcgccttcagaggactacacgtcctcgccatcagaggggtgcacgccctcaccttcataggactacacgtcctttccttcagagggctacacgtccttagcttcagagggttggacgccctaaccttcaaaggactacacgtccttgccttcagagggttgcatgccctcaccatcagaggactacacgttcttgcctacagaggactacacgtcctcaccttcagagggttacacgccctcgccttcagaggactacacgtcctcgcctttagagggcatcacactctcacctttagaggactacacgttctcgccttcagaggggtagcacgccctcacctttaa

SEQ ID NO: 74108 - DNA, 2898 bp, Glycine max
  Peptide Sequence Number=SeqID_190886
atgaaatccaatttacctccgcttttacctactccaccaggccctccaattaggtcctcgaatgtaaaaaggattactcctgttgaaatgcgattgagaaaggaaaaaggattgtgttatttttgtgatgagaaattttcttttaatcataaatatcctaataggcaatttctattgttgcaaatggaagatgataatgaggatcttatgagtacaattgtaccccaaggtactcaagaagatgaaataacagaatctgaagatcatcatttgtctttcaatgctttgaaaggtggtaggggagttggtactatcaggtttatagcgtatatcgaaaagttaccagtgactgtgttgattgatggtggtagttctgataattttttgcagccaagggtggccaagtttttgaaattacctgtggaaccagctactcaatttagagtaatggttggtaatggtaattatatgtctactgaaggattggttaagcaattgaagggtaaatttactactttacaaggagattgtgaactggtacctgagcaagctcaattacattgtataagaagaatggtggccactaattccattgctgaagtttatagtcagcagttgatggagccagatgttgctcctaatggttcacaacctgttaaggttaagccttacagataccctcatagtcaaaaggaagaaattgagagattagtatcaggattgttagatgaaggcatcatacagcctagtaagagtcccttttcttctcccattatattggttaaaaagaaagatggttcatggggtgtgtgtactgattatagggctcttaatgcaattactatcaaggacagcttccctattcctactgtggatgagttgattgatgagctttttggagcttccttcttttctaaattggatctaaggtctggttatcaccaattttttttaaatttggatgacagacataagatagcctttagaactcaccatggtcactatgagtggttggttatgccatttggcttaaccaatgctcctgctacttttcagagccttatgaatgacatttttgcgggaatattaagaaagtttgtactggttttctttgatgatattctggtgtatagtgctaattgcaaagatcatttataccatttggtagtggttttaagtatcttgaaacaacatcaattgtttgcaaggctttctaaatgttgttttggagttcaacagatggattacttgggacatacactgtctggttcaggagtagctatggatggaactaaattggaagctattcaaaagtggcctgagcctcataatctcaaacagttaagggcatttttaggactcacaggaaaaattgtgttacctcatgatgttgggttgcttaatcaaatcatggaggaatttcacagttctatgattggtggacatgttgtagttaatagaacaacaactagaattggtgctcaattttattggaatggtatgagaagtgatattagtacatttgtgagggaatgtgccatatgtcaacaagctaaagttgatcatgtgtttccagcggggttgttacagcctctgcctattcctcaacaaatatgggaagacatagcaatggactttattgttcaattgcctcctacgcaaggatttacaaccatttttacagtagttgatagattgtccaaatttgggtactttatccctttgaagtttgagtttaacagcaaggttgtggctgaagttttcgttaccaacattgtcaaaattcatggtttgccaaaaaccattgtttctgatagtgagagaatttttatcagcactttttggcaacaattattcaaagttcaaggcaccacattggccatgagttcttcatatcatcctcagtctgatggccagattgagaatcttaataagaccattgagatgtatctaaggtgttttatatttgaacatcctaagagatgggttactatgctaccttgggctcaattttggtatagtacttccttccaccaaagcttgggtatgacaccatttcaagtagtttttggtagacctccaccaacggtgatgcactacgaggttgatcctaaagatcctgatccactcaaggatttattacaactctgtgatcaacttttgagcaagcttaaaggtaatttacttaaggctcaacaatatatgaagatgcaagctgataagaaaaggagagatttgcaatttcaggttggtgatttggttttagtgaagctacaatcctataggcaacattcagtggctttgaggaagcatcagaagctaggcctgtgttattttggtccatttccggtgattgaaataattggtactgttgcatataaagtacagctgccagagtctactaaaatacatcatgtatttcatattgctcttctgaaaccatttaatggcaaaagttcttcaccatatcttccttttccactcacttctagtgaactaggaccaacgctttgcctatggaaggtgttggatgttcaagttgtcaaatgtttagaagctactgaagctaaggatgctacttgggaagacttgcaggatatatatgaatcttatcctcagttcaaccttgaggacaaggttgtttttgatgaggagggtaatgtgacgtgcataaagaaggaaggagatttggtgatcttgttgccggttgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgatcttttaagtgaaaggttcgggagttgtatttacgcacggggaaggtattag

SEQ ID NO: 74109 - DNA, 312 bp, Glycine max
  Peptide Sequence Number=SeqID_190887
atggtgcaggaaggtgatgaaggattttggtttgaggttagagaaactagtagagcagctgctggacttgttgtgttagaatcttggcctatggaaagggttgccaactaccctccatgccccaacctagtgctggtgaagaagggtcttcgtccccacactaatgctggtggaattatccttctcttccaggatgacaaggttatcaccaatggtaagtacaagagtgtggagcaccatgtgatagcacaaacagatgggaccaaatgtctattgcctcattctctatgtgtgatagcacaaacagattga

SEQ ID NO: 74110 - DNA, 209 bp, Glycine max
  Peptide Sequence Number=SeqID_190888
atggacgaagatcaatggatgtatgatagtataatgtctgaagaagtttatatggatgatcaaaatgaacaagaatgtggtgtaaatgaacaacatgttgattgttcggatgcattcaatacttctcaggtgtttggtacccgagatgatgttttgcagtgggctcgattagttgctcatgaaaacagatttgtggcgatcattatgag

SEQ ID NO: 74111 - DNA, 1003 bp, Glycine max
  Peptide Sequence Number=SeqID_190889
ccaggttcgactcttccagcaggtcgatcagcttcttgattttgcggagatccatggtggcctctttgctcttgatgtcagtgtggcagcgcatctgtgcgccgttgcgcgccgtgccatcggaattgagggcatagacggcgttgcagtcgtggtcgcgcagctgcatccaggcacgctgggccaggaccagctgctgctcggcatcgccgcaatagctgcagccgccaccgttggcgggcgcacaggtcgctctccatcgtggtggtcggacgtgagcagtcgatgccttcgtccttgcggtcgaacgccgtggccgcaccgcagagaccggcccacgccagaacgccggcaagcacgcgcggcagcacgttcacgcgcgggccgcatgcacgcgcagcagcgccgcgtccatcgcgtagcggtagctgtcggcgccgaagccgcagaccacgcccacggccttgtcactgaagtagctgtgctggcggaacggttcgcgggtatgcggattggacaggtggatctcgatgaacggcaccgccaccgccgccagcgcatcgcgcagggccaccgaggtatgggtgaaggcggcggggttgatcaggatgaaagcggttccgtcgtcgcgcgcggcctgcacgcggtccaccagtacgtgctcggcattggactgcaggctctcgatcgcgtgcccggcggccgaggcctgggccgccagcgcctggtcgatgtcggccagcgtggtgtggccgtagacctccggctcgcgggtgccgagcaggttgaggttggggccgtgcaggaccagcagcttcgccatgggatccggaagacgggaaagggcggcagtctggcggaaccggcggatgctgtccagttcggcgaagtttgctgcgtttcaatcgtttgtttgaaacctgccgaagcgcttgcggccctacgcggggcggcggatcaaggcgcgctgaacgccgtgcgggcgggggatgcgtgcacgtag

SEQ ID NO: 74112 - DNA, 2177 bp, Glycine max
  Peptide Sequence Number=SeqID_190890
caagagagaaagggttggaattggaaatatcttaccggagaatgggcgacggcagcatcgtgggccacctgccggaggagattctgttgaacgtgttctccgccgtgtccgacacgcgcacgcggaacgcgttgtcgttggtgtcctggagcttctaccacttagagcgcaagacgcgcacctcgctcacgctccgcggcaacgcgcgtgaccttcatctcatcccgacctccttcaagcacgtcacgcacctcgacctctccttcctctcgccttggggccacgcgctcttttgctcctcctccgccacagtcggccaccagagcctcctcgcgcaacacctccgcgccgcgttcccgcgcgtcacctcactcgcgatctacgcgcgtgacccgtacactctccgcctcctcctcctctccgcctggccggagctctccgccgtcaagctcgtccggtggcaccagcgcccgccgacctccgctaacgaagccgacttcgccgagctcttcaagaagtgccgatcgctcgcctcgctcgacctctcctccttctaccactggacggaggacatcccgaaagtgctcgcggcgaatcctatctccgccgccacgctccgccgcctcaacctcctaacaacctccttaccggagggattcaaggctcacgaaatcgaatcgattaccgcgtcgtgcccaaacctggagcactttctcgtggtctgcaccttccatccgagatatatagggttcgtcagtgacgacacgctggttgctattccatccaattgcccaaagctctcgctgcttcacttggccgatacgtcgtcgtttttgaatcgcagagaggacgagggtttcgacggagaagacgctagcgttagccgcgctgccctcttgactttgttctctggacttcctcttttggaagagctggtgttagatgtttgtaaaaatgtcagagagagtagttttgctttggaagtgttgggttccaagtgccctaatttgagggttctgaagttgggacagtttcaagggatatgcttggcgtttgggtctcggcttgacggaattgccctttgccacgggcttcaatcgttgtctgttggaaactgtgcggaccttgatgacatgggattgattgagattgccagagggtgttcgagactggttaggtttgagcttcagggttgcaggcttgtgacggagcgtggactgaggaccatggcttgtttgctcgccaggactctgattgatgtcaaggtttcttgctgcgtcaaccttgacaccgcagcgactctccgagccttggagccaattagggagcggattgagcggctccatgtggattgtgtgtggaatgggttgaaggagagtgatggcctgggacatgggtttcttaattttgatttgaatggtttggatgaaccgggtgatggtggtgaattgatggattactttgggggtggagaatgtgagaacgcaaccaaaaggaagaggcagagatgtgagtatgaaatgggggttcatgattcctttttgcaaagcaatggcaatggtttctgtggcaagagctgggacaagctgcagtatctttctctttggataaaagtcggtgatctgttgactccattgccagtggcagggttggaggattgtcccgtcttggaagagattcgaataaaggttgaaggagatagcagggggcagccaaaacccgcagagagcgaatttggtctgagcattctggcttgttatcctcagctattgaagatgcagctggattgtggtgatactaaaggttatgctctcacggcgccatcggggcaaatggatttgagcctgtgggagaggtttcttctgaatggcattggcagtttgagtctcggtgagcttcattactggccaccacaggatgaggatgtgaaccagaggagtgtgtcacttccagctgctggcttgctacaagaatgttacactttgaggaagctcttcattcacgggacagctcacgaacatttcatgaatttttttctcaagataccaaacctaagggatgtacagctgagggaggattattatccagctcctgaaaatgacatgagtacagagatgagggtaggttcgtgcagccgctttgaagatgcactgaataggcgtcgaatctgtgattga

SEQ ID NO: 74113 - DNA, 2448 bp, Glycine max
  Peptide Sequence Number=SeqID_190891
atggaagagacacgagaagatgcagggccagcagagcgaaggccatccaacatgtcatggtggccttcagattttgttgaaaaattcgaatctgtttctttgagctctcaagatgagaccttaaataataaagaatcacctagacattctaaccgggatgttatgtcacctcagaaggcgtcacaaattctgtggcgcactggaatgctttcagaaccaatacccaacggtttttattcagtcattctggagaaaagactcaagaaactttttgatagtattcctactttggaggagcttcaagctttgggtggagagggttttagggctgatgtcattgttgtggatgcagagaaagatagaaggttatctatgttgaagcaactaattgtggcattagttagaggattgaattcaaacccacctgcgatgattaagaagatagctggtttagtttctgacttttataagcgatcaaatgtagaaagcccagcaaaagctgcacttgaggaatcatcccacatgtttgagaatcgtggcgtccagatgctggggcaaataaggcatggttcgtgccgtcctcgagccatcttatttaaagtattagcagatactgtaggtcttgaaagtagacttatgatgggttttccaaatgatggggctgctgaatgtgtagactcttacaagcatatgtcagtgatagttgtgttaaattctgtggaactgctggttgatcttatgcgttttcctggccaactattaccacgatcaaccaagtcaattcttatgacacatatttctgcagcaggagagagtgattctgcagaaaatgattcctgtgactcaccattagaaccaaatagtcctttatatggggtttcagagagtgttgaaaaggaggaaaacctccaattccatagaagatttgaagtgtcttcgaatgtatcaggccttcccttgcgaaatatgatgttacgatcaaataccagtctggacaggaattggagtttttctcatagtgaacccaacattgctactgcatttggtcggcgtagtcggagaaaggtcattgctgaacagaggactgctagttcaagtccagaacatccatcattgcgagctcatggacggtccaagcttagtggtgacaggacttcttttagagattttgctgatgaccagtctacactaagatccagctacaagtcagatggcgcttcctcatcagaagctcgtaggatacgaagaagaagtatcagcattacaccagagattggtgatgatattgctagggctgtacgggcgatgaataaaacgctaaagcaaaagcgtcttccgagagagcaggggggtgatagttcattatctcattctccaattgacagaaccagcagtttagatcttcagaaaaatgtgtcaaatttccatcttgatggtcaccatgagaggtcccccttatatttgttacaccgtgaccctgtgacgtctcaaaaggcaatgtcgttaccttcttctccgcatgattatagagtacaagcctctgagagaagcgaggcatcagaatatacaacgaatgatgaactggagtctacttggaataaaatcctcgaatcaccaatgttcagtaatcgacctctgttaccatatgaagaatggaatattgatttcacagaattgaatgttggaactcgtgttgggattgggttcttcggagaagttttccgtggcatatggaatggcacagatgttgctatcaaggttttcctagagcaagatttaactgctgaaaacatggaagatttctgcaatgagatatccattctcagccggctccgacatcctaatgttatcttatttcttggtgcatgcacaaagcccccacgcttgtcaatggtgactgaatacatggagatgggatctttgttttacttgattcatgtgagcggtcagaagaagaagcttagctggcggagaagactaaagatgttgcgagacatatgccggggcttaatgcacatacatcgtatgaagattattcaccgtgatgtgaaaagtgcaaattgtcttgtggacaagcattggatagtgaaaatatgtgattttggactttcaagaataataacagaatcccccatgagagattcctcgtcagctggaaccccagaatggatggctcctgaactaattcgaaatgaaccattctctgaaaaatgtgatatctttagcctgggagtgataatgtgggagctctgcaccttgaataggccttgggaaggcgtacccccggagagggtggtttacaccgttgctaatgagggtgctcgattggatattcctgaaggcccgctaggcaggctgatttcagagtgttgggcggaaccacatgaacggccaagttgtgaggagattctctctcgattggtggacatcgagtactcaatgtgttga

SEQ ID NO: 74114 - DNA, 165 bp, Glycine max
  Peptide Sequence Number=SeqID_190892
atggagcaacttcaaataaaagaacgatcttctccaagttatgccaacattgatcttgacaagagaatgttcaagatacaattgaaagtttctcatgacaccaatgtagtaacattcacaatgttcgatcgagatgcgcaacaatttctaaacacaataacatga

SEQ ID NO: 74115 - DNA, 231 bp, Glycine max
  Peptide Sequence Number=SeqID_190893
atggaagacacacccgtgagccccgcgtcgccctcccgccgaaggcgaacgctcgctaagccagcagattggcttagcgaggaggtgaaaaatagcactttgccaagtctagaagttttagattgggctatagaggtcatcaggccagagatcagggctcctatgttcatatccaagcaagagactaggccaaagattagcctagctcgtgggggccaagttgaagtatga

SEQ ID NO: 74116 - DNA, 351 bp, Glycine max
  Peptide Sequence Number=SeqID_190894
atgggtggaacagttgatgacactctgtccagttgtaaggttgaaaagcaaaagttcaaaattcaaccggtgtcacccttttctactggtgaaggtttgccatatgcttttgaagagtggcctaatgctagtgatgtatggggctggaaagtgggcagaagggcaaacaaggctggatattttcatgatagatacctttatctttcgacatctcttcatacctcttgttgctattcatggtgcttccaaagcaagcccgatgttgagcggtacatccaatcaaattttccgaacatgaaaattgaagaattctttggtttatttagctggaaggtcccgacaactgagtga

SEQ ID NO: 74117 - DNA, 279 bp, Glycine max
  Peptide Sequence Number=SeqID_190895
atgtcagtgaaaaatctcgtcgagcacctaggagtacatgacaagacaaaccacacattgggagaccagtcaaggtcactctgttttgcgagaacgctccaatcatatgggatcaacatagacttcaagaagcattcaaaccgagtgtatttacccccaaggtctacacttcgaagagttcgtcaaggcctctccctcctaagtcaggctaaaggcccaagtggagaagggcgaaggcccaagtggagaaagataaagctcccgagtggagaagaatga

SEQ ID NO: 74118 - DNA, 225 bp, Glycine max
  Peptide Sequence Number=SeqID_190896
atgggcgtcatcaagtacctgaccatggatgaattaaagatcctaaacatcccctcagaaacgcttaaactctttaaccactctatttttccccacaagggacatccgataaggaaaatcagcatgcaacagggacaaacatatattctcgtagctaggttccctgaccctaactatggtgtcaaaacggtaaattttataataaactcccctcacctatcgtga

SEQ ID NO: 74119 - DNA, 732 bp, Glycine max
  Peptide Sequence Number=SeqID_190897
atggcctcagaatcagacgatgattctgaaacagatctgcaaaaacaaatccaaaaggccaaacagaccaaaactgtctgtaaccaaaaaccaagccaaccgttgactcaacaagaatcaacaccacaacccagcaacaactatatttcaaaaaacaaattcttcaatgttttacaaatggaaccagaatactgggacaagaatccttttaaggcaaccgccaaagtatttcccccgggatttcattataggccaacagccacaaacaaaaccagaaaattctatgaattcattctaatagatacaaactccgtatctattaaacatttcaaggaccccaaagatccaaacctaaacacccactccacaatccagatcttaaagagacacgcctttgtaaagtggtggtcacaattcgatacctcaaaggctgctccagaacaagtcaagaactggtttcagagcaaccctgagtttctcagacctgctgatccagagacatctttgtttctgaatcagaagtctcaacttgcagcattcttggcaagctcaaaatctaaagaaagtcttgctcagaatcttaaggaagttctccaactacttcaacaggaagaagaagaagaaccccccaagaaggaagccgaatcatccgaaaataatgatgaccaagaagattacccattctaccagaatgaggatgactgttttggtacatcgttagatgatgattag

SEQ ID NO: 74120 - DNA, 141 bp, Glycine max
  Peptide Sequence Number=SeqID_190898
atgtcggccttcatctactcttgcacctcctctactttacctattactcttgctctagcacaggttcggatatggggttgtgatatgaaccctcatggcacaagggctaatgacttaggatcgtctaggattaaaccttga

SEQ ID NO: 74121 - DNA, 147 bp, Glycine max
  Peptide Sequence Number=SeqID_190899
atggagttgaggcaaatttcaccttcttcttcttttgtggtcttctttgtgcagaaagaacacatgtgtcgtcggtgttgcgagagcatgtgtgccgatggttgcacggaccaccgtgagaggctgcgcggtgaggacagccattaa

SEQ ID NO: 74122 - DNA, 849 bp, Glycine max
  Peptide Sequence Number=SeqID_190900
atggatcagaaagtcgatttcagtgctccgcattccatgggaaccactatcatcggcgttacttacaacggcggtgtcgttctcggagccgactctcgaaccagcactggagtgtatgttgccaaccgagcatcggacaaaatcacacagctcactgataatgtttacgtgtgtcgctctggatcgagaatgaggcctttggctgtttggtctgttattatcaatgttcccctcgacttcttacatcatatgttggtcattttcaaaattttcccttcactaaaagtaatcttatcaatgtctgtggaatccatggatgacgatttggtgaaggctgctgattctcagattgtctctgactatgtgcgctacttccttcaccaacacacgatacaacttggacaacctgcgacagttaaagttgctgcaaaccttgtccggcttctcgcatataacaataagaatttcttacagaccgggttaattgttggtggttgggataaatatgaaggtggacaaatttatggagttcctctgggtggaacaatagtacagcaaccttttgctatcggaggatctgggtccagttacttgtatggtttctttgaccaagcctggaaagagggaatgaccaaggatgaagccgaggatttagtaaaaaaggcagtttcactggctattgctcgtgatggtgcaagtggtggggtggtgcgaacagtcataataaactcagagggagtgaccaggaatttctaccctggcgaccaacttccattatggcatgaggaaatggaggcccacaactctctgctagacattcttggtgtcccagagccgatgagcatgtga

SEQ ID NO: 74123 - DNA, 387 bp, Glycine max
  Peptide Sequence Number=SeqID_190901
cctgcgggttctgacacccttgactatgcaaaagggtaccttactgataaggcaagggatgtgaaggagagggcaaaggattatggaagttatgctcagggtggtgatggtggtggtacccttgtggatttgcatgttcaagttctgctgtttattttgaatcttgtttgcattgtgctgtgttgttctggaacaggaattagaaagggtgtgaaatttgtggccaaaagtggcttccgaagttctatattccaatgccacttgactgtagcagttgcagaaatgatgagagattgctgcctgaatcttaaatccgatgctattttgacgtcatcattttctgaaatgatacatgaactggataccataccgttcccgtctttttga

SEQ ID NO: 74124 - DNA, 867 bp, Glycine max
  Peptide Sequence Number=SeqID_190902
atggccacttctcccaccaccaccaccaccaccaccgttcgttcttcttccgtcccttctctgcctccaccctcccccaagtccccgccggagtacccagatttgtatggcaagcgccgtgaaaccgccagggttcacatgctcgagagggaaatcacttttctcgaggaagaattaaaatctgttgaaggccttcaagcagcttcaagatgctgcaaagagattgctgattatgtgatggcaaacgcagatcctctgttaccttcagatcatgattcttatgccttcttctctttcaagcagaaccaagaagaaccgtcggtcatgtggcttctggaagtggctctgttatttgttgaaaagtatgacaagaaagagattaagcatcagtctccagcaaataatttcttttccactcttgcccctttttcacttgagtatcttcttgtaaaaagaaaacgactaatgactaatgagagggaccctttccctttctgtgaagactatgtggcatgccctgttttaacctctcttggatctgttgctgctgttgctgctgtgaaggttgcagttgcagctgtcttccatccatcaaatgctgctccttaccaaagtggagctgttgttgctcttgccccaaatcaaattgctgtaaagagggttgcggttttggaaattgttgtactttcccacgtagttgcaattttgggtgcccaacttgtccatcttgcccctcttgctgcagttgcaaatgcacctgcacttgctcttgcccaagctgtccaaaggacacaggacacaggaaatgtcttttcatttggtacaccgattagtagccattcatggccaagatcgtttggaatataa

SEQ ID NO: 74125 - DNA, 467 bp, Glycine max
  Peptide Sequence Number=SeqID_190903
atgagggagggagaagaatctgaggctgaggatgaagtaaagacggctgagggaaagcctgcgactgcaagttgcagtacgaacccatttagcaaagttggggaggtttcgattgagattttgaggcagcgagcactgagtagtgtggcctggtgttgcagagagcaagcgaaaagcacgatgggaatacctcagaccgcacgtgaccgctgcggggttgagctctccgatctccaagcccctctggcagatttgaaccgtgaccacttcctcgacagttacccaccttcactggtgtttcgtgtgggtggcgtgggttttggctgggcgcatactggtttggttgtggtcggagtaggtggcggctggtggtggaacgacggtgggattggtggtggtatttgtgtagaaggtggcgatttggtcgggagtgtggtggttatggtggatgttgaagagggagaaag

SEQ ID NO: 74126 - DNA, 2469 bp, Glycine max
  Peptide Sequence Number=SeqID_190904
atgggagagcggattgaagctttggagacacaaatgggtaacgtaacaacgacgttgcatgacctcgctctgcagatgcagcaacatgctcaacagatgcagcaacagagtgtaattcttactgagctcagcaaacagatcagtcagaagggagtgtcgccagagggcgaaacttctgttggtgactcaactcagaatgagtctcgcctcgccggaaagaaggtcaaactttcggtgtttgaaggggaagatcctgtagcgtggattacgcgcgcagagatctatttcgacgtgcagaatactcctgatgaaatgcgggtgaagctgtctcgcctgagtatggagggctcaacaatccattggtttaacttgttacgggaaacaaaggatgatctttcgtgggaaattctgaagagagctttgattgcgaggtatggtggtagaagattggaaaatccgtttgaggagttgtctaccctccgtcagacgggaacggtagaagagtttgtcgaagcatttgagctgctttcttctcaggtgggtcgtttaccggaggagcagtacttgggttatttcatgagtggcttgaaacaaccgattcggcggcgggtgcgaacgttgaacccgcagaatcgtatgcaagtgatgaggatggccaaagatgttgaagaggaactgaaggaagaagacgatgaaggagatcgttactatgggaagaatcgtatgagccgtagtgagcccaatgggctgctgtctaaatctcgaaatgggtctaacccgatccacaaagattttacccgctctaattcgggtgggtacgctccaagtcagaaaacgggttctaccgggtcaaatacaaatcccacgtcctcaatgaattcaacaggacgaaaaggggaaaatgaccgtcgtacgctgtcgtcggaacggtggaagggagttcgcggcgttcagagtgatgaaatagctgaacgaagagccaaggggttgtgttttaagtgtggagggaagtaccatcccacgctccacaagtgtcctgaacgagcaatgcgtgttctgattttaggagaaggggaagagctgaacgaggaaggggaaattgtttctcttgaagccactgaaacggagggggagggagagggagaggagacagaggcggaatgcaatctgattggagtgatgggtagcatgggggagtataatacgatgaagatttgtggaaaaattgctagtattgatgtgatggttttaattgacagtggagctagccataatttcatctccccagaaatcactacagcattagggttacttgtgacccctatggcagctaagaacatcaagctaggtgatggtcataaggttctttcaaagggaatatgtgaaggagttcaaattgatttggggccccaagtttttcatgtggatgcgttggtgttagagctgggaggtttagacgtggtgctgggagtgtcttggttgagcactttggggaaagtggtgatggattggaaggatctatcaatgcagtttatgcacgagggaagaatggtaaacttacaagctcagggccgtatacaggaaaagcagagctgcttacactcctttttagaggataagcatagaaggggaggtgaaggttggtggtggactcaatatccttatcaccagaaaaaagaaattggaaagcaggtgacggagttgctagctgcaggagttattaggaccagcatgagcacgttttcgagcccggttatcttagtcaaaaagaaggatgggtcctggaggatgtgtgtggactatagagccttaaacaaagccactgttccagataagtatcctattccaattgtggacgagttattggatgaattgtatggagcaactattttttctaaaatagatttaaaggctggatatcatcagattcgtgttcataaggatgatatgcataaaactgcttttaggactcataatggacactatgagtaccttgtaatgccttttgggttgatgaacgcactagcaacatttcaggctacaatgaatgacattttcagaccctatcttagaagttttgtattggtgttttttgatgacatcctggtttatagcaaatctgaaactgaacacttggagcatttgaaattagtgttgtcagttctggaatctcattgctttgtggccaatgaagctaaatgcaagtttggttgtaaacaggtggactaccttggccatgtcatttctggagatggggtagcagtagacccagacaaaattaaatgtgtattagaatggcctgagcctaaaaatgtgaaaggagtgcgtggttttttagggctcactgggtattacagaaaattcattaaggattatggcaaaattgccaaacctttaactgaattaactaagaagaacaattttgtgtggggaaaagaagctttagttgctttcaagttacttaaatag

SEQ ID NO: 74127 - DNA, 2256 bp, Glycine max
  Peptide Sequence Number=SeqID_190905
atggattcatcaatttcccttttctttctcctcctccaactcacaatgctatctgcgaccaagaagacttatatagtgcacatgaaacaacgccacgattcctccgtgcaccccacgcagcgtgactggtacgctgccactctagattcttctccagactctctcctttatgcctacaccgcctcttacaacggcttcgctgccatactcgaccctcaagaagcccacgtgctgcgagcttccgattccgtcctgggcgtctacgaggacacgcgctacacgcttcacaccactcgcacccccgagttcctgggcctccaggcccattccgccttctggcaagacctccaccaggcctcacacgacgtcgtcataggtgtcctcgacactggcgtctggcccgaatcgcaaagcttcgacgattcccaaatgcctcaaatccccactcgctggcgcggtaactgcgagtccgcacctgacttcgacccttctctctgtaacaacaaactcatcggcgctcgaagcttctccaagggctaccgcatggcctctgctaacgctagaaaaaacagagaacctgcttcgccgcgtgacctcgacggccacggcacccacaccgcctccaccgccgctggctccgccgtttccaacgccacgctcctcggctacgccaccggcacggcccgcgggatggcgccgcaggcgcgcgtggcggcctacaaagtctgctggaccggcggctgcttcgcctccgacattctcgccggaatggatcaggctatccaggacggcgtcgacgtcctttcgctctccctcggtggctcctcctcctccgtcccttactacttcgacaacatcgccatcggagccttcgcggcgctggagagaggcatcttcgtcgcgtgctcggcggggaacaccggacctcgcagcggttctgtcgcgaatgtcgctccgtggatcatgactgtcggcgccggcacgctggaccgtgattttccggcgtacgctactctcggaaacggaaaacgctttgccggagtttcgctttacagtggagaggggatgggagacgaaccggtcggtttggtttatttcagcgaccggtcgaactcgtcaggcagcatttgcatgccgggttcgctcgacccggacagcgtgcgcgggaaggtggtggtttgtgacaggggactcaactcgcgcgtggagaagggtgcagtggtgcgcgacgccggcggggttgggatgatactcgcaaacacggcggcgagtggcgagggactggtggcggacagtcacttggtggccgccgtggcggtgggggaatccgcgggggatgagatcagagagtacgcgtctttggatcctaatccaaccgctgttctcagcttcggtgggaccgtgttaaacgtgaggccctcgccagtggtggcagcattcagctctcgcgggcccaatggagtcacggcccaaatactaaaacccgatgttattgggcctggagtgaacatcttagcgggatggtctggtgccgttggcccatctgggtcccaagacactcgcaaaactggctttaacatcatgtctggaacttccatgtcttgtccccacataagtggtttggctgcgttgttgaaagctgcgcatccagattggagtccaagtgctatcaaatctgcactaatgacaacggcttatacctatgacaacacagagtctccacttcgtgatgcaacgggcgaagaatccctctccacaccatgggcctatggggccggtcatgtcaacccacaaaaggccctatctcctgggcttctttatgatgcctccacccaagactacatttactttttgtgctccttgaactacaccctcgaccatcttagactccttgtgaagcatcctgatgccaattgttctaaaaaatttgctgaccctggcgacctcaactatccatccttctcggttgttttcggaagcaacaaggttgttcgatacacgcgcacgttgaccaacgtgggggaaccgggatccgcgtatgacgtggcggtgagcgcgccatccaccgtggacataacggtgaatccaaataagcttgagtttggagaagtaggggaaaggcaaacgtacacggtgacatttgtgtcgaataggagtgttaatgattccgctacgtctggttttggtagcattatgtggagcaatgaacaacaccaagttaggagcccggttgcatttacatggacctatttttga

SEQ ID NO: 74128 - DNA, 516 bp, Glycine max
  Peptide Sequence Number=SeqID_190906
atgaagaaacgcaaggaacttggccatgacttccctccaatttctccccctccgaaatcacgaagactggagtgggagcgcgacttattatgtagtactacgatgatgatgatgatgatgatggaagaagaggaaaatgcaatggtggaccaaccctgtgtggaccccacacctgcgtctgtgacggacacggaagagagggctattgttctttatgagccaaccgctactacgccttttctcaagtccccaagctcgcctgagttctctgtcgttatcaaggctgacttgattcctggattaaaggattatttgttgtcatggggcattgccaagcaagatgaccctgttgaagatgaaatgaggagggagaagagttctgaaatgtcaacaaacgactgtttggctgttgtcccatgggttgccctccattctcctatggcatgtgaagaaatagttccagaaactggtcaacctttagaggtggaagaaggcgacatgatggaaatggattaa

SEQ ID NO: 74129 - DNA, 142 bp, Glycine max
  Peptide Sequence Number=SeqID_190907
attcaacctcgtttacaagatgggtgcactggttggtgtcaagaagctctccatggacaccttctggggcttccgcaagttcacaatggagatggaaatatcaaatatcctgagcaagcttcaccacactaagatcacataa

SEQ ID NO: 74130 - DNA, 348 bp, Glycine max
  Peptide Sequence Number=SeqID_190908
atgatgatcctagaaactatgttccttcgctgctcatgttcagcttattggggtttcccttcttctttgcagaaatcttactttgatataaagagagagaaaaatgcccctgcggagaactgttcgaacctgttggaagtgacggagaagaggaaggagaggggaaaaactgtcgctgccactggaaacctccttcgacggtggcgcatggcgacacacagtggccaccgactatggtgccgcggtggcggggagaggttgtggagtgatacatgtttcgagacacatccagtaaaggaacgcaaaacacctcttcaatatatttgcgaaatgccatttcgaggttaa

SEQ ID NO: 74131 - DNA, 642 bp, Glycine max
  Peptide Sequence Number=SeqID_190909
atgatatcttctaggaagctgtttggcctcgcttattggcaaaagttttcaagaacaaaacttgtgaaaggtgatcattactttgattctgtcaatgatgtcttgagcaaagtgatagctgaaccaaatcttcttaagcttgaagtcgtagaaactaaagttggtggtagcaatggggaagatgcagaaacgggatccaacaaggatggtcaacctgataaccatcaccatcattacctcaaacaccaagcttctactaacaatggagaccatataatagggaagccatgtaatttaagcgaattgaaatctttacatggcaattcggtaggtaaagttgacgtagatgatgatgatatagcatataataaagggaacatgcatattagtaaaacaaaacataggaaaggtaaacacaataaagatgctaccactcaaaaagaagtgaatgctaaccctgatcatgcaaacaatacgacagaaaaccatgaaaatcagaagacctgtgtgcctgatggcaatcaaccaaagagaatcaatttagtcaaagagcaagatcaggttaaggctgagacaagccacactgttaagaactcctcaggaggcttaggatcagaaaattgggactctcagtcatcttga

SEQ ID NO: 74132 - DNA, 1050 bp, Glycine max
  Peptide Sequence Number=SeqID_190910
atgacgtggcaccccaacgacggcactgacacgtgtaaaagcgaagccatgtggagccttttttcctccccttcctcagagggtttcttcttctctgccgaaaaactccgatcacgcgtcatggaacaacacgatctccgtcgccgccactcgccgccgttaacctccgatcccaaaccattgccagagctcgctcgctccgcttccgcctcctcctccttcaccgtcgacaacaactccaaaggcctctcgcatcaccactccgcggcgcccgctccgcctatgtatctgaagacaattcacttggaagttgctggaaatatctttttgggccagtcgacgagatggactgatcagcagcacagtctatatattcgttctttagaggcctcattcgtgaatgaattgcatcattctatgcgtttacgctgtcggagcttaagaaatagcacagatgaagcatataaatgtagaattttgcaaaatttacataatatgcctaagcagtctctggctctacaagatgaccgccagaagaggatcaaccttcaaagagttgcacctatgttagagagcacagctgattctcatgttcttgctggaagtcaatttgaacttacatctgtggatggaagctgtagtttgagagagcctataacctgcaagcatggcttgctttgtgatgaggagattcagattcatgcaagaggaagttcaacatttactgacaggtcaccaagaagtttagagaagcaatgtatttgccgctcattccatctagacttggcttgcagtactacaggttcaaatcctggaaatagtctctcactctctctggttgcgaaggtcactgatcaaaactttaaggatgaggaagccaggtcaagcagcatgcccttggtgaaaaggttgaagacagctacagctgatggttcaagcagtgatcaagttgtaccatttggaaaacttcacataccagatgtttcaactagtagtaacgcgcaagctcagaaaataaaggacatgaattgctatgagaatccccagtga

SEQ ID NO: 74133 - DNA, 1305 bp, Glycine max
  Peptide Sequence Number=SeqID_190911
atggatattgaagaggatgttgaaatcccactgattttgggtcgtcccttcatgttaactgccaattgtgtggtggatatagggaaaggtaatctacaaatgggaatagatgatcagaagatcacatttgatttgtttgatgcagaaaaacactcacttgattggaatatttgttccaagatggatgaagttgagaatgagatgcctctagaaaaaggaaagaaaccgcctccaaacctcatgagccctatgatacgaccagatttatttccgagggtgcctgggaaagatatgagcagaacattcactctcggaacatccttccagagaggaatgcagcctgatggtctcattgatgtggccttggtcaagaaattttatgccaatttatatgacccagaggacaaatcacccaggaagatcagggtgaaagaaaagctgattaaatttgatggggagacgctgaacgcattcttggaaaccccgatggttatggagcctggggagcgctacaccgcctactccagcgccctggaagctcctgaggaaggatttgaccactctggcgccctaactagaggcttagccactcatggccatttagggctttacaatgagaaaggagtgaaagaaagagagggaggagtcgtgcctaattcattgaccttcaagtccttgagccctgccattaatttggcatacatcaggaagaattattggaacccggatgatcccacaatcactttttcggggacccgtaaggctcgggctcaaggacctacggacgtttctgccccttcttctgctccccctgctctagctccatcagcaccactagctccccttcctatagtaccagcacccttcggcacctccactcatagctcagaccagataatgtcgatactgcagagccttcaccatggcttatgcctggtgatgcagagtatacacgacctggctcagcatcagcccatcattagcatggaggatttcatggctcaggtggtctggccaggagtccaaccttcatctttgggggaaggtgaggctcctacagcccaagagtcgcaaccagaggccgatgcagatgttgaggagacgcctgaagacacccctgctgccacaccgacagaggccactaaggaaggagacggcgctgtaaatgccgattacgttgcagatatggtagcatcacagagcacctgggacccctggcccactctggcacaagatacatcactgccagcccaggatgctccctcctcacctcatgatgatcctacaccaacacaggaggactaa

SEQ ID NO: 74134 - DNA, 258 bp, Glycine max
  Peptide Sequence Number=SeqID_190912
atgaagactttaaagactattgtggatggtaaaattgatcaagctgcacctcaatggattgaagtaaagagccatgttcaaagtgaaggctatgagtgttgctatcatgtcatacattggatgtggaacatagtaagcgggggtttgaagaatgattgggtcatgtggtttgctgatggcacaccattagacaaggagaccataacaacaatttacaacaaatgggcagcttattttgtaaaagttaaagacagttaa

SEQ ID NO: 74135 - DNA, 747 bp, Glycine max
  Peptide Sequence Number=SeqID_190913
atggacaatgacaaaaagaacatcctcgctgttcaatcactaaggaacacaatcatgggtgcgaccctaatggccacaacctcaattctcctatgctcaggcctagcagcaatcgtaagcagcacctacagtgtgaagaagccactcgaggacacagtttatgggggtcatggagagttcatgatatcactcaaatatgtcactttgctctctattttcctcttctcattcttctgccactccttgtccataaggttcataaaccaagtcaacatcctaatcaacaccccacaggaccccatcatgtccttggtcacccctgaatatgtgaatgagattttggagaaaggcttccttctaaacactgttggaaacagactcttctatgcggcacttcctctgctgctttggatatttggccccgtcttggtcttcctgtgctctctcactatggttcctgtgctttacaatcttgactttgtggttactggtgcaaataagggaaagatgcagctcaatgagaatagagattttaaacaagtatgttctactacttctacccttgtggcaagggtatatgcatacgccaagaaaagtctcatgccattcggcaggaaaaacgaaaaagatgctctaataattcatgttctttcttatgttaatgtgaatggtcatattgttgatccactctacaagtatctaataaaatcaagcaaaggtggactcttcgaggataatatcaaatga

SEQ ID NO: 74136 - DNA, 234 bp, Glycine max
  Peptide Sequence Number=SeqID_190914
atggctatggacttgaacttctcttcgactacccctcttcgactacccgggctctttcaagctctgcctttagggcttccacttatgatagccgccgatgatcccattactgcttcccctaagctatctgtcctttcttcacgccgcatcccatgccttgcgaactccttggagtaccctcgcattgtggtcactgaaaccccgtgtgatgaaaggcgtgatgctttcgtctga

SEQ ID NO: 74137 - DNA, 453 bp, Glycine max
  Peptide Sequence Number=SeqID_190915
gaaggaagaatcaggactctatcttcatgcgaaggatgtccaaatgttcccttgatgggaacaaggggttgtattaattataatcccgtcctcgccataagacagcttggctaccccatgagaggagtgccatcagacgaaagcatcacgcctttcatcacacggggtttcagtgaccacaatgcgagggtactccaaggagttcgcaaggcatgggatgcggcagtccagacacaaggattggattggctcccaaatctaaagactgtgagagacagtgaggttaaagcttcggaagaaagtgatgaggtacaagccctaaaggcagagcttgaaagagcccgggtagtcgaagagggggcagcaatagtgagctcaagctccgaagaggtgaaaggaatcatcacgggtcaaaggcatgatctggaaggacgagctaaaggcttgccttag

SEQ ID NO: 74138 - DNA, 291 bp, Glycine max
  Peptide Sequence Number=SeqID_190916
atggagaaagctccaaggattgacccgctctacaaccctaattcatcgtcattggggctattctctcgaaagaagagtgtgatagaagcatatccgtttcagcctagggatcagcctatcaaacaaacaaaaatagttggaatggtgtatccagcagacggtctttcatcagtaagcgatgtgctagtctttgttggtgaatacctatctggtgttcaagtctccggtccttgtccttctattagtggtggtatcctaagattccggtttagaaatgatcgatttctgtaa

SEQ ID NO: 74139 - DNA, 933 bp, Glycine max
  Peptide Sequence Number=SeqID_190917
atgaagccatcgccatcaaataacacgcatgacaatgacgtggacagtgaagaaaaagaacagggaacggatatcgaagtggacgaagacgccctgccctcgcggggtgcggcgatccatgaagagattcgacaggacggtgaaaaggagctggaacgcgacggtatggcgctgctgtggtcagcgattgccgccggcttatcgatgggtgcctcgctgatggcgaaaggcattttccaggtgcaccttgctggcgtgcccggcgcttatctgctggagaatctcggctacacctttggttttgtcatcgtgattatggcgcgccagcagctttttactgagaataccgtcaccgccgtgctgccggtgatgcataaacccaccggcggcaattttatgctggtactgcggctgtggagcgtggtgctgatcggcaatttgattggtaccgcgctgggcgcgctggcgtttaatcatatgccgattttcgatgacgccacgcgccaggctttcaccgccatcagcgaaaaagtgatggagcacacgccgggtgaaatgtttgccaacgcagtgatttcggggtggatcatcgccaccatggtgtggatgtttccttatgctggcggcgccaaaattgtggtgatcgtgatgatgacctggctggtggcgctgggcgatctggcacacattgtggttggatcggttgaagtgctgtatctggtgtttgccggcacgctgccgtggcaggagtttttgtggccgtttgcactgcccaccctgctgggcaacatcaccggcggtacgctgatttttgccctgatcagtcacgcgcagatccgtaacgacatgagcgaagcggccaaagcaaaagcacgggccgaacagaaacgtaaagagaagcaggaaaagcagaaagatcaggaaaaagcgtga

SEQ ID NO: 74140 - DNA, 639 bp, Glycine max
  Peptide Sequence Number=SeqID_190918
atgaataccccatttgggggaagggggagcttgcgcgcagacttcggcccctggtttgagtgtggtattattcccgcctcatttattgctatgaatctcccttctatgctcgaagtgattaatctcgcctgcgttcgcgatgagcgaaccctgttccacggactgagttttcaggtgcaggcgggcgatgtggtgcaaatcgaagggcctaacggcgcaggcaaaacttcactgttgcgactgctggctgggttaagccggccagagcagggcgaagtacgctggcaacagcagtcgattcgccggcagcgcgaaatatggcagcaaaacctgttgtatctcggccatcatccgggcgtgaaatcggtgctgtcgccgcgggagaatctgcacttctggcacggcgatcgcagtgaagacacgctgtatgacgcgctggaacaggtcaatctgctgggttatgaagaggtgccggtggctcagctttctgccgggcagcagcggcgcgtggcgctggcgcgactgtggctcagcccggctccggtgtggattctggatgagccgctgaccgccatcgacaaacacggcgtggaaaaattaatggcgcgcttcgccgatcatgccgataacggtggcgtg

SEQ ID NO: 74141 - DNA, 453 bp, Glycine max
  Peptide Sequence Number=SeqID_190919
atggatatgaggagaaatggttgctcaacatcatggtcattgatacacgtggtgcacaagataagaaagcttgcactcaatgcagagtataccattccagcaactggtggtggtggtgattctcctcatgtccaaaaagcaaacatcccaatggaaaatggaggttatctaatttatggcactgctcatatgcattcaggtgttgtaaatgcaactttatatggacaggatggaaggactttatgtacatcaacaccaaaatatggaacgggaaaagaggctggaaatgagaaaggttatctcattggaatgtctgtttgttatccacaaccgggttcaatcaagattcatgatggtgaaattttgactctagaatctagatataaaaatgagtttcgtactggagctatgggacatttctacatctatttggcagaggaactaccacaatga

SEQ ID NO: 74142 - DNA, 180 bp, Glycine max
  Peptide Sequence Number=SeqID_190920
atgaaagtctcaaccttttgtcgaaagagcaaggatctgagtgaggaatcctatggtggtgcgattatctcctccacaccccctcactcctttgtcgtgcgccccctaccaccatctcctccttctccgacgttgtcgtctgcacctcctcaccgcctctgcttcccatgccttgaatag

SEQ ID NO: 74143 - DNA, 165 bp, Glycine max
  Peptide Sequence Number=SeqID_190921
atggcgatgacgacaacgacggagtccgatctcgattacgagcttcgctatctcagtctcgccgtaaccgataccttcactgctttccaaaacctcttaccggaaaggatctacgcataccctatcgaaggggaaaatataagaagaaaaatagtgttgtggtag

SEQ ID NO: 74144 - DNA, 1191 bp, Glycine max
  Peptide Sequence Number=SeqID_190922
atggaaggaataatgtttatatcatggaggaaaggtatctctcaaatcattgtttcgtttccaagtgaaccatataacttatataaagcatcaaaacctgattcaagaagagtttgtttctccatgcaaaaggaaaaggaagcaattgtcaaggaggggactacggaaatagaaatggaaggaacccgtgcaaaagaggaaaccctaccaccgggatttcgatttcaccctaccgatgaagaacttgtcacatgctatctggtaaataagatatcggattctaattttacagggagagcaataactgatgtagatctcaacaaatgtgagccatgggagctgccagggaaggcaaagatgggagaaaaagaatggtacttcttcagtctgagagaccgtaaatacccaacgggtgtgagaacaaatcgagcaactaacgccgggtattggaagaccacagggaaagacaaggagatcttcaacagtgaaacatcggagttgattggcatgaagaagactttagttttctacaaaggcagagctcccagaggagaaaaaagcaactgggtcatgcatgaatatcgcattcactcaaaatccagctatagaactaacaggcaggatgaatgggtggtgtgccgggtattcaagaaaagtggtaatgcgaagaagtacccttcttccaaccatgcaagagcagtgaatccatacagcttggaaatagaaccaaatattttgcctccgctaatgatgcaactgggagatcctggtgctcatttcctttatggaagaaactacatgaacagtgctgagttagcagaacttgctagggttttgagagggggtggatcaaccagtagtgtcaacctgccaattcaatcccacttgagctaccctacatcatcatcgacaggaggaggattcaccatttcagggctcaatttgaaccttggaggaggaggagcaacagccacaacacaacccattttaaggccaatgcaaccttctcctgctcctgttcatacgatggctcaagtacttgatgccaattccagcatgatgacaaccagttctcttggtgctgagaatgtaggttatggagcagaaatgagtaacttgaatttgcatgggaataggtatatgggcgtcgatcactgcatggatctagacaactattggccttcctactaa

SEQ ID NO: 74145 - DNA, 435 bp, Glycine max
  Peptide Sequence Number=SeqID_190923
atggccacctgtacaatggttagtatgcgatccggtctcaagcgagagccacctccaaaaagttccaatctcctcctaactaccatgacaaacaatgacactctctgccaactccaacccatattgcagagatggagtgtaacgacccgcctcgtcgctacgatatcacttactataaaatcttgcttgtggggcttctatggaggctggatctttgagcttcaatgggggtcctttaatggtgattttccaccatggagatgcagcggaagacaaaggaaaggaggtgagaggaggcaccatccattaaggaataagccatggaagaaggagcttcaccaccaagatgagccttggataagaagcttggagaggatgcttcaatggaggaaaagaaagagggagagaaagagggaggggggagcacgaaattga

SEQ ID NO: 74146 - DNA, 1530 bp, Glycine max
  Peptide Sequence Number=SeqID_190924
atgtactccaagtgtggtatggttggtgaggcaggacaaatgtttaacactttgccagtgagaaatgttataagctggaatgcaatgattgctgggtatagcaacgaaagaaatggtgaagaggctttgaatctatttcgtgaaatgcaagagaagggagaagttcctgatcgatacacgtattcaagctcattaaaggcgtgtagttgtgctggtgcagtaggagaaggaatgcaaatccatgctgccttaattaaacatgggtttccttacttggctcaatcagctgttgcaggtgctctggttgatatttacgtcaaatgcaggcgcatggccgaagctaggagggtgttcgatcgaattgaagtgaagagtatgatgtctcggagcacagtaattcttggttatgcacaggaagataatttgacagaagccatggacttgtttagggagttgagagaaagcagatatagaatggatgggtttgtgctctcgagtctcatgggtgtatttgctgattttgcccttgtagagcaagggaagcaaatgcatgcttataccatcaaagtcccttatggtttattggaaatgtcagtggctaattcagttttggatatgtacatgcaatgcggattaacagatgaggcagatgcactcttcagagagatgctaccaagaaatgtggtctcatggactgttatgatcactggttatgggaaacacgcttgcagccattctggcctcatcaaagaaggtaaaaaatacttctccagtttatgtagccaccagaagatcaaaccgcaagtagagcatcatgattgcgtggttgatcttcttggacgaggtggacgcttaaaggaagcaaagaatctcattgagaaaatgcctctaaagccaaatgtgggcatatggcagacattacttagtgtttgtagaatgcatggagatgtggaaatggggaaacaagtgggagagatacttttgagaagggaaggtaataatccagccaactatgtcatggtgtcaaacatgtatgctcatgcagggtattggaaagagagtgagaaaataagagaaaccctgaagagaaagggattgaagaaagaggcaggacgtagttgggtagagatggacaaggaaatccacattttctataatggagatggcatgcatcctctcatagaggaaattcatgaagtgttgaaagaaatggagaagagggtgaaagaagaaatgggctatgttcatagcataaatttttcattgcatgatgttgaagaggagtcgaagatggagagtttgagggttcatagcgagaaattagccattgggttggttttggttagacgaggattaaaactaaaaggtgaaagagtgattaggattttcaagaacttgagggtttgtggggattgtcatgcattcatcaaaggtttgtcaaaggttttgaagattgcatttgtggtgagagatgcaaataggtttcacagatttgagaacggtttatgttcgtgtggagattactggtga

SEQ ID NO: 74147 - DNA, 1791 bp, Glycine max
  Peptide Sequence Number=SeqID_190925
atgggagtaagagagttagaaaaccgtttcgtcaccaccctgagaaactgtccgaagattgcagaactgaagaagattcacgcacacatcgtgaagctgtcactgtcgcagagcaacttcctggtcaccaaaatgttggatctatgcgataacttgagtcacgtggattatgcgaccatgatattccaacaactagaaaaccccaacgtgttctcttacaacgcaataatcagaacctacacccataatcacaagcatcctctggcaattactgtgttcaatcaaatgctgacaacgaaatcagcatcgccagacaaattcacgttcccgtttgtgataaagtcctgtgcgggtcttctttgtcgtcgtctagggcagcaagttcacgcgcacgtgtgcaaattcggacccaagacgcatgcaataacggagaacgcgctgattgacatgtacacgaaatgtggcgatatgagtggtgcgtaccaagtgtatgaggaaatgactgagcgagacgcggtttcttggaatagtttaatctcggggcacgtgaggttggggcagatgaagagtgcgagggaagtgtttgatgaaatgccttgtaggactattgtgtcttggacgactatgattaatgggtatgctagaggagggtgttatgctgatgccttggggatttttcgcgagatgcaagtggtgggtattgagcctgatgagattagtgtcatatctgttctgccggcttgtgcgcagcttggggctctggaggttgggaagtggattcacaagtactctgagaaaagtgggtttttgaagaatgctggtgtgtttaatgcactggttgaaatgtatgctaagtgtggttgcattgatgaagcgtggggtttgtttaatcagatgattgagaaagatgtgatttcttggagtaccatgattgggggactagctaatcatggaaaagggtatgcggcaattcgagtttttgaagatatgcagaaagcaggagtgactcctaatggagtaacatttgttggtgttttgtcagcttgtgctcatgcagggttgtggaatgaggggttgagatattttgatgttatgagggtggattatcatctagagccacagattgagcattatggttgcctagttgatcttctaggacgctcgggacaggttgagcaggctctggacacaatattgaagatgccgatgcaaccggattcaaggacatggaactctttgttgagctcttgcaggattcatcacaatcttgagattgctgttgttgctatggaacaacttttaaagcttgagcctgaagaatctggaaactatgttttgcttgctaacatatatgcgaaacttgacaagtgggaaggtgtatcaaatgttaggaaactaataagaagcaagaggataaagaaaacccctgggtgtagcttgatcgaggttaacaacttggttcaagaatttgtatcgggtgacgattcaaagcccttttcacaagaactgcggtatggaacatttggctttttagaaaccagtgtgtttaaggcagtggataagtgtactcttatacaaaagattgcgttctctgcctggtcttggatgaggggatatcttgagtcctttaattgttcgactaatcaatgcctagcgtgtccagggatatctgttttgttgcgtgaagtcatagttgtttggttgggaaaatttgacacaagctatcagattctcacattatgctgcagcaagggggttgagttgggtatgatggggtggtgttattggtga

SEQ ID NO: 74148 - DNA, 432 bp, Glycine max
  Peptide Sequence Number=SeqID_190926
atggctgtaaacaagccagtagacaatggcatgttagggagcaaacctgtctctactctaattgattatgatgtaagactataccaacaatctggtactccacttgatgatacaaaagcttcatcatatcacaggctcattggtcatcttatttacctcaccaatacaaggcctgatattacatatgcaattcaacacttaagtcaatttgtagctcatccttcttcagctcatcaacaagcagcctataggattcttagatacttgaaagtaacaccaggttctggtttatttttatctacttctagcatattccagctcaaagcatttagtgactttgattgggcaagatgtattgacaccaagcgatctatcacgagctactcagtttatcttggtagttcctttatttcttggaaatccaaaaagtag

SEQ ID NO: 74149 - DNA, 294 bp, Glycine max
  Peptide Sequence Number=SeqID_190927
atgaaagaaagttgtttcaaatggcattgtggtgtggttaccttgcgcattgtgtctgccactagttcgctggtagtgggggaggtagcaaaagttaaggatgacaagactttcttcgggcatgatcttggtgggattggcttcccaggctggggtggtgatggaggtgatctaggaggaggtgcaggtggtggtggcggtggcgatttggaggtggacttggtgctggtgctggtagtggcattggtggggcagcggctaatagggcaccacactagctatttgattaattaa

SEQ ID NO: 74150 - DNA, 225 bp, Glycine max
  Peptide Sequence Number=SeqID_190928
atggcagtttccaaactcagaaatgatgcaaaggcaacttggaagattccgcttcagttgaagggttcctctaggtgtggggtttcaacggagaacaatggcggagaagaaatgacgtttttccaaagctacttggactacaaagctcaaaacgcacaagtgactaatgttctcgaaaacggaaacgtggcacacactccagacatcttgtcacagatcccaacg

SEQ ID NO: 74151 - DNA, 357 bp, Glycine max
  Peptide Sequence Number=SeqID_190929
atgttgatcagcatgaatctcaagagagatccaaatcgagtgatatgcccccaagtacctgcatttttcatcatgaaaaatcacaagtgtactgacaaagtttatactatttccatgcaattatgcagtatgaaacatgggcatcatcaatgcactgaacttggacgattgaaaattctaagccttccacttccctctccatggatgcttataatttttaaaccaatctccttccctctccaaggatgtccaacagggtcattgcaccccccatcaataagcggaggtggctcgtggcggtcaccgatgatcgtgggtggtggagaaggaggttctagggtttggagagagaaatga

SEQ ID NO: 74152 - DNA, 2136 bp, Glycine max
  Peptide Sequence Number=SeqID_190930
atgggttgtgcacagtcccgaatagacaacgaggaatccgtgtctcgctgcaaggaccgtaaaaatctcatcaaagacgccgtcgtcgctcgcaacgccttcgccgccggccattcaggctacgccgttgcgctcaagaacaccggcgccgccctcagcgactacgcccacggcgagacccacgacccccaccctccgcccctcgaccctccctcctcctccgccgaccctccgccgccgccgccgccaccaatcgacgacagtctccctcccccgccgccgcctctcccggagttctcccccgccccggcgccgctttctcgctccgtcaccatgcccgccggcgtcatgcaccactaccgccaccgcagccccgtccccctctccatcgccgaggaggacgaagagcaagatgcaacccccaagctggcgaggaaaaccgccggatcgccgcctccggagatgaagactccgccgccgccgcctccggagtcgaagggcatggcttgggattacttcttcatggtggagaacatgcctggacgttctctcagtgctgaagatgataatgatgatgatgatgatgatgataatcatattcataaccataatcataatgatgatggtgagcgtaaaatggagaatgtggttgaagatgaggttgagcctaagacaccagataaagtgcaggaacatgagaatgtgagtattcatgaggagcatgatgatgggataagtgaagcgaagaaatacattgagcattctaaaactgctcctgctgagtttagaagagctataaaggtggttccttctgttactcttatgcagattctcaatgtccttgatgatcacttcttgaaggcctccgagggcgctcaggaagttaccaagatgctcgaggctactaggttgcattatcattccaatttcgccgataatcgcgggcacattgatcattctgctagggttatgcgtgtcataacatggaataggtccttcagaggtgtgtccaatggggatgccgctaaagatgacattgattctgaggaatatgaaactcatgccactgtgttggataagttgttggcatgggagaagaaactttatgaagaagtcaagcaaggtgagcttatgaagtttgaatatcagagaaaagttgcaattctaaacaagcagaagaagcgtggtgccagtgctgaatccttagaaaagactaaagcagctgttagccatttgcatacaagatatattgttgacatgcagtcgatggattcaacagtttcagaagtgaaccatattcgagatgcccagttgtatccgaaacttgttgctcttgttattgagatggcaaatatgtgggaaaatatgtgcttacatcatgacagccagctgaaaatagttacagacctcaaatctcttgatatttctcaagctcctaaggaaacaaccaagcatcattatgatcgcactgtgcaacttgagaaagtcatcctggaatggcatttacaatttgagaagcttgtgactcaacagaaacattacatcaaagctcttaacagctggctaaagttaaatctcattcctattgaaagcaacctaaaagagaaaatctcatcccctccaaaagctcagaatcctccaatccaagcccttctccatgcatggcatgattatgttgacaagcttcctgatgagcttgccaaatctgctatttcctcctttgctgctgtgataaagacgatcttacttcagcaggaggaagagatgaagttaaaggagcgatgtgaggaaaccagaaaggaatacttgaagaaaaaacaagcatttgaggaatggtaccagaagcatttaatgcggagagggcctgatgaagcagaacatgaaagaggagaggaagtaaacacaaataatcctgtctcggagaggcagtttgttgttgagagcttgcagaagagattagaagaggaaattgaatcccaccaaaaacattgcattcaggtgcgagagaaatcactgcagagtctcaaaactcgcttgcctgaactcttccgtgcattgtcagactatgctcatgcctgtgctgaggcttatgagaagctgaagttaatcacacagtcacgaggtggtggggcataa

SEQ ID NO: 74153 - DNA, 375 bp, Glycine max
  Peptide Sequence Number=SeqID_190931
atgcagagtctgcaacacaaggcctccgaatggagtggagtttccacagctgatgcttttaccatcgacgaggccttcaaaccttggttaccttctctaccaatttctacaacagggtgtatatatgatgacgaggaagagtggtttcgttcaatatttgccaattcacagaaccagtacgagttcctcgtccagagaatgggaggccccactctctattctcaattctcaaacaagagaatggttacatcatatggctcaagcattggacactacactgcatatttcctagtggctggagttgagcagcaggatcaaaaccttcacacaccatgtaaggatgcagccctaaagcagcacgcaccacccatgtaa

SEQ ID NO: 74154 - DNA, 129 bp, Glycine max
  Peptide Sequence Number=SeqID_190932
atggcaagcaacggcggctcgcggcggccaccggtggccttgggtggtggaaaaatgaggaaacgccagacaaaattcgaagtcgatccaacggtttacgaatccaggatcgcgattttacttaactag

SEQ ID NO: 74155 - DNA, 165 bp, Glycine max
  Peptide Sequence Number=SeqID_190933
atggtgatgaagcacaaatctggcgacgcatggaggatgacaacaacaagacgggtggggtcacgcacactggtggtggatgagggtgggattagacaacatgacaacacggttaggggattgagaagtctaaggggaaagggagggggtgtagggatttggtga

SEQ ID NO: 74156 - DNA, 522 bp, Glycine max
  Peptide Sequence Number=SeqID_190934
atggtggggcggtttgcttattcaatagcttctccctcattggctattgctggcggcgacgtttgtgttgggcaatatggtttggcagaaaccagtttgtgcttcaaaataggaggcttgagtacgtataatcagattatccagaagatgctctctaatctgagagaggcaggaaagcataaaggcccagctattcaggaagtccaagacgaggttatatcgaaaccaccaacaaaagtaagctataaggtgaactttgatacaaagattaagaagaatattggcacaggattggggatggtcattcgcgaccataaaggtcaaatcattgcagctgccacaaaatttatggacatggagttgtgccctatagaagctgaagctttttcattgcgatgggcatcgatcttggtgtgggagttgtgcgttcatggtgcaatttatgagacgaattgcctggactctgtcaaacatggaataaccaaaagaacaagatgggaagaaacttatttcacagcttag

SEQ ID NO: 74157 - DNA, 1569 bp, Glycine max
  Peptide Sequence Number=SeqID_190935
atggtagaagcaggggaagaggaggttattgaattcaagtggggcacaaggaaagggttgggtggcaaaaagaaggatgtgcagttttacgaatcgttcacctacgatggtgtggaatactccctctttgattccgtgtttctctacaaggaaggtgaacccgagcattacattggtaaaatccttaagatatgggagaactctgataagagcaagaaagttaagattctatggtattttagaccttctgagattttgaatttcttggaagggagtgagacacttgagaatgagttgtttctggcttctggtgaaggcgaagggcttgtaaatgtcaatcctctggaagctatttctggcaaatgcaatattgtttgcatttcgaaggatatcaggaatccatatccatcagatgaagaagttcaaatggctgaatttgtattctatcgtttctttgatgttgggatgcgtaaaatattggacaagatagtagttgataaaattgctggaattgaagttaaaaatatttttaacaatttagatagtcaaaaggttgttggtcttgtgaaacctgatttagacaacaaagaagttagcgggaacttcatggcaagtaatgaagtggtggctctttcgagccaaaaaaaaagtcaacctttgattgaaaaaccagatgggaagtgttttgacacattagttagagaaaatgctgcttctaagtcattattgggagaaaaacctacttgtagcattggtgtaaaggaagcaagtaaatctgctaatgctttgcatactatttccaacaagaagactgtgcctcaagccaaagttgaagaaaagaggggttgtaaggattctttggttaaacaaaaatcatttgctaaactatcacatggtttgatagctggtttggaaatgaaggaaataactaaaatggatgatgggagtggaaagggatctattgagaagaacattttgatgtctaggggtgattcaaaaagggatgatcgcaaggatgttggtgtcccgattggacaaattaaaaagggattagaggaggaaaatgcttccaagaagggaaaacgtggtggctttggtaaggtttctagtttgaagaagaataataacgggcaaaatcgaaggcttattacctatgacgatgacaacaatgatgatttgaagactatagctccatgttcatcaaaggagaaatataaggttcaacgggcaatggattcttgtgatgtggaggaactcccttccaagaagttaaagattgacaagaagctagcgaaactcactagtgacaagttgcgcaaagaatcttcaatgatttcaccgaatgtggaacacaagctagattttcgtccaatggaagttactcgaagaccaaatgatttcttgttctcttggcacttcttgtaccttactacatcaccatacgaccaaatgaacaagatagagttgtcaagacaaggtcaacctctaaggttggcatttggcccgaccatgcttttagtgcctagcttaaacaacgatcttgttgggctagacttatattataactaa

SEQ ID NO: 74158 - DNA, 624 bp, Glycine max
  Peptide Sequence Number=SeqID_190936
atgaggatgttgcggtggatgtgtggtaagactcgacaggataaaattagaaacgaagctattagagagagggttggagtagcgcctattgtagagaagatggtggaaaatagactaaggtggtttgggcatgtagagagaagaccggtagactctgtagtaaggagagtagaccagatggagagaagacaaataattcgaggcagaggaagacccaaaaagactataagagaggttatcaaaaaggatctcgcacttaatgatttggatagaagtatggagttaaaagggaacattcgtgtattctgtcgagtgaggcctttattagctgatgaaagttgtagcacagaaggccaaaaacattcttttacatttgataaagtttttacaccagaggcatcacaggaagaagtttttgtagaaatttcacagcttgtaccaagtgctcttgatggttacaaggtttgcatctttgcctgtggtcagacagggtcagggaaaacctatacaatgatgggaaggcctggacatctagaggagaagggcttgatacctcgttcattagagcaaatatttcaaacaaagcagtctcaacaacctcaaggctggaaatatgaaatgtag

SEQ ID NO: 74159 - DNA, 216 bp, Glycine max
  Peptide Sequence Number=SeqID_190937
atggagtcatctaatgaaaaaatgatgggcaaaagaaaagtttcaagaagaaataatgaggaaacaagaagttattttacatggattttgaagatggaatgtgcattgaatgatgtactgagagatcaaaggaatttgagcaacaagggcgatgagggttggagaaagtcagcattgaatgttgcccgcagtgttgtctacaagcttcaatgttaa

SEQ ID NO: 74160 - DNA, 216 bp, Glycine max
  Peptide Sequence Number=SeqID_190938
atggtgtcaccacaagggaggaacatgtggacagttgatgatctcgtgccttatgtggagaagataacgattttatccgaagagcaagagataatcattgagcctgtggcacatggtccatcatctgagcgtcgattccaccacaagagtttcacatgcttcagtcaagtgttgaaactcggggttttggcagatgaagggaggttgttgaagtag

SEQ ID NO: 74161 - DNA, 369 bp, Glycine max
  Peptide Sequence Number=SeqID_190939
atgaagcggacacgcaaagtgacacggctacgatcgttggccactaaacaacatggtgcaaggagactagtggtcaatgttgatcttaataccgggaaggccgacggtccccacaagaagaaattaagaacatatttggagattgtcgtgcgtgataaggtcgacgtcacatacgagacctggaaagaagtccctgctgctcagaaggatttgatatgggaggatattcattttaaatcggacttgaccaagaaatgggcccttgcagccgaacaggatgatgtggatgacattgcttgtgaaaaatatgacattagcaaggataaatgggctcaattttgtgagacacgcagagatccttcttgggag

SEQ ID NO: 74162 - DNA, 531 bp, Glycine max
  Peptide Sequence Number=SeqID_190940
atgagcaccacatcttcaaccgcatcaactgagaataccatacaacttccaaccttctatcatactcaatgggcaccaaactatcctgagattgttcatctcagatacaatggagccatttatgaagtacgagtcagacaacgcagagataaagtgtatttagcagatggactccaaagcttctggaaagatttgaaaatttatgagtcaaccagcatcaacttttttgcatgtgacaatcactctgttttttacatacatttcataccaccactggagcggcaaacttgcggcaggcagaggaagaccatatggactcttcaacttactcaggaaatgccggatcatcctgaacccctgaaactcccccattgtacagaagttcctcttagagcttgcggcaaccacatgacagtcttaaggcggcatggccccccactgcaatggaaagttgaaacgctgaatcctgctattggtggaaaaggtgttgtccaaccatggtatgattttattcaagaaatggatttttga

SEQ ID NO: 74163 - DNA, 255 bp, Glycine max
  Peptide Sequence Number=SeqID_190941
atggagaattacaaaaaatccatgaacttcatcctagctatctaccactacagtatcctctgctctttccttatggagaagacagatacagagctgacatacttcatcgttgtacttcatccagcaaaaaaagaaagttataccatggtggaatctgaaagacttagctatatcagaaataaccaaaagaagcttagagtttataagtattctagcttacaaacttcattggatactggacaactaaaggcttaa

SEQ ID NO: 74164 - DNA, 132 bp, Glycine max
  Peptide Sequence Number=SeqID_190942
atggaaaatccaagccaaggtgcttccgtaacgcttccaagacgtttccttgagcaaatccatgaaggttttccgccgttcttcaccgttcttcatccgtttttcattcgttcttcgttcttcaaccggtaa

SEQ ID NO: 74165 - DNA, 246 bp, Glycine max
  Peptide Sequence Number=SeqID_190943
atggtgaccaaaggttggagctttgttggagcttcaatggagaatgaagaagaaagaaaaagcaacgtgagggagagggagagagagcttctgaattttctttggctgatccctcacgtttctctgcgcccgtcgaggccagttttcgaaagtaggcaatatatatatcaaaacgctcagaataaagccccgagcgtggttcagaggttggttttgttaaattttaagtcgcacgcaaaacgatga

SEQ ID NO: 74166 - DNA, 468 bp, Glycine max
  Peptide Sequence Number=SeqID_190944
atggtctgcattgaccaggcagatatgaccggtagactgctttccggttgtccaatcgactgggcccatttgattcgttaccgcatgcataaggcattgcggtctagtgaacctctaccttaccctcagcttgtgactttatttcttcaacattttgaaattcctttgaattctgagccctttgtgcaagttaaacgttcatttgctattggtgtcggtgcggtaacctccttcgactaccataaggacatggatgggcaatggttgaagaaggatgtgcaacctccgcaagatgaacgtactccctctcctctgcctcaacgagatgactcctcagccctcatgcatgaagttttttcggagttacgaggcccccacacctatgttggtgagcgctttgattccttggatggttgtatcgatgtcattgatgctcgctttgcaggcatggatacccacatcacttag

SEQ ID NO: 74167 - DNA, 153 bp, Glycine max
  Peptide Sequence Number=SeqID_190945
atggtagccataatcccagcaaggattcctcaacctccattttcccaaggatacaactcaaatgcgacatgtgcttatcatggaggagttctggggcattctattgagcattgtatgaccttgaaacataagatgtctccaaggactcattag

SEQ ID NO: 74168 - DNA, 324 bp, Glycine max
  Peptide Sequence Number=SeqID_190946
atgggaatttttgtaggtcaccttgagcttcttaaagccaattgtcgcacgatccgtaaggggggttcttcagccctgagcccatctaggcccatcaggaagcttttggaggaagcaactagctctcttgggcaagcatgttacttcaggcttaagccaccagctcgcctgggcgagttgggcggcaagctcctccatttttctataaatggacattggggggagaggcgaaggggttcaacacccttggtattcaaatttcacttaaaattagtgaggaaaataataaagaaggagaatatcaaggttgaggcgcttccgtaa

SEQ ID NO: 74169 - DNA, 298 bp, Glycine max
  Peptide Sequence Number=SeqID_190947
atggtgggagcaggtttgaaaaaggatcttagagtgtctagggttgtgccaggagggtctcttaatgccttcctttttcttctcatcggagttatttcacaaagacttgccatggaatctattgattctctcccaattggttggactgtaggtgcgatgatttacttcacgggcgaggtctctgctcagttggtagagctccgctcttgcaattgggtcgttgcgattacggaggaccgaaacatgccactgaaagactctactgagacaaagacgggctgtcaagaacgtagaggag

SEQ ID NO: 74170 - DNA, 146 bp, Glycine max
  Peptide Sequence Number=SeqID_190948
tgttttgcataaagaaggaatctggaagagcacctgaattgaagcagcgcgctaagcgcgagatcaactctctaagcgagtcatccatctcttgccaggctcagcgcagcattggtgccaagcccaaatccacttactcacgctaa

SEQ ID NO: 74171 - DNA, 300 bp, Glycine max
  Peptide Sequence Number=SeqID_190949
atggcttccaacttccaacaattcagtgcaagaaatgatgctattgtccttaaaggagtccatgatatgcccacaaattcatcttcatccgttgaaaataagaagcttgagggaaaacttgatgccttggtcaacctaaataattatgatctttcaagcaacagatacaatccaggttggaggaatcttccaaatctgagatgggcaaatcctccacaacaacaacagcctatccctcctttccagaatgttgctggtccaagcaggccatatgttcctcctccaatacagcagcaataa

SEQ ID NO: 74172 - DNA, 285 bp, Glycine max
  Peptide Sequence Number=SeqID_190950
atggccacagatccgacgtctcccccgcagtccgatggtcaatcagaggcgacttccaagaggagtagaacaacgacacggttgagaacattgacattaagaaccgtggatcagcccagaccggcagtttatgtggatcccgctaccgggagagcatcgggaccgatgcgtgaaaagttccacagctacctaggcgtagtggcgcgagaaaaggttcccattatccacaataattggaaagacgtacctgaaacgctaaaagacatagtgtggaatgacattcta

SEQ ID NO: 74173 - DNA, 393 bp, Glycine max
  Peptide Sequence Number=SeqID_190951
atggtggaagccgtgagaaggtcaactctttacactaatagcgtttccctcatgtgttttcttggtacagtaatctcatatgatttctggatgtcgttgattgctgatctcatgctgcccaactcttcccctcccacgattcttcctccccttgacatccactgggtttggttctgtcacactttaaaccccgtaagttacagggaatattgtgaaacaagattctcaaagctgattgggaaagcgggaatctttgatgaagagaacagagagtacgcgttgatgcggtgtagggagatttggagcagtagatactcgttggagttgtttgaaacgaggcgagttcggattcgcaggatttggatattgtggttgttgttaggggctatttga

SEQ ID NO: 74174 - DNA, 3462 bp, Glycine max
  Peptide Sequence Number=SeqID_190952
atggcagatcttgttagctacaggaatgccgaccgtgacatcgaccaagtttatttttctcctttttggaatgttatgattgtgatcagggggggaaatagggcaggcttgtctgtgtttgaatggaatggactgatgggacgcgaggcattgattgctttgaaaaagggtgctcaactacttaaatatggtcgtaagggaaaacctaagttttgtccgtttagactttccaatgatgaattgtctttaatctggatatccagtagtggagaaagaaatctgaagctatcttctgtctcaagaattattcctggacaaagaactgctgttttccaacgatatctgtgtcctgagaaggactatctatctttttcacttatttataacaacgggaagcgatcccttgatttgatttgcaaggataaagttgaggcagaagtgtggattgctggtctcaaggcactgatatcttccggtcaaggtgggcgttccaaaattgatggatggagtgatggaggcctatatcttgatgacagtagagacttgacatcaaatagtcctagtgaaagttcagctagtgtttcacgtgacatcagttctcctgacgtttctgttagtctggcaaatacttctccacaatccttttactttgagagtaccttaaatattgaaaggtcacatgcaccatcaaacccatcaaatatgcaagtgaaaggatctagttcagatgtttttcgtgttagtgtctcaagtgcccccagcacatccagtcatgggtctgcacccgatgattatgatgctcttggggatgtatacatatggggggaggttatctgtgagaatgttgtgaaagttggtgctgagaaaagtgctagttattttagcccaaggacagatattctcctccccaggccactggagtccaatgtggttttagatgtgcttcaaatagcatgtggtgttaaacatgctgctcttgtcacaaggcaaggtgaactttttacatggggtgaagagtctggaggacgccttggccatggtgttgggaagaatgtgattcaacctcgtctagttgaagcaatggcttccacaactgttgattttgttgcctgtggggagttccatacctgtgctgttacaatggctggggaactatatacatggggtgatggtactcataatgccgggcttcttggtcatggcactgatgttagtcattggataccgaagagaattgcaggtccactagaggggcttcaagttgctttagtcacttgtggtccgtggcacacagccttgataacttcaactgggcagctcttcacatttggtgatggaacatttggtgtcctaggccatggagatagggaaaatgtttcatatcctagagaagtagaatccttatctgggttgaggacaatagctgttgcttgtggagtttggcatactgcagctgttgtagaggttattgtgacacaatcaagtgctagtgtatcatcagataaattgtttacatggggcgatggagataaaaatcgccttggacacggagacaaggatgcccggcttgaaccaacttgtgtatctttacttattgattccaattttcatagaattgcttgcgggcacagtttgacagtaggcctgacaacatccggagaagtttttacaatgggaagctctgtttatggtcagcttgggaatccccagtccgatggaaaggtgccatgtttggttaaagacaagcttgcaggagaatccgttgaagaaattgcatgtggggcttatcatgttgctgttttaacttccaaaaatgaagtttacacttgggggaagggtgcaaatgggagattgggtcatggagatgttgaagatcgaaaaacaccgactttagttgaagccttgaaagatagacatgtgaaatatatcgcatgtggttcgaactactctgccgccatatgccttcataagtgggtatccggtgctgagcagtctcagtgctctgcttgtagacaggcatttgggttcactagaaagagacacaactgttataattgtggactcgtgcactgtcattcatgtagttctaggaaagcattaagagcttcccttgctcctaatcctgggaagccctatcgtgtttgtgattcttgtttcgtaaaattaatcaaggttgcagaatcgggcaataataatcggaggaatgctatgcctcgtttgtcaggtgaaaacaaggacagattagagaagtctgagctaagattgaccaagacagcagtcccttctaatatggatttgataaagcagcttgatagtaaggcagcagccaaacaggggaagaaggctgatacattctctctggttcgcacctcacaaccacaatctttgctacagctcaaagatgttgtcttgtctactgctattgatttgaagcgaacagctccaagacctgttctgacaccatctggagtgagttccaggtctgtatcccctttctctagaagaccaagcccgcctcgttcagctacacctattccaacaacatcgggactttccttctctaaaagtattactgatagtttgaagaaaacaaacgaacttttgaatcaggaagtgttgaagttacgcggtcaggttgagaccctgagacagagatgtgaactgcaagaattggagcttcaaaggtcaacaaaaaagactcaggaagctatggcactggctgccgaggaatctgccaaatctaaggctgcaaaggaagttataaagtcacttacagcacagctcaaagatctggctgagaggcttcctcccggtgcttatgatgctgaaaacatcagaccagcttacctgccaaatggtctggagccaaatggcatccactatccagaattaaacggtgaacgtcacaccagggcagagtccatcagtggctctagtttggcttccataggacttgaatcatccctattgaatagaaccgagggcactttgcctggaagctatggagctaatctttacctgcaaaaccggggatctgtaacctctaatgggacagatgattacccgaatgttaaattgccaaatggcagcagcatgattcagccaagcagcagtactgtgtcagatatggttgatggtagggattctggagatttccaagatgatgagagtggtttgagatcaagaaacaccatagtgcctgctaatagtaatcaagttgaggcagaatggattgaacaatatgaacctggtgtctacattacactggtcgccttgggtgatggaacaagagatctgaagcgagtgcgattcagccggcgaagatttggagagcaccaagcagagacttggtggtcggagaaccgcgatagggtatacgaaaggtacaatgttcgaagcacggacaagtcttccggccaagcggcacgtaggacagagggtgctggttcacctgttttataa

SEQ ID NO: 74175 - DNA, 747 bp, Glycine max
  Peptide Sequence Number=SeqID_190953
atgtcaccttctggtctgacttcagggggcaatgagatgcataattatattgctcgaaatgatgaccatactggtcaccgaattctaaaggacactaaaacacttggatctgcttatgaccgctaccttcaaagcgctgggcagcttacttcgtttaattctggggaagccagtgcaattagcagtgttggattgggaaggggtgttggtggattgccacatcattcactaactgatcctgctgtcacggggcatcctggtggtggtcatgatctttcacgaaatggacgtaatgtcaattatgccagtcagttaccagtagatgcagcttccatgcctggacctgagactctacctctacccccagatgcttcaagtactttatacgttgaaggtctcccatctggcagcacgagacgggaacgtggcggagatcctctaatcctttgttttgtggattttgcaaatccggcctgtgccgctactgctctgagtgcattgcaaggttataaagttgatgaactgaatcccgagtctagtcacttgcggcttcagttttctcggtttcctggtcccagatctggacctggacttcgtggcaagagcgttgatgttgattacgatgaagatgatgatgatggtgatgacaacgatgagagtaacaagatggtgacgacaatagtgaccatgataatggtgatgatggttggtgaagatggagatccaatcataaaccctaattcgtaa

SEQ ID NO: 74176 - DNA, 586 bp, Glycine max
  Peptide Sequence Number=SeqID_190954
atggcattacgaaggtgtaacagtggcctccacaatccgttaagcgctattctagctcatataacggcgtccgccatttgggctatggcgctttgcatggccataacgacatggcggttcacggtgggcatggcagatgtggtctttgccgttagaagggatccattaactgttgatgtgaccgttaactcgacacgtcaacaagctacttgtgatgccatcggagaatccccttcaaagcagaaagggttacagggaaacacaacggtggagttaccatcaaagccgcattataaaccacctgaagtgggagcgattctgctattggttcagttccttaatgcagaggagaatccgagcttgcatgttaacaccgtgacgacaaatgggggtgtccatggcagcgatgctggaggaggggctgacgattctagaggcggtggggtcagagagggcaaggaagagggggaatggtgctgctctgaaaagggtctgaaaagcgactgcagccaattcatggcgaaacacaagggtctgaagtcgacactactgccatggttgcttcctcaacttgccgatgtgtcga

SEQ ID NO: 74177 - DNA, 753 bp, Glycine max
  Peptide Sequence Number=SeqID_190955
atgtcaccttctggtctgacttcagggggtaatgaaatgcataattatattgctcgaaatgatgaccacaccggtcatcgaatgctaaaggacactaaaacaattggatctgcttatgatcggtaccttcaaagtgcagggcttacttcttttaattctggggaagccagtgcggttggcggtgttggattgggaaggggtgctggtggattgccacaccattcactaactgatcctgctgtcatggggcatcctggtggtggtcatgatcatgcacgaaatggacggaatgtcaattatggtggtcagttaccattagatgcagcttccatgcctggacctgagactgtacctctacccccagatgcttcaaatatttttcggccttttgttggatatagagaagtgagacttgtgagcaaagaatccaaacatcgtggtggagatcctctaatcctttgttttgtggattttgctaatccggcctgtgcagcaactgctctgagtgcattgcaagctgtactagtgatcatcactgggaatgtattcctgttctctgctggttataaagttgatgaactcaatccagagtctagccacttgcggcttcagttctctcggtttcctggtcccagatctggacctggacctcgtggcaagaggataatggcagaggcccagtacagtaacgccataggctatagccgtgtagtctatagacgtttttggatcctaagttataagtgtttttaa

SEQ ID NO: 74178 - DNA, 483 bp, Glycine max
  Peptide Sequence Number=SeqID_190956
atggacgaaattgaaatccttgcccatttcctctgccctatttcccttcaactcatgagggaccttgtcacagtttgcacaggaatcacttatgatagagaaaacatagaaagatggttattttcatgcaagaacaacacatgccccgttactaagcagtgcctattagaccatggtctcactccaaaccacactctacgcaggctgatccaatcctggtgcaccctcaatgcctcacttggagttgaacgcattcctactccaaagtcaccaataggcaaaactgagattgtgaaactcctcacagaagcaaaagggttcccagagaagcaactcaagtgcctcacaaggcttcgatccgttgcctttgaaggccaaaggaacaaaacatgtttagagtctgttggagtaatagaattcttggccacaacaatgaatatatcagcaccaatattgtggggaaaagatttagtccacatgggc

SEQ ID NO: 74179 - DNA, 282 bp, Glycine max
  Peptide Sequence Number=SeqID_190957
atgcttggtgcaccaggaccactgagactccccaactgtgccatgatacatgtaaatgcttgcggtcaacacatgaccattctcagaagatttggacctccattacagtggaatgtcgtggtggttgacggtggagttgggcgcaaatatgttgtacaaccatggtatcaattccttgcagataatgatttctcccacagtgatgaagtctccttctattacaggagcattgacaaaatatgggaaattgtcatccgccggagaaagaattgggattattag

SEQ ID NO: 74180 - DNA, 279 bp, Glycine max
  Peptide Sequence Number=SeqID_190958
atgaggaagtttggagatgacaagtcttggattcaattaataaattttagttatttacatcttaatattcgtccttatgaagaaaaatcgatgattttaccattgtgcatgtctaacaacagagacttcttcatgctgaaattcactagaaatgctgatgatgaataccaaacaattctgtataaccagagggatggtagtttcagaactttgttgtggtgcaacttcaagatttttaccaaaactttggtcatctcgaacgctttgtcagatgtttga

SEQ ID NO: 74181 - DNA, 1113 bp, Glycine max
  Peptide Sequence Number=SeqID_190959
atggatgtgttagctttgctaatttttggggtcgtcctctttccaaacgtggatggtttggtggacctagcagcaatcgacgctttccttgcataccaccatagcaaggaaagtccgatggcagctgtcttggcagatttatttgacacatttgaccgaaggtgcgaaaagagtagcgcacggatcatctgttgcttgcccgctctctgtgtttggttggtttcacacctgttccagcaagacacgaggcatccatgtccgctccagagccatcgctcgtgtactgaaaagagaagaatagattgggaccagtttttgactgggataggaggtagaacaatcaattggttcccccgatggaaggaaggaaaggagggagtccttttctcatgtggagggtacccaaacattccgctgataggaacgaggggttgtattaactacaatcccgcgctcgctataagacaactagggtaccccatgaggggagcaccgatggaagaaagcatgtctcctttccttgtgaaggatttcggcgcacaaaatttcaaggctatacaaagaatccataaggcatgggaaaccccgttaaggaaagatcaagaacttaggggcattcgtaatggcaccattggtggttaccatgaatggctgaaagttcatatacgaggtttagattggctcgccaagttaaaagtcgtcagcgaagagagttttgaagcaccggaagaggacgaagaggtccaagctttcaaaagcgagttaggaaaggcgaaacttgccaaggagaagttcaagttagccgctacacacatccggaaggaatgtgccggattacgggaagagaatgcaactaccgcaagagcccttgagcaagagaccaagagggctcgcaaggaagagtatggccgtaacaaatttcgcggagctctgtggggtagcaacaatgaactcaagctgcgaagggaagagagggaccagtcgcaagcacatagcatggtcttgaaagaggagttagttgcctgttcaaggtccaaaaggagcttgtctcagcgtttatgcgagacggagaccaacatgctagctatcatcgccaagtacaagaagagttag

SEQ ID NO: 74182 - DNA, 387 bp, Glycine max
  Peptide Sequence Number=SeqID_190960
atgatgaggattcttttgataggccaaggttcaaaaaagtctaaggttgtgtttcaatggggtcttttatcgtgggaacccaatcttgatatctggggcaaaacaaatttgggtgtcaaggtgtcggtctcgggcctaactcccatattactccacaaggcacgcgtgacaatgatgatttcaaaacaacgtgcaaaattagtcatggctacagccaggtgggcactcaagcatcccgtttatggcattgtgatactatggttgggaatttacacaaacagacccaacgtttccaagttatgttctttcattagttcaatgaattcatccattcttatctcggttattccggaaaataaactcttatcgtcagtcccttgtttctag

SEQ ID NO: 74183 - DNA, 120 bp, Glycine max
  Peptide Sequence Number=SeqID_190961
atggcaggggttgtaagggatggcaagcctatgttgcattctagagtaatggggcatgccacattgcccccattctcttgctattcatgccaaaacgtgcgcccaccaagtgcccggtga

SEQ ID NO: 74184 - DNA, 444 bp, Glycine max
  Peptide Sequence Number=SeqID_190962
atgaatgtcaaaaatgaggaagatgttgacgttaaagttgattgctctgattcctttaatacttctaagttgtttggtagtcgtgatgaagttttacaatgggctcgatcgttggctcatgacattggatttgttgccgttataatgaggtcatacaccaatatcggtgttcgaggaaaagtctcatttctgttgatagcttgtgaaaggagtggggagtataggcctaagaaatataatttggtaagaacatgcactggtcgactgacaaaggatgagaagattgttgttgcagatatgacaaagtccatggtgaagcaaaaaaatattttgttgacgttgaaggagcacaatgacaacagttatacaacaatcaaacaaatttacaatgcgagacatgcttaccgttcttccataagagggagtaacaccgaattgcaataa

SEQ ID NO: 74185 - DNA, 543 bp, Glycine max
  Peptide Sequence Number=SeqID_190963
atggaggagatgagagctactaaaaacattttgaacatagagatcaagaaggatggagtccaaaagaagctcttcccattcaatactactcagtcaaaatcagagaaggaatacatggctcatgttacttatggaagtgttgtaggtagtctcatgtatgctagggtatgcaccaaacaggacctagcacaagcagtcagtgttgtgagtagatttggatgcaaagagatctatgactgggtacacattcacgattggaacctcttttgtcagttggaaggcaatagtagagtacatggctctggcaaaagtagcaaaggaaaagatctaactgaaagtttgagtgcaatctatttagtcaaggatcaattccatcatgagaggactaagcacattgatattagataccacttaatccattttgagaagagggttgaagtccataaagttgatacaagtgagaatctaattgaaatgttcacaatgccagttccaagaagcaagttcatgcaatatttgaatctacttaacatagattactag

SEQ ID NO: 74186 - DNA, 339 bp, Glycine max
  Peptide Sequence Number=SeqID_190964
atgaccaaacaccaaagatcaacagagcgtgatccgtcttactatgtgaaagatgacagtaactatggatatcgtgcaattgttgtgttattaggtatgggtgaagattcatggtcgttggtgcgcaaccatttgcttaaagaacttgtcaaatggtctaatgagtatgtcaacctctttgttggcatagatagatttaaggaattaaagaggtccctacttgttgatggattatccatgattactatggataagtggatggatatcaccgacatgggatatgtcattgcatcgaggtataatgtaatccttttatcgttgtcttgcaacaaagtatga

SEQ ID NO: 74187 - DNA, 390 bp, Glycine max
  Peptide Sequence Number=SeqID_190965
atgcaaggatatttcaaagggtcactaagaaaggataaagaacttaagggaagcagcaatgggatcatcagtagatatcacaagtggctaaaggctcggatgcaagagctagattgtctcccgaagctaaaaacctcgagtgaggaagaggctgaaacccctgaggagagtgaggaggtgcaagctttgaaggtagaacttgaaagggcgcaaacagtcaaggaaaagttcaagatgacaactataaagccgaagcattggaacgggaaacaaagagggtccgaaaggaagaacgaggtcgaaacaagtttcgaggggcttcgtggggcagcaacagcaagcttaagcttcggagggccgagagagaccagtcgagagtcaaaggcatga

SEQ ID NO: 74188 - DNA, 267 bp, Glycine max
  Peptide Sequence Number=SeqID_190966
atgtattcatacattcacacaaaggtgtcggtcttgcaagtagaaagggaagcgagagaaagagtaatcgcttcattacacagagaagcaatgatgtggatggataggttcgctttcaccttgaatgggagtcaaaagcttccaagactgctaaacaaagctaaggtgatagcgaacatgtactcggccccagaggaagttcataggctccttaattattgtccgctcatgatcgatttaatggcccacataattaggaaccgctaa

SEQ ID NO: 74189 - DNA, 396 bp, Glycine max
  Peptide Sequence Number=SeqID_190967
gtcgactctagaggatcccaccttcaaccaagggaaaacgagcccgttgacgcgcagagactaacatcgtcttctgcaccttctgttgtcctgacccgtgaatcgggtgacatgcggggttaccttatggttactcgcacctttcgtcaaccaggggcaaacaggcccgttgacacgcaaagactaacatcgtcttatgcaccttttgtcgtcctgacccgtgaagtcaggtgtcatgcggggttaccttatggttaccctcaggtgacatgcggggttaccttatggttacccgcaccttttgccatccagggacagcgagtcagaaacattcaagcccgacgacgtgcgagattcttctctgctgggcagggacgatcaagtgcaatggcgtag

SEQ ID NO: 74190 - DNA, 108 bp, Glycine max
  Peptide Sequence Number=SeqID_190968
atgacctttgtggataactgggcggtgggcaaggagaaggaacaatgggggctagatatgcgggttaggctgattaaggaagagaaatccataactggaagactatag

SEQ ID NO: 74191 - DNA, 243 bp, Glycine max
  Peptide Sequence Number=SeqID_190969
atgatgatttgggaacaacgtgcaaaattcgtcatggctacaactaggtgggtactcaagcatccaatttatggcattgtgatactaaggcttgggatttacacaagtagacccaatgtttccaaattatgttctttcatcggttcaatgaatccatccattctcatctcggacgacgttcctaaaggaaagccctacaaggttccggaatttcaacaaacattatcgacaataacgaagtaa

SEQ ID NO: 74192 - DNA, 1134 bp, Glycine max
  Peptide Sequence Number=SeqID_190970
gtgttcggtgccgacgcgatgcgtggcccgcgcggtctgaaaggcgttggcccgtacgtggtgaccaaagcgatggcgtctggcgtctctgcctgcctggccacgccgttcaaaatccacggcgtcaactactccatcagttcggcgtgcgcgacgtcagcacactgcatcggcaacgcggtggagcagattcagctgggcaaacaggatgtggtatttgctggcggcggcgaagagctgagctgggaaatggcctgtgagttcgacgccatgggcgcgctctcgactaaatacaacgaaaccccggaaaaagcgtcgcgtacttacgatgccagccgtgacggtttcgtgatcgccggcggcggcggtatggtggtagtggaagagctggagcatgcgctggcgcgtggtgcccacatctacgctgagatcgtcggctacggcgcaacctctgacggcgctgacatggtggctccgtcaggcgaaggcgcggtgcgttgcatgaagatggcgatgcagggtctggatacgccaatcgactacctcaacacccacggcacgtcaacgccggtcggcgacgtgaaagagctgggcgcgattcgcgaagtgtttggcgacaacacgccatacatctctgcgaccaaagccatgaccggtcactcgctgggtgcggcaggcgtgcaggaagcgatttacaccctgctgatgctggagcacagcttcatcgcgccaagcattaacgtggaacagctggatgatgcagcgaaaggcatgaacattgtgacgcagccaaccgaaaaagcgctgaccacggtgatgtccaacagcttcggcttcggtggcaccaacgccacgctgaccctgcgtaaataccaggcgttgccagcagccttaccagcttcgcgcaggcgcggtcaatttcgccgggcgtcaacgccgcaaagccgagtatccagccctgctgtggcgatgcgccggcgtaaaggggtgacagcggcggcagcagcagaccgtctgcctgcgccagccacggctgcagatgctgttccagctgcaccagcagccgatcgcgccggctatgatagagctgacgcatcagccgcaggtggctggcgaaatagccttgctggataa

SEQ ID NO: 74193 - DNA, 181 bp, Glycine max
  Peptide Sequence Number=SeqID_190971
atggatgagttgattaacaaaacacaactctctcccaaaataatcccaacgtcatcacgtcggctcagtggctccacaaaagaatctcacttctcgtactctactactgtcattctactcccacgaacaaaggttcgcgatcatcataggtaccaaccacacgatacaaaaattgtgaggg

SEQ ID NO: 74194 - DNA, 276 bp, Glycine max
  Peptide Sequence Number=SeqID_190972
atgaattgcgttttcgttcatgcatcctccacccacgagtttggcgccatgcgtagtgattgcttagtgcaattctccattctctaccctttttcggagtcctatgaattgcgatttcgttcatgcatcctccaccaaagagttttgagccatgcttcaagattgactggtgaggaccctctagtgcaatcctccatgctcgccttttattcggagccccatgaattgcgatttcgttcatgcatcctccacccacgagtatggagccacgcgtag

SEQ ID NO: 74195 - DNA, 630 bp, Glycine max
  Peptide Sequence Number=SeqID_190973
atgatatccaacctcagaggaactgttaaagcggtgatccaggctaagctgatcattaaaggtgaagagaaacccgcatacaccggtgatttgcattctatgaaagaccacgaattacatcagcttactgatcttcttttcaaatccgggaaagaagaaaaatacgggcctaaaagcgtaataatcgaagaaggaacagtttcgcgaaagttctattatttaaaaaaaggaattctgagaggctggacaaattatgacggtaaagaagtcacatttcaattcctgtttgaaaatcatattttttgctgttccgagagcttcttttatcatcagccaagctcttatacagtggaaacgatcgaagcatgcagccttttatcagtagaaaaaacggatatcgatacattatccgaagacattaccttcgtgaatctctttaataaatatctcataagccgggtaaatgattaccagcagttattgatctctcagatccgggaaaagccggagatgcgctacaaaaagcttcttgaagaaaatccggaaatcatcctccgtattcctcagcatttgatcgcgtcttacctcggtatgacgccggtcagcttaagcaggatcagaaatcgatga

SEQ ID NO: 74196 - DNA, 468 bp, Glycine max
  Peptide Sequence Number=SeqID_190974
atgcataaggtcctgcttttattggtattcctgaacctggtgaatatcccggttattcggaatgatgaccctgtatcgctgtataaaacaggagatgatccggcctgggcacctaagaactacaatgacaaaaactggtcacgggtaagaggagatacttctgataagatattctggtcacggacccgtcttgatctccggcaagtagaacctgaacttacgcctttaggacttcagattgaatcttttggagcatttgaagtatactgggatggtgtttttatcggaaacaacggacaattacctcaaaatggaaaacctgaaatcccaggttccgaaagcagttattacagagttccggacagcctgatttcaccgggttcccatattgttgcattgcgaacttctcaatcattacttcctcattttaattttaaaagaggaaagtggctcatggcagcccttctg

SEQ ID NO: 74197 - DNA, 402 bp, Glycine max
  Peptide Sequence Number=SeqID_190975
atgaagaacggtgaaaaacgacggaaaatcttcacggatttgctcatggaaacatctcggaagcgttacccaagggggttaaggaccctttggaacagcctcccttcgcctatttataggaaaaggggggaggaggttgccgcccagctcgcccaggtgagttgggttgccttctccttaagtaatcaagcaagtcggagacctagcatgatcacagtggagtcgccaactgtcgcaacctacccttcggcgggagggcgacgcgagactcgcgggatgcgtgttcctcgaaaggaatacgcgtggagtcgccaccaacgtttatttgaggaaaacgtcggaaaatccggaaaagacgtgatctacgaacttttaagtgaaaggttcgagagttgtatttaa

SEQ ID NO: 74198 - DNA, 279 bp, Glycine max
  Peptide Sequence Number=SeqID_190976
cgaaaggatgtggatgtgcgtaaacacaaccttccacctccaattcctgaagaccacatgagattaggtatcttcgggcttaaacacaacctgccaacaccctccccgccaccgcaacgggattcctcatcttccttattgaatgacgttctcactgagcttagctgtcatcatcaaaacgatggagaatgtgattgcatatgctgtataaaggttttgatgatgccaaagattgaagcaattcaaagtttactacaagttcaagacaagatcaagtga

SEQ ID NO: 74199 - DNA, 579 bp, Glycine max
  Peptide Sequence Number=SeqID_190977
atgctgtccttgtccattgatcagataactgaggctttcagtggtgccaaggaaaagatgttattattctcccgacagaaccaaacctcggacgaatctcctccgacgttggttcatgaaacgaccacacagcagtctcagatggatgctagtctaatgcaggaatggctaaggtctagtcatgcactgacaatggatcagttgtttcaaatgcatcagtttcatgctgcaaggagcacgctgcagcagattggtgaaatgggagggaaagatggggaagattctgagagaaacaagggatctgaaggggaagtgcagggaatccacgcgtcaccctcgcggccacgaaaaagggaagctaatcaagagaagagaaaagtgatggttcctgccccacagtttggaaacacggaggtgccaccagaggatggctacacttggaggaaatatggccagaaagaaatacttggctccaagtacccaagaaaagtcggaaataccccagaagtgtataactcctccccacagtcccacgtaatgaataacaagtggttgaggcatttctctggcatgcagtga

SEQ ID NO: 74200 - DNA, 606 bp, Glycine max
  Peptide Sequence Number=SeqID_190978
atggcgcttccgcctgcgttggcctggctcgacatccattggctgggcaatgccgtcggcgagtggtcgctggtcgaactgacccaggaaggcttcctggtcgccagcgtggctgccttcgtccggcttgcgttgcggcgtgccgatgatcgggcctttgccgtgctggcggcagcggtgttcgcctgcatgctcctgcgtgagatggatgaggcgctggacctgatcgcacacggcttctggaagtatccggtgggtgtgctgatcatcggctcactggcctgggccagccgcgactggcgccgggccatgcaggcgctggtgcgttttctcgtatcccggccgggtaccgtgatgacgattggtctggtcctgctgctgttctattcgcgcctgatcggcatgacgtcgttgtggaccggactgttgggtgatcagtacatccgtgtgttcaagaacaccatcgaggagaccaccgagcttcttggttacaccttcattctcgcagccagcgtcggctatgtggcacatcgggtgcgcgagccgctgacggcgcgcaagcgcaccgtgcatgaggacgccgggatgcagcaacggccactctag

SEQ ID NO: 74201 - DNA, 225 bp, Glycine max
  Peptide Sequence Number=SeqID_190979
atgtttggaacgggatggtgcgcagtagttgggagagccgggtttgcctcgacagtcgtgctagcagcggcggcggtggccgtgttactctccattagtcatttcattcccagcatggcctccatcatagaattcatttgttctttcaaagctaacatgtcggctttcatctattcatgtacttcctctaggtcacccatcatcctagacttagatctagtgtga

SEQ ID NO: 74202 - DNA, 366 bp, Glycine max
  Peptide Sequence Number=SeqID_190980
atgacagcaacccccatccggggtataaccgaggtgcttacccgtacggtttaccacccaactacacaccaccagccatgcatgaagacatgggtcacgttactcccctcatcctcgaaggggagcctcctcggcatcctgatggggtccacgagaatcctcgagagcatgctcagggagacgccaactcctactcctcgtttcccgctaaggggctggcgcccacgcactacctcaacccaacgtcacgggagagcctcgaaaccacccaacgcagccaatgtttttgtccgtgggagggcctcccccggcagcggaaggaaaggggaaactcgatctcatcgaagagagattgagggctgttga

SEQ ID NO: 74203 - DNA, 330 bp, Glycine max
  Peptide Sequence Number=SeqID_190981
atgtgtatggattccttgagccacagtccattcagagatctgggcaaccgtagtttgaatcaaaaagttatatcaagagttggatgtagagttcaaaacgcgatgtctaccttggagcctagcggacactggcaaatggtcgtcattctgcctaaggaaaaccttgttgtctggttttgttccttgcataacaggccagacaactaccttaagggaataattagcagtgccttgaaaggacttgatgatactccacagcctaaatccaaggctggtgctaggtggattgttgttaagtattttaacgatgttagaccattggaagcatag

SEQ ID NO: 74204 - DNA, 507 bp, Glycine max
  Peptide Sequence Number=SeqID_190982
atgggacgtcaacgcagcatcgatcgcgacaaggttttggacatcgccgaagaaatcgtcgccacccagggcgccgccggtttgaccatcgacgccgtcgccaaagcgatggggatctccaagggcggggtgcatgcctatgaaacgctgttcacggctatcgccggcgacgatccttcaccgcagaccgctgtgcgggcgcatatgctggccacccacagttcggatcagaccgccagcgccaaggccgccgggctgatggcgacgctgattcaaacgccggagcatctggcgagcacgcgcgaatggtatcgcagccgcatcgccgggctcgatttgaccaccgaagagggcaagcgcgcgcgcctggcgtttctcgccacagaaggcgcctttatgctgcgttattttggtttgatggatatcgaccaggcggaatgggaaacgatgttcaccgatatgcaggcgttgattttaactgaggatgcctatcgcactgatagctag

SEQ ID NO: 74205 - DNA, 258 bp, Glycine max
  Peptide Sequence Number=SeqID_190983
atggtcgccagcgccctgttcctgatcgtcatcgatatgacggtgttatataccgccctgccgcgcttaacccaggcgctggacgccagcgcctcgcaaaaactctggatcgtcaacgcctacccgctggtggtggccggcctgttgcccggcgccggcatgctgagcgatcgcatcggccataaacggctgtttctcgccggactgccggtgtttgccgtcgcgtcgctgtgcgccgcgttctacgggatcctctag

SEQ ID NO: 74206 - DNA, 735 bp, Glycine max
  Peptide Sequence Number=SeqID_190984
atggattttgaggccaatatcgatatcgtcaccaatgccaacgaggccaaaatcccggtggtggtcaccaatgcgcgcctgaacacggacgcgatgacgtctgaagtggtgtctaacgacgagttggggggatatctggaagccaaagccgtactggacaaactcgactgcaagaaccataaggtgaacgtggtgattatcgaaggcccgaaaggcggcagcggtgagatccagcgcggcaagggcaatgataaagcgatagccgagtgcggcgccggccaggtcaccgtgcttgaacgcaaaacggccaactggtcacgcgcggaagcgcagccgctgatggaaaactggctgcagaaacatcggggcaaaatcaacggcgtgattggccaaaacgacgagatggcgctgggcgctatcgaggcgattaaaggcgccggcctgaatgtgaaggacttcgcgattgccggcgttgacggcgtttccgacgcgattcatgcggtgcaggccggtgaaatggtctctatcctgcaagatgccaaaggccagatgcaggggtccatcgacgtcgcgctgcgcgccgtgaaaggtgaaagctatcagccacagtcggatatctggaaacagtacgccaaggatctgaaatgggaaggcggcacgcagaagcattattacattccgtggaccgtcgtcaccgcagagaacgcccaatcgctgttggacgcccgtaaataa

SEQ ID NO: 74207 - DNA, 366 bp, Glycine max
  Peptide Sequence Number=SeqID_190985
atgtcaaagaatgagatgaaacttcctggagtagtgattatggtcatgcttgtgataggcttcgctgaagccgattttaattctacatttgtgcaaattgaatcaaaccgtgtgtctagtaagccaagactaacatgtggtcccaaatgtgaactatcatgcttaccttatgtcttggctttcattttgtatccaatatgtgttgctgcttgtatgaaacaatgtcgtcaaacacccattgatactatctacagttgtcttagtggttgtgacgcggtcaaatcgcttcctgataataatgaaggtcgtggtcgtgcggcatacgtggtagattcttgcttgcaacagtgtgaggacaagaaataa

SEQ ID NO: 74208 - DNA, 366 bp, Glycine max
  Peptide Sequence Number=SeqID_190986
atgtcaaagaatgagatgaaacttactggagtagtgattatggtcatgcttgtgataggcttcgctgaagccgattttaattctgcatttgtgcaaattgaatcaaaccgtgtgtctagtaagccaagactaacatgtggtcccaaatgtgaactatcatgcttaccttatgtcttggctttcattttgtatccaatatgtgttgctgcttgtatgaaacaatgtcgtcaaacacccattgatactatctacagttgtcttagtggttgtgacgcggtcaaatcgcttcctgataataatgaaggtcgtggtcgtgcggcatacgtggtagattcttgcttgcaacagtgtgaggacaagaaataa

SEQ ID NO: 74209 - DNA, 692 bp, Glycine max
  Peptide Sequence Number=SeqID_190987
gtgatccacctaaacaaaagagaagtcaaggaaatgagaaaaagacagaagacgacaatattactcaagggccatcaaaacgaagaaagcaatttagggttggagatgacggtaaaatattatttgatgaagaagagctcaaaatgatcctagattttaagagaggtgaggactatattgaggttctttgtggcgctacaaacaaaaaatatggagattatgttgggaggctaaaaattaataacgaaggtcaatatttcatcacttgtgagtgttgccttgagtgtcccttggtgagtgtcactctagaagcatttgagaaacatgctttaagggaagggagcggaaggtggaagagaaacatctgggttcattgtgaagacgaagacaaagttccactctggaaaacacctctgataaagtattacttacaccaggcaaatgtggctaaccggaaagactctgcaatgaggaaacaaaactttcacagggatgagttcctgcgttgcacgagatgcgggaaggagcgtaggttccatctccagagcagaccagacattaagaactaccatgatgctttaaaacacaaatgctggatttgttctctttggccttatcaaaattggtacttagtcttgcaaaacacattttatgctggaaaaagatactggggactcacgatgtgtcaataa

SEQ ID NO: 74210 - DNA, 441 bp, Glycine max
  Peptide Sequence Number=SeqID_190988
atgttaatgtgcaatgaccaatactcgtgtgttggccctatagaattattatgtaccattattagaacaccggatgctatactcaacctgcttcaatcaaccatcactcctactcatgatgcaattatgtattacaacgggaagtggaacataccacgtcaaggtgagtttttgggttactcctttagtggaactaatccaataagatttggcattccttcgggatgtggcatggagaaactcaaggatttaatcaagcaagttgcacctacaggggttcccccgaatggaattcacatatcacaattggttagacgattgttctttcgacaaccaggtcattctaagtattccgaaaatttgattgaatatgacataacagaattgaaaaatgatgaagacgtgctaaaggtgttagcacaatccaactattggaaatga

SEQ ID NO: 74211 - DNA, 315 bp, Glycine max
  Peptide Sequence Number=SeqID_190989
atgtataatttccttaaatcgcccaagaaacatgtgatacaacgccttggcgagctttgccaacaccgtctcgagcttcctaactcgcacgacgagatcgaagccgcgcgcctggaggttgcggcggaggtcggagatagagtcgataaggaaggcggcgcgataggggccaatcttgtcgaagcagaaaatggggaggacggagagggagtcattgttggcaacagtgaggcactgattgttgaggaggccgaggttgttatgaaaccagacaagggcggcacgacggcgttggaagggtcgcgagggcagtag

SEQ ID NO: 74212 - DNA, 767 bp, Glycine max
  Peptide Sequence Number=SeqID_190990
atggaggctaccggcgcgtacagtgagccgctggccaccttcctgcacgacgaaggctatgatgtcagcgtggaaaatcccgcgcgcatcaggcgcttcggacaggcggagctgagccgtaacaagacggataaagacgatgcgcgcatgatagcgcgctactgtaaactgcacggcccgtcgctgtggcagccggcgccgctgaatgaacgcaggctgaaggcgctggtgaagcgcctgacgaatcttcaggaaatgcggcagatggaagagaaccggctggaggtctcggatgcggtggtgcagccctcaatccgcgtggtcattgcggcgctggatgcgcagatagacgaaacgaagcgggcaataaacgaccatatcgacaatgatccgggccttaaaaagaacagggaactgctggagtccatcccgggcatcgcgggcgtgctgagcagcacgatgctggcgtatctgggggacatgtcgaggttcagcagcagcaaggcgcttgtggcgtgggtgggtctgaatccgatgcggcaggagtccggtgagtggaagggcaaaagcaggatatcgaagatgggcaacagcgcgatgcgcaaggccctgtacatgcctgcgatagtggcgatgaagtggaatccggcggtgagtgcgctgaagaaacggctggatgcgggtaagaaaacgggaaaagtcgtggtgtgcgcggcgatgaagaagctgctgcagctggcttatggcgtgctgaaatcgggtcgtcc

SEQ ID NO: 74213 - DNA, 666 bp, Glycine max
  Peptide Sequence Number=SeqID_190991
atggacataataggagaacatgtgataatggattcaagaaccataaacaatgttgataatgcaactgctgaaccagaaacaaccgttgctagtactaacatactacatgttgcaccgaatgttggatcagttgcatctactttgcatgagggtggcttggttgcagttgttgcagttaacattggaccaagtcagaagacaaaatcaagtgcatcatcatcatctagtgcaaaaggcaaaggaccagttggaacaaccaaagccaataaaggtaccaaaacaccaacaaacgcaacaccacttagggttgtaagaaaaacaagatttaaaagtcgtgtgactgaaaaaactgaagaaatgcttgggtttatggtccctctagtagaaaagatgttaaacatgaatggagctttggagctaacaatttgccccttcttatttgtttgcaagaagcggtggaaaattcccaaatcatcaaagggccgtgcaggatttgtgcgtcgcgctccgagatggaacaaactggttgtcccttcggggacatccgataaaattggaacgatacagagaagattagcatggcccctgcgcaaggatgacacgcacaaatcgagaaatggtccaaattttttttccatttccaatttctccgattatagcagttag

SEQ ID NO: 74214 - DNA, 489 bp, Glycine max
  Peptide Sequence Number=SeqID_190992
atggatttttctgtggtgtttcatcatagggggtacccaaaagataagttcaaattgtggtggaagcatagtcatatggattttgagcaagggttaaagttaatcagtgatgacatacaagcaatggagttagaaaattatgcactttcaactaatgaagaagtgcatatatatgtagatcatattccaattcctattactgatgtgggtattataaacccactgctttggataaataatggcatggcagttgtggatgatggtgttcaaattaatgtgcatgtagttggggatgatcatgttggtgatgaaattaatgtggaggaagttttgcatggacagagatggttggtgttgaaattgtacatggtggacacggtgacattaaaagtagtgatgaagatgaagattttatacgtattcaagttgaggaggatagtttgcagactagcttggacaatgagaatgagtaggatactgctgatgtaa

SEQ ID NO: 74215 - DNA, 1341 bp, Glycine max
  Peptide Sequence Number=SeqID_190993
atgataagaacaaactcattgcgacattttcacaaacatctcgcgagccaaaccctggtgctggtaatcaaagacctcccattcgatgctcacccacccccaccctcaccctcaccccctccatggacaaacgacgccgtcacggaggtcctccgcctcatctcccgctacaccctccaatctcctcgctccatcggccgccagcacaccttccgccaccgcacccctctccggcagcgcaacctcaacctcgagcaccacaagctccgcagcaacaccctcctcctcggccccgcggcccatctcgacccccgcaaggcccaccacctgggcccactcaaagccctcgagttcttccgctgggtcgaggcccgcttcaacttcccccactccgaacccacctgccgcgaactcgcctgcctcctcggccgcgccaacgccctcaaacccctatggcacttcctcaaacactcccctcacgtgaccactgccactgtcacgtgcctcatcaaactcctcggcgaacaagctctcgccgacgaagcacttctcaccttccaccgaatgaagcagttccactgcaaacccgacactcactcctacaataccctaatccacgcgctctgccgtgtcgggaagttcaccaaagctcgctcccttctccagcaaatggagctccccggtttccggtgcccgccggacaccttcacctacaccatactcataagctcctactgccgccatggaattctcaccggctgccggaaggccaggcgaaggcgaatttacgaggccgggcgtctcttccggttaatgctcttcagaaaattggttcctgatgttgtcacttacaatgccctgattgatgggtgctgtaagactttgcgcgtggagagggcactggagctgtttgatgacatgaaaagaaggggccttgtgccgaaccgtgttacttatggttgcttcattaggtactattgtgttgttaatgagattgataagggtgttgagatgttgagggagatgcagaggctggggcacggggttcccggttcgagttcgtatacgcccatcattcacgcgctttgtgaagctgggagggttgttgaggcttggtggtttcttgttgagttggttgagggagggtctgtgccaagagaatatacttatgggctggtttgtgacaggcttcgtgcggcgggggagggtgggttgttggaggatcatgatggggtgcacaagagaattaaggatgggatatggaataggtacaggcaaatgatgaaggtgaaacctgttatggctcgcaagggctatcccgagatggaggaaccagtttga

SEQ ID NO: 74216 - DNA, 429 bp, Glycine max
  Peptide Sequence Number=SeqID_190994
atgggttgcaaaacaattggtagaccaattgaagtcaaatccaaagatgactataacacagcgtgtaaaacaacatttaagcaagcatgtagaccttttattggggttgatggatgccacttgaagtacttatttggagggcagttgttggtggctattgggagggaccccaatgaacaaaatctaccaatagtatttatgttgttgagagttgaggccgagacaaaggacacatggagatggtttttgacactgctttttgaagacataggcagtccaacacttgttccatgggtaattatgtcctatgtcaaacatttataccagaacttcaagaatttttttggaggaggcactatgatgagagatcttaagataggggcttctaaggcagcatatgaagttgcatgggttgagaagatggaataa

SEQ ID NO: 74217 - DNA, 702 bp, Glycine max
  Peptide Sequence Number=SeqID_190995
atggcagcaagatttggaactaaaattgtaccttttggttcagttggagaagaagactctagtgaagcacattccaccctgaacggcaagctcgagtcgattttggagtgcctctccatgttgtccttaccaccttcgccacccacccttgtcccacagccagtcatgcaccatccgcacctcaaactggaggtctctcgtttcgatggacaggacccgtttggatggatattcaaaatattccagttcttcgactaccaaggtgtgcctaagcctgaacgactcaccgtcgagagtaggagacactacaccttgtctccctttcaagcaaccgcgacctatgttaccattgtgatgaacagtggagccgtgcttagtctgaatgctttagtaggaatgccgacctcggagaccatgcgcctcttcggcaccatcaacaaccaccaggtgctcatctttgtggatagtgggagtacccacaactttatccagagtcgtatcgcgaagtttttggcattacagtcaaccctgacaccaccagtgaaggtactggtggggaacgacaccaccatggactatgatacctcttgccctcagataccagtgctcattcagggccacagattcatggtggatttctttgccctaccccatagcggcacagatgttgtgttaggggttcagtggctatgtgaactgtaa

SEQ ID NO: 74218 - DNA, 417 bp, Glycine max
  Peptide Sequence Number=SeqID_190996
atgttgcgaagtatgagcgtgtacattaagctggcaaaaactcttctcgttgtggatgtgtcaaaagaactactcacggtcttccatgtgcatgggttatttaagcctcaagtgaccataatcaaagagatggaaaccatatccaagcgatgtgaagagcttgatgtttgtggcaaagttactctaaagagtaaactctgggaaattgcctaccctgatttaaaatctatgtgtcctcctccaaaaaaggtgaacaccaaagatgcacaaaacaaaccaatgatcaaacaccaaagatcaacaaagtgtgatccgtattactgggagtatgttgatgctttacattttgtgcaaaatagtaattcttcagtagtgcatcatcttctgaccaggacattccaagaaggactatgctaa

SEQ ID NO: 74219 - DNA, 132 bp, Glycine max
  Peptide Sequence Number=SeqID_190997
atgagatctgacatttacgtgtttggcatagtgttattggagctaattactggacatagagcatgtgatgatacccatggccctgaaaagcatcttgatgattgggtgtgttggtattgtagaaaggaatga

SEQ ID NO: 74220 - DNA, 585 bp, Glycine max
  Peptide Sequence Number=SeqID_190998
aggactactaagctggaggagaccttgactcagtttatgcaggtaacaatgtcaaatcataaaagcacagagtcagcactgaataaccttgaggtccaggctgaggatgaggatagtgttgtacataagaagaaaattgctgacaagaaaggtactgattgcaagagaaataaggtgagaggtgtggaagtaccatatcttgtggtaccttccaagaaggaaaaagatcatcatctggcgagatttttagacattttcagaaaattggaaataaccatgcccttcggagaagctttgcagcagatgccactctactctaaattcttgaaagatatgttaacaaggaagcataaatatattaatcaggaaaacataatagtggaaggaaactgcagtgctgtgctccaaaagatccttccacccaagcataaagatcctgggagtgtaactattccttgtccaatcagagaggtcaatgtgggaaaatctcttattgacctgggagccaatgatgccactctccatgtgcagaagattgggagagttggcaataatggccactcgaatgactttacaattagctga

SEQ ID NO: 74221 - DNA, 366 bp, Glycine max
  Peptide Sequence Number=SeqID_190999
atggcggccgccggagcatgtctcttctccgccgcgctcttccgccgtgagccgccgtctcctgccgggaaaccgagctcccaccggatctcgagtacgactccgcgactcgccgtgtcggtggaccgagttccggcatcgacggcagcggtggagagcggagaaggaaacggtgcggtggtgagagagaagcgtatggaagagaaggaggagaaggagaatcgacgcatgaacggttggaaggagtatttggagcaatcgaaggagctgatagaaccggacggtggaccgccacgttggttttcgccgttggagtgcgcttcccgattggactattctcctcttctgctcttcttgccggtttaa

SEQ ID NO: 74222 - DNA, 513 bp, Glycine max
  Peptide Sequence Number=SeqID_191000
atggcacacagacaaattatggtcattttgcgccttttgtcatccagaggcggcgagcctgatgacatgcggagacaaattatggtcattccgctcaccttttcgccatccaggcccgatcgtgtccaatggcgcgcagagaaaaattatggtcattctgcgcctttccatccaggctcgatcatgttcgatggcacgcagagacaaattatggtcattctgtgccttttgtcatccagaggcggcgggcccgatgacatgcggagacaaattatggtcattccgctcacctttttcgccattcagacacaatcatgcccgatgacacacggagacaaattatggtcattctgtgccctttgtcattcaggagcagcaagtcgagtgataaacgcacagagacaaattattgtcattctgcgccctttgtcattcaggagcagcaagtcgagtgataaacgcacagagacaaattatggtcattctgcgccctttgtcattcagggacagtga

SEQ ID NO: 74223 - DNA, 516 bp, Glycine max
  Peptide Sequence Number=SeqID_191001
atgccttttagaggcttgataaatgcgagaaaacgaactacgctttctgtgttttctggaaaacgcgatgaactcgctaagcgagcatgctgcgctaagcgagttcatcaatactcattgtatatgtcttccagaaaaagaaagagcattggtgcaaggcccacaactcaatatgacacaagaagattccactccttcgaggcctggaccagatacacagacaatgtgctaggaagacatatactagttgagaggaaggttgaattggagaggcgtaacttccataagcgcctcaccaattttgctggcagcagcatcgaccttgccctagtgaaggaattctacgccaacctctacagtcccgaggggccttccccaaaacaagtcaaaatccaaggccacttgataaaaattgatgcagacagcctcaacaccttcctagagacacctgtggtactggctgagggagaatccttacccgcttactgcagatactgcctgcaggatgcccactga

SEQ ID NO: 74224 - DNA, 897 bp, Glycine max
  Peptide Sequence Number=SeqID_191002
gaggttgtctttcggcaagtttcaggaaaaggtagaagggtagtcttcaaattaaaggacttgagtcagcaattgctatcttgcactttgtgggatgattattgcttgcagtttttgaagttcttagatgattatgaaggtgatgacccaattatagttctattaagccattgtaggatcaaggaagcgcagggatcttatcctgcatcgataaacaattctttcaaggcttcaaagttaattattaaccagcccgtgatggagcttcaagaattcaatgaacgctattttttgcttgtagagttgggcattgaggcccggtcaggttttaaatcccatggtgaagggagtacacaactttcaggttctatccaattatcatcaaaagaatcattctttggcaagactgaggcaaagactattgctgacattaacaccatctctgaagaaattgtttgtgtcactgttggcacaattactaggattgttctggacaatcattcatggtgttatatagcttgcattcagtgccataaaaaaagtgatgcagagatggggccctttacatgtgcatgcggcaaatacaataaggaagctgtgcttaggtataggcttgaggtgatgatcaaccagggaaatgaaagcacaaaattcctactttgggaccgtgaatgcagtgaattaattggccaatcagctgatgcagttaataagcttaaaattgaagatggtgatgttgatttgaatgcttcaccccaatcacttgataagctgctgggtcatgaacttgctttcaagataaaggtgcaacccaagttcaggaattctgctgttttgaagtgttcagctgactcgagcttgataaatgttgtgatggatatgctagctgatgctgag

SEQ ID NO: 74225 - DNA, 387 bp, Glycine max
  Peptide Sequence Number=SeqID_191003
atgaagttcctaaacttagactctacaacatcaggagagaaaaggaaggtacaactacaagaacttgaagaaatgcacctcaatgcatatgaatcatccaaactctacaaagaaagaactaagagaaaattaaaatcgagatggagtgatccctttactgtcaaagacgttaagccttatggagatatagagataaaggaccaatccaaagaccgcaactggttggttaatggccaaagattgaagatctaccttggtggagaagtcccacaacacacaatagtcatcaagctcaaagatcctaagagcgacaccaaacatcaagctagtgatgttaaagaaacgtttactagaaggcaatctagctttctaactcttacattttag

SEQ ID NO: 74226 - DNA, 306 bp, Glycine max
  Peptide Sequence Number=SeqID_191004
atggcaataagcttcaaggatgtggactacccttggtctgctgacatagcaaagtttaaggccatggaacaactactacaaggtatgaaattccatgagagaaaaaggttcttccaagaagccactaggaagaacaagctagcatactttggcattgccataactcaccatgaggaggccactttaactgagaaagaacaactgcaaagatccttcaagaaagattatattggcctacattcttcaaagatgcttataaccatgcacgatcatgcggcagctgtcaacgaaccagaacatatctag

SEQ ID NO: 74227 - DNA, 548 bp, Glycine max
  Peptide Sequence Number=SeqID_191005
gggctaggagagcgagggcaaggccagctgagcttccttccacatctacagctcctcctccagcacgtacctcagcagctccttctaccccttcttctgcagactttcaacatcttgaagccatgctggtagcacctccagactttatcccttttgttgaacagtttaatgaatgggtagcctggcctgggactcagcctccccttcacagggaagacgaaggtctcactgctcaagtaccacagcagagggaggatgagtcatccgagacttccacttcatatcccctgatcagaaggaagagggtagttgaaacacaagaagttgcagccacgtctgagaaatctcttgatgccacttctgagccttcagaaccaatggcggatatggcttcaattcagcaggcagcagacccctccactcatgaggatcaaaccacatcagtcctatctccgaacacctctcctccaactacccctgtgcttcgcttaatagatgaggaggatggtcagatacaggacaatcaggacaagtcacaggaattttaa

SEQ ID NO: 74228 - DNA, 299 bp, Glycine max
  Peptide Sequence Number=SeqID_191006
gggggtgcattgaccttgttggatgtccctggtggggaaaaataaagtggttaaagagtttaaacatctctgaggggatgcttaggatctttaattcatccatggtctttgaacttaatgtatgtacttgtagttccttattaggaggactacttgtactagggggtgtgtcactcggtttgggaactcccttatggcccaggctaatcaccataggggggagttatggtgcacgacagggtggcctcgacacttactgcgtagtttccctaagtgaggtgttgtggggatacgcttag

SEQ ID NO: 74229 - DNA, 687 bp, Glycine max
  Peptide Sequence Number=SeqID_191007
atggcgggtatgatttacaggagcataagggttgtgcttttgtctagcaaactcaacttgcttatgccttttgggcctcttgcaattcttgtgcagatattgactggtcatcatggttggatctttggtctaagtttgttgggaataatgcctatggcagagcggttagattatgtaaccaagaagctgacactttacactggccatacagttggggtagggggtatttttaatgcttcatttggaaatgcaacggaattgatcatctcactatgtgcactgaaaagtggaatgatacgggctgtccagctatctttgctgggttcaattttcttcaatatgttgctggtgcttggatgtgcattcttcagaggggggattgtttctaataagaaggaacaagtgtttaacaaggaaattgcttctgtaaactcaggattattactgatggcagttatgggcatacttcttcctgctgctctacactacacacaggctgaggtccatgttggggagtcagagttgtcactttcaagattcagcagctgcataatgcttgtggcctacgttgcatgcctatttttccagtttaaaagtcaaagaagtctctatgtccctgtgaacgagcttaagctcatctacacccttaattgcaaacaagtacgtagcatgcaaagtcacatttag

SEQ ID NO: 74230 - DNA, 384 bp, Glycine max
  Peptide Sequence Number=SeqID_191008
atggatgggaaaaactctcttcaaataactagaagtggtattggtgcttatgatgatgatggacatgccaaaaggactgggaatttgcagagtgctgtagctcatatcattactgctgttattggttctggtgttctttctcttgcatggagcacttcccaattaggatggattggagggccattttccttgctttgttgtgcaattgtcacctatatttcttcattcctcctgtctgattgctacagaactcctgatcctgtcactgggaaaagaaactactcttacatggatgctgttagagtttatcttggtagtaacacattgaactctttctcatgtgcttctacaatcattctagctaaacatagatatatactttaa

SEQ ID NO: 74231 - DNA, 969 bp, Glycine max
  Peptide Sequence Number=SeqID_191009
atgggtgaagtagacgagctgcaagagtggatgaaggctgacatggaggccatgaaagaacaaatcaccacaatgatggagaccatgatgagcatgaagaagatgatgggggtcaatacggctacagttaccgctaccagtgccattgttgaggtggagccaactcccccatctggcctcaaccaaataaatcatccaacctcaaatatggtagggcagggaggcaaagagttgggaagtactggcagcccccattttgtgcaaattcaaaacaagcacgccttcccgccatatggcttgcctccgaactatactccacccaatgagaatgtcaataactccactcccatactcattgagagccaacaacctcaatctgatcatgcacatgtctctcaacccatgggggagacacatgaaataccccaccataatctagccgacttcaagccttgcctcggatatgccattgagggacaaccagttcgtggtgtaccccttccaaacactttggagggccctcagtttcgcccacaaccacaaccattgcatttcacaacgggaaaaatccctcctggtatgacggaaaagggaaagttggaccatctagaggaaaggctcagggccattgaagggggcagagactatgcctttgctagcctagaagagttgttcctagtacccaacgtcatcatccctcccaagttcaaggtgccggactttgacaagtacaaggggactacttgtcccaagaatcacctaaaaatgtattgtcggaagatgggggcgtacgcaaaagatgagaaaatgttgatgcatttcttccaagaaagtcttactggggtagctatcacctggtatactaacttggaaccttcccgagtccattcttggaaggacctaatggttgccttcgttaggcagtatcagtacaattctgatatggctccagataggatgcaactatag

SEQ ID NO: 74232 - DNA, 375 bp, Glycine max
  Peptide Sequence Number=SeqID_191010
atgagttgttattctctgaaactattttatgcacttttgctgcttttattgcatgctgctggatccattcttggattcaacagtcttcccaatagcacagaaattaagtgcattgagagtgagagacaagcactcctaaacttcaaacatggcctcaaagatgactctggcatgctgtctacatggagggacgatggcaataacggagactgttgcaaatggaaaggcattcaatgcaacaatcaaactggtcatgttgagatgcttcatctccgtggtcatggtagacaatatttgagtggtgcaatcaatatctcttcattgattgcccttgaaaatattgaacacttggatctcagctataatgattttgaa

SEQ ID NO: 74233 - DNA, 996 bp, Glycine max
  Peptide Sequence Number=SeqID_191011
atggcgccgctggataaacgcgcccggctgcaggagctggcgcgcctgcttggcggcatgacgctgttgacccgaaagatatctaaagtgcggcgcggcggcgatcctaagcctcctcaacggcctgaaacaggccaagcgcttgaggtggtttatcgtcctgacatcaaccaggggaactacctgacgtcgaccgacgtggcgaaaattcagaaagggatgacccagcaacaggtcgcttacacattgggcaccccaatgctgcaagacccgttcgggactcagacgtggttctatgtgttccgccagcagcctggccatgaagacatcacccagcagacgctgacgctgaccttcgacagcgcaggcgtgttgaccgacatccagaacaaaccggcgctgaccaacgccttatttttttgccttttctgcccgttgccggcgcagctctttcggatcggcgagcaagggccggtagatctccacccggtcgccgtcgttcagcgtatcgcccagcttggccgggcggctgtagatgccgattttgttgctcttgagatcgatatcctggcgcagctccagcaggcccgaagcctggatcgcctgctcgacgctgctgccctcggccagtttcaccttgcgcagctctttgaacaccttgccgaacgccagctcaatcagtttgttggtgaactcgaagtccaggtgcagctccaccttgcaggcctcttcgctcagcggcgtgaactgccaaccgcccatcagcttgcggaacgggccatcgaccagctgcatattgatgctctggttatccagcagcgtattgcgcgtggtgaaggtcttgctgataccggccttggcgacgtccaccgcggcggtcatttcgttggaggtagcgttaagcacccggctgccggtgcaacctggcagaaaatcgggataagagtgaacatcgttaaccaactgatacatctgctcggcgctgaacggcactaa

SEQ ID NO: 74234 - DNA, 147 bp, Glycine max
  Peptide Sequence Number=SeqID_191012
atggtagcccttggaggtggtagaggctcatgttgcataggtgcaacttcagggataaaggcagcctgtgccttttctgagatccattcctcaagtctaaagaagtctctcaaagaactcattcatggtcctctaaagttgatcaat

SEQ ID NO: 74235 - DNA, 495 bp, Glycine max
  Peptide Sequence Number=SeqID_191013
atggtgaaggaaacatcttcaaaattagatgttatcactaaaaatgatggcagtaacaataggaagaaggactcaggaaatgctacaattgttcaagatgatggctatgaatctgcagaggcactgatggtgtctgaaaagaatccagaaactaaatggataatggattcagggtatgggttagtactccttggagataacaagccttgcaaaattaaaggaattgggtctataaggtttaagtttcattatggggctgaaagaattctcacagaggtcagatatgtacccgagttgaagagaaatttaatctctcttggtgaatttgataaaagagggtatgtgttcaagggtgaaaaaggaatagtgaatgtagttaaagaatccatggttgtcatgaggggaattatggagaatggcctctattctgtagatggtgaagttgtaattggctctggagccattgcaactggaagagtttttatcaaaaactaa

SEQ ID NO: 74236 - DNA, 723 bp, Glycine max
  Peptide Sequence Number=SeqID_191014
atgttattttctttttttgttctatttgattctatgatcattcaaatagggaaggaaacatcaaataaggatttgtcaacattagccaaggtagcatttgaattgcttaaatggatgattgtttgggaacctcaccttcagaaggctgtatctgtgattcttactgctgccaatgattccaactggcgaactagatctgctacattgacatatctgcgcacattcatgtacaggcacacttatattctctcaagttcaaagaagcaagaaatttggagaactgttgagaagttactaaaatttgggtactttatagaacatgccatccttgtagaaaaggtaagagaacatgctgcagcagttttagcaggcctaatgaagggcggagatgaagatcttgctagagatttccatgatagagcttataaggaggcaaatattgtacagaagagaagaaagtcgagaaatgcaagttctggattatcaatagcatctgttcatggtgctgtactagctttggtagcttctgtattatcagccccatatgacatgcccagttggttgcctgatcatgttacactacttgctcgcttcagtggggagccatcacccgtgaaatctacagttactaaagcagttgcagagttccggcggacccatgctgatacatggaatgttcagaaagaattatttactgaagagcaacttgaggtagttatctag

SEQ ID NO: 74237 - DNA, 1581 bp, Glycine max
  Peptide Sequence Number=SeqID_191015
atggatgtgaaaacctctctcccaactgctacaagtgttattggtgcttatgatgatgatgggcatgttaaaaggactggaactttatggagtgctgtggctcacatcattaccgctgttattggttctggtcttctctctcttgcatggagcacttcccaattaggatggattggagggccagttgcatttctttgttttgcaattatcacctgtttcttcatctctcctttcttcatcactgggaaaagaaattactcatacatggctgctgttagagtcaaccatggaattgatggtgaatgtgtgagtgcagggacagtgtggactgcagtggcacacatagtgacaggagcgatagggtcaggagtgttgtctttggcatggagcattgcacagcttggatggattggagggctactcactattgttttctttgctgccatcactctcctctcttctttccttctcagcaacacatatcgttctccagaccctgaacttggccctcataggagctcctcataccttgatgctgttaatttgcacaagggagaagggaatagtcgcttctgtggtgtttttgtgaacgtaagcttatatggtttgggaattgcttatgtcattactgctgctatcagcatgagatttctcactcgtactccaccaggaaaatatgaagagcaatccaaaaatcaaactgttcccaagacaatgggaatgaagaaacatgtggatttggggatggatatttcatcaattatgtcctttgcttatgctttcataggaatggggctttccatcgggcaagtcaaagaaaatggacatgctgagggtagcattgaaggaatccctacttccagtggaatggaaaaattatggctgattgctcaagcacttggtgacatagcattctcctatcctttctcagtaattcttatagaaatacaggatactttgaagtcgcctccaccagaaaacgtaaccatgaagagggcctcaacaatatcagtcattatcacaacatttttctacctctgctgtgggtgttttggatatgcagcctttggtaatgatacaccaggaaaccttttagcagggtttgcacactataataaacattggcttgtagacttttccaatgcttgtatagtaattcacctagttggtgcatatcaggtgtatagccagccactttttgccaatgttgagaattggcttcgtttcaagttcccggacagtgaatttgcaaatcgcacgtactacttgaaactccctttgctgccggctttcccgctaaattttctcaggctgactttcagaactgcatatgttgcatcaacaactgggattgcaatgatctttccctacttcaatcagattttgggagttttggctggcataatctattatccattatctatatattttccagtggaaatgtacttgagtaagggcaatattgaagaatggacagctaagtggacaatgcttaggacttccagcattgttggttttttggtgggattgttcactctaattggatccattgaagggatagtatctgcaaaattaagctga

SEQ ID NO: 74238 - DNA, 978 bp, Glycine max
  Peptide Sequence Number=SeqID_191016
atggggcgtattccatgttgtgagaaggacaacgtgaaaagaggacagtggacacctgaggaagataacaagctatcctcctacattgttcagcatggcactcgcaactggcgtctcattcccaagaatgctggcctccagagatgtggaaagagttgcagactaaggtggactaattaccttcgtcctgatctcaaacatggccaattctcggattcggaagagcaaaccattgtgaaacttcattcagtttttggtaacagatggtcactgatagcagcccagctgccgggacgcactgacaatgatgtcaaaaaccactggaacaccaagctgaagaagaaactgtcaggcatgggtatagaccctgtcacccacaagccattttcccatctaatggctgaaattgctacaacattggcacccccacaagcagctcacctagctgaagcagcccttggctgtttcaaagatgaggtgctccatcttcttaccaagaagccaattaacttccaccagggacagcattccactgcagcactggggaataacttcacagattacgttaattgtaagccagatgaaaaggacgcaacagttgagaagattaagtttgacctatcaaaggccatacaacatgatcctgaaataatgcccgcaaacaaaccttgggactccaatgcaactacatctgcaaattttgcaatgccatacggtgttttccctacaatgtctgggtttcaattgtctccggtatctttcagcaaagggcatgcatctcaatggagccaaagtgtatgtactggaagcacatgcacagccatggatcagcaaatccaattacatgaaaaacttgaagccgaaattggtgatgattctgaggctacgaaggaaattagaaatctatccaatatattcagctccgattgtgtggtgtgggatctaccagcagatgatttaattaaccccatggtataa

SEQ ID NO: 74239 - DNA, 954 bp, Glycine max
  Peptide Sequence Number=SeqID_191017
atggcactgtttggacttgttcagattgtaatgtcattcataccggatctccataacatggcatgggtttcagttgttgccgcacttatgtcctttacatactcattcattggactaggacttggcatagcaacagtcataaaaaatggaagaattatggggagcttgacaggaataccaactgataaaattgctgacaaattttggttggtcttccaagcacttggtgacattgcctttgcctatccatactccattctccttcttgagatccaggacactctagagtctcctccaccagaaaatcaaacaatgaaaaaggcttccatggttgcaatcttcattacaacattcttctacctgtgctgtggatgctttggatatgcagcttttggaaatgatacaccaggaaacctcttgacagggtttggattttttgagcctttctggctcattgaccttgctaatgcttgcatcattcttcacttggtgggaggatatcagatttacagtcaaccaatatacagtactgttgacagatgggcttcaagaaaattccccaacagtggctttgtgaataatttctacagagtgaaacttcctttgcttcctggttttcagctaaatcttttcaggttctgctttagaacaacctatgtgatctcaaccattggtcttgcaatctttttcccttacttcaaccaaatcctaggagtgttaggagccataaacttctggccattggctatatatttcccagtagagatgtactttgtacagcagaaaattgcagcttggagtagcaaatggattgttcttagaacattcagctttgcttgctttctggtcactgtaatgggcttggttggctcacttgaaggaatactgaatgctagtgttattgagagtaagatagagtacaagcaattgtgggggatttcagaaagtgaataa

SEQ ID NO: 74240 - DNA, 3795 bp, Glycine max
  Peptide Sequence Number=SeqID_191018
atgggggtcggtggacctatgcattggagcgtgctaaagttaattgaccgtggtcaatacagcaagaatgaacatctctctgagacagttgctgcagcaacttctatactgtcctatgtagaaccctcattggttctgccatttgtggcatctcggtttcgaatggcccttgagacgatgactgccactcaccagttgaaaattgccgttatgtcagtggcatttgtcgggcgttcactattttatacatctgtatcagcttcctccatgaaaccaattgatcttggtggtggtgatgaaacattcattgatcttgtgggggtttcattatccaatgcattacttggcatggatgctaatgaccctccaaaaaccttggctaccatgcaattaattggttccatattttcaaatttggctttattggatgataaaattgatgacctatcatttatgccgatgatccgcttttcagagtggctggatgagttcttatgccgcctgttctccctacttctacacttggaacccggcagtgttataaatgaaggtctgcaatcatcagcagcaacaggaactttcctggttgatgatggtccatactacttctgtgtgcttgaaattctgtttgggaggctttcaaaatcactgtataatcaggctttgaagaaaatttccaagtttgtgaggacaaatattcttcccggtgctgttgcagaggttggactgctttgttgtgcgtgtgttcactcaaacccggaagaagcagttagtcaacttgttgagccaatattactgtctgtgatatcttctttgaaaggaacaccacgcactggatttggaggaggaggaacttttgatgcttctgcttcatcaaaggttagatccagcatttcaccagctcttgaggcttcaattgactatcaacttaagatattgtctgttggcatcacatatggaggtccagcgatcctccgctacaaggatcaattcaaagaagctatcttcttggcttttgactcaccatcttggaaggttaatggggctgctgatcatcttcttcggtcccttcttggaagtcagattcattattatccaatagatcagtataagtgtgttcttagtcaccctgatgctgttgctctagaagaatggattagcacaaaaggtttttccactgatgaaaagttgatcccaaagtggcatattccttgtgatgaagaagttcattttgcaaatgagcttttagacattcacttcaagtcagctttggatgatcttttgaaaatatgccagactaaaatccatgccgaccaaggagacgagaaagagcacttgaaggtgactcttttgcgtattgaatcatcgttgcaaggacttttttcttgtttgcccgattttgtcccagactctaggaatggaatggttgaagattcaaaccatatgtttttaattgccggggccacaggttgtactgttggtagtactgctctgagagaaaaagctactgaggttgtacatgcagcctgcaaatatgtcctggagaaaaaatcagatgacagcatcctgttgatactgattattcgcatcattgatgctttaggaaactatggaagtttggagtatgatgagtggtctagtcacaggcaggcttggaaattagaatctgctgccataatagaaccccccattaatttcattgtgtcatctcattctaaagcaaagaaaagacctaggtgggctcttattgacaaggcatttatgcacaatacatggaggtcttcacaagcatcctatcatctttaccgtacaagtgggaatttctgcccatctgatcatgtgactatgttgatggatgatttgttgagtctctcgttgcatagctatgaaactgtccgcctgcttgctgggaaatctctagtgaagctgatcaagagatggccatctatgatttcaaaatgtgttatcactcttacccataacttgcaggataccaatgccaaggaatatgcagtgttggggtcctgttcagtccttgcctcacaaacagtactcaagcatttgacaacggatccaaagtcattctcttcatttatcttggcaattctttcaagttcgcatcatgaatccttgaaagctcagaaagcaattaatgagctttttgtgaagtacaacattcaattttctggagtatctagaagctttttcaggatctcagacaaagaaaatcatactggtgggctggggttttcagatttggtttctcagattggctccatgagttttgattctactggcttgcattggagagataaggccaagatagagtatataattgaggtgcaaccctcatctcatgagctagcttttggtgttgagttaggaccaaactcacattctaagatgatatcagagcttatcctagatccattaaacgagacacccgccatgtataacttgatggctaatagagtgctgctcctgctggctttggcatctaggaaccatccaaattcatcttctaaaattctgagtgaaactgctggacacttcctgaagaatttgaaaagtcagcttcctcagacaaggatacttgcaatttcagctttgaatacactattaaaggaatctccatataaactgtctcatggtgagaaatctgccgtacttgaggatttgcaagaccatgtcaaatcatcacttgaaggaactttaacgcaaacttttcaggaagagggtttcttcaatgagacactgactagtctttctcatgttcatataataactgatactgaaactgcttcaagaggaggtcagggagattcaagtttccaaagcttagcagacaaatccataactcgtttttactttgaattttcggcttcatggccacgtacgccaagttggatctcctttttaggaagtgatgataccttttattcaagttttgctcgtatttttaaacggctagtacaagaatgtggcatgcctgtcgtattggctcttaaaggtgcagtagatgagtttataattgctaaggagaggtctaaacaatgtgtagctgctgaagcgttggcgggtgtgctacattctgatattgatggtctatcaggaacatgggaaagttggctgatgcctcagttgaagaacatcattttagcccaatctgttgaatcagtttcagagtgggcatcttgcatacgatatgcagttactggtaaaggaaagtatggaacaagagttcctcttttaagacagaaaattctggattctttgatgacacctttacctccaacagtagctactacagtaacagccaaacgatatacttttctggctgctgcacttatagaaatatccccacagaaaatgccagtagctgaaatccagctccacaatacacttctgaaggaagttcttggtaatatgtgccactcatcagcccaagtgagggaggctctaggggttaccctttctatattgtgctctaacattaggctctatcattcaagccgtcatgataatgcacaggatgagagaaatgacaatgttgatagtttgatgaaagatgaaagctgggttcagtttcttacagagcgagcagctgaagcagttgtcaacattcagattgctacccaatcagataaagtagtgaatcctgtagattcaagttctcaaaatgggcatctagatggtgattcacaagatgacattaaatggatggaaacgtctgggagatcctcatatctgctcgacgtgcttgtgggacttctatatcctgtgatttgcttgcag

SEQ ID NO: 74241 - DNA, 631 bp, Glycine max
  Peptide Sequence Number=SeqID_191019
cttgatcctttgtcttgatcctttgtctacactcataagggtggacccttgggtactagtaccctcaccttcagagggctacacaccctcaccttcagaggacttcacgccctcaccttcagaggacaacacgtcctctccttcaaaaggcgacacgtcctcaccttcagaggactacacgtcctcatcattagagggctgcacgccctcaccttcagaagactacacgtcctcgccttcagagggctgcacgccctcgcctttagaggactacacgtcctcgccttcagaggactacacatcttcgccatcagagggctgcacgccctcgccttcagagggctacgcgtcctcaccttcagagggctacatacacgcccttagaggactatgcgtcctcaccttcagagggctacatgtcctcgccttcagagggctacacgcccttaccttcataggactacacgtcttcacctttagaggactacacgtcctcgccatcagaggactacacgtcctcaccattagagggttgcacgtccttgccttcagagggctgcacaccctctcatttagtgggctgcgcaccctcgcttttagagggatggatgccctcgccttcaaagggtga

SEQ ID NO: 74242 - DNA, 180 bp, Glycine max
  Peptide Sequence Number=SeqID_191020
gggcaggatcatcttgagctaccttctggggtagagacagaacatgaacagcagaaaccaatcaaggtaagacagcgatgcggtcgagattggccacaccaggttgtttcttacttgcaggttagctcgcctgggcgggctgagctcgcctgggcgagccacccctgcaccaaattataa

SEQ ID NO: 74243 - DNA, 222 bp, Glycine max
  Peptide Sequence Number=SeqID_191021
atggttggttggtcaattgaattatccgaatttgatatatcatatgaaactagaggactgatcaaagagcatgtgctagcagactttgcggctgaaatgccctcccctgtaacatcggaaggcaatagagaatgcgtacagtcaatggacggagttgcaagcaagaagggtaatggagcaggagtcatattagaaggactggatggagtgatgcttgaataa

SEQ ID NO: 74244 - DNA, 170 bp, Glycine max
  Peptide Sequence Number=SeqID_191022
gtcgatgaggacatatctgttggtttagaagctttctgccgaatagctccttcaattcctatcattgccaatgtcatcattagtgaaaatctttttgaggtgctgagttcatcaactggtgctcgccttcagttccccatctatgacaagtacctcactggcctggaaag

SEQ ID NO: 74245 - DNA, 252 bp, Glycine max
  Peptide Sequence Number=SeqID_191023
atgaacggatccttggagacagccaataagaatatcaagaagattatccagaagatgaccgtgtcatacaaggattggcacgagatgctcccattcacgttacacgattaccgaacctcagtgcacacgtcaaccggggcaacaccgttctcattggctttctccggaggggctctggtgctcaccaacatggatggcgaggagctaccgtcacccgtgaactccgatgttgtcaagcgatactacgcttag

SEQ ID NO: 74246 - DNA, 402 bp, Glycine max
  Peptide Sequence Number=SeqID_191024
cgctgttcatgtgtcttccactttcgagtttggagctgtgtttcatgattgcctaagtgcggaccctcaagacaatcctccattctctccgtttgcggagctccatgaatgttattgcctagcgctgttcatgtgtcctccattatcaagcgcgaagtctctggtgactgggaaacacgttattctgttgttttccggatcggtttcttcgccggatataagaaaaagagaaggagtagagacgagagtcgtcatcacggaaagggtaggacggacgaaatcagtgtcctatctttgctttcctcttatctccgatgagagtcccgagacgtctcggaaatcaaaaggaagcaggcttgcacgatccgtgaaattccgtaatgaggcggaagtcgaaaagag

SEQ ID NO: 74247 - DNA, 543 bp, Glycine max
  Peptide Sequence Number=SeqID_191025
atgaccaccctgacccagatatggatgacattgctgctcagcaacatccagcccaacgatcataattctgacctccccctgctgaagtgtcagctggtgtacgccgtcctgacacggatgagcattcacgtggctcagttgatcgctgatgccatttatctatttgcaggtatggcgccgaccaggcaccctttggacccggataagtccaacagggccctgggatttcctacattgatcacaggactttgtcagtcgttcggagtccccgtcgcacctagcaagccgaccaaccaccgggcgcacgtgcagatccatgactgtctttatcagctgagcctcagcctgcatagccagggttttacttcttttctatgccctactcaatatcagttcagggcagaggtcgcatggcccggagattggcctgaggcccaggaaggggaggcacctgcagaggctcccggcgaggcagatgaggcccacgaggacgaggagatgaccgatttgcttgacttcttgggagggagcggagccacatga

SEQ ID NO: 74248 - DNA, 243 bp, Glycine max
  Peptide Sequence Number=SeqID_191026
gccggcaaccttgatgcggtggtccatgactcgcccaatgtgctgtactacgtgaaaacggcgggcgatggcaaagtcaaagccagcggtgaaaacgacacgattctgccgcagcagtatggctttgccatgcagaaaaacagcagcctgacacctaagatcaacgccgcgctgcaggccctgcgcgcggatgggacttacagcaaaatctacgtgaaatggtttgctaagcagccgaaataa

SEQ ID NO: 74249 - DNA, 597 bp, Glycine max
  Peptide Sequence Number=SeqID_191027
atgaattttgacagtaaatatatttgggaatctctgccgctactgctgcaggggctgcagctgaccttgattatttcgctgtcaggtctgctgggcggttttattattggcttactggcgggaacctgccgtgctctgggtggcaaaattgctaaaacgctgtcacttatttttgtcgagcttattcgcggtacgcccatcatggtgcaggtaatgtttatctattttgcactgccgatggtgttgccgataagaattgatcccgtcaccgccgcgatcgtgaccattgtgattaactccggtgcctacattgctgaaattacccggggcgcgatcctctcaattaataaaggctttaaagaagcgagtctggcgatgggcttatcgcagcgcagtacgctgtggtatgtcattatgcctttagcgttacggcgaatgattccggctttagaactgacgcgtcaggggcaggagatcattgcgggtaatttccgtgcgctggaagtgtggacggcggtggccatgatttatctgctggtgacgttatgcctgagctttttactgaagcagctggaaaaaaggatccatattttatga

SEQ ID NO: 74250 - DNA, 243 bp, Glycine max
  Peptide Sequence Number=SeqID_191028
atggatattttcataagtgcaaatccattctctttcaaatccttgaagattcctctaatcacaaaactgattagaaacaagcattacactctaccacttctggctacaacaagtgttcatgatgcaatcctccctaggaagggaccaatcactagaaccatgagcaagaggctccaagaagattgggctagagctgctgaagaaggccctagggttctcatgaaccttagggtagatttctga

SEQ ID NO: 74251 - DNA, 330 bp, Glycine max
  Peptide Sequence Number=SeqID_191029
atgaagagagaggaagggtggaagctagatacatggactgagatgaaaagggttatgcaaaagaggtatgttccaaccagctacagcagaaccatgcggcagatactccagagaacacctattttggacctacaaagctttcctagcaaatcccaaccccccaccaacccgccaccaaaaccagaacctagaagaggtgaaaagaacttacttaccttgaatggtgaagcacaaaggaaggagggtgcacaaagagccctgacgaggaagctgcaggcggaacgaggtggtgtgagagaaggaggagaaccattgcgggaagaacaatag

SEQ ID NO: 74252 - DNA, 243 bp, Glycine max
  Peptide Sequence Number=SeqID_191030
atggaaaatcctacatatctagggaaggacaatgtagaggcttacttagattgggaaataagggtagggaaacaacttaaaaggaagtctacttcaaaagcttatggctctcattcttatccaaagaaagaccaaggtcaaggcatcttaggggtgacaccttctgagcccaaaaatgataaggggaagacaatagaaaagcaaacccttaaggctagtgatgagaatcctaaaactgcctaa

SEQ ID NO: 74253 - DNA, 282 bp, Glycine max
  Peptide Sequence Number=SeqID_191031
atgattctcggactcaattcgccttcaacgttattttgtacctgtgcagccgagccccacggtgatgataaagtaaaccctccaggaggagtggttgaagaatggagccagagtttcttcttgagcttgattgtggaggatggtgtagcaacagtggtaattggtagggagcttccccatggaggagtcgggtggctcattcagaaaaatagtaaggaggattttgaggaggatccagatgaagatatgtgggatgcttcctcacgagagtcttgttgttag

SEQ ID NO: 74254 - DNA, 291 bp, Glycine max
  Peptide Sequence Number=SeqID_191032
atgacgagaggttggacaagggatcctattgttaacttttggatgttggaattgtcctcaaaatcagcctatagtgccctactattgccttttcgttcctgtggagatcatggagatctcctctttgtcatcttcatcttctttttcatcttctttagatgcatcgaactacatgctagggccaacctaatgttgacgaggattctgagcatgaagtgtccaccccgctcactcgagcacttattgaggaggacgacaagatcgtggaggaccgctagaggtggcaaatga

SEQ ID NO: 74255 - DNA, 390 bp, Glycine max
  Peptide Sequence Number=SeqID_191033
atgaagagcttggtagaggaagaacccaatttggctaaggggcctaacaacaagtcagttgtagtagcaattgttcctatgttgattttcacagccttcctaagaacttgtcaagcagtttctcctttgctagagaatttggtgttcctcgagaaagttcttatcaactctggaatatgtccatcatatgagtgtgggagattaagggtatgccaagagtggtcaagtgaactgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 74256 - DNA, 795 bp, Glycine max
  Peptide Sequence Number=SeqID_191034
atgctgtgcggtccctccggcgtcggcaaaaccgaaaccgcgctggcgctggccgagtcgctgtacggcggcgagcagaacatcatcaccatcaacatgagcgagtttcaggaagcccacaccgtttccaccctgaaaggcgcaccgccgggttacgtgggctatggcgaaggcggcgtgctgaccgaagcggtgcggcgtcgtccctacagcgtggtgctgctggatgagattgagaaggcgcatccggatgtgcacgagctgttcttccaggtgttcgataaaggctggatggaggatggcgaagggcgccatatcgacttccgtaacaccatcattattctgacctccaacgtcggtacgcagctgatcagcgcgatgtgcgccgatccggagctgatgccggatccggaagcgctgagcaacgcgctgcgtaaaccgctgctggaggtgttcccgccggcgctgctgggtcgcctgctggtggtgccgtattacccgctgagcgacgcgatgctggcggaaatcgtccggctgcagctgggccgcattgttcagcgcctcgccgataaccacggcatcagcgcgcagattgacgattcggtcatcagccagatcgtgcagcgctgcacggaagtggagtccggtggccgcatggtcgacgccatccttaccaataccctgttgccgcagatgagccagatgctgctcagcgcccacgcccgcgatgaacgctatcgtcgcgtgcaggtacgctgtgagcagggcgagtttgtttgccagttcgatgtctaa

SEQ ID NO: 74257 - DNA, 450 bp, Glycine max
  Peptide Sequence Number=SeqID_191035
atgcttcacttcatgctccagaacttacacagggggcagtccattatcatgcagagccttcagggcttgggcttgccatccatcatgagcatagatgagtttgacgtgcaggtggcttggccaaaagcccagccttctccttctggagggggtggggcctccgcagcccaggagcctgagctagaggagccaacagcaacagtagaggggaaggatgagcttactcctcctgagcccttttattttgattcaggtgtacacatggctcaggaggaggagactgccacagaacagattctagagccatctccagtacccacacctgatgattccatgccatctgcaccagcatctgagctagagcagcctatccctcaagattcaccagctactcaggtgttggatctcaatgagcatgcacaggagcaaccacaagagcaggacatttaa

SEQ ID NO: 74258 - DNA, 114 bp, Glycine max
  Peptide Sequence Number=SeqID_191036
atgcaagtaaaattaacagcagtagccaaaattactaaacctcgatccctagttggactgaatcaatccaagcttcgtcctcaaatccctcttattggactaggctcaatttag

SEQ ID NO: 74259 - DNA, 492 bp, Glycine max
  Peptide Sequence Number=SeqID_191037
atgttttcctcgaataaacgttggtggcgactccgcgcattttccttccatggaaggttcgatttttctgtttacgatgcccgccggttggtttacaccaaccaagcggatatgatcggaaggcttcttgccggttcattggcatttgattgccgtatcctccactatcttattgttcgcattttgcttccgagatcttcaaaccttgcacaggtacctcttgattctaaaccttttgttcaaatcaagaagtccttctccattggggctgcaatggtcgcctccttcggttatcgcaaagagcgtgatggctcttggagtgtcatggataggtttgacaatcttcagacctatgttggagagagatttgactccttggagagtcaagtagacattcgattcggagagatggattctaggatcacgaagattgaaggcaacattactttcatcagagattgctttgaccttccaccgccaccatccacttag

SEQ ID NO: 74260 - DNA, 629 bp, Glycine max
  Peptide Sequence Number=SeqID_191038
aaagtgaaaattctgaatccacacaaggttcaggctctaattttatgactcccttcgaggattgtcaatctccaactaatcagtctgtaatcaacactgaaggatattctgatcttggtgatcaactcatccaatgtagatattgtaatgcacaaatgtgtcaatattccggaattcagaatcatattgtttcaactttaagtcacatgctcgatcaacacaattctcatgctaaaagttttagaatggccagagatagattggtaggtgatcaagccaataatatcaaattgcaactcatagctgctcggggaaaagatggccgtgtatataatatgcctaatgttccgaaaattgctgctcttattgttggcgattttcatccaggctcaaaaagagatattattgttgaaactcaaaatggagaattacaaagaatccatgaacttcatcctagctatctaccactacagtatcctctactttttctttatggagaagacggatatagagctgacatacttcaccgttgtacttcatccagcaaaaaaagaaagcaaaaccgtctgacaatgagagagtggtttgcttatagacttcagtccaggttataccatggtggaatctga

SEQ ID NO: 74261 - DNA, 351 bp, Glycine max
  Peptide Sequence Number=SeqID_191039
atggaaagtgccttcttaaaaaggtatttctcttccatgaagatggatcagtacatcagggacattggaaactttgtgcaaaaggagcaagaaaccctgaaaactttgtttaggattcaagaggactttgaggagacagaaggttcttctccaaaagctactaagaaatttaagaatcaccagcaagatgtgcaatttagaaaatttcttgaagttatgaaaaagttgcacatcaacctgcctttcattgaggctattacacaaatgccatcttatgctaagaatttgaaaaagattatatcaaacaaaggaaaattggcaaattttggcactgtgggtctttatgagtag

SEQ ID NO: 74262 - DNA, 311 bp, Glycine max
  Peptide Sequence Number=SeqID_191040
ttttgcttgatcaaaaggttttatccatcctctcaaaagattatgagagttttgcttgtccacaaatttctgaggccacttgtctaacagagggctacgcacgcaatgcagtagaaagatggcaggagattgaagcaagattaaggaactatggtgaagtatgtggttatgttccatctatgagatggcgatgtatatggttatgttccatccgtgaggtagtgaggagtagaggactcacccctacaaccaacaactttcagccttcatctaaggatgatgaggatgagcctcccaaggatccgtcttag

SEQ ID NO: 74263 - DNA, 294 bp, Glycine max
  Peptide Sequence Number=SeqID_191041
atggctgtgctgaaatccaccttaggtgtggtcggaaattgtgacactgaagctttggaacattatggaatgactacaaccatcacggcggtgccttctggtggaagcaacccagctcgcctgggcgagctgggcggcaaccacctcgcctgggcgagctgggcggcaaccacctccctcttttcccctataaataggggaaagagggcagagcaaattcgttcaaccctcctggttttccaccgttcttcattgttcttcgttcgttcttcgtcgttcttcggtcttcaaccg

SEQ ID NO: 74264 - DNA, 144 bp, Glycine max
  Peptide Sequence Number=SeqID_191042
atgcctccaatggatgaacctgatgaagtcgatgatggacatgcaaatagtgtagatcatgatgaaggatcattggccacaccttctgaggtctcctcccacagtctgatggtcaaatcagaggccacttttgaagaggagtag

SEQ ID NO: 74265 - DNA, 176 bp, Glycine max
  Peptide Sequence Number=SeqID_191043
cgttagtcttctcacttagcctaagggttaaaggcagtgcgtttagcgagttcacactcgctcaacgcctctgtacagctcatccttcttccagattcttctgtgtgcttagccggaggatagtgcgcttagcggatgattcgcccagtgcgcggcatggctcagcgagttcataa

SEQ ID NO: 74266 - DNA, 225 bp, Glycine max
  Peptide Sequence Number=SeqID_191044
atggagatgacaattccaaagcttaaggttcaatttgacaattacaattcagttcatagatgggtgcaaatgatatcatcatcgataaacagcataggagtggctggaggagtggtagtcagtcccaagactagtgtggaaaggtcctctagaatctccaataatggagtagaagggtctgctggcatctcatgcactggtgtaggagggtctgctagctgctga

SEQ ID NO: 74267 - DNA, 596 bp, Glycine max
  Peptide Sequence Number=SeqID_191045
gcttcaaaaacagctgtgggatggtcaatgtcatcagatacaggggatcatcgacctcatgatctgggctttttggaggcattgaatgaatctcctattggacataaccagttccctaaagttacctcagaagttgtggccatcgctgaagatataaatgacatgtcatttatgagtgcacaatcagctgaagtcacctcacatacaatagaccttggacgtgatggctgggagaaggctgaaaatgaagggacaagtttaaagaagcaagtccaagcactgactctcagaaattcaacacttaaagatagagtcacccatctagacagtgcacttaaggagtgtgttaggaagctaagacaaacaagggacctcattgaaggtgctgcaatggcttccacaacaaacactggtggattcatacatgcgttaccaattcttgatggcaaaaactgtgatcaatgggttgtaaggatggaagcgattcttggcttccatgagattcttggcattatgaaggaaggaatcttagagaaggagaaagatgatgctacaattatgaagaaggacttcaaggcaaagtgtcttcttcatta

SEQ ID NO: 74268 - DNA, 324 bp, Glycine max
  Peptide Sequence Number=SeqID_191046
atgactactaaaatgagagttaaatatgacaaatattggggaacacctaacacaatcaacattttgctaatgattgtcgttgtccttgatcctaggtgtaaggtgaaatatgttaaccactttgttaactacttatttaatgaaaaccagacaaatgaattgaagttaaagttgtcttctagtttaaaatcactttatgagcaataccaaggtgttgaagaagactttcaaattaaccaagaagtagcacaattggatgaagaagatgatgatgatatccatggtaaactcaaccagatttccaatctaggaagtatggcctaa

SEQ ID NO: 74269 - DNA, 405 bp, Glycine max
  Peptide Sequence Number=SeqID_191047
atgagattcaatggaatgcaacattttcagcattctgatagctcattgtcaagtgaaagtagtttgatcatagaagaaatgagcagaaccagtccttatagcccagaggagaagaaggtgaggattgagagatataggaacaagagaaaccagaggaactactgcaagaaaattaagtatgcttgcagaaagacattggcagatagcaggccacgtatcagagggcgatttgcaaggaatggcgaaattgcaattaaccctccagctcagtggagtcacatgggaaatggagaggaagaggaagaagaggaagagaattgggctaatttctttgattccttagttcctgcaaatcttgctcaggagcctcaaggcagtagttcctcctttggtgtgttctattaa

SEQ ID NO: 74270 - DNA, 438 bp, Glycine max
  Peptide Sequence Number=SeqID_191048
atgtacacacaccgcaacgcctcactctcacgcgccgccgactccctcggccatttcctctctcccccggacgcatccacggcgtcaccaatgcagtactctcccgccgccgccgccgccgccgctcctcctccccttcaccaccaccaccacggcgagttcgactcgctgctcgaactcaattactcggagatgagttcgaacaacacgtacaacagctgcagcagcgggtgcacgagctacatggggtcgccgagttcgctggcgagtaattacgagagtcgacgagtagtgcagaggagcgttagcagccactcgctgcaaaagaacggtgggacccaccaccatcccttttctgagttctctcctcttttcgctgagttcattgactcggaaaacggtcccgtacggagagcttgcagtaccggtgaacttcag

SEQ ID NO: 74271 - DNA, 253 bp, Glycine max
  Peptide Sequence Number=SeqID_191049
atgtggaaaagaccactggaagaaggaggaactaaggccattgacagtgttgaaacactcagaacttgcccagtccaataggggcgctcagcgcgcatcaggcgctaagcgagcaactaactggaggcgctgggcgtggcagaaaccgttacgcgcgctaagccagccaggcgcccagcgtccgatccaacagaagcacaggcccagcgtgcatggcgcgcccagcgcgcgatctgaacgcgctaagcgcgag

SEQ ID NO: 74272 - DNA, 603 bp, Glycine max
  Peptide Sequence Number=SeqID_191050
atgcatccggcaattcgtaaaacgttagtcacaacggaaacgttgtatgtcgatggcggtaaagcagcagaaaaaccgctggtgatgattgccgccgccgcggtgatccgcaatccgtgggcggggctgggctatgtcgatgaccttgcgccgcaaatccgtgaattcgcgccaatccttggcgagctgctcaccggcctgatcctcaaggaagctggtagcggtgaaaaagtcgaagcgtttggtaaaagcgcgatcgtcggccttgatggcgagctggaacacgcttcggcgcttatccacacgctgcacttcggtaaccactaccgcagcgcggtgcagagtaagagctatctggcgtttaacaatactcgcgggccggcgaactcaccggtgctgatcccaatgatgaacaagaatgatgaaggcagccgtgagcactacctgaccatgcagttcaacatctgcgatgcgccgcgttatgacgaaatcgttattgcgctgggcgcggcgctgggcggacgcccgcatcaccgtattggcaaccgttattccgacctgaaagagttaggccatgatgcgcaaaacccagctgctgtctga

SEQ ID NO: 74273 - DNA, 678 bp, Glycine max
  Peptide Sequence Number=SeqID_191051
atggttgataaccattcactcaaaattgacgccgttccggtcacattacgcgagttggcgctcacaaaagtacgccaggcgattatcgccggctatttcaaagctggcgaccggctggtcgaacgccagcttaccgagcagcttggcgtcagccgcagcgtggtcagagaagtgatccgctatcttgaggccgaagggctgattgagacgctgccgaaaaaaggcccaatcgttgccgttttaaactgggaaagcgcagagcagatctacaaaatccgtatgctgcttgaacaagaagccgccagcgattgcgccagactcgctaacgatgatgataagcaccagctatatcagcagctccagctaattgcccaagcctcgcgcgagcaggatgatattaaacgggttgaagcctcacaggccttctatgaaaccctgttccgggttgctaagcacaccattgcctgggaaatcgttcaacgcctcaatagccgcattagccgtttacgtgcgctcacgctggcatcgccggagcggcaagttgccggctttgaacggatgtcgcgcatctatgacgccatcgaaaacaacgatcctcagcaggccagacaagcggtactggagcatctgaccgaagccgcgcagcttgccaaacagattctatcctcacaggagtaa

SEQ ID NO: 74274 - DNA, 171 bp, Glycine max
  Peptide Sequence Number=SeqID_191052
atggttcaagttgaagccagagatcataacatggctggattttgtgcagtgtccaaagaagcaagaagcacttatacaattaagatgttttctatatgggtggactttgtggagtgtcctaaggttcaaaatgaaaaaatggaggaccttcacatggacttgatggagtag

SEQ ID NO: 74275 - DNA, 390 bp, Glycine max
  Peptide Sequence Number=SeqID_191053
atggcccgcatgaagaaaacaagccagatgacgtctgatgcagcaaaggaaattgctaagaagattgtaagtcactttcaattaacaattgtaattgtcgcaacctacccttcggcgggagggcgacgcagggctcacgagtgtgtcttccaagaaaggaaaatgagtggagtcaccaccaatgtttattcgaggaaaacgtcggaaaaaccgaaaaaggtgtggtcaacaaactttaagtgtgaaaggttcgggagttatttttacgcacggggaaggagagaaacgttaagccgttggaccattaacgatctcttgggatggtcgacaaaagcggggtttttgctcctacgtatcctcaattgcgatgaggaactcagacctacgtag

SEQ ID NO: 74276 - DNA, 411 bp, Glycine max
  Peptide Sequence Number=SeqID_191054
atgatactgtcggttgaccatatcattggacccctatatgaagaaggccctatggatttgactttgctttggttctatatagaccatgtatggatcgatcagtccaaagcgaagctgaagttggttagtcatggtggaaaggttacagactaccctacccaggtgacgatgaaggggtacgttgataggttagggttgaaggctctgtatgatgcatggtacatgaccacgaataaatgcacaatcaagcctttatcaagagatagcatgtgcacccatgtggatagtgccattagcaaaactacaggtgccaataacaactccttaaacattttgaatgagtttgactctctacacaagggagttgttattcccactaccagaactgctattgtcaccaccaagcattag

SEQ ID NO: 74277 - DNA, 237 bp, Glycine max
  Peptide Sequence Number=SeqID_191055
atgttacctggactcaggcaaaacgagctaggaaattgttttgtgcagctaccgtttattcttgtacatccaacatttttcgttatttccaatattattcatggcaaatctaaatgggtgcgcaaagcaattcccaacgagctatcgtctataagcctgtatttaaatgggccgacatcaactggctcaggcctgtacgagcagcaagttaagagcactgctaggtgcacccagtag

SEQ ID NO: 74278 - DNA, 3210 bp, Glycine max
  Peptide Sequence Number=SeqID_191056
atggaggctcagcagagaagaggaggattggtgccgctgtcgccggcgcgagatctgcgatctgcggattccaattcgagtggtcacagcaagttcgataagtacaaaggcgtcaatgtgcaagtccttgttcgttgcaggccgttgagtgaagacgaagcgaggttgaacacaccgatcgtgatttcctgtaacgaaggtagaagagaggtttcggctgtgcagaatattgccaacaaacagatcgacagaaccttcgcatttgacaaggtttttggtcctaattccaagcagaaagaactttttgaacaggcaatgtctcctattgtgaatgaagtgcttgaaggatataactgcaccatctttgcgtatggtcaaacagggacagggaagacatacacaatggaaggaggtgcaaggaagaagaatggagagtttcctagtgatgctggtgtcataccaagagccgtgaaacagatttttgacatattagaagctcagaatgccgagtatagcatgaaagtaacgtttctagagctttacaatgaggagataacagatcttttggcccctgaggagactttaaaatttgtggatgacaaatctaagaaacctatagctcttatggaggatggaaaggggggtgtttttgtcagaggtttagaggaagaggttgtttgcactgcaaatgaaatttataagatattggaaaagggttctgcgaaaaggcgaacggctgagactcttcttaacaaacaaagcagtcgttcccactccatattttctatcactattcacattaaggagtgtactccagagggtgaagaaatgattaaatgtgggaagctaaatcttgtggaccttgcaggttctgagaatatttcacgttccggtgcaagagagggtagagcaagggaagctggggagataaataaaagcttgcttacacttggtcgagtgattaatgctttagttgatcattcaggtcatgtgccatataggtatgaatggctaccgttctcctggttatgggatagcaaattaacaagactgttaagggattccttgggcggtaaaaccaagacatgcatcgttgctacgatatcaccttctattcactgtctggaagaaactctaagtaccttggattatgcacaccgtgccaaaaatatcaagaacaaaccagagatcaatcaaaagatggtgaaatctgcactcattaaggatctgtattctgaaattgaaagactgaagcaagaggtgtatgctgcaagagagaaaaatggaatttatataccgcgggatcgttatcttcatgaagaaggggagaagaaggccatggttgaaaagatagaacgcatggagctagaagcagagtctaaggataagcaattgatggaacttcaagaactctacaaatgtcagcaacttttgactgtcgagttaagtgataaacttgaaaaaaatgagaaaagtcttgaagaaactgagcggtcattatttgatcttgaggagaaacacacacaagcaaatgcaactattatggaaaaggaatttctaatatcgaatctactgaaatctgaaaaagcacttgtggagcatgcaattgagctacgagctgatctagagaatgctgcatctgatgtgtcaaacctgttttctaaaattgagcggaaggataaaattgaagaaggaaatagaatacttgtccagaaattccagtctcagttagctcaacagctagaagatttgcacaagacggttgcagcatctgtaattcaacaagagcaacaactaaaggaaatggaaagtgatatgcactcgtttgtatcaacaaaggcagaggctattgaaaatctaagaatgcgggtaggaaaatttaaaaacatgtatggttctggcattaaagctttggacaatttagctgaggagtttaaaggaaataatcagttaacttttgaagcgttgaattctgaagtagccaagcattcatctgccttggaggatcttttcaaaggaattgcattagaatctgattcattactaaatgatcttcaaagtagtctccaaaagcaagaggccaagttgactgcttatgcacgacaacaggaagaggcacatgccagagcagtggagaatacacgtgcagtatctaaaataactgtgaacttctttgagacattacacatgcatgcttccaatttgatccaaattgtagaagaatcacaatttaccaatgatcagaaattgtatgaacttgaaaacaagtttgaggagtgtactgcccatgaagaaaaacaactactggagaaagtagcagaaatgcttgctagctctagttctagaaagaaaaaactggtagcggtttcttttagacatgctaagcttacctacagtagcttccgttactacctgagtgttcaaatggcagttaatgatcttcgggagagtgcaaacgctaaaatcagtaggctgaggcaagaaaccttaaccatgcaagattccacttcttctgttaaagcagaatggaaacttcacatggaaaaaacggagtccaactatcatgaggatacatctgcagtagaatctggaaagaatgaccttgtggaggctattcagcgctgccgcaaaaaggcagaagtaggtgcacaacaatggagaaatgctcaagaatccatccttagcctagagaagagaaatgctgcttctgtggatactattattcggggaggaatggaagataatcatctccgacgagaccgattctcaagtgctgtgtcaactacacttgaagatgcagaaatcgcaagcaaggatattaactcatccattgaacattcattgcaacttgatcattacgcttgtgggaatctgaactctatgattatcccatgctgtggtgacttgagagaattgaagggcggtcattaccacagaattgtagagataagtgaaaatgcagggaaatgtcttctcagtgaatacacggtagatgaaccatcttgttcaacaccaagaaagagaaccttcaatttacccagtgtttcatccatagaagaactaagaaccccatcatttgaggaactactaaaatcattctgggatgcaaaatctccaaaacatgcaaatggtgatgttagatacattggggcatatgaagctgctcaatccgtaagagattccagagttcctcttgtagcaattaactag

SEQ ID NO: 74279 - DNA, 1512 bp, Glycine max
  Peptide Sequence Number=SeqID_191057
atgggtggagatagtcatagtgctctgaaatccagagaagtatcagcgatgataaagcagggtttcatacccgacccaacccactctttctcaccttccagaaccttctctcctcctccttcctcaactcgcccgagtcagactcagactcagactcagtcccatactcactctcaccctcacactcagactctcttcgacatgatgtcggaggagcacaaattctccgacgagaagcgccgcaaaacgcaagatcgagtctccaggctcctcgacgagcccgccctgcgcggcggcggcgacgtcaggctcacggtggtcgccagggacggtttcagggcctcgatggaggttcgcaagaccgttctcgccgacaagagccgcttcttcgccgacaagcttcgctgcgccggcggcgatctctcccactccgtcgagatcagcgactgcgacgacatcgaagtgtacgttgaggccatcgttttgatgcactgcgaggatctcaagcctaggttgcgctccatggccgaaggagttcccaaaattttgagcttgctcaaggtttcagcagctatcatgtttgaccttggagttgtgtcatgcctggaatatttggaatctattccgtggactgaggatgaacaggaggaagtcatatctcagctagaacatcttcagattgatgactctgcaactgaagttcttcttagagtatcatctgatccatctactgctgatagagctgacgacatcttcttgaacctgctaagtggtgttctacaagcaaaagacgacaaagctcgtagggaaatgaaagctctgttatcaagattgcttaaagagaatgtgtctaatgatagcagcagacttgatgtttctaaagacacactttatcatctttgccataagtgtattggttctcttctcctatgcctgtccgaagcagccagcagcgatgagaagctggatcggggggctataatgagcgacataactcgtgaagctgacaatattcagtggattgttgacattctgattggcaaaaagataggtgatgaatttgtgaaaatatgggcagagcagaaagaacttgttacacttcactccaaggttccaacagtttaccgccatgagatcagcagaatcacagcacaactgtgcatcggcattggaaggggacacatactggtgccaaaagaaattcgattttccttgttgtcaacatggctagaagctctatatgaagattttggatggatgaggagagcttctagagctgttgacaggaaattggttgaggatggactaagccaaactatattgacacttcctttactccaacaacagtctgtgttgctgaattggtttgatagatttcttagtaaaggagatgactgccctaatattcagaaggcatttgagatttggtggagaagggctttcatcagacagtattcagctgagcctgaaaattcccaattgcaaataactctctctgattaccccagctga

SEQ ID NO: 74280 - DNA, 117 bp, Glycine max
  Peptide Sequence Number=SeqID_191058
atgggatatggtggcagaatgcaagtggaggttagcaagcatacagagggggctaaggagaagatgctacgtcccaatggattgcccgaatccttgattcgatacgatggcatataa

SEQ ID NO: 74281 - DNA, 906 bp, Glycine max
  Peptide Sequence Number=SeqID_191059
atggaggcgtttccaagagaccaacgaggttcgctcgaagtgttcaacccttcttcttcttactccaccgagaagtcggtgaactcgcctgtgcgtgttcaatccacgtggaagacgtggattgacgagttaccggaacaacaacaacaacaacaatgtggtggtactaacgaggtgaccgccacgtcatggatggcgcttaaggactccgctcctccaccgccgacgctcgccgcagtgctgggcgagtctctgtcagcggcggtgggggaggttggcaacgccgcgaagcgcgcggcggagtggggcctggtgctgaagacggacacggagaccgggaagccgcagggagtgaaggttcggacctccggcggggaggagccgagcgcgaaggtgaccggcgggtcgaggagggactcgagcaactcggttcggagctccggcgagtcttccgacgacgggagggagtaccggggaggaataccgagggtttcggaggacctgagggacgctttgtcggcgtttcaacagacgttcgtggtttcggacgctaccaaacccgattacccgatcatgtatgccagtgccgggtttttcaagatgacgggctatacatcaaaggaggtcatagggagaaactgtcggtttatgcagggggcagacacggatccggatgatgtggcaaagataagggaagctttacaaagtgggtctacttactgtggaaggttactcaattacaagaaggatggcacccccttttggaaccttctcactattgcccctatcaaggacgacgatggaagagtcctcaaattcatcggaaaatgccaaacagcgcccactgttatgtctattgtttccattcattatatgaggatccgtcttcttgataactttaattag

SEQ ID NO: 74282 - DNA, 786 bp, Glycine max
  Peptide Sequence Number=SeqID_191060
atgagtgtgaaagtacttagagtggagcatgcatgtatgattttgttgttttttgctctctattttcgaaacgagattggagctctgactattgtggtttttgaatttttttttggattgttttttccaagttgctgcatcgcgcttgcaaatggaggtttggttcctgtcagtgaagctctgaagatttcgtccgcagtttctgtaaggatgtctgttaacaattaccataagcaattactgattttattccttatgatattgtgtatatgtaaatttgtttgggccccttgggtggagtaccctcagaaattgatagttcaagtgcttgggatgtggagaatccatgattcacttggggaggatatcatgttcgctggtccgatgaacaataatgttgggaaagggaaaaaaggtttggcagaacaaaatcatatgttttttgacaaaaagagtctcgaaaatggagtagttaatggaggggtagcctctggatcatcaactgaagatgacacaagatttaataaggtggttgaagatggaaacaatggattgaggggtctgattcaaatccatgggagcttgcagatttcacaacaaccacctcaagagccagccgtatgctgggagagatttctcccattaagatcgataaaagttttgctggtggaagatgatgattcgacacgccatgttgtgcgtgctctgttacagaattgtagttacaaaggtattaatgttgtctttgtggtaaatcatgccttagcaccaaggttaacaaattga

SEQ ID NO: 74283 - DNA, 840 bp, Glycine max
  Peptide Sequence Number=SeqID_191061
atggatcctactgccaagcttattccaggtcaggacatcatctttgttgtcagcatggtgagtcaattccttaatgccacttgtgacagtcattgggatgttgttatgtgcatccttcagtacatcaagattgcaccaggatatggattattatatgaagacaaagacaataccataatcatttattactttgatgctgactgggcaggatcactatcagatatatggtacacttggcaattcaccactgactttgttagctccaaagaccaactggtagacatgttcactaaatctctcaagggttctcatgttgactacattcgtgacaagttggaaccacaagattggaagtggggattaaggccaacagtagagaagtcacagtaccagacaccagtgggaaagttcatctacttgtcccatactagaccagacactgcttatgctgtgagtgtgaatgcaagctacccaaggaaatgtatacaaatgaagactaagctgagtcagttgttgataaaggatacatctcaggctatggcacagaacatctgtgagatattatggatgaagatcattcttgatgaccttaagataaattatgaaaaccctctgaggttgttttgggataataattctactattagcattgtccacaaccctgtacagcatgacaaaaccaagcatatagagattggcaggcacttcattaaagagaaattagataatggtcttataactacaacttacattccttcaagactccaattggcagatgtattgaccaaggagctccctatggtaagatttccagaacttgatatccatttaccaacttga

SEQ ID NO: 74284 - DNA, 399 bp, Glycine max
  Peptide Sequence Number=SeqID_191062
atggtggggacctcagtgggtgagggcgcgatggagggcttcacggaggggcacttggagagagcttcgacacaacttcaagagagggcagcgtggttgacgatggccgggaaacttcgagaaaggtttagggcgcgagggaggggcgcgccagcggagtcaaagctagagggagctgcaacggaggcagtgttccagaactttacaatgcaaccatactccattatcttgcgaacaagcaactcgcttcaaagtgtccaacgagtttttcttttggatgttgcggactctagtagtgctcgaagctccaaaatggacttcttcgggatactaatgggagatggcttcgtgcatggattctttggtgctattggtgtggctgatactattgaaggttaa

SEQ ID NO: 74285 - DNA, 1266 bp, Glycine max
  Peptide Sequence Number=SeqID_191063
atgatgagtgaaagtaggtgtacaagtaaagagaagagttttctcatacccactttgctgcttcagagaaacaacggaaggaaagagatggaaaacaatgctgaatctgagaatccaaaagggaaagggaaagggattccaattcacggagggaagtacgttcgctacaacatcttaggcaaccatttccaagtctattccaagtacgctccccctctccaacccgttggtcgcggcgcatacggcatcgtttgctgtgcgacgaattcggagacgaaagaaggagtggcgataaagaagattgggaatgcctttgacaacaggatcgacgccaagaggacgctcagggaaatcaagcttctctgtcacatggaacatgataacataattaaaattaaagacataattcggccagcggagagggagaacttcaatgacgtgtatatcgtgtacgagttgatggacaccgatctgcatcagattatacagtctaatcaggctctcaccgatgaacattgccagaagaagtatatgtgtgcacgtgtcagggaagtgattgagtgtgtggagtactttttatatcaactcttgcgagggttgaagtacattcactctgcaaatgttttgcaccgagatctaaaaccaagcaatttacttctgaacgcaaactgtgatctcaagatatgtgactttgggcttgctagaacaacctcagagaccgactttatgacagaatatgttgtcactcgttggtacagagcccctgaattgctactgaattgttcagaatatacttcagctattgatatttggtcggttggttgcattttgatggagataattagaagggagcctttatttcctggtaaagattatgtccagcagttggcccttataactgagttaataggttcaccaaatgactcggatcttggattcctcagaagtgataatgcaaagaagtatgttaagcagctcccacatgtagaaaagcagtcctttgcagagcggtttcctgatgtgtccccattagcaattgatcttgctgagaaaatgttggtctttgatccctccaagcgcataactgtggaggaagcactgaatcacccatacatggcaagtcttcatgagatcaacgaggagcccacttgcccaactcctttcatatttgatttcgaacagacaattctcaacgaagaagatataaaggagctcatatggaaggagtctctaaacttcagccaggatcatcagatgttggaatag

SEQ ID NO: 74286 - DNA, 1236 bp, Glycine max
  Peptide Sequence Number=SeqID_191064
atgggttggttttgttgcccagggaaatcaagcaaaaaatcggttaccgaagactacagcgacaccctcaaccagaaacccatcaatttcactgccacagatagtgtcaaagttgatttcagagtgaatgggaataaggaagatggttctaaaggtgatcaacttgctctggacgtaaagagtttaaatttgaaagaggaggcttctcaggatagaaaagataatggtaatcgggcacagacattcagttttaatgaacttgaagctgcgacgggaagttttaggttggattgttttttgggtgaaggaggctttggcaaggtttacaagggacacttggagagaataaaccaggttgtagctataaagcaacttgaccctaacggacttcaagggattcgtgaatttgttgttgaagtgttgacgttgagtttggcagatcaccctaaccttgtgaagttgattggattttgtgctgagggagagcagaggctattagtttatgagtacatgccattaggatctttggaggaccatttgcttggtagaaaaccacttgattggaacacaagaatgaaaatagcagctggtgcagctaggggtttggagtatctgcatgataaaatgaagcctcctgtaatatatcgcgatttgaaatgttctaacattttgttaggagagggatatcatcctaaattgtccgattttggcttggcaaaagtaggcccaagtggtgataagacccatgtttcaacaagggttatgggcacatatgggtattgcgccccagattatgcaatgacaggccagttgacattcaagtcagatatttacagcttcggggttgttcttttggagcttattacaggccggaaagccattgaccatacaaaacctgccaaagaacaaaatctagttgcatgggcaagacccttgttcagagataggagaaaattttcgcaaatggttgacccattacttgaaggtcaatatcccgtgagaggcctataccaagctcttgccattgctgctatgtgtgttcaagagcagcctaatatgcggcctgtaatagttgacgtggttacagctctaaattacctagcttctcagaagtatgatccccaacttcatccagcacaaacttctagaaggagtccaccttctcagatgatgaaaagggatgatgatgatcatagacatattttaagcatcgagcatgagacagacagatcttaa

SEQ ID NO: 74287 - DNA, 177 bp, Glycine max
  Peptide Sequence Number=SeqID_191065
atggagctcaccaaacaaatgatccctccaaagagggggctggtcacgatcagggttgtgaaaagtgtcgtcaagtccgtcatgtctttccttgctgctgcctttactccaagtgcccctgatcaaagaaaagagtatatgaaaattaagaacaggaaaatggctgcccgagggtaa

SEQ ID NO: 74288 - DNA, 207 bp, Glycine max
  Peptide Sequence Number=SeqID_191066
atggcaacaaataattccacagttcacaacaagaaaacaagttttccaccaaaaaggggccaaattaaagctcagatatttagcaacttggtcaaaattgttgcctctaaattctcaaaggacgaaaaagacgacgatgataaaaacggtggtgactctgctatatcgaccccaccaccaagtgcttacagctccgatggagtctag

SEQ ID NO: 74289 - DNA, 776 bp, Glycine max
  Peptide Sequence Number=SeqID_191067
acgctggaactgacgctgggcgcgccgttgatcgaccgcaatgtcaccggcgtccagctgactacgcggcgcaacagatcctgccgcacgtgcgcgacgtgttcgcgtccctgcaggtggtgcgggccacggtcagcgccagcgcggggctgcgcgccgggatgctgacgctgggatcgctgggcgcgagttcgtcgttgaatatccttccgcagttgctggagatgttcaaggcgcgctatccgggcgtcgacgtcttcgtcaccgaaaagcccgatccggaaatggagcgcgccctgatcgagcgccgcatcgagatcggcgtggtggcgctgcccaaacccgacttcgatacgctgcccctggtgtccgacgaactcatggtcgtgctgccgcaggggcatccgctggccaggctgagcgtgatcggcgtcaaggacctggccgcgtatccgctcatcatgacgcgcgccggctcgcagccggtgatcacgcgcatgttcgagcgcgccggcatcacgccgcgcatcgcccacgatctctcgcagatcatgtcgatcctggagttcgtcaggagaggccagggcatttccgtgctggcgtcgctggtgttgcccgaccgctacgacggcctggtctaccggaagatcggccccgcggtcaaaaggcgcatcggactggcctgtctgaacgaacggcggctttccccggccgcccacgcattctggaccatggtgcgcgaggccgcgcccggcatgacgtttccggtgatgtga

SEQ ID NO: 74290 - DNA, 771 bp, Glycine max
  Peptide Sequence Number=SeqID_191068
atgaagcgttatgccggtttcatcgctctgggccttctgtcgctcggcgccttatggttcgcgcagcaaaatccggccccaaccacaccggccgaccggcagacacaaccccaatcgcagaccgccggcaattccgggccggacgctccagggcgctcggtttctcaagcgaagccggataagaggcctccgccgcgcggaagcggcttcgatttttatgtgctctcgctttcatggtcaccggcattctgcgccagctccgaaggctctggcaaccgacagcagtgcggcagcgacaggcgttacggattcgtggtgcacgggctatggccgcagaacgaaaacggctatcccgaattctgccgaagcgacgagcctgagcgtgttccggacgcgattggccgcaccatgttcgacatcatgccctccatgggcctgatcggccatcagtggcgcaaacacggctcctgttccggcctgtcgcagcgagactatttctcggcgacgcgggccgccttcgaggccatccggctgccggagagaatcgcctccggcgccgaaacagccacgctttcagccgatgcgatagaaaccgcctttaccgatgccaatcccggcctgtcgaaacgcggcatttccatcagctgcgacggcaagcgccttgaagaagtgcgcatctgccttaaccgggacatgacattccgcgattgcccggagcttgaccgcaagggctgccgcgcgagttcaaccgaaatcatccccattcgctga

SEQ ID NO: 74291 - DNA, 342 bp, Glycine max
  Peptide Sequence Number=SeqID_191069
atgggccagctacaagggttgctagtgaaaagggttcccttgtgtcacatcaacaagagatttgtcagtgcgggttggatgtgcgaggggcggatcaccatgatacacaaagaaacccctcaagagcaaccaaattgggtgcggccgtgccctccggagttcgaattgggaaattggcgaatcgccaaacaacccggaatttccgtggcgagctcaatatccaacaatgagtcttgtgaaggtaatgataccgaggacctagatgttgattttgagcaactgatgaatcaagctgaggaagtggaagacaaggattggggccttcctccagagctaaagtga

SEQ ID NO: 74292 - DNA, 216 bp, Glycine max
  Peptide Sequence Number=SeqID_191070
atgttttatcctctctcaaaagaaaatgagattccaagagaacttcattgccaaatgctctctcaagaactcttggggcaaacacttgataatccattaagagttcatccctgtgtgcctatccctcttaagttattgaggccacaaggtccaacaagtggttcagggataaaagggatgtcccacattatttccatgacacacatgcaacaatga

SEQ ID NO: 74293 - DNA, 282 bp, Glycine max
  Peptide Sequence Number=SeqID_191071
atgtcaacagaaacattcatggggagaccctcttcatggatgacaacacctccaacttcgtccaccaaattcacaattgctccattcgccaacttctcactcttgtcgttctcagcatctccctcgacttctccatcctttgccttggctttctcaactcacggagcaatatgtatctatggggttgttcttggtttcgttaattcacttgggctcaatgagcttatagattgtgagctacctccaaatttacataaaggggttgttcttaaaggtgattga

SEQ ID NO: 74294 - DNA, 627 bp, Glycine max
  Peptide Sequence Number=SeqID_191072
atgctgcgggagcaagaattggagcggcggagatcagtcaggagaggggagtggtcggaggggatgccggcgaggcgttcacggaggcagagggcgcagaagccggtgacggggacggaggggtggcggtggcaggcggagaggcggtggggtttggaattggaagacatgactcatgagtgtggtggcagtggcagtgacagtggcattttaagaaggcttttttgtggtagtgacgccaatgatgatcggtgtaataatgttaactctcgtagtaacaataatggtgtcaatgataatgaccgtcatagcagaggcattggtggggatagtggtaatggtagcaatattaataatgacaataataatagtaacgacgacgacactaatgatgattgtattaatgttagtgacgacatcaatgatagtggtgatgagagaagtgatattgataatagtagtgttaaaagtgattgtgacaatgacagctatgaaagttgtattggtggtggaggtagagatattgatggcgatgacaataacaatgaaggtgaccatgttgatggtggtataggtgttagccatgaaaataccatatcaaatttagggagtgtgttgtttttttaa

SEQ ID NO: 74295 - DNA, 273 bp, Glycine max
  Peptide Sequence Number=SeqID_191073
atggagaacaaagagagcaagaaagcatggatggagaagaagacagagagaaggagaagacaacgcgaaggagacgaaacataccttggtatggtggcgaaggagaagaagcagagacttgtgatgatgctcgagtgcgacgaacacgatgctcagatgcagacagggacggatgaagcttcttcttcctactgtaacatttgcagaacttccttcagatttttagctaagacttcctttgatgtcgatcctgctaaaaatgctgccagatga

SEQ ID NO: 74296 - DNA, 402 bp, Glycine max
  Peptide Sequence Number=SeqID_191074
atgagtttctcacatagtatggccacgttagctttgttgctattgctagcttcatatgtcaaagctcaagctagcctttttgatataagaaaatatggtgtagtacctaatggagatataaccatggctttgcaaaaagcttggagggatgcatgtgtatcaacaactccaagcaaagttgtgattcctagcaataaatacaaattgagacaaatagactttatgggaccttgcaaggctcctattgagatcctggttaatgggataattaaagctcccaaaaatccattcgacgttagtggtcaaaatcaatgggttagatttggatatattaatttcttaacattatctggcaatggaacttttcacggtcgaggcaaaatggcttgggaaacaaaataa

SEQ ID NO: 74297 - DNA, 1716 bp, Glycine max
  Peptide Sequence Number=SeqID_191075
atggctgaggaagatgtttacacaaaagatggaacagtagattaccgtggaaatcgtgctaacaaaaaggaaactggaacttggagagcctgcccctttattttaggaaatgaatgttgtgagagattggcatactatgggatgagcacaaatcttgtgacttatttcaatactaaactaaatcagtctggtcctactgcttccaagaataatgcaaattggggtggaacatgctacatcactccgttgattggagcatttgtggctgatgcctatcttggaagatatcttaccatcctttgtttttccatagtttatgttattggaatgacactcttgacactgtctgcttcagttccaggcataaaaccaagttgtgatgatcaaggtaattgccatgctactcaggcacagagtgcagtgtgctttgtggctctataccttatagctcttggcactggtgggatcaagccttgtgtatcatcatttggtgcagatcaatttgatgatgctgatgaagctgagaaggagcacaagagctcttttttcaattggttctacttgtcaataaatattggtgctcttattgctgcttctgtgttggtgtgggtacaaaccaatgtcagttggggatggggatttggaattccagcagtggccatggcaattgctgtggtgagtttcttctcgggtacgaggttgtatcggaatcagaagccaggaggtagccccctcactcgcatgtgtcaggtcatagtggcatccataagaaagagtgatgttcaagttcctaatgataagtctggcttatatgagatagaagaagattcagagtcagctattgaaggaagccggaagcttgatcacacaaatggattaagattcttagacaaagcagcagttctaggagattcagacaatgtgaaggacccggtaaacccatggagactttgcactgtgactcaagtggaagagctgaaagccattataagattgcttcctatttgggccactggcatcatattttctactgtttatagtcaaatgggaagctactttatactgcaaggtgacaccatgaacaaccgtgtgggcaacataaagttacacatctcaccagccactctttctgtctttgataccatcagtgtcatcttttgggtgccagtgtatgacaggatcattgtgccagtagcaagaaaattcaccggccgcaaaaatggcataactcagctccaaagaatgggcattggccttttcatatccatatttgctatggtgtattcagtaatcttggagagcatgagacttaaaatggttagaagacacaattactatgaccgtgagcaggtccccatgtcactttatttgcagattccaccatattttatcataggttgtgctgaagtgttcactttcattggtcagttggagttcttctatgagcaagcacctgatgccatgagaagcacatgttctgctctccaactcctcactgtttcatttggatcctacttgagttctttgcttataacaattgtgactaaggtcactactaggaatggtggccctggatggctacctgacaaactaaactatggtcaccttgattattttttcttgctgttgacagtgttaagtgtgctgaattttgttgcgttccttcaggtgtcaaagttgtattcatataaaaatccggttggaactcttcactga

SEQ ID NO: 74298 - DNA, 555 bp, Glycine max
  Peptide Sequence Number=SeqID_191076
atgactaaaccacgtcatcgccactatcattcaatatttctatgttcatcgtatgatcgaagcctcagtttcgcaatgcctcgtaagcgctttcaggagccgcaacccaaaacaggtctacaacatacccaggatttcctgaggaaaatagggttggggaaggagaactactacttctggaagcagattggaaaggctttgctttgcacctatgcagtgatcggggcagtgtgggtgtacaacgagacctcaccactgggttggtggacactgaagccaaagccaaaggaagagcttgagctggctcatttgtacgagcggcggcagtttccttacccgggcgatgaagaggcaatgcaagagttcattgccagaggtggaatgattggaacaaccattggtcccaaagggatggttgagggtgataaggatgagagtgactacaagaaggagctgaaggacaagaagtttgggcaagaggctcagaaactgtggatgaggatgaggagtgaggtcattgctgagcttcaggagaagggctttgatgtggaatga

SEQ ID NO: 74299 - DNA, 642 bp, Glycine max
  Peptide Sequence Number=SeqID_191077
atgtcaaatgtaaatgcaaatgtgaaggtgtctccggccaccttctatggtgccaagttgctgattactgagaaggagttgatggatagttatgtaagatcttcgagtggtgatgttgttcaatctgattgtgtggtggaatctgattccaaggatgttgctgatgtggccactagacaaaagggttcgaagaagttgcagaaatggcgtggcgtgtggaacaagttgggattagtacagggaactgagagaaaggaggatagggtgagggaagaggagggtgattctggggttgaggttgacaagcctcttgcagagtctttggagaggctgaggagggtggttaatgtgcaagcaagtgagcctgttgggcagaagcttatgcgtagctatagcgttagctgtagaagcccgtgtggaacggatggttatgccacggaggagtctgagaacaaagggagtgctttgaatgggagacaagagcttatgtttcagaggaaccggagcgttaggtattcacctaataatcccgacactggcttgttgaggttctatttgactcccacaaagagctacaagagaagcaaggtcggaaggagtagtgttaaggatttgcattcagcagccagaagtggcttgtaa

SEQ ID NO: 74300 - DNA, 798 bp, Glycine max
  Peptide Sequence Number=SeqID_191078
atggcttggaaacaaaataactgttcaacaaacaagaactgcaagaagctcgccatgaattttggctttggttttgtcaataattcagtaattcatgacataacttcaaaggatagcaaatattttcatgtgaatgtttttggatgcaagaacatttcatttacaaacttcagagttagttcacctgcatatagtcctaatacagatggaattcacattggaaaatcaactcaagtgaagattactaactcaaaaattgacaccggtgatgattgcatatctctaggtgatgggagcaaagaagtcactatcctaaatgtaacatgtggacctggacatggtattagtgttggaagcttaggaaaatattcaaatgaagattctgtagaagatgttattgtcaagaattgtacactaaaaaacacaaacaatggtctaaggatcaaaacttggcctggtactgcaataatttctcttgcgtctgatttgcattttgaagatatcacaatgattaatgtcagcaaccctataattatcgatcaagagtactgcccatggaatcaatgctcaaaacagagtccatcaaaaataaagataagcaaagtcactttcaaaaacattagaggaacttctgcaactcaagaaggaattactcttgtctgtagcagtggtattccgtgtgaaaccgtggagctcagtgacataaatctaagatttaatggaactactctagtaactgcgaaatgtgcaaatgtcaagcccaaaattggaaggaaagcacccatatgtgcaacttag

SEQ ID NO: 74301 - DNA, 451 bp, Glycine max
  Peptide Sequence Number=SeqID_191079
ggtgcggataaccgtaaggtatctccgcgtgtcatcgggcccaccgcctctggatgacacaagggcccgccgcctctggatgacacaagggtgcagaatgaccaaattttgtctctgcgtgtcatcgggcgcgccgcctctggatgacacaagggcccgccgcctctggatgacacaagggtgtagaatgaccaaattttgtctctgcgtgtcatcgggcccgccgcctctggatgacaaaaggggtgcggataaccgtaaggcccgccgcctctggatgacacaagggtgcagaatgaccaaattttgtctttgcgtgtcatcgggcccgccgcctctggatgacaaaaggggtcagtatgacaaagattatggggcggccgacaaaagcaaggctcttgctcctacgtatcctccaatgaggaactcagacctacgtagttctagataa

SEQ ID NO: 74302 - DNA, 397 bp, Glycine max
  Peptide Sequence Number=SeqID_191080
tttttcttgggcccaagaaggcttgggggtgtgctgtttagaaggctcctcaggcacctcagccagcacccattcctcaggccctcattcctcctccatcaaccttcacttctcagtagccgacaactcccatgttgtagagcatccaccacacccaatttataattatgcaaagcctccaacaaatcactatcgtgctccaccagcctatcatgatgttggaggacttcctttaacaagtagcttgacccgaggatcgacctccctttgtttgaggggtgagagcgctaaagatgatgttgctacaagaccttctagagctggtgagggtaatgttgtagagcaaggagatgatgaggactacatcgcagacgtctcagttgcccaaacaacttag

SEQ ID NO: 74303 - DNA, 988 bp, Glycine max
  Peptide Sequence Number=SeqID_191081
atgtcgcccaggtcggtgccatccacccaggatgcgaccgtgctggggctcgatcgacttcagtgccagcttgaacagcgtcgacttccctgccccggtctcccccatcaggaagttgatgccgccgcgcccggcgtggaaggacgcatcccggacgccgcgtccattgccgtagcgatggctgacatgctggaactcgatccggccgcattctccgtggaatcggccggccgtccacgaacgggcaacgtcatcgatcgagcgcgcgatcatttcaaagggcatgttgagctgcagcaacagcaggttgaacagcacgatatcgccgacgctcaggtcaccgctctgatagcgcgggagcagcagtgcgaaggtgacgatgaactcgaccgccaggccgatgcccagcagcgcgatgaagccgacccgctgcagcacgtaggcccgccagctgtcgcgcacctcctgggccttctgttcgaagcgctggatcatccacgcgctgccgccgaactgccgcagcgtctccatcgcgttcatcgcattgccgacgaagcgcgcattctgctggcccgcttcgaccgccgcctcacgatggatccgtgctcgccgcgtagcgatggccgagagcgtgacggccacagaaccgtagcccagcacgatcgccaccatctgcaggttgatcagcgcacccagtgtcagcagggtcagcaggatctgcagtgcgctgggaatgaacaccaccaggccaagctgcaccacgatcttcagggcgttgcggcccttctccccggccacctgcagttcggctgcgttgtaatccaggaagaagctgtgtgtcttcttcagcagccgcgcgaagtagcgggtgctggtgatgaaacccaggatgctggcggcgccgagcatcaccgcgtagagcaggaaccctcccgccagttcacggatgccttccgtgctgatgcggtcgatcaggcgcgagaacagg

SEQ ID NO: 74304 - DNA, 219 bp, Glycine max
  Peptide Sequence Number=SeqID_191082
atggctgggaagaatgcttatttgagattcacttgtagcacgggtgatgccatggggatgaacatggtttccaaaggggtgcaaaacgttcttgattttcttctgaatgatttccccgacatggatgttattggcatttctggactggatctttcttttgttaaccggaatgatgtcaccattcaccaatgctgtttactttgttatatgctctactaa

SEQ ID NO: 74305 - DNA, 399 bp, Glycine max
  Peptide Sequence Number=SeqID_191083
atgggcgaaagcctgacggagcaatgccgcgtgaaggtagaaggcctacgggtcatgaacttcttttcccggagaagaagcaatgacgcagccgcggtaagacagaggatgcaagcgttatccggaatgattgggcgtaaagcgtctggctcaaccctggacaggcggtggaaactaccaagctggagtacggtaggggcagagggaattttcggtggagcggttaaatgcgtagagatcggaaagaacccccaacgggcgaaagcactctgctgggccgacactgacactgagaagacgaaagctaggggagcgaatgggattagataccccagtagtcctagccgtacaccgatggatactaggccgctgtgcgtatcgacccgtgcaatgctgtag

SEQ ID NO: 74306 - DNA, 398 bp, Glycine max
  Peptide Sequence Number=SeqID_191084
cattgcacgggtcgatacgcacagcggcctagtatccatcggtgtacggctaggactactggggtatctaatcccattcgctcccctagctttcgtcttctcagtgtcagtgtcggcccagcagagtgctttcgcccgttgggggttctttccgatctctacgcatttaaccgctccaccgaaaattccctctgcccctaccgtactccagcttgacgctttacgcccaatcattccggataacgcttgcatcctctgtcttaccgcggctgctggcacagagttagccgatgcttattccccggataccgtcattgcttcttctccgggaaaagaagttcatgaccctcccagtgtggctgatcatcctctcggaccagctactgatcatcgccttg

SEQ ID NO: 74307 - DNA, 570 bp, Glycine max
  Peptide Sequence Number=SeqID_191085
gaaaatgtagaggctaacttagattgggaaataagggtagagcaacaacttaaaaagaagtctacttcaaaatcttatggctctcactcttatccaaagaaagaccaaggtcaaggcatcttaggggtgacaccttctaagcccaaagatgataaggggaaggcaatagaaaagcaagcccctaaggctagtatgcaagagaaaactagctctataaagtgctttaaatgtcttggaaaaggacacattacttctcaatgccccaccacaaaaaccatgattatgaggggccaagacatttatagtagccaagatgaggctactacttcaccttcctctagtgaaagtgaagaagaaaaaggggaagaatctagtgaagaaatatacccccaagaagatggacaaccattagtggttaaaaagaagtgtaaggagaaaaacattaaagaaactttccctcttagacaacctccacatcttctcctttgtaaaaagacacttgttagcattgccacacctattgggcttgaggttattcctcaagtaaaggagttattggacgaaggtttg

SEQ ID NO: 74308 - DNA, 351 bp, Glycine max
  Peptide Sequence Number=SeqID_191086
atggaggaaggtataggtctcatactagacctcactcccaaagaagaaaaaaatgatagaatgtttcaagaggttagcattagcctcccatatttccatggaaaaaataatgttgaggcctacctagattgggaaatgaaggttgaagaactctttacttgccatcacattagtgaagagagaaaagttccattggctacccttagcttccaagggtatgccctttattggtggacttccctttttaaggaaagaaggattcatggggatcttctagtagagtattggaatatcttaagagttcccttcggaagaggcacattccctcatactatgaaagagagcttatag

SEQ ID NO: 74309 - DNA, 538 bp, Glycine max
  Peptide Sequence Number=SeqID_191087
gaaggcttcaccgcctgcgccggggtcagcggccaggcgcgtgcggtcagcatttcggagagcacgcgggcgaccagtggctcggaatcgacgagtacgccgtcgcagtcgaacagcacggcatcaaaggggaaaagggacatctacaactccagggcgcaatgcggtggtgcaattgcccgccattttcccacagccatccttgggtggcacccgggcagggtgccacccattcccggcaggccggtcagcccaggtcacaccccgccggctgcggccaggtgctggccggcagcatgtttttcagcgaggccggtgcgttgatcgcgacgtagctcgcacccagcagctcctccagatcggcgatggtcaccaggtagctgtcgaggctgccgagaaaggcttcgttgggaatgatccagctgatagccttggccgtgccggtgttcgggtcacgggtgatgatggtcttccagaagaactccggtgtcgggatgccgtggctggaaaggaagtagtcgtggaaacgtcgccgtag

SEQ ID NO: 74310 - DNA, 177 bp, Glycine max
  Peptide Sequence Number=SeqID_191088
atggaggaggctagaagggtaatgccaagtattgcgaacaaggagaatgaatggttaagagttgtatcgtgtacaatgtctgccgtgaacgacgtcaagacagcattgaatactccaacagctacagacattgcagacttgcctgcatgggcagattgggatcataccgtatcataa

SEQ ID NO: 74311 - DNA, 439 bp, Glycine max
  Peptide Sequence Number=SeqID_191089
gattaagcagcgcgctgccggcgaaatagcgcgcgtagggcaggtgcgtcagcagcagcagtggaataatgatcgccatggctaccagcagcggattgacgatagagaggttgattctggctgccagacggcgtgccagcagatacgccactacggagacgacaatcgggccaaactgtgcgctgaggatatcggtgtagcccatcacgccaacgctgatcggcacaaacagcagcgccatgtagcggatcaacagctgacagccgggtttcacccacgttaccgggataatctgcagcgccagcagggcaaacagcaacagcatgccaaggatgctgccgggaatggtaaatggcagcagggcagcaaggccgttgccggcatacagcgcggcatagacgatggcaaaggcgcgcagatagcgccagcaggcagatag

SEQ ID NO: 74312 - DNA, 264 bp, Glycine max
  Peptide Sequence Number=SeqID_191090
atgaaccacaccgtccaaccgcagcgcgcgctgcgaaaggcgatgccgcaagcggagcaaaaactatggcgctatttacgcaaccgaaatgtgtgtggcgcgaagtttcgccgccagcatccagttggagggtacatcgttgattttgcctgcgttgagcaatcactgatcgtggaactggatggtggacagcacaatacgcctgaagatcagcttacgatgcccggcgcacggcatatttacagcgctgcggctggcgcgtaa

SEQ ID NO: 74313 - DNA, 258 bp, Glycine max
  Peptide Sequence Number=SeqID_191091
atatcaaatcagcccctttcattgcattcactgttccacggaacaaaaaaaaaattaaaaaaaagtggaatcgccagccatgccagcgagacctcctctactgctatttcgccagccatggtaacgagaccatgcctgctctttctgacaccagcaactgtttcgccaatactgctggcgaaacaccctccacgtcatgttgctaatgcgagtgacggcttaactttatcaccaatacaaatggcgggatgcatgtaa

SEQ ID NO: 74314 - DNA, 720 bp, Glycine max
  Peptide Sequence Number=SeqID_191092
atggacgtcgagcgcctggagcggatgaactacctggtcgaccaggccgttccacgcgatgggggcgagccggtcaccgtgcgccgcatccaggtgctgaccatcaccccgagccgctcgctggattcgctggcgctggagcacctgggcgacatgccggcgcaggcccgtgcccttttccgcgtactcggtgtatcgtccgacccaggccgtcccgggggcggtgcgctgatgtcctacctgttgttcgagtccagctacaccaagcgattgatcgaactgggttatgccgatacgatgcagccgctggcccatgacgggctggacaaaaaggccgtggtcgacgccgcgcacgagctcggcctggcactgttcgtggccaattgcgacccggcccgcagccgttccgcggtgctgcgcgccatcgtcaaggcggtcgatttccccgagtatttcggcggcaacctcgacgcgctctacgactgcctgtgcgacaccgtgctggatcacaagaccggcgtggtgctgtggctgtacaagctgcattccggcgacccggcgctggaggaagacgccgcccgcatcgagtcggtgtgcgccgacgccgcggagttcgcccacgaaaatggtcgcacctttgcgtatgtggtggagcacgcgggcaagcacccggaccccgagcccggcgtggccgccgcgccctacggcgagaacgactga

SEQ ID NO: 74315 - DNA, 228 bp, Glycine max
  Peptide Sequence Number=SeqID_191093
atgaagaaacgaacgaagaacgtcgaagaacggctgaaaatcttcgtgaaaatccccacagaaacgttacgaaaaccttacggaagcgcctcggctcggattttcttcacgaaaatgggagagatgcttgccacccagctcgcccaggcgagctcagcttgcccaggcaagcaaggtgacttcctccagaagcaaccgccttctggaggaatcttctggagggcctaa

SEQ ID NO: 74316 - DNA, 336 bp, Glycine max
  Peptide Sequence Number=SeqID_191094
atgactccattgtcgtcactccaaaatggtcaagtgactaaatcaaacagaacacacactctgagggagttcccggagagatttgcaaaaaggataggatttcctacatctaatatccagtcgtgtggatttgggatgaccggccctctcgatgagtcgatctcttgctttctcataagggtggacccttgggtgcttgtacctatcaccttgaggggactacatgtcctcgccatcagaggactgcatgtccttaacttgagaggactacacgccctcacctccagaggactacatgtcctcgccttgagagggctacacgtcctcgggtactag

SEQ ID NO: 74317 - DNA, 285 bp, Glycine max
  Peptide Sequence Number=SeqID_191095
atgataattttgttcgagatctctgtcgttagtcggtattcgttatctgcttacgtgaccgttaaccggatacatgagcatgcgacgtgtgatgtcacatgtactcgttgtttgagtgggattacacgtgccactgccacctcatcaataacccctcccatgatgagaattcttaaactagccaaatacaggctaaaggctcaagtagagaaggacgaagacccaagtggagaaggacaaagtccccaagtggagaaagatgaaggccttagtggagaaggatga

SEQ ID NO: 74318 - DNA, 424 bp, Glycine max
  Peptide Sequence Number=SeqID_191096
gatcccacctctagacccgaataagtctaacagggccttgggtttttcggcattgatcacgggtctctgccagtcattcggggttccggtcacacctagtaagggtggcaacccacaggccccagacgcatcgctgccacctcctcaggctgatccagctgggtcatttgacatagagcgggcgcatgtgcagacccatgactgcctctaccagctcagcctcagcctgcaaagccagggttttgcctcttttccatgccctactctggatcagtttagggcagaggtcgcatggcccggagattggcctgaggcccaggcaggggaggcacccgcagaggctcccggcgaggcagatgaggcccgcatggacgaggagatgaccaatttgcttgatttcttaggagggagcggagccacatga

SEQ ID NO: 74319 - DNA, 213 bp, Glycine max
  Peptide Sequence Number=SeqID_191097
ggctgttcatgtgtcctccactttcgagtttggagctgtgttccatgattgcctaagagaggaccctcaaggcaatcctccatactccaccgttattcggagcaccatgaataagaaaaaagaagaagtagagatgagagttgtcatcacggaaggggcaggacggacgaaatcagtgtcctatctttgctttcctcttatcttcgatgagag

SEQ ID NO: 74320 - DNA, 849 bp, Glycine max
  Peptide Sequence Number=SeqID_191098
atgaaaaagaaaacatcgctcagcgaggaggatcaggcgctcttccgccagctgatgaccggcacgcgccaaatcaagcaggacaccctcgtcctccgtccgatgcgcaagaaaatctccgaggtgcctgtcaaaagactgttgcaggagcaggccgataacagccactatttttcagatgaatttcagcctttgctcaacacgcaaggggctgtgaagtatgtacgtgaagacgtcagccattttgagctgaaaaaattacgccgtggggattattcgcctgagctgtttctcgatctgcacggattaacgcagatgcaggccaaacaggagttgggcgcactgatcgcagcctgtcgccgcgaacatgtgttttgcgcctgcgtgatgcatggccacggtaaacatattctgaagcaacagacaccgctgtggctggctcagcatccacacgtgatggcatttcatcaggcacccaaagagtacggcggtgatgccgcattactgaattaccctgacaggacggcgggaggcagagtttgcgcccccgcgttatcgcacgtcacgtcagatggcttttgccatcttcaggttgcacggactcatttgccagttgaagacacctttacccgtttcgtcgagagaaacattggcaatggcagatgtcgtgaacatcggcggggtttcgcccgggcacagttcagataccagatagccaaccagtggcaggtgggaaatgaccagcgcggaggcgacaccttcattgcacagcgcctgaagataagcactgacaaggccgacatcgccacatggggtgagttcagggagaacatccacactggctggcag

SEQ ID NO: 74321 - DNA, 860 bp, Glycine max
  Peptide Sequence Number=SeqID_191099
aggactacacgtcctcctcttcagatggctacacgccttccccttcagaagactacacgtccctcgccttcagaagactacaggtcctcaccatcagaggactacacgtcatcgccatcaaaggactacaaatcctcagttttagaggactacacgtcttcgccttcagaggactacacgtccttgccttcagaggactacacgtcctcgccttcagaggactacacgtcttcaccataagaggactacacgtactcgccatcagaggactacaaatcctcaccttcagaggactacacgtcctcgccatcagaggactacacgtcctcctcttcagagggctacacgccttccctttcagaggactacacgtccttgccttcagaggacaacacgtcctcgcctttagaggactacaggtcctcaccatcagaggactacacgtcatcgccatcaaaggactacaaatcctcaccttcagaggactacacgccctcaccttcagaggactacacgtcctcgcctttagagggctgcacgccctcaccttcattggactacacgccctcgccttcagaggactacacgtcctcaccttcagaggacctcatgtcctcaccttcagaggactacacgtcctcgccatcaaaggactacacatcctcgcctttagagggctgcatgccctcgccttcagaggactacacatcctcaccttcagaggactacacatcctcaccttcaaagggcgacacgtcctcgactttagagggctgcacgccctcgcctttagagggctaggcgtcctcactttcactgggctccacatccgcatcttaagagaatgtgggatcctctag

SEQ ID NO: 74322 - DNA, 315 bp, Glycine max
  Peptide Sequence Number=SeqID_191100
atgagttttggtggtagttactatgccttagtaattattgatgactattctagattctttggaagatatgctctatcaagaaagaaatataaaaggaagagaaatgaagaaaacaaggatattcaagaggacatagcccaagaaaatgatgatcttcccaaagaatggaaaacttcaagaaatcatcctcttgacaacatcatcggagatatctcaaaaggggtaatgtcataccctaatttcgtccggggacctttgctcgatgacgtgcgaccattctttggtcctcgtgaggtgcttggcacccatcattag

SEQ ID NO: 74323 - DNA, 400 bp, Glycine max
  Peptide Sequence Number=SeqID_191101
gggggctagaagaccaagggcaaggccagttgaggctccttctacatcagcagctcctcctccagctcatattgtagcagcaccttctaccctacctcctgcagattttcaatactccatccagacggcagaacaatttaatgaatgggtagcctggccagggactcagcctcctcttcacagggaagacgaagatcccgccgctcaagatgctgcagccacctctgaaaagtctcctgaggccactccagagcctccgacaccagtggcaaataccacttctccccaacaggcagcaaacccttccacgcctgaggatcaaaccaccccagtcctgtctccgaacacctctcctgtagctactcatgtacttcatttgtcggaagaggaggagggttag

SEQ ID NO: 74324 - DNA, 2727 bp, Glycine max
  Peptide Sequence Number=SeqID_191102
atggcatcagattcagatctattgacacaatactcccacacccgccgcatcgtccttctcatcgacctaacctcacttcaccaccaccatctccaggactacaccaaacgcctcgtttcgttcttcgaaaccctaatttccttccctccgctttcttcctccctcttctccttcaagttcttcttctcctccctctcccctctcctctccttctctaagctccaacccttcctccccaaccctaccctctccttcaacaccccttcctccaccctcgcacacctctcccacaccctctcatccctcctctcctcctccttccactccttttccaccccgaacgcctcccacctcgccgaatccctctcccaactcctccatgaccactcctgggaacacccggacgacaacgaccacactccccaccacgccattccacccaatttagtactcctcttctccccctctttcacgtccctcacctcccttgcctcgttccttgattccgacgccggtcttgttgcacactccgcctctttctgcgggaggctctctttagttttctccaatgtaagtcgggcctttgcctccaagggaattcattgttgttggattagtattggtagcgagattgggagaattgagactgatgaggctagagaagcttgttgtttgctcgagactgggcttgggaggctcggttgggggttttgctctttggattcgattctacttggttcggctcttgttccgtttggcttggtttatcccaaaattggggttttgtgggattctgtttgtttttcttctagggatgctaataatgttggtgcgcagttgagtcttcggatgttggatgtgaaggggattcccattgagtacagtgattgtgatctcgagtttgttgatgtgaaggtcttgggagggagtggagatttgaatttgcagggtggaggatgcggaagaaaggagaggttttggaagctgtgtttggacggaggtgtcaaattggaggttaagattgtgcagaggtgtgacgcgtttgttgggatagaggagtggttgtctgattcagttctagtgcgtgaggatttccggggattgaagaagaaagtgaaggggggtttggatggtttttttgcggatagggttcttgagcttgttgcaggcgagtttggttgtgagtggcggcgaaaacaggtgccggtttgggaaattttgttgagttttctttatagggagggttgttgggcattggtgtctgttaccaatggtaaaggtggttcgtgtatcgctattcttagaccttttacagtgtttgctgctctcttgtctgtgttaggcgatccacacggggcttgtagttttggtgaagaaaatgtgggacaatatgtcaggatggtggacaatgagatttgcggatctgatggcaaatttaacaagaaagaggatttgttggattctcaaggtaagaaaagtactgcggtggttgagggtcatcaaaggaaaaaaatggtggatttgaatacagttcgagacctcacgtggaacttgttctgtaagttggtgtatgatcaatttgagacaaatttgcttgaggtttattataccatggaaggtaacaagtctaaaaagttgagatttttgaaatgctggatcaaacagatgaagaaatctggctgttcgagtctagctttgttagaaaaacccaagccaaatccgatagttgctgaagaggctagcagtaaattgaatgacttaactcaaaatgctgaacagccaatcttctcatttgcctcagctgaaattaaccctgagccagaagctttgagaatacaggaggatgctgtgctggactttaggtcagaaacatctgaatcatttttcagtaatcttgccgacaggatcaatcggggaattgaatctgaagtcgtagacacaggggcgttggcagagcgacttgtaaattcatctatatactggctatgtcagaaggttgatagggaaactatttctcagagtcagtctcctttgaaagatcataacgcttgtggtagcatgattgcatctgagctgatgaaacttctattaagggagcccaaggagatagttgcaaagcataaaagccaaaatccaatgaaatccctaaaattcaggtattctctcgctcttgaagatgtggttcagagaatctacaacaaaatggacctgctgctgtttgccgatgaggatgaagccccaaatagtttacttaacagtgaggacagctacaaacctttgaagaaaaaaacatacagagatgaggtaggtgaaaatgatttcagtagccaacctatttcagcagaaaatgagccctttcagttgcagaaggatggaagtggaagattccaaaggattgaagatggtgaccataaaaaactaattgaagctaaggagaagagagagagggcacaaagattttcatcttttacaagttcaatgcctgttttgcgaagagttagggcaacaaagcagaagggtatgaaaccgaagacagatctgcttcaaagggtgcagaaaaggaaggagcgagaaagggcaagctatggaactgtatgtgagactccaatgacaggaaataagcgttcaagcccaagggcaaggagttcagatgatgacaatggcctggctgataggagtcaatcatatggctcagtttctaaggcattgttcatggatgatctttga

SEQ ID NO: 74325 - DNA, 876 bp, Glycine max
  Peptide Sequence Number=SeqID_191103
atggccaaacagcgtcttcccggaccgatcttcaactacatcgacggcgctgccgatgacgaggtgacgtatcgacgaaacacggccgccttcgaaaaatgcgatctggttccggacgtgctgcgcggcgttgccgatgtggatatgtcggtcaccgtcatggggcagaagctgtcaatgccggtctattgttccccgacggcacttcagcgcctctttcaccatcagggtgaacgggcggttgctgcggcggccggcaaattcggcacgatgttcggcgtgtcctctctaggcaccacaagtctggaggaagcgcgccgcatcagcggcgggccgcaggtctatcagttttatttccacaaggaccgtggcctcaaccgcgatatgatggcgcgcgcaaaaagcgccggtgtggaaaccatgatgctgacggtggacagcatcaccggcggaaaccgcgagcgcgacaagcgcaccggctttgccattcctttcaagctcaatctttccggcattgcgcaatttgcaatgaaaccggcatggggcatcaattatctgacccatgagcgcttcagcctgccgcaactcgacgatcacatcaagatggacggtggagcgctctccatcagccgctatttcaccgaaatgctcgatccttccatgaattgggaggacgtggagcagatggtgcgcgaatggggcggacctttttgcctgaaaggcatcatgtcgggggacgacgcccggcgtgccgtcgagatcgggctgcagcggcatcgtgctctccaatcatgcggccgccagcttgatggtcccgcagcgctttcgaccagctggccgagatcgtcgatgcggtcggtgaccggattgacgtga

SEQ ID NO: 74326 - DNA, 428 bp, Glycine max
  Peptide Sequence Number=SeqID_191104
aacaagagaggatacatctcttgtggaccagttcaagtggagggtacatccacttggttgttcaaagagaaaaagggagggtacatcccttgtcgatctttgcttgtaaaggcttttacaaggttgaaaagaaatctcaaggatcacaggtcgcttggggactggatgtaggcacgggttgttgccgaaccagtttgggggaatcccaagttgatgacttaggtttgatggtagtaatatgggtcgatgacccttctttctttggtttctgggtggatgacccagtctgggtaggtgacccagaagatgccgaagaaccttttttgatagttggctctagtagagccaacttgaatccttttccggaactccgacctccccttagggaggttcctgttgccttaggaggcatcaccacttttctgtaa

SEQ ID NO: 74327 - DNA, 702 bp, Glycine max
  Peptide Sequence Number=SeqID_191105
atggtcaaaattaacattcttttctttgattggttccatgcttataccattagagaaaacctagattacccttggaagcaagacatcataggtgatctaacaaccaatgttattaccaattggcagatcaaagatggtgtgttaatccaattggaattacctccagcaacacaatatcaattgtcaaaggtcaaagatagtaatgataaacctgtcatggccacaccctttaaaactaaagatgtcaatgaagaagtcacctcaaaagccatcaagagcccaatggaacaggctaattataccaacaaatatcttcaggtattaggagaaaccattaaagaaaaggtatctcctaaacagagaacccatgaagaatccacatcaaatgtccagatagaaaaacctttattaaaaccattcaaggtaggtgacaaaaatagtgaattattaaacaagattgatagtttacttaaagtcatccctgaaacacctcaaccttcggaagaatcatccaaaatgagaacaagaaatacctccagattaattgatgttattaatgaggatagtgaccaaaactcggaacaaacaactgaaacaggattttccagtcaattaaaaggatggtgggataattatctcactaatgatgaatgtcagaccaaggaggaggatttttctttaacctatcatgtaatggtttga

SEQ ID NO: 74328 - DNA, 1311 bp, Glycine max
  Peptide Sequence Number=SeqID_191106
atgaaatatgctgacttgctccctgccctgctcgccaaaaaccttgtccaggtcagaacaccccctcgtacaccagatgttttacctccctggtttcgtcatgatttaacctgcgctttccaccaaggggccccaggtcatgacgttgaaaactgctatgtcctgaagaatgaagtgcaaaaacttgtccgagccaacttgctatccttcaaagatcagaatcccaatgttcaggcgaaccctctgccgaaccatgggcctactgtcaacatgatacaagattgtggtgaagaaggtgtcatcctgaacgtccagcacattcgaactcccctggtcccaatacatatcaagatgtgcgaggcagctctgtttgaccatgatcatgcagcatgtgaaatatgtccagtgaatgtaaaaggatgcccgaaggtacaagaggacatacaagggctgatagacagcagagaactaaccatcacgaggaaggatagagaagtgtacgtcattacccccgagtttcagcggttggaaataagctataacagtggggaatcaactactactccactagtgattagtttgccaggacctatgccgtatgcttctctaaaagcggtcccttacaagtatagtgccacgatgttggaaggtgggcaggaggtgcctttgccttctccaactcctgcgatttctgtggacaacattgctagtgacggtaaagttctaaggaatggacgtgttatccccacattgtttgcaaagaaagtgaatgatccggcagttaaacaggcgacagtgaatggccccggtacaaggaaggaagtaggccaatccaatgggactagcaagaattctgatcatgacgagattctgaaactgatccagaagagtgagtataaagtagtagaccagctgctgcaaactccctctaagatatccattttgtctctgctattgaactcagaagcacaccgtgaggctctaatgaaggtgttggaccaagcttttgtggagagggacgtgactgttaatcaattggacagtatagtaggaaacattactgcctgcaataatttaagctttagtgatgaagagcttcctgaggaggggaggaaccacaatctggcgttacatatatcagtgaactgcaagtcagatgctctgtcgaatgtacttgtggacactggttcctcattgaatgtaatggccaaatccacattagatcaactttcctaccgggggcctcccatgagaagaagcggggtggtggtcaaagcgtttgatggatcaagaaagtctgttatcggggag

SEQ ID NO: 74329 - DNA, 219 bp, Glycine max
  Peptide Sequence Number=SeqID_191107
atggctccgaagaaactctccacgaagaggtctagaagagacgccgcagcagaagggtccagtgccgcccctgagtttgatagtcatcattttcggagcgccgagcaccagcagcgtttcgaggccatcagaggatggtcgttctgcagagaaaggcgtgtccagctcagggaggatgagtatacagactttcagaaggagatagctcgcagacgttag

SEQ ID NO: 74330 - DNA, 591 bp, Glycine max
  Peptide Sequence Number=SeqID_191108
atgattgaaagttttcaacaacaacaagaaatgggtgtcattgaattgtgcgttgaagtagatgttgtcggtgcttctacgttgaatgtgacaaattcactattatcatgtgggaataatatagctggcaatgaatcaaaagttcaaagatttgtaataaatttagatgatgattctgacgatgatgattacatgatatctaattcatatgttgaggactcgttggataaggaggaagatatcgatgatatatctaacacagatgaagaaggtggaagtgagactgcattttgggaatctgcttctaattatagtaacattaattggagtcatccggatgaagaagacatatgtggtttcaatatgggatcaaccttcaatattggccaagaattatttgttgacatggaatttgaaagcaaaaatgcagtaaaaaatacactgcaacagtatgttatgaaggtgcaccaaacttttaatgttgttgaatcaaaatcacaaaaatatgttgtttgttgcgcaaatcgaaatgatgacatctcatgccctttttatacgagggcaattgtatctaaaaaaactgatacatga

SEQ ID NO: 74331 - DNA, 173 bp, Glycine max
  Peptide Sequence Number=SeqID_191109
gactgcaatcgcaaggaaacacggtggtgtttggtgggcggttgtgtttgagttcggcaagggcacgacggttgagagtgtaactgactataactctgtaagggtgaacgtcatgtgtccagtgttattgaactcggatcagtcagcgactaggtcaaggtactgggtcagag

SEQ ID NO: 74332 - DNA, 459 bp, Glycine max
  Peptide Sequence Number=SeqID_191110
atgacatacaaatacaatacattatacatatttggactcgaaaagagcagcaaaatacataaggattcaaaatgcaccaaacagaaatgttcgaatagagcagggcatagaagtgctaacctattttctggaactgcaaagggcgttgccagtgacggaggctcctgcggtgactcggctggggcgaggagcggcgacactgctggggtgaggcgcggcgcggagacgctgctggtgcgaggggcggcggcgagcggcgacgctgctgggagagggtctattcgaggtcgagggactgagcaaaggtcaggtttatttatgcaaagcctggtcagccctgacctattctcatccttacacattggatcatcgattcaagatcagggccaacccacttggccctgcataatggccctatggggccttagccaccctaatgaggggtcctatagggcatag

SEQ ID NO: 74333 - DNA, 453 bp, Glycine max
  Peptide Sequence Number=SeqID_191111
atggcaaacatcaacgcgaaatggctccaaagaaactcccagccaagaggtccaggaaggatgccactagagaaggttccagtgcggccctgcaggcaaatatggactttgatggacacaggttctggagtgcagaacaccaacaacggtttgaggccattaaaggctggtcattcctcaaagagagctaagttcgatccggagatagtcatggagttttatgctaacgcctggccgacagaagaaggagtcacagacatgcgctcttgggtgaggggccagtggattccctttgatggcatgccatcaatcagtttctggggcatccactggttttggaggaaggccagcgttgtgagttctcctagaggaggattcagacctccagctttaatgaggagtttatcagtcagttgctatgcgttccggggtaggactttgcccagagcgtag

SEQ ID NO: 74334 - DNA, 111 bp, Glycine max
  Peptide Sequence Number=SeqID_191112
atgcctattttgggaaaagagctatggaggcaacaagaagagcagcttttgcagagataccaaggtgacattagcattgggaaatgtactgttgccttagaacttgaatga

SEQ ID NO: 74335 - DNA, 1392 bp, Glycine max
  Peptide Sequence Number=SeqID_191113
atggcaaataagttctcagttatcagcccttcctattgtgttcctaactctcttaacctacaaattaacacagagaaaggtgttacttacgacgtaaagggtaaccgtgtattttacatagaagatactttgttcacatttcacggtcgtcgcgtgttatgtgatgataaaggaagccccatcgtcactctatacaagaagaatgtgacattgcacgggcaatgcaaagttttcaggggtaatagcaatggtccctctgagttgctcttttcggtgaagagatcgtcaataatcccgagtgggaagatgattagattagatgtcttccttgaaaacaagagaaaaggaagcatgtgtgattttagagtcatcgttcgtggaagtaaaaattcatgcactatttatgccggtgaatctccaactattgttgccaagatggagaataatggaggcttcaaagtcttggtctatcccaacgtggactacgcattcatagtgacactacttatgattattgatgacatcaaagattatgatgtgttggtaaatgcgacggtgagtagtgtcctaactgtggcgacggggggtatcttacctattctgacattgtttgagggagaaaatttagaagaagaaaccttagatggagaaaacttagaagaagaatacttacaagaaggagaaaacaactcaggtggagaaaacttagatggagaaaacaacccagaaagagaaaatttagaagaagaaaccttagatggagaaaacttagaagaagaatacttacaagaaggagaaaacaactcaggtggagaaaacttagatggagaaaacaacccagaaggagaaaatttagaagaagaaaccttagatggagaaaacttagaagaagaatacttacaagaaggagaaaacaactcaggtggagaaaacttagatggagaaaacaacccagaaggagaaaatttagaagaagaaaccttagatggagaaaacttagaagaagaatacttacaagaaggagaaaacaactcaggtggagaaaacttagatggagaaaacaactcagaaggagaaaatttagaagaagaaaccttagatggagaaaacttagaagaagaatacttacaagaaggagaaaacaactcaggtggagaaaacttagatggagaaaacaacccagaaggagaaaatttagaagaagaaaccttagatggagaaaacttagaagaagaatacttacaagaaggagaaaacaactcaggtgcagaaaacttagatggagaaaacaatccaaaaggagaaaatttagatggagaaaacaacccagaaggagaaaatttaaatggagaaaacttagaagtagaaaacaacttcgaagctgaaacttag

SEQ ID NO: 74336 - DNA, 935 bp, Glycine max
  Peptide Sequence Number=SeqID_191114
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccgcggaatgtgtggcggtttaaacattaacttgtttaaaactgtgatgacagaaatcaaacaatggaaagataaaggtgttactgttgaattgggcttaattggctcaaaaggtatcagctttttccgctcattaggattactcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 74337 - DNA, 400 bp, Glycine max
  Peptide Sequence Number=SeqID_191115
ggatatcgattactggtcgtaaggggcgggatatctggttcagcagcagatcctaattacccttctggtgactcccggagaagcgttaactactgggatatcggggagttcctctccagctactggaacttccctcgctacatgagctattgtataaatacagagaatcgtaagcttcatttcatcaaacgagactcggaaagagtggcgttaaagaggactggggagcctctcgaagtctccgatctcacagatgatctagttctggagttagagttaacatcgattgctaaactccttttcggagagctcagaaaatgcagactgaaagtgaaactgcctgcctttctttcaagatcaagatactactactcctatgatttccttacagggaacggaa

SEQ ID NO: 74338 - DNA, 1363 bp, Glycine max
  Peptide Sequence Number=SeqID_191116
agcccgttgaacataataaccctgcactctctcccaacttcgaatcttctgtctacgaggctgaagaggaggaggatgatgaaatcccagaggaacttgctcggttattagaatatgaaaagaaaaccattcggcctcatgaggaggtagtagaggtgattaacttgggaaccaaggaagataagaaggaagtcaagattggggcatcgcttgaggcaactgtcaaacgaagggtgattgaattactcaaagaatatgctgatgtgttcgcatggtcgtaccaggatatgcccggcttggatccctgtattgtggagcaccgtttgcctttgaagcccgaatgctcaccggtcaagcagaaactgagaagaactcgccctgacatggctctcaagatcaaagaggaagtacagaagcagatcgatgcaggttttcttgtcacatcagagtatcctcaatggctagccaacatagtgcctgttccaaaaagggacggcaaggtcaggatgtgcgtcgactaccgggatttgaacaaggctagtccgaaagatgattttcctctacctcacgtcgatgtattggttgacagcgctgcaaagtccagagtcttctccttcatggacggtttctctgggtacaatcagatcaagatggcagttgaagacagagaaaagacgtctttcatcacgccttggggcaccttttgttacagggtaatgccttttgggttgataaatgcaggtgccacttaccaaagaggcatgaccactctctttcatgacatgatgcacaaagagatagaagtgtacgtggatgatatgattgttaagtcaggcactgaagaagaacatgtcgaatacttgctgaggatgtttcaacggctgagaaagtaccaacttcgactgaatcccaacaaatgtacctttggtgttagatctggaaaactcttgggtttcattgtcagtcagaaaggtattgaagtagatcctgacaaggtcaaggccattagagaaatgccgattccacaaacagagaaacaagtgagaggttttcttgggcgtctaaattacatttctcgtttcatctcgcacatgacagccacgtgcggacctatattcaagttgctccgaaaagatcaaggggttatttggaccgaagattgtcaaaaggcttttgatagtatcaagaattatctgctagaacctccaattcttatacctccagttgaaggaaggcctctgattatgtacttgactgtgttagaagattctatgggctgtgtgctcggacaacaggatgagaccggaaggaaagagcatgccatctactacttgagcaagaagtttacagattgtgagtccag

SEQ ID NO: 74339 - DNA, 228 bp, Glycine max
  Peptide Sequence Number=SeqID_191117
atggccaaaatacaaggctcaaaagaaggaaaaacctattctaatatttacaaagaagagtggacccaaccttggcccatgggtacatctttgcttattcaacttccactggaatgtgagtgtaagccattggtctgtttgctcaagcaacctgcgctcctgagtgttgacttccaagaccgttcaatcagagtttactcatcttgcacgttggtgggggtgccgtaa

SEQ ID NO: 74340 - DNA, 915 bp, Glycine max
  Peptide Sequence Number=SeqID_191118
atggtagtgccaataacagtgggaggtagtgagaataacaattcccaaataagtggattatgcaagctagcctatgagcccacagaatacgtcgtcaagtccactggtttcatgggccaaactcaagtattgcctatagttatgtgggttaaaaaaagcagcccttcctattgtgctcctaaggctcttaacttacaaattaacacaaagaaaggtgtcacttatgacgtaaagggtaaccgtgtattttatataaaagatactttgttcacatttcacggtcgtcgtgtgttatgtgatgataaaggaaaccccatcgtcactctatataagaagaatgtgacattgcacgggcaatgcaaagttttcaggggtaatacctctgagttgctcttttcggtgaagagatcgtcaataatcccgagtgggaatatgcttagattagatgtcttccttggaaacaagagaaaaggaagcatgtgtgattttagagtcatcgttcgtggaagtaaaaattcatgcactatttatgccggtgaatctccaactattgttgccaagatggagaataatggaggcttcaaagtcttggtctatcccaacgtggactacacattcatagtggcactacttatgattattgatgacatcaaagattatgatgtgttggtaaatgcgtcggtgagtagtatcctaactgtggcgacggggggtatcttacctattctgacattgtttgagggagaaaatttagaagaagaaaccttagatggagaaaacttagaagaagaatacttacaagaaggagaaaacaactcaggtggagaaaacttagatggagaaaacaacccaaaaggagaaaatttagatggagaaaacttagaagtagaaaacaacttcgaagctgaaacttag

SEQ ID NO: 74341 - DNA, 633 bp, Glycine max
  Peptide Sequence Number=SeqID_191119
atgaagaatatgtttctcatccttttcttttctgctcttctaatttcatccacttctaatgcttctaacgtcaatgatttctgcgtagcagacctcaagggtacaaatagcccttctggctctaactgcaagcccgctgatacagtaacagcaaatgactttgtcttcacttttcaacctgcaaacacatctaaccctatcaaaactggaatcagcactgcatttcttaaagactttcctgctctcaatggtcttgacatctctgcagtacgtgtagttatcgataaagatggatttattccattgcattcacatcctcatgccactgaactaataatcgtggtggaaggtcaaatcactgctggattcatggcagctaccaaagcttatgtgaccaagacactgaaaccgggagatcttatggttatcccaccaggacaattgcattttctagcaaattatgatcaaagaagagccactgtttttgctgcttttagtagctcaaaccctactgtccattcttttaataatatatttgccaacaatgtaccctctaatgtacttgcccaaactaccttccttgatgttgcccaagtgaagaagcttaaggctcgtttcggtggcagaaactag

SEQ ID NO: 74342 - DNA, 438 bp, Glycine max
  Peptide Sequence Number=SeqID_191120
atgagccttattgtcagacatgggccgagtgagataagcatgcagtggcagtggtcaaggttgttccacatggggctccatgggcttgcactcgatactacctgccttggtattaagagcattcacatccatacatgctttcaccacaggagggagagccaccacacagtcctaatacatatttctcctcaacctcggccacgagctagtggtgttcagatgctagattatgtatcaggggttgtttactcctatcaaagactaatggacatgagagttgtacctaaaggcataaatagtcatcaggtcaaacaacaacttctgctgatggcacacgatggtcttgcagctggatgtaggtcactgaggagtagccgaggaagaaagccaacaaaggtggcagaggaggtggccataagggcacttgaagacatttga

SEQ ID NO: 74343 - DNA, 567 bp, Glycine max
  Peptide Sequence Number=SeqID_191121
atggtggaagagggataccttaaaggtccagatagcctttctggctatccttgcttgccacctacaacacttacagatgataactttgtgttcaatcttcaacctgcaaacacctcacagttccctactatcaaagctggaattagcactgcatttgttaatgaattccctgccctcaatggtcttgacatctctgtagcgcatgtagctttcgaaaaagatgggttttttccaatgcattctcatcctgatgccactgaactaatcatcttggtggaaggtgaaatcactgctggattcgtcaccggtatgaattcgattgcttatctgaagacgctgaaacccggagatcttatggttattccaccaggacatttgcattttgtagcaaattctggtaatgagaaagccactggttttgccactttcagtagctcaaaccctactatccattcattcaacaatatatttgccaacaatataccttctgacatacttgcacaagctacatttcttgatgttgcccaagtcaagaatcttaaggctcgttttggtggcagcaactag

SEQ ID NO: 74344 - DNA, 558 bp, Glycine max
  Peptide Sequence Number=SeqID_191122
atgaagaggtacgtggataggtcaaggctaaagggcctgtatgatgcgcggtacatgtccacaaataaaggcgtagtcaatgtctttattgagagatggcacagtgtgacctcctccttccacctttctataagagagatgaccattacccttaattatttgtcatgccttttacatctttctatcatcgtttgttttcttgatcaaacagacacgacctacgccacaaaggagattagaggtctagtaaggttagagcttggaattatgatggaccaggaggtagatgttgcaacgtcatcaagcaataaggtgcctctgagtttgttagagagccttatcacagttacgtttccaatgagtcatttgtttgggttgccaaggttactacttgatgctaaaaatatatttcatgttttacaagcatgggtgtttgagcctttttcgaccattccttgtagtgaaaaggtgttggatcatgaccgcaagcatcgcaacatgccgttgaggggtactaacaaggttgttgggactagggagttattggataggctatag

SEQ ID NO: 74345 - DNA, 198 bp, Glycine max
  Peptide Sequence Number=SeqID_191123
atggctgaccagcttcagctcatctttgggttgactgatccatacatggccaactatgtggtccttataggatcgaagcagactcaaatacataagacttcctccaattggggatttgatgatatggctatggctccggttgtgcctgtgcctccggctcttgtcaagaagcctttgaatcacaacatgctgacatag

SEQ ID NO: 74346 - DNA, 999 bp, Glycine max
  Peptide Sequence Number=SeqID_191124
atggagaaagaggttgtggaaagcctttggaatggtaacacagaaatgcagattcaagcagctgtggaactcaggaaactcagcagaaagcagaggcacaacttggtggaaagtggagtcatggtacctctaatttccatgcttcattatgaaaactatgaagccattgaagctgctctctgtgctctacttagccttgcctttggaagtgaaagaaacaagtcaaggatcatcaagtcaggagcattgccagtgttgctgagtctcttccattgccaaagccaaacggtggcggaattgacaatagctacattgctaaccatctcctcttgcaactcaaacaaggtagcaattgcttcctctggggccatccaactcttagctcaatttctcaacagcacaagtagtagcactcagttccaacttgacacactagccactctccacaacctctcaacatgccaggagattattacaccttttgttgtctcttctggggtcataatttccttgcttgaacttatccacacatcagaaaaatcatccacgttggttgagaaagcaattgggttgctagaacacattgtgacttcatcaaagagtgcactgtgtgaggctgctagtattgggggagcagttagaaccttagtagagactattgaagatgggtcacttcaaagcaaagagcatgctgtggggacactcctccttttttgccaaagctcaagagaaaaatttagaggaatgatattgagagagggagtgatgccagggttgcttcagttaagtgtggatggaacttggagagccaaaaatttggccaagaaattattgctgctactgagggattgctccaattatagttcaactagtaataaacaaattaactatgaggttgtggaacggatcatggaagaaattgatgatgctgaaggggaggaattggctgagactactttgagattggtagaggaaatgattgcaaaacttagtacataa

SEQ ID NO: 74347 - DNA, 645 bp, Glycine max
  Peptide Sequence Number=SeqID_191125
atgatgatgaagaataaagttctcattcttttcttttccgctcttctttcatccacttcctatgcttccaatgtgaatgatttctgtgtggcagaccttaaaggtccagatagcctttctggctatccttgcttgccacctacaacacttacagatgataactttgtgttcaatcttcaacctgcaaacacctcacagttccctactatcaaagctggaattagcactgcatttgttaatgaattccctgccctcaatggtcttgacatctctgtagcgcatgtagctttcgaaaaagatgggttttttccaatgcattctcatcctgatgccactgaactaatcatcttggtggaaggtgaaatcactgctggattcgtcaccggtatgaattcgattgcttatctgaagacgctgaaacccggagatcttatggttattccaccaggacatttgcattttgtagcaaattctggtaatgagaaagccactggttttgccactttcagtagctcaaaccctactatccattcattcaataatatatttgccaacaatgtaccttctgacatacttgcacaagctacatttcttgatattgcccaagtcaagaagcttaaggctcgttttggtggcagcaactag

SEQ ID NO: 74348 - DNA, 312 bp, Glycine max
  Peptide Sequence Number=SeqID_191126
atggcggagcgtggccttggaatgtattacacaccaccaacattttctcagtatccaacgcagatgtatcagtatcctttcaaaggtcatcacactgatatttctgcaagcaaacactcgtttggtggtgttgcagaaacacatcttcatttttcatggtcaactatgaccccttcacagcaacatgatgccccaattccaacacctaacgccccattaggtacgcaatggaatgtacccagagcaatacctgatataggtgacttattaggtgctgatttgcgtcaccaattttttgctgaggctgaccaa

SEQ ID NO: 74349 - DNA, 531 bp, Glycine max
  Peptide Sequence Number=SeqID_191127
atggtgtatctctgcagggggatttctccccatttttcctttgtgcataggtggaaattctgtacttgcttaaacaggggtttggaggaatcaaatgttgatggcttttttgaagatgttttggtgaatggtaaaccatggactgctggagtcccggaggtgtttagtggttcacatgtgtatgtatgtgctcatggaagtcgtgacgtgagatgtggtgtttgtgggccagttctcatcaagaagctgcatgaggaaattgagcttcgaggtttgaaggatcagatatctgttactgcttgttctcatattggtgggcataagtatgctgggaatgtaatcatatacagcccaagagcagatggaaaaattatgggtcactggtatggctatgttactcctaatgatgttcctgatttgttggaccaacatattgcaaagggagaggtcatccaacgacttttgaggcatgttgggcttaaaagttttgggtctccgggtataaaattggaaaggcctacctattgttga

SEQ ID NO: 74350 - DNA, 318 bp, Glycine max
  Peptide Sequence Number=SeqID_191128
atgtcgttgttggccatcgaagcttggaatcgcataagagtggttttctcacagtctagtaaccaaaaggggtcatatgcgttggtcggacacctgagtgaaattaaacttacgttgctcgcaagtttggagagcaaaacgcacaaggaactcgaagggacttcgtataacagtcagtggacccctcaccatttgagtggttcaacaaatagttacatggttgatagtgaaaatgtgagcctaggcaattactatgagttaagtgtggagtatgatatgaatctgttggatggaagatggattgaaggtacatggtag

SEQ ID NO: 74351 - DNA, 225 bp, Glycine max
  Peptide Sequence Number=SeqID_191129
atgggactactggtgcatgctcgaatttcaatccaaaaccctaaattcgccttcgattgtgacaatgcacaggttgagggttccatgactgtttcaaccaccaggaagactagggacccctatattatcatcaaaaccagggatcttaccaagcttctatcaccaagtattcttgctcctcagcttaaattaaataatagaattataactattttactacattaa

SEQ ID NO: 74352 - DNA, 180 bp, Glycine max
  Peptide Sequence Number=SeqID_191130
atggtcattctgcttacggggactcacggtttttgctcccccaagccacctttggttgcatttgcgtgtcatttttggtactcctactcactccaacaagggatggccttaggcctatgttgcatcctgaagcaatggggcatgccacgttgcccccactctcttgctattcatgcctaa

SEQ ID NO: 74353 - DNA, 276 bp, Glycine max
  Peptide Sequence Number=SeqID_191131
atggttaaactagccaaaataaacactaaaagcggtgtgaaagataaggcttggatgaccatttggaggtctcaactggctcttcaattagtctgcatggtttacactaagctattacacacaaatagaggtttgggtggtctcttagagactcccaattgcttatgctcaattgtcttggataacacaattcaagagagcttaagacttattttgattctcaaatctagccacaacttcgcaccacaactcaattttttcataggcatcatatag

SEQ ID NO: 74354 - DNA, 273 bp, Glycine max
  Peptide Sequence Number=SeqID_191132
atgggactcctcagaaactttgtcgttgttactgtgattgcactctcagagtttctgagtataggagctggggaaaccaattcctcatcacaaacatgtgattttcaagccatattcaactttggtgactctaattcagatactggatgcatgtcagcagcattttacccagcggctttgccctatggtgagacttttttcaatgaggctgctgggagagcttctgatggacgccttatcatagatttcattgttacaaattttattatttaa

SEQ ID NO: 74355 - DNA, 711 bp, Glycine max
  Peptide Sequence Number=SeqID_191133
atgtattgtttaagacagggaaattcctttccaaggccagaggactttgcgaaggccatctacacattcgacattgggcaaaatgacattgctgctgctcttcaaagaatgggccaggaaaatactgaagcagccatctcagatatagtggaccaattatcaaaccaacttatatatttatacacacaaggagcaaggacattctggatccataatacaggccccattgggtgcttgcctgtgtccatgcccaagcatattgcctacaattatactccagcagaaggatatcttgaccaaaacggctgtgtcgtatatgcaaacgacgtggccaaggagttcaatagaaagctcaatgatacggtggttaaactaaggacattgtaccttgatgcctcctttgtgtatgtggacatgttctctgccaagtatcagctaatcagtaatgctaagaaagaaggatttgttgacccatctgaaatctgttgtgggtatcatgagggtggtaatcacttcttctgtgggaattacaatgcaacggttaatggtacagaaatttatgctggttcatgcaaatctccttcttcccacattagctgggatggcgtgcactacactgacgcagcaaatagctggattgccaatcgcattgtcactggttcattctcaaatccacagcttcccattacacgttcatgcttgttagcataa

SEQ ID NO: 74356 - DNA, 1029 bp, Glycine max
  Peptide Sequence Number=SeqID_191134
atggggatagggggtgtggagccaaaagcctcacccacttgtacatttccggcagtttacaactttggggactcaaactcagacactggaggcatatcagcttcatttgtgccaattcctgcaccttatggcgagggcttctttcacaagccttctggaagggactgtgatggccgtctcattgtagatttcatagctgagaagctaaacttgccatacttaagtgcttatctgaattcccttggaaccaattaccggcatggggcaaattttgccactgggggatccaccattaggaagcagaatgaaaccatatttcaatatggaataagtcctttctctcttgacattcagattgtgcaatttaaccagtttaaagcacgcaccaaacaactctatgaagaagccaaggccccacatgaaaagagcaagcttccagtgcctgaggagttctctaaggctctctacacatttgacattggtcaaaatgatctctctgttgggtttagaaagatgaattttgaccaaatacgtgaatccatgccagatattctcaaccagttagccaatgcagtcaaaaatatataccaacaaggagggagatacttctggatacacaacactagcccctttggctgcatgccagtgcaactattttacaagcacaatataccagaaggctatcttgaccaatatggatgtgtgaaggatcaaaatgtgatggctacagaattcaacaagcagcttaaggatcgagtcatcaaattgaggacagagctcccagaggctgcaattacttatgtagatgtatatgctgcaaagtatgcactaattagtaataccaaaaaagaagggactgataacgggaaggacgtgtttggttctgcttgtgagaacccttcacagtatataagttgggacagtgttcattatgctgaggctgcaaaccattgggttgcaaatcgtatactcaatggctcttacactgacccaccgacacccatcacccaagcatgttacaggcattaa

SEQ ID NO: 74357 - DNA, 522 bp, Glycine max
  Peptide Sequence Number=SeqID_191135
atggccccgaggaagcttgcctcaaagaggtccaggaaggacaaggcggccgaaggaactagttccgctccggagtacgacagtcaccgctttaggagcgttgtacaccagcagcgcttcgaggccatcaagggatggtcgtttctccgggagcgacgcgtccagctcagggacgacgagtatactgatttccaggaggaaatagggcgccggcggtgggcatcactggttgctcccatggccaagttcgatccagaaatagtccttgagttttatgccaatgcttggccaacagaggagggcgtgtgtgacatgagatcctgggtaaggggtcagtggatcccgtttgatgccgacgctatcggccagctcctgggatatccgttggtgttggaagagggccaggaatgtgagtatggccagaggaggaaccggtctgatgggttcgatgaggaggccatcgcccagctgctatatatggatgacgttgctcctcagcaacatcctgcccagcgatcataa

SEQ ID NO: 74358 - DNA, 758 bp, Glycine max
  Peptide Sequence Number=SeqID_191136
atgtcgcgcggcgattggccagcggcactgacagcgatccgcaagatggccggcaagcagcgcagcgacccgcgctggcgctacttcgaaggccgcatgctggagaagaccggccaggcccagcaggcgcagccgttgttccgcgaggccgcacgcgcaccgaccttccacggtttcctggccgccgacaagctgcagcagggctacacgctgtgcccgtggaagccgaatgacagcgcgcaggcacaggcagtagtcgcgcgcgatccggccatccagcgcgcgatggcgctgtaccagatcgaccgtgccggctgggccgtggccgaatggaacagcgcgctgtcgcgcttcgatgacacccagcgccgcctggcggtacgcgtggcgcaggacaacggctggttcgaccgcgccgtgttcgcgctcggcaagcagccgcaggaacagcgcctgtacgacctgcgtttcccgctgcaccacgacgccaccatccgccgcgagtcggcacgcaatgccgtcgacccggcctgggtggctgcggagatccgagccgaaagcaccttcactccgcgtgcgcgctcgcctgccaacgccatgggcctgatgcaggtgctgccggccaccggtgccggcgtggccaagtcgatcggcctgaccggctacggcggcgccgacagcctgtacgacccggacaccaacattgccatcggcaccgcctacctgcgccagctgatgaacaagtacgacggcctgcc

SEQ ID NO: 74359 - DNA, 405 bp, Glycine max
  Peptide Sequence Number=SeqID_191137
atggcagaagcagtaactcaatttatgtccagacaacaaaaatcctttgtagaggctgcagctcaagagaaaagccctctaaaagagcatgaggaacaagcacaacaacaatgggagaagtactcaacagtaaaaaaccaacaagaaaatattctccaaagcgataaccttcctcatcaactgattgacaagaaaggaaggcaagcagagcatgaggaaaccttaagtgccattctttctttaataactaacacctttcttgaaattcctttcgctaagcataagcctcacgctaagtgcatctctgttcatgcgctaagccgcgagtctcaagcgcttagcacccaacccttgcatctgaggctgatttggtccgctaagctggccatggttgagctaagctaa

SEQ ID NO: 74360 - DNA, 755 bp, Glycine max
  Peptide Sequence Number=SeqID_191138
aaacttcggaggaagaaacagaaactgcaacttcatcctccgtactttccgacgaaaatctaaacttaatccaacaagatgatcaattatcatcaacggatgatgatgataagcaaatcaacactctaacaagagaacaagatctcttgtttgaagcaattaattccattcctgacccccaggaaaagaaggtttttctggaaaaactcaagaagaccttagaagtcaaacctagacaaaaagattttattacaaacaacaagtttgatgtaagtaacatactcaagagattggaaaactcttcaaccaaaccaacgactatccaagatctccaaacagaaataaacaatctaaaaagagaagtaaaagaacttcgtcaacaacaagaaattcatcagatcattctttctcaacttgaggaagaaagtgattctgaaaacaccaacagtgaagaaaatcaaccagaaaatctggaagacgatatgtttatgggattaatcaacaagattaaaatccaaaaattttacataaacataaaaataattattaatgattttgttctagaaacaatggccctattcgacacaggggctgactcaaactgtattttagaaggattaattcctataaaattctttgagaaaacctcggagaaacttagtacaacaaacggctcaaaattaaaaattaactttaagttatcaaatgcaattattgaaaaccaaggtcttaggattaacacaaactttcttctg

SEQ ID NO: 74361 - DNA, 126 bp, Glycine max
  Peptide Sequence Number=SeqID_191139
atggggccttctgggcttagcgagtatggcggtgatcacacgcttagcgcaggattcgagctaagcatgcctctggacttcttcgtgagccttcttcgggctaagcttgcgctggccgctaagtga

SEQ ID NO: 74362 - DNA, 369 bp, Glycine max
  Peptide Sequence Number=SeqID_191140
atggcaaacctggttgaggatgagggaaggaatggcgatgacaagcaagagctagaagcaccataccctctggtgccatccaagaaagacaaggagcgacatctggctcgtttccttgacatcttcaagaaattcgagataaccattccctttggagaagagatggctccaaagaagctttcggctaaaagggctaggagggccaccgcatgggagggatccagtacagccctgcaagcagagattgagtttgatggataccatttccgaagcgaggagcatcaacggtgtttcgaagcgattaaggattggtctttcctcaaagaaagatgggtccagctaacagaaggagagtacatagaattctag

SEQ ID NO: 74363 - DNA, 222 bp, Glycine max
  Peptide Sequence Number=SeqID_191141
atttatgtgtccagtattttcgggccagatgtcctggacattgtatccgacatcatggatcctgcagcttttgtcttgccttgtgcattgtgcagcaactccagtattttcgggcaggatgtcctggacattgtatccgacatcgtggatcctgcagcttcaattcttcatttgacattttatcttgccttgtgcattgtgcagcccgatcttatactttga

SEQ ID NO: 74364 - DNA, 492 bp, Glycine max
  Peptide Sequence Number=SeqID_191142
atggttctacttgtttccatatctgggaaacatgatctgatgttcagttattcttatattctctattcatgtctctgtattttgttgatgatagttttttgtcattttgttgcagctcctgaagtagttgagaagcctggggataactcattggctaggctgaaatttttgtacactcaagcaaaagatctttcagaaagtgaagcaagtatttccaacttactgataaaccaaattgatgccctactgcctacgggtccacaagggcaaacacgaagaagaataggaaaagaaggtaatgagcagaaaaggaaacgagtgaagactgagtcagacatttcaaggctaactcctaatatgcgaagtcaacttgaggcttgtgccagtcttaaaggcgaacaggtagcggctagggtcacaccacgaaatgctgataaggacgagtggtttgtcgtaaaagtgattcattttgataaggaatcaaaggagtaa

SEQ ID NO: 74365 - DNA, 651 bp, Glycine max
  Peptide Sequence Number=SeqID_191143
atggtagatctcccatatgagaaagacttcagggagaaacaaattcccacaaaagctagaccaatccagatgaatgaagaacttcttcaatactgtcaaagagaaatcaaggatttgcttgataaaggtttaattagaaagagcaaaagttcatggtcttgcgctgctttctatgtcaacaaacaggaagaacttgaacggggtacacctcgtttagtgataaactacaaaccgctaaaccaagcattacaatggattaggtatcctattccaaacaaaaaatatttactcaacagattgaattctacaaaaatattttccaaatttgacatgaagtctggattttggcagattcagattcaagaatctgataggtacaaaactttcttcactgtacctttcgggctgaagaaaaatccgcctgcttggtctaacatccacactcaaactgtcaaagacatcaaactcaaagtccaatccataaaatgtctatatctcccaattccacaagcattcaaaatcgttgaaattgatgcatcagacatagaatacatcaagggcacctcaaattctctacctgactatctcacccgtgattcttacagagaaacggtcatgtcgcccaagccacggaccaccctacgggagtag

SEQ ID NO: 74366 - DNA, 618 bp, Glycine max
  Peptide Sequence Number=SeqID_191144
atgactactgtcttcaccaccaacatgattgtcattactgtcaccatcgacgacaatgacgatcataatggtagcaatgatgattatgatggtggcaacaataatttcatgacaacaatcacagtggtgatggtggtgatagttgtggacctaagaatcaaactgaagtatcttgtaacatttactcttggattagatcagaaagacaacattgatgctgcgctccttatcaaggaacaaggcaaggtaggtgagggacgtgaaagaagggagaagatgagtactaaatttggtgatatggtgtggtcgttgtcgtccgggtgttcccaggagtggtcgtggaggagttgggagagggattcggcaaggtgggaggtgttgagggtgaaaaaggagtggaaggaggagaaggaggatgagagggtgtgggagaggtgtgccagggtggaggaaggggtgtcaaaggagagggtagggttggggaggaagggttggagcttggagaagaagaggagatgggagagggaggagaagaagagcttgaaggagaagagggaggaagaaagcgggggaaaggaaattagggtttcgaagaaagaaatgaggcatttcgtgtag

SEQ ID NO: 74367 - DNA, 357 bp, Glycine max
  Peptide Sequence Number=SeqID_191145
atgtcttcgccggacattgtctcgatattggagaactcgaaggagttcgatcgggtgaggaaagaacaagaggatattctgtcggagatcaacaaacttcacaagaagcttcaagcaatgctgcatcttcttcgtttttgtgatcctaatggttcatcgtgtagtttggttttgacaagtgtgaagaacatcgatagaagtgctagtgaggaaaaatggatcaaatggaagattcgaggtgttgagcatgattcactgaagcttctagaaattgtgtccagacctcaggttggtctgggatctgagatggctcagcagaatccaggcttcagtttcatggcctggatttgcatctga

SEQ ID NO: 74368 - DNA, 1074 bp, Glycine max
  Peptide Sequence Number=SeqID_191146
atgtatccgattgagtggtacatgaaggtattgaagggttatacgaataatcaataccgactagaagcaagcattgttgaaaggtacgtcactaaagaagctattgagttttgtttagagtacatacaaacaactacacctgtggggcttcctaaaagtcatcatgactgcacaaggggaggtgggggtacacaaggattcaatgttgtaacaatgaatcaccaacaactctctcaagcgcatctatatatattaaacaacacaacagaggtaatttcgtacatagatactcacaaacaaaatctcacagttactcacccaaaaatgaacataatgaaggtgttgcaagagcacaatagaactttcatcaactggacaagcctttcatcatggcagaacaagcgagacaagtgttttacgtccaagatttgtgtgactcaagatgggtcaattgttctacaaggaagaccaactggtattagtcaccaaaatgatgcttcagcacttgatattattgagacgcattctttctcccaacaaatgccttacatcaatgcagaacacaaggaggaggatggcagctttgtttcccatggtcatgatgacatactgaatactgctattgggcgacctgagaaccttggtcatgttcatgcagtgggcactggtgtcacaattaaccagtactttagacaagtgtcacatggctcaaacattttctctgcatcaattagcccacaacaattggttgacataatcagaaacctaaaggaagagtggaggagagaaggtgatgatgtggtgaaggtcaatgttgcaaaagtttacgacgatgatgctcaagtcccttttccaacgtcagagattcaatatgtcaggcaggcccttgacacattcattgcatggtcgacacatcttgtgaaacttgtatcctatgagaaaaatccacaaaaaccggttgaacctggtgagaggttcaataccattgctggagttgatcctttgggcgaattgtttaagaacttgtatgatgtttaccagaagtctgttgagttatcgtgggatgcaacttaa

SEQ ID NO: 74369 - DNA, 189 bp, Glycine max
  Peptide Sequence Number=SeqID_191147
atggctttaattggtgaggctttgaagtggcaacaacatcaagctgctgtgaaacaagatgtggatgacatgtatccaacaactctttctcacacaataaagtttgggacaaaaagtcatgcagaatgtgcttgcttttcaccagatgggcaattacttgtatcatgctcagttgatgggattacataa

SEQ ID NO: 74370 - DNA, 2901 bp, Glycine max
  Peptide Sequence Number=SeqID_191148
atggcagttgcaacttgccatgaaatcgccaatggcagttgcaacttgccttttggcctgcaaacgctgcaaccagctgcaaaagcctgcaccctggaactcgccagtttgactggcggttccatcttccagctatatcgccaatggcaagggcgatttgttcctgtgcatgtgcaagtcgctgctgtcagtggcgactccaggcagcagcagcaaacccgccagtcccactggcgaaccccagatggggaaatttgccgactcggtagtgccctgcgtagacttgaagtcttccacttgcttgcttcgattagcttgttgatggatacaagtggcacacgaattgctttaggaacaatcctccccatcctgttgttgtgcctcccttacttttctatagcagttgatgttatttaccgtcccgttgaactcttgagcatcaactgtggctcttccagtaacttttccactctcgatggtcggaattggactgcagacatcaaattcctctcagaaaacaaggactcggttgctgcttctgctctcacaccgtctacccaacagggtccatacacctatgctcgtttctctcactcccaattcacttactcctttcccgtctccgcaggcccaaagttccttcgcctcttcttctactcaacttcctaccaaaacttcgatcgttccaaatccgatttctcagtcaaagcaggcccttacaccctcctccatgatttcaacgcttccctcaatgctgatgctggggacgagcctggcaactacttgttcagagaatattgcatcaacctcaaagatggagagaggctcaacataaccttcattccaagcaccacagattcgtatgctttcatcaatggaatcgaggttgtttcaatgcccccttatctctactacaccaatcttgacgacaacactggattcccgcaaattgttggaggagtaacatatactattgaaagcaaatcagctctggagaaaatataccggttaaacgttgctggaacaaatatccccccaactggggacacgggtatgttaagaacctgggaagccgatgacaactacgtaacaactcaaagtaacatatctgttgattttgggggtataactaagctcagcttcactactgcgactgaaaactacacggcaccagacaaagtgtaccgatcctcaaggagtatgggaactagtggctctttgaacatgggattcaacctcacatggcagcttcctgttgattctggctttacctacttgttaaggttacacttttgccagcttgacccgcatgttcatcaggctggtgacctggaattctacatctacatagcggatcagttggctaccgatagggcagacgttctcttatggaccattaaccagaaggctgtcccagtggttacagactacatagtttccatcccggtgaatcagaagaaaccaaatatttcactgaaactgcatcctcaccctaaaagcagaatcaaggatgcacaactaaacggaattgaacttttcaaaatcaaccactcaacaggtaatctcgctggaccgaacccagaccctcatccaaagacctttgaatttcctcttcaaagcaaaaacaagaaaagcaaagggaggacgggaaccataactgccgccgttgctggcgcagtttccggtgtcgttatgctctcccttattgtcgctttcttcctcatcaaacgcaagaagaacgtggccatcgacgaaggttccaataaaaaagatggaacttctcaagggggtggctcactaccagccaacctctgccgtcacttctcaatagcagaaatcaaagcagctaccaataacttcgacgaactcttagtggttggtgtgggaggctttggcaacgtgtacaaaggctacatagacgaaggttcaacacatgtcgcaatcaaaaggctcaaacccggttctcagcaaggtgagcaggagtttgtgaacgagatcgaaatgctgtctcaacttcgtcatctcaatcttgtttccctcataggttactgttacgagagcaatgagatgatactcgtttatgatttcatggatcaaggaaccctctgtgagcatctctacggcaccgataacccttccctctcatggaagcaaaggctccagatctgcataggtgctgcacgaggattgcactatctgcatacaggtgcaaagcacatgatcattcaccgtgacgtcaagagcaccaatatcttattggatgaaaaatgggtggccaaggtttcagactttgggttatccagaattgggcccacgggttcttcaatgacccatgtgagcactaaggttaaaggtagcattggatatttagacccagagtattacaaacgacagcgtttgactgagaagtctgatgtctactcgtttggggtggtgctcttggaggtattgtctgggaggcagcccttgatccgcactgcagagaagcaaaagatgtcactggttgattgggcaaagcatcgctacgcaaagggatctctgggtgagattgtggatcctgcactgaagggccagatagcaactgagtgtatacacaaatttggtgaggttgcgctgagttgtttgcttgaggatgggactcaaaggccctccatgaaggacgtcgttgggatgctggagtttgttctgcagcttcaggacagtgctgttaatggagtggtggtcagtggtggggattatgaagatagtgaggatatgtttagcagtacccatagtagtatacaactttcgaattatagtaacagcactggattgaacaccacgagctatggcagtaaggaatctgacaggttgatcccggagaatgttttctctgagattaagaatccagaggggcgataa

SEQ ID NO: 74371 - DNA, 966 bp, Glycine max
  Peptide Sequence Number=SeqID_191149
atgattcccattcagatccttaataagagcaagaaaaccagattgaatgacagaccacagcattgcaatttgttttctagagtcgacagtcatgatcagcttctgaaccacccgaggcctgatacagcaacactatcaaatttagcatgtcaaaaagaaaaagaaaacatcttcttctaccaaattattgtgaaaggcgttaatgacacccacttgaacaataacactgtcagtctcacgtgcgaccttgtggttccaacctccagcgccagcagagccctttactcccgtccggtcagatttcggcaaccgggaaaccgttttccggcgagcttcaccacattcttttccttctttgttaccagcctcaacccctcctcaatcggtggcggcctcaccttcgtcctttcgtctgatgacgacaccatcggtgaagccggcgggtttctcggcctcagcggtggcggcggcttcgttgctgtggagtttgatacacttatggtcatggagtttaaggaccttaatggaaaccacgtcggtgtggacttaaacaacgtcgttttgagtgaggttgtgacaagcgtcgatgacggtgacttggagggtgagggaggggaggatgacagtgtgggtggtgccggagtggaggatgcggaagagggagaggtcgaagccaaggaacttgaaggggaggagtttggcggtgacagcggagcagaagaggggggcatggtgctaggagggggtgaggccgtgggtgtggtcagagtggaggtgggtgagggtttggaggaagtaagggtgaaaaatgagaagggattgaaggaattgagcgagggatggagagagagtgacaaaatgaaggcttatacaacgactgttttgcctgaaaaccgtcataggtggaaagcaaaaaatatgccaacaaagacaatttttgcatcaaattttaagacaattttttag

SEQ ID NO: 74372 - DNA, 288 bp, Glycine max
  Peptide Sequence Number=SeqID_191150
atggagatgaaaggctctgtacgcgggacgtcgggatgtatgcggtttataggcgttcagaatccagacgatgtcaaatccagagagctttctcttggccaatgctggagttggttctacaacactatcaatgatgcatcccttcatactctgagaggagatgctggcatcattgaatgtgcatatgttgcttcacaggggcaaaatgacgtatggggttttttttacaaacttattctaaaaaatgatccctttttaaatatattcctcaaagggttttttttgtaa

SEQ ID NO: 74373 - DNA, 408 bp, Glycine max
  Peptide Sequence Number=SeqID_191151
atgtcctcgccttccgagggctacatgtccttgcctttagcaggactacatgtcctcgccttccgagggctacacgtcctcgccttcagaggactacacgtcctcgccttcagaggactacacgtcattgccttcagagggctacacgtcctggtcttaagagggctacacgtcctcgccttcagaggacaacacgtccaagtcttcagagggctacacgccctctgtcataccctaatttcgtccggagaccttttcttggtggcatgcaactttcatttaaccattttgaggcccacttgggccctccagaagattcctccagaaggcggttgcttctggaggaagtcaccttgctcgcctgggcgagctgggttgcaagcatctcccccattttgctataaatag

SEQ ID NO: 74374 - DNA, 243 bp, Glycine max
  Peptide Sequence Number=SeqID_191152
atggaagggccaatggaagcaaaggcacgaaggaagcgtagctgctatattcaggagcaacccgccagccatgttggcgatccatgggcaaggcaaatcgccattaccattggcgatttggccttgactgacgcgctctgcccttcactgccatggcaggctactggtgcaccctcagctgttggaactcgccagtttgactggcggttcccaatggcttctgcaaatcgccattacagctag

SEQ ID NO: 74375 - DNA, 150 bp, Glycine max
  Peptide Sequence Number=SeqID_191153
atgggaatgggaaatggtgaacggagtgagaatggaaatagaatgggaaagggcagtggtaacacacggactgaagagcaaagaagcataaaagagggtttattattggacatgtggcaacacacgacaatgagcaaagaagaaggataa

SEQ ID NO: 74376 - DNA, 447 bp, Glycine max
  Peptide Sequence Number=SeqID_191154
atgaaagattgcaaaaatacaagtggtgaggatgtctccttcacctctaggatctcacaatcactcacaaactcatctcaagctctcaaattggctcctgcttcaagctctagtctctgcagatcttcacacaacaaaatttctcaaaaactctctggaacttggacctttctctctctagaatatctagacatgcaaagttctgaatcccagcccaaactcgcttcacaaaatctgatttctggcttaaataggtggccttgttcgtgctcgaaagaacacactttacggtgcccttaccgaacgcatgccaaagctagagtgatgagtgaaatagaggaggtacaacaacaaatgaaggccgacatggaggccacgaaagagaaaatgaccacaatgatggaatccatgatgagtgatgtgccattattttctcctatctcttaa

SEQ ID NO: 74377 - DNA, 225 bp, Glycine max
  Peptide Sequence Number=SeqID_191155
atggaggtcaacacgactacaatcgttactacaagtatcgccactaaggtggacctgactcacccatctggccttaatcaggtccagagcaagcattccttcccaccatatggcttgcctcctaactatacaccacccaatgtttcacacgctcccgatgagaatgtcgataactctgctctcatacccattgagagccaacatccccaatctggtcatgcatag

SEQ ID NO: 74378 - DNA, 348 bp, Glycine max
  Peptide Sequence Number=SeqID_191156
atgaagttgaaatctctttcccttgtgaagtacatgggagtcaaagatatcgatatggaagtgtctatactttctccttgcgagtcttttcaatctttagtcattcaaaagtgccctggttttggtagtgctagcctagccatgattaattgtgaggctggacttgtcaatgtaaacctcactggtttctggaacttgacaaataacatagtctcaaccttggcttggctatatggtggaaaactcgaagtactaaatcttgatggatgcgggaaaattaccaatgcaagcttggtcgtaattgcaaacaacttcatagtgcttaatgatctagatgtgtcaaactga

SEQ ID NO: 74379 - DNA, 441 bp, Glycine max
  Peptide Sequence Number=SeqID_191157
atgaggggcatcgtgcatgagcctcaaacgaacctaggcgcaaatcaaaataccctcaccttcagagggctgcacgccctccccttcagacgattgtgcatcctcgcctttagaggactacatgtcctccccatcagagggctacacgccctcaccttcaaggactacatgtcctcgcctttagtgagctgcactcccccgccttcagagggctacacgtcctcgtcttccgaggactacacgtcttcaccttcaaaggactacatgttctcgcctttagatagctgcactccctcgccttcagaggagtacacatcctcaccttcagaggattacacaccatcagaggactacaagtcctcgcattcagagggatacatgccctcgccttcagaaaactacacatcctcgccatcagagggttacatgccctcaccttaa

SEQ ID NO: 74380 - DNA, 280 bp, Glycine max
  Peptide Sequence Number=SeqID_191158
atgccaatctccccctgcagatgtatcagttgggatcgcgcccacaaggcgtccagtggacccgaagaagtccaacagggccctggggtttccagatctggttacgggcctctgtcagtcctacagggtgcccattcccccaacaaggaatcgcacccacaaagacactcagtggacccagagaagtccaacaggggccctgggggtttccagctctggttacgggcctctgcagtcctacagggtgcccattccccccggcaaggtcacgtcatcatag

SEQ ID NO: 74381 - DNA, 558 bp, Glycine max
  Peptide Sequence Number=SeqID_191159
atggaagcagaaacgcaaacgacacaacaaaaaggagaagaggcttacctcgacggtcgacagtggagcagcgtaatgcacgtcctcaatgccaaaagagaagaacctccaaagcaccatgaacacgccaacacagacaacaaacgcaagaaggagataaaaagggggcgggttgaagaagaagaaggggctgaagataaaggggcactcgcagttgcggaagaagaagaggctgggtgcacaaaagtttttaaaaaaaggccagggcaccattttatgcctccgtattacagcacaatgagcttccatttgtgccgccaccaatcttcttcccttccctccgtttgcgtcgccgctattcttcttcccttatgtcagtgtcatttgggctttgatccttcttttcctccgtcggcattgtgtacgtgctccaccgtcgaggaaataggtttaggcttacagatgaagtattttgtaggattgtacatatggatcaagttgatctgtatgaggtttagggatcaagttgatccgcaagcctcatacggatcaacttaa

SEQ ID NO: 74382 - DNA, 237 bp, Glycine max
  Peptide Sequence Number=SeqID_191160
atgaatgttattgccgttcatgtgtcctccattttccagtttggagttgtgtttcatgattgcctaagtgcggaccctcaaggcaatcctccattctccccgctttttcgaagctccatgaattgcgtttacgttcatgtgtactccactttcgagtttggagctgtgtttcatgattgcctaagtgcggaccctcaaggcaatcctccattctccccgtttttcggagccccatga

SEQ ID NO: 74383 - DNA, 174 bp, Glycine max
  Peptide Sequence Number=SeqID_191161
gctaagtgcgcatccaccgctaagcgcagctttagcgcgacagaagaatctgacagagcatcaatatcagggtcgcgcgctaagtgtgagatcagtgcgctaagcacagcagttgtcttcagccaggctcagcgcacgactgacgctaagctcaaatccacttactcacgctaa

SEQ ID NO: 74384 - DNA, 368 bp, Glycine max
  Peptide Sequence Number=SeqID_191162
caacgcctgatgaagctcatatcatcttcaagcctagtaatcctggtatctatggcatcgaagcgctcacccacaaaagctcgaaggtcacggagctctgtgggtacttcagtcagaagagaagtggaatcagccctttatggtggaggaaatggggtacgttcgtcgagaataggcggtggcaagtcctgtttgcgaacccactgaccatcaacatcctttcgataaccaaaggaggtaatcgcaccggcaacaatggaaaacaaccttttaaccttgacatatggttcatcatccaaaggaacattgaaatgatgaagaaaaagagtaacaaggtggggataaggcagaggtgcattggcccgtaa

SEQ ID NO: 74385 - DNA, 348 bp, Glycine max
  Peptide Sequence Number=SeqID_191163
atgtcaagagcaccagtatcttgttggatgaaaaatgggcagccaaggtttcagactttgggttatctcgaattgggcccacagattctcagaagtgactgcattgacgttggaacttaccgttttgttcttgtcctccctaaggctgtaaggctcgatcatgcaattcttaacataacactctcatgcatccatctagtcaaccttaattgtgatgattttcaattcccaatggacgaagtgaatttcatggccaagtgtggtgtagacacaatggctctaatcctgttgagggtaggtcttccaagcaagatgttgtacgatgtatctacatctaccagcacgtag

SEQ ID NO: 74386 - DNA, 270 bp, Glycine max
  Peptide Sequence Number=SeqID_191164
atggctggaaaagcatgttcatcgttgcctgaaagttggaatgggaaacctgtcgcgtactgtgatggcgttgagggcgcggtagtccatgcagaactgccacgagtcatcatgtttgcaaacgaggagcaccagagaagagaagggactggtgctgggtcgaataagacccttctgcagcatggattcgacctagagttcaatctcctgtttctgataatgagggtactggtaggggcgcacattaacaggggtagcttgcagaagtaa

SEQ ID NO: 74387 - DNA, 270 bp, Glycine max
  Peptide Sequence Number=SeqID_191165
atggccaagctcggatgtggtgaaaagttgaagaataagaaggttgttggggctggtgtcccgctaagcgaggcttgtgcgcttagcgagaatcattcgctaagcaaggcactcatctcgcttagcgagttcaaagaatttgccaagcatctgcgcactcagcgcgtcatcagctcgctcagcgagtcatttgtcttctctcgtgctaagcgtgcccagctcgctcagcgaaaaatcacttactcgcgcttagcgcgaaaatggcactaa

SEQ ID NO: 74388 - DNA, 2481 bp, Glycine max
  Peptide Sequence Number=SeqID_191166
atggctacctctagctcatctggtgaggatgattctactccaccaccaccaccttccttcactgatcccaataactatcgccctttgcctccttgttcttgctctgcaaaaacttaccaccaacaggattttatcattcgtttccttaaaggccttgatgagcgttttgccatggccgaggcaacccacaacaaggggggaccaaatcaacacgtgaatgtgacttttgtggctgcttcgtttgggtaccctcatggacatccgaaatatccaagtcacccacgtctctctaacaacaaatatacctccggtggcggcacaacctcttcaggtggaggtgcggtgaacagcgctgaagtggtaaccccaacccatggaggagaaagcaagaaagaaagctcaactcaggatcatgggtttcacatcacaatggcccaataccaagaattgatgaatcttctcagcaaatcctctggacctggtggtgcaagctcagagactactcttacgcgagccaacctcactcattctagcccaaatcaaattcacaattctggttttggtagtcattttgacatgagcacgttgagggcgattcgtttgactgacttgaaggaaggcctttttcacttgataattggaaaggatagaagcccatctaccaacaatatcaccaccaccaacaccaataactctaagctttggcattttagattaggtcatttatctgatggcagtattgagcgttacaaggctcgtcttgttgccaaaggatactctcaaattgaaggcatagattactttgaaaccttctcccttgttgttaagatggccactgttagagatgttcttgctctagcatcgattaatcgatggcacctccatcagttagatgttagcaacgctttcttacacggggacctcagggaggatgtttacatggagatccctcctggcttgcttggttacacatcaattgcacattctgataaaggaatttcattatgccaacataagtattgtttggatttactgaaagattctggtatgcttgggtgtaagccattctccactcctatggacagttctcttcgactccataatgattcctctggttttcttgatgatcccctatcttatagatgcctagttggaagactggtctatttgacaagcacacgccctgatattgcctttgctacacagcaactaagtcaatttatgtccaaaccaacaaaagcccatcatgctgcagctgtccacgttcttcgatatcttaaagggtgtccaggccaaggaactggtcctcgaaaccaacccaagttatctctaacatttggtgctctcattcccattgtcgaccaacctctatacggcaacccacattcaccactcgaggccgtcatcctcaagctcaccaccctacaggtttcccttggtcaaaccgttcagtccatggcccagaaattcgatgaactcttgatacgtttaccctccatctcatcttctccatcctcgcaacctattccctccatctcccctgtacctgtacatcaacaccgcatgaaattagacattccacgcttcgatggtactgaccctttggctcttgcttggtttcagtggatggccactaatggccaactcacctcctggctcgccttcatccaagcccttcagacccgctttgccccttcccattatgacgaccccaccggtaacctcttcaagctcacccagcgcggctccgtgacgcaatatttatcggagtttaaggagcttgctaacagaattgctgtgggtcttgctcgtctccaggaggagaagctcctggacacgcgcccaaccttctgcaaccgcactctgcccgcgctttccattcctcaaccccgtcaggtgacaacccctgcccttcttcaagctccttcttcacctgctccgccaccacgcctacctccgctagtgaagcgcctatcaccggcaaagatagcttctcgccacgaacgagggttgtgttttacatgcgaagagaaataccatagaggccaccggtgtgcctctagggttttcctgctggtagcggctgaagatgagaaccctgatccttatatagaggacttggacccggctccggaatcgcccgatagcccgaacccgaccacggcccaaattagctttaactcacttgcgggtaatttggcacccgaaactctccgcctgttgggcacgaccgccagccaccacgtcgtcatcctcatcgatgggggcagcacccataatttcatccaggaagacttggttcagcggataggcctccccacacaggatactacccccttgcgggtcttggttggcaatggccaacacttggcttgttctcgatggtgtccacgtgttcctctcaccattcaagaactcacctgtgaagtggacctctatgtcttacccattgtcggcgccaacattgtccttggcgtttaa

SEQ ID NO: 74389 - DNA, 2028 bp, Glycine max
  Peptide Sequence Number=SeqID_191167
atgaattgggcaaagcttgttggttttcgaaactcgatttgttgcaaggatatcaccaaattcgtatgcattcctcaaacattgctacaacggcctttcgcactcaccacgaccactgagtttaaggtggaataccttggccatgtggtctcccaacgaggggtggagccagtcacttccaaggtggatgctgtgcgccagtggcccactccgcactctgctaaagccctctgtagcttcttgggcctcgccagattttatagaagattcattaaggggtatgccactattgcagccccattagttgcggccaccaccacaaagccctttcagtggactgcacctgcccagttagcattcaaacatctgaaacaggctctgtcggaagcccctgttctcacccttcccgactttcagctgccattcacggtcgagactgatgcatcaagcatcgggatggctgtttacagtgacgacggcggtcaagaagtggtgcagactcttgagcaacacatgtacctgacccgtttgatggggtacgactaccaaattcagtttcgttctggtgccactaaccaagccgcggatgcgttgtcccgccttcccgaggaggagtcttccctctccctcgtcttatcagttccttgcttaatctttatggaggaattgtgcaaacagttagcccaacacgagacttaccagacccaccttcaggcaattcaaatcactcccaccaagtttcctgatttcaccatctcaaacaatctcattttacgcagaggtcgcatatggcttcccccacacatacccttgattactaccctcctcatagagtaccatgcgactccaaccggaggacatcttggaattgctaaaaccatagcccgtttaatggacaacttctactgggatggtttacgagacgtcatggccaaatttgtttccagttgcctggactatcagcatgccaagtatgagaccaaacgcgtcgctggactcttgtgtcctctgctagtttcacaccgttcatgggaggacctctccttggactttatcactggattacctgcttttcaggggaataccgtcgtccttgtcgtggttgataggttccctaagggaattcatatgggaatgctaccaacttcccaacagttctggcaagacttatttcgcctcagtggcacccaattacatatgagctcctcctaccatcctcagagcgatggtcagacagaagctcttaatcatgtcattgaacaatatctcagggcttttgttcaccgacgaccaaactcgtggggtaagttgttgatgtgggttgaatggtctcacaatacctcatggaatgcagccactggatccaccccatacgaaataacatttggcaggaagccctttaattaccctgagtaccttgccagaaaatctaagctcgatgttgttgatgatatgctaaccacgcgcgaggatacctttcgcctgatacgaaagaaacttctcaaagctcagggattgatgaagaagtacgcggatgctaaatgtagagactttgtgtatcaggttggtgattgggtcatggtcaaactcagaccccatcgccaaacctctgccaaacctcaatcccacatctccagcaaactctcgaaacatttttatggaccattagagattattgagcgcattggccctgtggcctatcgattaaagctccctgaggatgcccgcatccaccctcccctcatctctctagtagccattctggactaccgtcgtagctcgaccactgcagggtcaccatgggaagtgttggtgcaatggtcaggtcttgctcctgatgagacttcctgggaatcctggtcacagctatgtcgcgattaccaccttgaggacaaggtgcatttccaaggcccgtgggatgatagagaaacagaggtgcaacaagcaattgagaaagaacaaggtgcaaacaacaacagagaggaagatctgcaaggattgttgtcgaggatcaggggacaaccataa

SEQ ID NO: 74390 - DNA, 465 bp, Glycine max
  Peptide Sequence Number=SeqID_191168
atggaagaggcttccataatccaaagctttcaaaagcagttaaaggttctccaaaagagaaatgggaaagaaaaggtcgtgttaagacagaaacaagaagtgaacctcaaggcactacgcgaggaaaatgatgccattcaagctcagtttcaagcgccgaaggccaacatagttccaactcaacgaggagcaaccaagttggaacattcctcacatgaaaccaatcatcatgccatcaccacaggacaatctcagcaaaagtcctatggtcaacctactgaggcgtgtcatcaacaccttttcgtcatcttggatataccccttcccctggggtggaggccattgaacatttactactacaatggaactacagatcccaatgagcacattgaagcatatgtgatcaacactcaaaccaaaagcatttgggaacaacctatgcaagaagaggctaacaagcattga

SEQ ID NO: 74391 - DNA, 570 bp, Glycine max
  Peptide Sequence Number=SeqID_191169
atgtatggctggtctctaacatttttctccatgaaagtagacccgactgtcccctacaaggtcatcgcatgtgtgccgagaaagggaaagcgaattgggagcaactcttggcgggtatggaagggggcgtccgttaaatggttcccccgatggaaagaaggaggggcaagagttttgtgctcatgtgaagggttcccaaatgtccccttgatgggaacaagaggttgtattaattataatcccatattggccataagaaagctaggctaccctatgagaggggtgccattggaagagattatcacacctttcatcgcacgaggtttctatgaaggcaattcaaatgtgcttcaaagagttcaaaaagcgtggaatgctgtggaaaggaaagataaagagcttagagtaagcaacaacgatgttattggtggctatcataaatggttgaaggctcggatgcaagggataacttggctcccgaagctaaagatttcaagtggtgaagaagccgaagtcccggaggagagcgaaaaagtgcaagccttgaaggcagaacttgaaagaacgtga

SEQ ID NO: 74392 - DNA, 285 bp, Glycine max
  Peptide Sequence Number=SeqID_191170
atggcatattctgatcaaacaacggaaattaaatattacgagcgtacttccagccattgcaaatcgaacagaagtgggtttggtgatacaaaattgagagcaccatatcctatttatagagtatgtccatcacagagctcaaccaacttgttatcagaacgtgggcttgaggatagaaaattgagaaagataatgaaagatgaaaaagaaattgatagaaataaagtaccagttgggattgaaggatctgagttcgtagaaatggaatcatcgatgacggcgtag

SEQ ID NO: 74393 - DNA, 396 bp, Glycine max
  Peptide Sequence Number=SeqID_191171
atgacctcattaaaggtggtcattcagaatcttggaaaaagattagtcataaataacctggtgtcagaccctaatttcgttcgggaactatcattcgctaatgttttgattcttgctaaccgaaaggtattgttcgacaccaatttctgctcaaggcgtgagatcgttcgacgttttggtcaagaatgcggaaaatatccaatgggaggggcaaaagggtcatttcaggcaattttttggaccctggctcgccaggctagcctttggctctcctgggcccccaaattgcttagggttgaaggaaccagcttgactgggcgagccagtttcttctggactaagctccagctcgcctgggcgagctgccatagtcccaaatgccctcatttcctataa

SEQ ID NO: 74394 - DNA, 162 bp, Glycine max
  Peptide Sequence Number=SeqID_191172
atgagtaggtcagaacaaccacgggatttgaagacgttagtattcctctcatttttcgctcaatttttttttggtggtgaagtgaatgacaatgagaaaaatgccatagggatggtggtaattagaggaaatagtgtgatcattgttgaggtgcttaattga

SEQ ID NO: 74395 - DNA, 255 bp, Glycine max
  Peptide Sequence Number=SeqID_191173
atgaaagcgaagaaaagaataccaaaagtaaatgagatgaagaatgaaagtgaacaaaacaagaatgaattgaaagcctcggattcaaaaacttaccgattgaagatcgaagaatggcagaaaatcttcacggaatcgctcacaaaaacgtctggaagcgttacggaagcatttcggcttggatttccttccgtttttcacttcttttcgctaaaaacaactgaaatacacagcatagaggtcagggacccttga

SEQ ID NO: 74396 - DNA, 135 bp, Glycine max
  Peptide Sequence Number=SeqID_191174
atgaacagcgctaggcaatcaattcatgggactccgaactcaatgatggacgatgcacgaacagcgctaggatgcatgaacagcgctaggcaatcaattcgtggggctccagactcgatggtggaggatgcatga

SEQ ID NO: 74397 - DNA, 261 bp, Glycine max
  Peptide Sequence Number=SeqID_191175
atgattccgctaggatcaaagggctccactccatgtggtggtccgacagcaagcgttggcagctcatggtgtttgccggtggttgtgggtggagaaggaggggagtttatggtttgggtgagggtttacgagaagaggggtagaagaatcatgtttttctcgttgctgaacatatttgtaaccccgttaaactcgcctgggcgaaattttgctcgcttgggcaagctggcccaactcaaactcgcaaaaggttgcttctaa

SEQ ID NO: 74398 - DNA, 453 bp, Glycine max
  Peptide Sequence Number=SeqID_191176
atgaccaaggctgtagtttggcacaagccacaaaagaaaagtgcacagttcatggttcttgtgtgtatcttgaatatctgcatcctactctctaagtcaggaaagccaaactcaactttacggtccaatcgcccaggccgcaatagtgctggatctagagtgcatcgaaccgcaacccaacccaaacttgaacctgtgcctccgtccattggttcgcctagcaccagcggcgacacactatcggagttcaacattggcgtgttcaaggacatggccgtggtgtccgagtcagcgagggagccatcgtggaaagacagatctgaaggtcacgcggtgggcggttcacggcacacgctagcatatggttacggtgttgctgccagtgatggtgcttcttctctatggcagcttttggtaggttctggttctacattgtgcctttccatattctag

SEQ ID NO: 74399 - DNA, 786 bp, Glycine max
  Peptide Sequence Number=SeqID_191177
atgggtcgccaagccacgcaagaagatgctcatgtcaagaagaccattttgaacaattcaggcagcgtcggtatcgttccgctagggttttggaagaacaatggctgctgctgcttctccagttctccctcaggaactcatagtcgaaatcctgtcatggcttccagtgaagcctctaatgcgattcagaacccatcatccactgtcatcgatggttgccaccgattcaagtactacaacttcgtcttcggtgtctgcaatgggttggtttgcttgtttgattcttctcacaaagatggattcgaagaataccgcatccggatttggaacccggccacaaggatcatgtccgaagattttccgcgcttacgtctccattcaaacgattgtaaagttgtgaattatcgtcgtgcttgtgagtacacaaagtttgggtttggatatgatgatttgagtgacacttataaggttgtggtaattctcttgtatggtaaatcacagcaaagggaggttagagttcgctgcttgggtgacccttgttggagaaagattttaacttgccctgcttttcccattctaaaacaacaactttgtggacaatttgtggatgacactgttaactggctagcgcttcgcaggccaggttctgattaccaatgggaaaccgttgctatcaatgagttagtgattttttcgtatgatctgaagaaagagacatatggatatgtgttgatgcctgatggtctttctgaagttcctgttgttgagccttgtcttggggtttga

SEQ ID NO: 74400 - DNA, 519 bp, Glycine max
  Peptide Sequence Number=SeqID_191178
atggggtacaagtggatcttcaagaagaaatccacattgtccagtgaatacgtcattcattataaagcacatctagtagctaagggctacaatcaaaaggaagaagtggactacagtgagatgttctctccaatagatcgacacacttccatacatgctttattgaccttagtggcaactctggatatggagttataccaattcgatgtcaaaacttcctttccccatggtagactgaaggaagacattctaatgcaacaacctaaaggttttgagctggaaggaaaggaaagttttgtctatagattggagaggtctctttatgggttgaagcaatctccaagactatggtacaagagattcaatgagttcattgtctctcatgggtacaccataagtccctatgactcatgtttttatcacaacaaggtgaaggatgatttggatgcaagaagatctgtgactagatatgctttcacgattagcaactctcttgatagttgtaaggcaatactttaa

SEQ ID NO: 74401 - DNA, 426 bp, Glycine max
  Peptide Sequence Number=SeqID_191179
atggtgaagggaatgaataaggagaggaatggaaggaaaagagaccattctgtagcagcgagaagcagagtagcggatatgaagaagcaagcatcaagcactttcctgatgtgggttatggtgatatcgcttcacgcacatctcatcattgcagctgtgtctaagtctaatggcacaatttccgtgtgcgatggctccgtagaggactgcctcaacgtcgtccacttggactcagagcttcttcccaccatctccagctcccacttccgcagaatccttgctggaaaatatgatggagttaccaacgatgcactaattcctgataaacccttcaagggatgtaaaatcggagaagcttatcgtagctgtctggcccaagttgaaggtagagcgagaaactgtgccatctacaagaggggttgctaa

SEQ ID NO: 74402 - DNA, 720 bp, Glycine max
  Peptide Sequence Number=SeqID_191180
atggagagtgtatccgctcttatgtgttgcgatggtgacacgattccatcatatgaagggataatgtttgaatgtcctagtgatcctaaagtcatcacaataagtgaggacatgtcacttgatgccttaaggaaaacaattttttacgccaacgaaggttgcaaatttttacttgatcttttttaccatcaaccaatctatgtaggtgatgattgtgttgaatacgactatatggagctcaaacacgacaatgatgtgggaaaaatattttttatctattcagaatttagtatcaaaggtctaattgagttaaatgcaacttttgagcgttctctagatgaaatcattgccctaatgcacaaaccaaggaaaccaagaacaactgctaagatcattgctctgatgcgatttgaatctgactctgacgttctcctcaatgtagatggtgccgaagcctccctcgccgaggatgttagtcaccacaaaagctcttggttattgtctccaacttgtagagcgggaacgcaatcacgtgcgtgtagagcagtgtgttgcttctattgttaccggacggtgtggaataggattgcgctgacagcgttccgtatcttccacttgaaacacaaatctagaaagattatggagaagcagaggaactgcggtgtgtcgtggaccgtggttggtggcgatgtaggactactgtcgttgctggcgaggtag

SEQ ID NO: 74403 - DNA, 447 bp, Glycine max
  Peptide Sequence Number=SeqID_191181
atgaccactaaccctaaccctaggtcagagacacttttaatttacaccaatgcgttagagacatttttgctttactttatgtcatggaatccaatgcttcaaatccttaaccctaaacctaacattaggtcagggaatccaatgctttacatcagtgtgttagagacactttcgctttgcgtcagtgtgtcaaagacacttttgctttacgttagtgcattagggaatccaatgcttcaaaccctaaccctaaacctaaccttagggaatccaatgtttttcgttagtacatcagagacacttttactttatgccagggaatatgatgcaatcctccctaggaaaggaccagttactagagccatgagcaagaggctccaagaggattgggctagagctactgaagaaggccctagggttcttatgaaccttggggtagatttctga

SEQ ID NO: 74404 - DNA, 306 bp, Glycine max
  Peptide Sequence Number=SeqID_191182
atggctaaacttgggctgaactctggggtgggttttcagctggttgagtctcccccacaggatttgaagcctctcttaatggcagatgccctgggagttgaattcctgccaggttgtgccattggaggcatagttgagcatgcggtgaagaggaagcgttttggaggaagaggagaagatgaaggaggggatcagagagttgtgattatgacacggaaagctcccaaacggttagatagcccaacctggtggttgctttcggatcacaatgttctcaaaagttcagtcatatgctgtttcgaatga

SEQ ID NO: 74405 - DNA, 468 bp, Glycine max
  Peptide Sequence Number=SeqID_191183
atggatgactggaacattccagaaatccctcaggatcaactatacgttcctaaaacaattaaagacaaacacaactttgattacataatcaaaacagtagaaaacaatattcctctaggacaagatataggggaagaatttcatctactttcaaaaaattcaatttatgaacatagccgtaagtataaatatctacacatcggttgtgtacaagtagccatcaagcccttaattgatatgggcatagatgcagcagttttaatgtgtctaagagatattaggcataatcaatttgaagactccctaattggaacagtcgagaccagcctaggacaaggtccaatatattttaattgttatccaaacaaaacagcgagtctgatggacagaaacattcttgactctctgttcttaaacatccactttcatggccttggcatgaaagaagtttacttaatccttaattga

SEQ ID NO: 74406 - DNA, 294 bp, Glycine max
  Peptide Sequence Number=SeqID_191184
atggcggcagccatgtacatgattggccattgttttgattctaatcataacctttacacttctcatgatcaacatagccaaactgccaacaatgacaatcgttcacctctcaatcaggtcattatgatccgcataaaggggacaatctgcaactgtggctttgatctttactatgacatgtattgtacaacccacgaactcgacaggaacaattggcgcccagcgcaggaccaagtaaattcagaagatgagaatgttaagtacttaacctatcagagctattctttgatgtaa

SEQ ID NO: 74407 - DNA, 306 bp, Glycine max
  Peptide Sequence Number=SeqID_191185
atgttttggagtcggcaaatagaaaatggaggattatatggagtgctgtatcttgtgttatatggaactggaggaacaacatggtgcttagaggtgcaacctttcaccgggataaagtatctttatttttggcctgagttcgtggtgctgaaagctgcgtatcagatgcttgtaggattgcttggtggattgtttatggtctgctgcggtttggctggagttggtccttgtggtgaggtgctgctgtatttagaggtcaggggcgttggtgtttgcttggttatgccactggttggttacgtgtga

SEQ ID NO: 74408 - DNA, 252 bp, Glycine max
  Peptide Sequence Number=SeqID_191186
atgcttaaacatgaagacatctgtatgtacaatcatactcaaaagcatataaggttagcaaagggcacttatagaagatgcgcatgcatggatacataccgtagagagcttgttcaaggtgccatcaatctagacaaagtaagcctccaagagcatctcaagctcctcgacatcaagttgcttggtgatggcactataggtggcgttgtcgcgggttccatggttgtccctaccgagaacattgtcgaatga

SEQ ID NO: 74409 - DNA, 753 bp, Glycine max
  Peptide Sequence Number=SeqID_191187
atgttgattgcgtccagatgcaaggcagatattgaggaagttaaagtgctattggaaagggaatttgaaattaagaatttgggtgctgcaagtaagattctagggatgcagatcacgagggacatggtccagggagtgttgtgcctggatcagaggagctatgtagctaaggtgctgaagacgttcaacatggatcagtccaaggcagtgttgacacccatggcccaatatttcaaactttctcatcagcattcacctcagacgaaggaagaagcaacatacatggagaaggttccatatgcgaatgcagtgggcagcctcatgtatttgatgatccgcacaaggcccgacctggcatatgctactatgctggatgcctcgacactagacggtcacttactgcatgtggtttcactatccacaactgaagctgaattcattgctctcactgaggcaatcaaagaggctgtgtggatgaagggtatggcaacgagcttgtatactaaggtgaatggtgttaaggtgtactgtgacaaccaaagtggcattcacttggccaagaaccagacgtaccatgagaggacgaagcacattgatgttaagctgcactttgtgagggaggttattgcaaagggggaagtagtcgtcgagaagatccacactaaaaacaatccagcggagacatcgacgaaggcattaccagggcctaagttcaaacagtgtgtgcaaatcatgaaggttgaaggagcatga

SEQ ID NO: 74410 - DNA, 1692 bp, Glycine max
  Peptide Sequence Number=SeqID_191188
atgaggatcaagcgttgttgctgctcagatcattaccaagtgagtatgatagcctctcagacacgctcatatatgtcattggatgaggcgaaggctgccctattttcgaaggagttgaagaagaaattagagggaggtggctatcaggacgctgaaggattgtacacgaagggcagaatggagaagaaggatcccaagaacaagaagggatcaagatcgaagtcacatgatggaaggaaaagaaggtgctttggcaatcaaaagagtcagaatggtgatgcggacgtggctgtagaagggtatgacagcacagacgtcatgtgtgtttcagacgtgaagataaaaccaaagtgggtgctggactctgggtgctcattcgacatgtgccctgagaagaactggttttgttcgtatgaagaatgcaacggaggccaggttcttttgggtgacaataaagcctgcaaggtggttgggattggagctatagagttgaggcttgcagacagcaccatcaggacactgaaggagagtcctgaaggtcacgaaggttcattagtgatcctgaaagggagattggtgcatggcttgtatctcctagaaggaaacacaacatcgttcaacattgcgtcgtccagcactaaatcatctagtgctgctattgtgactgcacagatgcactctcaggcaagtctctggcacaagagacttggtcacatcagtgaaggaggcataagagaacttagcaagcagaagttgcttggcaagaagagtctggacgcattggagttttgtgagcactgcatctacggcaaggccaagaggttgaagtttgttgttgctgaacaccatttgaaggggactctggactacatccatagcgatctatgggggcctacgtatgttctttcacacagtggagcaaggtacttcctatccatcattgatgatttttcgaggaaggtatgggttttcatccttaagagtaaggatgaagtctttgctaagttcaaagagtggaaggtgttggttgaaactcaaactagcaagaaggtcaaaaagctgaggactaacaatcgtttggagttttgttctgatgaattcaatcagttctgtaaaaggaatgagactgaaaggtatagaaggatcaagggaacacctcaacagaatggacttgcaaagaggatgaaccaaacgattatggagagagtcagatgcttgttgtctgacagtaattgttcggggcatttctggggtgaggctgtgatgacagtctgttacctcatcaataggtgtccgtccactgccaccaacatggtgactcctgaagagatgtggagtgatcattcacccaacctcaagaatttgagagtgtttaggtgtgtgacatatgctcacattagacaagacaagcttgaaccgagggccttgaagtgcatgtttctggggtacccacaaggagtaaaggggtataggttatggtgcatggagaaggggcatgttgtgttcaaggagtctgaaatgtatcacttgaaggaggattcaagtaaagggaaggcagtgtggacgcaggagagcgtccagttagaggtggagtctggtgcaggatcgtctagtgcaggaaggggtcgtccactacttgggtctacaagtgctgaagtggagcgtccagagcatgggtcgtctggtgccaga

SEQ ID NO: 74411 - DNA, 243 bp, Glycine max
  Peptide Sequence Number=SeqID_191189
atgaccataatttgtctccgcatgtcatcgggctcgccgcctctggatgacacaagggcgcagaatgaccattatttgtctttgcgtgccatcagacacgatcgagcctggatggaaaggcgcagaatgaccataatttgtctctgtgcaccatcggacacgatcgcctctggatggggaaaaggtgtgcggaatgaccataatttgtctctgcatgtcatcgagctcgccgcctctggatga

SEQ ID NO: 74412 - DNA, 303 bp, Glycine max
  Peptide Sequence Number=SeqID_191190
atggttattctgcgccctttgtcattcaggagcaacaagtcgagtgataaacgcgcagagacaaattatggtcattctgtgccctttgtcattcaggggcagttccgctggcggggagtttgtccggctgaatggtgttccactcgaacaaaattagtgtcttatctttacatcccttttatctccaataaaagacaagtaaagagaggcaactgtcataccctaatttcgtccggggaccatctgtttattgggatgcgaccctcgcttgatcacttcgaggtacttgacgcccatcattag

SEQ ID NO: 74413 - DNA, 862 bp, Glycine max
  Peptide Sequence Number=SeqID_191191
gtcgactctagaggatcccacgaaggccgtcagggcccaggcggtcgtacgcacctggtcagcccggaaatggctgctgccgctgcgattgccggccactttgtggactttttgaagtcgatcaagcgctctggctttggtccttacctgtttgatgaatggcgctacaccaactatggtgagccaggcatggattgcagcacgcgtccgctaaacccggattttgtgttgaatcagccacgctaccagggggcacaagtcctgctggcacgtgataacttcggctgtggttcctcacgagagcacgcgccatgggcgattgaagatcagggttttcgcgtgattattgcgcctagtttcgctgatattttctttaataactgctataagaacggtattttgccgattgtggcttctgccgagcaggtcgatagcctgtttaaagaatgttttgcaaatgagggatataagctcagtgttgatctggaagcgcaaacagtgaccacgccttctggtcagtccttcagtttcgagattacacctacccgcaagcacaacctgctcaacggtttggatgaaattggcctgaccttgcaacatgcggatgagattcttttgcctggtgatggcatcggcccggaaattattgcgcaagcgttgcgtgtactggaagtcttgaaaaaagagggtctggacatgacctttaccgaggcgcccctgggcggccaggcttatgaccagtacggtcatccataccctgagtttacgcaagaaatctgtcgcaaagccgacgcggtattactgggcgcggtaggcggtccacaatacgacaacctgaatcgcccactccgccctgagcgcg

SEQ ID NO: 74414 - DNA, 426 bp, Glycine max
  Peptide Sequence Number=SeqID_191192
atgtctacctcgcgagttcctgactccaaaggttctattgctcggattgcctcgacaggtataaaccctacaatccccagggggagaagaattcctatcaaatcatcctttgatgatttcaaagcttggcttgagaattacaatttgactcatctttacactaaaggagcattcacttggagtaatgaaaatcatcgaataggtgtggggtcaattgttcctagctcccctatgttcattctgacacacaaattgaaacttttgaaagttgccctcaaatcttggaacaatgattcttttggaaatatccatgactcgattgatagagctaaaaaggagttgtcttctattcaacttctcattgatcaaaacagaccctcagtggacttagtcttgcaagagagaagagcccaagacaacctttaa

SEQ ID NO: 74415 - DNA, 207 bp, Glycine max
  Peptide Sequence Number=SeqID_191193
atggcgaggcacaaacataggtttggagactataggaaaattgctgggggagggataaggacctcaatgtctgggtgtggggacggagtaggagcgaaatctgttgggggcaggaagccccaaaggcagatcgacagaggagtcaccatggtggggcagtgcaccctaggaaaatcgaaagggttaagacaagcagacgggtcttga

SEQ ID NO: 74416 - DNA, 532 bp, Glycine max
  Peptide Sequence Number=SeqID_191194
gtcgactctagaggatcccaccatattgcctggagtagatattagcaagttcaccatcgatcatttccatatgcactaccaacaatatataatgaagcctgatcatattgacatgcaattgcataacctcactgatttgcttcgggtcttttacttacctcctgatgggatgccaagaagagaaaaagaaacagtgaagcatctctatagtgcaagccagctagtggaggcaggtgtgaagctccatgttggtaaaaacaaaagtgcactagagttacaatttgaaaaaggtgtgttgacaataccaagatttgaagtttgtcattggactgagattcttattagaaatgtggttgcaattgagcagtgtcattatccatttcaaacctacattactgattacatattcgtcttcgatttccttattgacactagccaggatgttgatacacttgttgacaagggaatcatgattaacacattgggagatagcagtgcagttgcaaatatgaaaactgaattgcttttatga

SEQ ID NO: 74417 - DNA, 285 bp, Glycine max
  Peptide Sequence Number=SeqID_191195
atgaagcaaaaaagctttagtagcaacaactcattcttcacctatgatgaaaaccatggcctttccaaggttggaggaaaatgtgatggagactcactagcaaagaaaaggaatttagagaacaaattgaacaaatcaaaatcgcatattccaccgaagtccaaaaggggagaatcttcaatcactatcatcacgtatatggaggaagaggttgtttctgacgaggttattcctttcaacatgatgttttccaaatgcttagtggagtttcaggtccagaaatag

SEQ ID NO: 74418 - DNA, 330 bp, Glycine max
  Peptide Sequence Number=SeqID_191196
atggcctccatgttggccttcatccgcactcattactctggctctagcacgcattcggatgacaatgtcttcagtcattgcatgctttcaaaaggcgacattgactttcatttgcatttcaaagacgacaatgtcttcagtcattgcatgctttcaaaaggcgacaatgaccttcatttggatttcgaagacgacaatgtcttcagtcattgcctgccttcaaaaggcgacagtgaccctcatttacatttcgaagacaacgatgtcttcagtcattgcatgctttcaaaaggcgataatgccatcatttacgctttcgaagacgacaat

SEQ ID NO: 74419 - DNA, 354 bp, Glycine max
  Peptide Sequence Number=SeqID_191197
atgaaactctgggccctcgcgctctcttgcgctaagacatcgcaaaatgctctagaacaaggttccgcagtcgcatctgtattctctggtaccgcaagttttcatatgagccttccaatcggagtgtacgtcgtatttcttagaacaacgttcgcattgccactttttctcactgtgttttctgcagaagtgcttcttgatgccggtgaggtcgtcgagcgcccttgcggggttgtggtggactcaggaaggttcgggacacacggtttttcgggttccaaggagctgaatggacgcggagaggagaggaacagactccaagagtgcgtgaaactcgacaaggaccgtctttga

SEQ ID NO: 74420 - DNA, 1014 bp, Glycine max
  Peptide Sequence Number=SeqID_191198
atggacaaaactgcctccactctctccggccgccaccaccccacggcggtgctgccatcaccgcgacttgtccgtagccgaagcggtagtggccccgcggccgctataaccacccccgagagaagttcacataggttcagctctagtgaaagattcaccatcaccagtgtccaacgttcaaaatcaacatcaagaacaagagcaaccaacaatgaaggaaacaatattaacctaaattccactttaacaacttccattttgagcaacccaacccacaatagggttcatgagaagaagggtagagatgatggctatggcaagctcatgcaacgtggtgttagccctgatattaataatgttggagcttcaaagaggaccacatcaaccattaagtcgccttcggcatgggcactttcgccgggaaggtggtcactcaactcttcagtgtggcctcaacccccggcgaaagcaaatgatggtggtaataataacagtagtagtagtgttggtggtcgcgttattaaagtcttgaagtacttgaagcaaaggaaagtgtcgtcagtgcaagaagaagagtactatcgctttaggattttgcataatagacttttgcagttgagatttatcaatgctagagctgaggttgtcagggctaatgtcaagaatatagccgagatacaattgttttctgtatggctgagaatcctcatgttgagaaagataacaatacaaaaaagtatcgaattgagaaagatcaaacaagtgataaagctttatcatattttggatggacaactctaccttcttactgaatgggcacaattagagagaagaaatcaagaatccgtaggaagattgacaaggaagttgacagcattgtccaacatactgcctttaactcacactgttaaggtagacacggaatccgtctttgaagcactgaatacagctgttcaagtaatggagagtgtggaaccattaatcgcgaaataccatgagaccaaggtcacttaa

SEQ ID NO: 74421 - DNA, 780 bp, Glycine max
  Peptide Sequence Number=SeqID_191199
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtttctttcctccgcttattgatatgcttaaactcagcgggtag

SEQ ID NO: 74422 - DNA, 843 bp, Glycine max
  Peptide Sequence Number=SeqID_191200
atgggctgagacacaaaccaagcgactgccagatgcttcagcagggggaaaaataaagttgaagacccctaaagaggcaactgagctaattgagaatatgtcagccagcgatcatgccattctgcacgatagagttcatcaacccacaaagaaaagcttgttgcaggttgtaccatctgtgggtccttataaccaacaaggacagtggagatcacaccctggcaatcaattcaacaaagaccaaggtggaccttctaacaggccaatcaaacaagggccaaatatctttcagaggactactaagctggaggacaccttgactcagtttatgcagatagctgacaagtcatccaatagttttgtggcgaatacagaaaagaatcccaaggaggaatgcaaagttatgatgacaaggagtaagaggtttatggaggaggaggatgaggacaatgttgtcatgcccaagaagaaagttgctgaaaagaaagatactgatgataagaaagaagatgtgagagagaggagtagaagtgaacaagctagagagaagaagaaagaaaaagttgtgaatgaaggtatggaagtaccatatcttgtggtaccttccaagaaggagaaggaccgtcatttggatattttaacaaggaaacacaagtatattcactgggaaaacattgtcgtggaaggaaattgtagtgctgtgattcaaaagatccttccacccaagcataaagaccctgggagtgtaaccattccttgttcaattggagaagtcactgtgggaaaggatcttattgacctgggagccagtattaacttaatgccactctccatgtgcagaag

SEQ ID NO: 74423 - DNA, 543 bp, Glycine max
  Peptide Sequence Number=SeqID_191201
atgatgccgaagaaaaacggcatcgatacgctgaaagaactgcgccaacatcaccagacgccggtcatcatgctgaccgcgcgcggcagcgaactggaccgcgtgctgggcctggagctgggtgccgatgattacctgccgaaaccctttaacgatcgcgaactggtcgcgcgcattcgcgccattctgcgccgttccaactggagcgaacagcagcagcaggtcgacagcggcgccccgacgctggatgtcgatggcctgcagctgaaccccggtcgccaggaggccagcttcgacggccaggtgctggatctgaccggcaccgaattcaccctgctttacctgctggcgcagcatctcggccaggtggtgtcgcgcgaactgctgagccaggaagtgctgggcaaacgcctgaccccgttcgatcgcgccatcgacatgcacatctccaacctgcggcgtaagctgccggatcgcaaagacgggcatccgtggttcaaaaccctgcgcgggcgtggttatttgatggtatctgcaacatga

SEQ ID NO: 74424 - DNA, 789 bp, Glycine max
  Peptide Sequence Number=SeqID_191202
ccgctgcgcttcggtttcgatgcgcgccagttcgtggccttcgccgtggcggcggcgcatcagcgcggtggccagctgcaggcgcgtcagcggcgtgcgcagctcgtgcgagatgtccgatatcaggcgttgctgagcattcatcatgcgttccagcgcgctgaccatctggttgaagctggcgccggtggccaggaattcctgcgggccggcctccagttccggatgctgcttcaggttgccgcgcgctacttcatcggcggcgtttttcagcttgcgcgccggtttcgccaggctccaggccagccacagcagcagcggggcgctgatcaacatggtgacgatcagcagcagcagcggccggtcgaacatcaggttgatgaaatcggattgcgggctgttggcgggacggatcaggtacagctggtagttgtcttcgccgtcgcgcaccgcgaacggccctaccagctcgacgcggccgtactttttcttcttcggatgatccgagttgtcggattggccgatgaagttgcggacgatctgcatttcattgcgctgcgcgccgatcacccggccttcgctggtgaccagcagcaggcgttggcccggcggcgcccatttgtcgatggcgcggaacaggcggcgccaccacatcaaatcgttggccggatcgttttgcaactcggcctcgacgtgctgttccagcatcaacccctgccgctgttcgctgtcgagcagcgaggtcatttggcgggagtcaagcttgggcaccatcaacaccaacattag

SEQ ID NO: 74425 - DNA, 192 bp, Glycine max
  Peptide Sequence Number=SeqID_191203
atggttaatcatctcaaggttgttaatgatagttcagagctacgctctactattgaacatgtgcaggtcatcacctttggtgtgctaacaaggattagtggattactattttgtttgcatgcagaaaaacttaagtttcaccttagactgggtgacaacaaacctatttataatgcgttcaaagccatttag

SEQ ID NO: 74426 - DNA, 294 bp, Glycine max
  Peptide Sequence Number=SeqID_191204
atgggctcatacttggcccatgggctcaaaatctaccctaaggctcatgagaaccctagggtcttcccttggatctctggcccaatctacttggagtcttctatccaatgcccttgcggggtaggattgcatcaatatggggtgggtaagtgggccggcacgcctcgcgtaaggcccgcccgcattggcagcggacgaggccagctcgccccgtattcttacacggaccaaataaactggtccgcccccgccgcgtggaccccgctggtcaaaagagccggtccgcaggcctag

SEQ ID NO: 74427 - DNA, 351 bp, Glycine max
  Peptide Sequence Number=SeqID_191205
atgaggggcaaaagggtctttttattgagtttcctagaccctagctcgcccaagctagcctctggcttgtctgggcccccaaatgacttcagggtgaaggaatcagctcgcctaggtgtgctagggaggctgaggaagggttccaaggttcataagttgagggaattgagagaagagagaaagaagaagaagaaagaaaaggaaatgaagtcgaggcggcgccgaatcgcgactgtgatcaatgtctacattgttccttgttcggtgttttttgtgcgattgtcgggttcaggagttgtttatgcatgggcaacaccccacgcgcctgtcacaagggacggtagcctttaa

SEQ ID NO: 74428 - DNA, 189 bp, Glycine max
  Peptide Sequence Number=SeqID_191206
atggagttttcacctcaaattgaaatgacacattttatagttagtgatatcgtagcgacgaggcgggtcgttacaatggtaaccccaattatttgtggtggcggtgatgattgtgcacttttgattttgtcaactccagtgttgatcatgttagaagttgatggaagcttgcttgagaagcttctatga

SEQ ID NO: 74429 - DNA, 252 bp, Glycine max
  Peptide Sequence Number=SeqID_191207
atgaagctgatcgcaccaagaaatgcagataccataggaactatggaagaggtcgaggtggttatagaggtggttacaaaggcggatatgctaaaggacgaggtaataaccaatgaactattggagaagctaaacaaagacaacaagaaaatccccaaggtgttatccgaggtgttaccaacaccattatcggtggcattgctggagaaggttgcacaaaccccagtaggaaacaacacctctaagcactga

SEQ ID NO: 74430 - DNA, 552 bp, Glycine max
  Peptide Sequence Number=SeqID_191208
atggctaagttggaccctgaggtagtcctggagttttacgctaatgtttggcccatagaagagggagtgtgggacatgcggtcatggttgaggggtatgccacccaccaggcaccttctagacccggataagtctaacagggccctggggtttccagcattgatcacgggcctctgccagttattcggggttcccgtcacacctagtaaatattgcacgcctaggcaggcgcaaggtgatggaccacaggccgcagacgcaccgccaccacctcatcaggctgatcctgctaggtcattaggcatggagcggtatctacaacacttggttcgccagcaggcggccaaccacagggggcagagccagggtttcgctcctttttcgtgccctactccatatcatttcagggcagaggtcgaatggcccggagattggtctgaggcccaggcaggggaggcacccgcagaggctcccgacgacatggagggggcccgcatggatgaggagatgacagatttactcgatttcttgggagggagaggagccacatga

SEQ ID NO: 74431 - DNA, 447 bp, Glycine max
  Peptide Sequence Number=SeqID_191209
atggctcccgataggactcagttacaaaacatgagcaaacgggaacatgaatccttcaaagagtatgcccaaaggtggagggatttggcggctcaagtggcacctcctatggttgaaagggagatgattaccatgatagtagatactctgtcggtgttctactacgagaagttggtgggctacatgccctctagctttgcagatcttgtattcgcggacgaggggatagaagtgggcctaaaaagggggaaatttgactatgtctcccctaccgacacaagcaatagaaggatcggagcagccggggcaaaaagaaatgagggggatgcccatgccatcacttcgacacctgcttggctgaagcctcagcaagccttgcatggtactcatcagtacgctcaatgtggcgtccccaaaataatgactggtttaatagtaatgatttaa

SEQ ID NO: 74432 - DNA, 288 bp, Glycine max
  Peptide Sequence Number=SeqID_191210
atggaatttgagatcatcaacgaatctccagctgattccacttcactatcctcctcttcagtctcaccatgcacaccaccaaaccctaatctgttatgtgattctccaaatccacaaccaaatactaataccaatccatctcacaagagaaaagcaggtagaaagaagtttagggagacacgccacccagtgtataggggtgtacggcaaagaaacggaacaaatgggacataccttactcctgaagtggcagctagggcacatgacgtggctggtcttgagacttag

SEQ ID NO: 74433 - DNA, 228 bp, Glycine max
  Peptide Sequence Number=SeqID_191211
atggctaatgcaaactgtccgcaagagtcattgcattcagtctcaaacgggaatctaagtggacagggtaggcaacaaatctgtttggtggagagacttacaaaaggctttcaccagctcacaccaaggatagattatccaacagggaatgaagtggagtgtgggcagcggataccaaataaagttttaggaggacaagtggaatggggaggaggaatcattggctga

SEQ ID NO: 74434 - DNA, 732 bp, Glycine max
  Peptide Sequence Number=SeqID_191212
atgaactatttgttcttgacgatagtgagggtagtgaatgatttaaacctcattttgaactctattggtcatcctcctattataatagacatgtcagttcctatgggaggcatgaaaaagaattaccttaagaagaacttgcttctgcgaattatattgttgaattggttaacaagattagagatttcatcccttaagctcttcttggttgtagtccttcttgttgttagcggtagtgacaagaagaaggtgatttggaggaacaaacctaaaccaaccaacaaatgtagaagttataacattgagactcgttctaagtctttgcatgaccttcctctgcctccctcaaagaaacaaaatattgttgaccttgaaggtgatgtacaaccaatcaggactagtttgatccctactaataagcttagtggtcctcatatgtggatgtcttcaaggtcaaagattgatcggatcatcatgtcagaagattgggaagctttccaaaagaagggtcttgatgatgttgaaaatttattagaagagtttaaccagctgaaaattcatgccaatgagttagaagcttacgtacaacaagagcgagaaggaaatgtctggcttaaggaaaagaacacccaacttaaaggagacggagaattctgcatgagggtcaatggtgaactcattcctactcgtcttagggctcttggtactgtgaatcaagattgtgttacatga

SEQ ID NO: 74435 - DNA, 282 bp, Glycine max
  Peptide Sequence Number=SeqID_191213
atggcagctcgcccaggcgagctggagcttactcctaaagtaactggctcacccaggcgagctggttacttcaccttgaagtcttttgggggcccgggcaagccagaggctagcctaggcaagctagggtccaggaaactcaataaaaagacccttttgcccctcttttttggtatctttcgcattcttaatcaaaacattgaatggttccttgctttgcactgtaactggtgttcaacacctaagtcgactagcaaggatcaaaagatcaacgaacgatag

SEQ ID NO: 74436 - DNA, 492 bp, Glycine max
  Peptide Sequence Number=SeqID_191214
atggcgtatggaattgaggtggtcattcctaaagaaataggagaactgaccttcaaaattgcaaacttgaatttggagcagaatgaagagagcctcataactgaattggacttcattgaggaaagaagaaaggtagccgctataagagatacaacattaaaaggaaaaataatgactaggtacaatatgaaggcacccctagggaatgggttcccaaaccagggtaagtatcttaatggcctacttgttcagttacaagtaagcatcctaggaaatgagttcctaaaccagggtaagcatctaaatgacctacatgttcagctacaagtagccatcctgggaaatgggtcccccaaacagagttactccagccatattgagaaaagtcaagcaaacaatctccaacctcttattaaaaactctagcattttgaaggcaacaaccaagtgcatcaaaatgactagagtaactaacggaaggacaaagaaatga

SEQ ID NO: 74437 - DNA, 813 bp, Glycine max
  Peptide Sequence Number=SeqID_191215
atgaagccattcaagatactccatatgcatcttcttcattctttactcttattcaatatcatattatgttcttctataccccagcataatcatgcaaacttctgtgggaatatcaaaactcaaacacctttcttggattccaattcttctatgttagacaacatcaccttgtgcatatctcagaatctctacttgagaacatcccttggcctttttcatgtttcatcacttgacaacaatggtagattactaaccatcactcactcttcttgttcttctctccaatatgtttctcctctggctgtcacatctggtttcccttctcctccagaacctaactcccttgttctcttcaactgctcaagcagaagagacaccactttaccaatcatgcaaaattgtagtgacctgtacaaatgtggaggtgctggttcaccaccttctaggcctcaagagcacctggaacatccttattcatgtttttttgttgaagatttgcaaaaggtggataaggattttcaccctgaacatctgaattgttctcattacagctgggtgcatagaagtacttcagatggtggacatgatcagggatataaggtgggaacaaggttatctgtcgacattccacgtgtaccagaaatttgtcaagggtgtgaaaagcctaatggaaactgtggtgctgggttgaattgcttatgccaccctaaagagtgcaaagacaaggtcatctccaaggctgggataaaatctactgctagtgcttttttctctatgctttctttgattggttcagttactgtagcctactag

SEQ ID NO: 74438 - DNA, 978 bp, Glycine max
  Peptide Sequence Number=SeqID_191216
atgagagacatagtttcttgcttcagcgagaacgcagtgaacgtgtctcactcttcaatgtcgtgttcttcctattcaaacaacgcgtgcatctctccctcctcctcctcctcctcctctgttgttccctccacccaaaactcaatctccagcgtctacaaactagtcctctccacgctgaagcaaattctcatcacggtcacatggtgtaggagcaactccaaccaaggactcaccataaccttcaacgacggcgatgaccctccaccaccacccttcagactcaacaccaattcacgtctcttcagaaagaaaaaaggctccaaaatcctcgaatcttcatcttctgactcatcaaccaaggtagaaatcttatgggatctctcaaacgccaagtacgaatcaggacccgaacctgttcagggctttcacgttctgatcatcatcgactctgaaataggcttggttcttggcgacactgctgctgctgaagaaacagtttccaagaggcaaaatttcaaaaacaacaaaaacacccctttggctaaggtctcactgttatcacgaagagagcattgttctgggaacacgctttacaccaccaaggctcagttctgtgacactggcacgtggcacgatgttatgatcagatgcagtgtggagaaggagaatgaagggttgttgttcaagtcaccggttttgtgcgtgtgcattgataagaagactgtgattcgtgtgaagaggttgcactggaattttagggggaaccagaccatttttgttgatgggttgcttgtggatttgctttgggatgttcatgattggttcttcaacccttcttcttctgggtatgcggtgttcatgttcaggactaggagtggcatggatagcaggttgtggttggaggaaaagaatgcacacaaagataaagacagggttgaattctccttgttgatctatgcctgtaagacttcataa

SEQ ID NO: 74439 - DNA, 459 bp, Glycine max
  Peptide Sequence Number=SeqID_191217
atggcattgtatatggtttgccttgagcaagcattgagaagtaagctgagtgagattgaaaggttgaggttgatgcctaggatgtttgctttgagggcagtgcaaaggcacactgccgcctcaaggtcaataagaccgctgaggagggagcaacaaggggtaactagtggttggcccaaagtcacgttgagcaacccatttagcacattggcgcatacgcctagtttgagtgcgtcacgggggcacaagccacctgaaggattgggattaggatttggattggggtcagggttaggggttagggttgggttggggttgggtgttggacttggttttggttttggaccagggcttgaaccactaccacaatcgcatgcagaaacaagtgcgatgaagaggaggttgagtgtgaagaaaagagcaagggaggaacaagtgttggaagccatcttatcttaa

SEQ ID NO: 74440 - DNA, 1635 bp, Glycine max
  Peptide Sequence Number=SeqID_191218
atgacactttcttcgttcctgtgtcttgttttcatatttcaatttctcttcacatcaccctcactctctttgtcgtcggatgggctcgcccttctcgcgctaaagtctgcggtggacgagccctccgctgcggcgttctccgactggaacaacggcgaccccacgccgtgcggctggtcagggatcgcctgcaccaacatctccggcgaggcggagccgcgcgtggtcggaatctccctcgccggaaaatcgctctccggctacctcccctcggagctcggtacgctacggtttctccggcggcttaacctccacgacaacgccttctccggcgtcctcccggcgcagctctccaacgccactgcgctccacagcctcttcctccacggcaacaacctctccggcgccatcccctcctccctctgcaccctcccccgcctccagaacctcgacctctccaaaaacgccttctccggccacatcccggagcacctcaaaaactgcaagaacctccagcgcctcgtcctcgccggcaacaaattctccggcgagattcccgctggcgtgtggccggacctccgtaatctactccaactcgacctttccgacaacgagttaacaggctcaatccccggcgaaatcggaaccctaatttccctctccggtacgctgaacctctccttcaaccacctctccggtaaaattccagcttcgttaggaaaattaccggcaacagtgagctatgacctcaaaaacaacaacctcagcggcgaaattccccaaacgggatcgttttcgaaccagggccccactgcgttcctcggaaacccggacttatgcgggtttccgctcaggaaatcgtgttctggtctggaccggaatttttctcccggttcggatcagaacaaaccgggtaatggtaaccggtccaaggggctgagccccggtttaattattttaatttcggcggctgatgctgctgtagtggccttcattgggcttgtgattgtgtacatttattggaagagaaaggatgatgagaatgcttgtagttgcattaggaagaggagttttggtgaagagaaagggaacatgtgtgtgtgtggtggattatcatgtgttggtggggtgaagagtgatgatgatgaagaggaagagtatgaggggggtgagggtgagggtgaaggggaattggtgaggattgacaagggtttaagttttgagcttgatgagttgttaagggcttcagcttatgtgttggggaagagtgggttagggattgtgtataaggtggtgttggggaatggggtgcctgtggctgtgaggaggttgggggagggtggtgaacagaggtataaggagtttgctgctgaggttatggccattgggaaggtcaagcaccctaatgttgtgaggttgagggcttactattgggcacatgatgagaagcttctcatcagtgatttcatctccaatggcaatttgactcatgcccttagagttgatgacgttgatggaatatgccacctgctagaacaaaaggcaatgctgttggttcagcatgtgtctggagatttttttattctgattgtttttgtttgttgggttgggttggcttcatgcagtgaagtgtag

SEQ ID NO: 74441 - DNA, 666 bp, Glycine max
  Peptide Sequence Number=SeqID_191219
atgcttcacttcactcgactatttgctgcagggagacatggccaaccatctacaaatctttcatggtccaccaggctgagaatcaccaaaggaacagcgaggggcctggcctatctccacgaatgcagtccaagaaaattcgtccatggcgatatcaagccctccaacattcttcttgacaacgacttccagccctacatatccgattttggccttaaccgtctaatcagcatcactggcaacaacccttccaccggtggattcatgggtggagctcttccttacatgaactcatcacagaaagagagaactaacagttacaaagcccccgaggctcgtgtccctggctgcagacccacccagaaatgggacgtgtactcgttcggggtcgtgctactagaaatactaactgggaggtcaccagagtcatctcccaccacatcaacttccatggaagtccctgacttagtgaagtgggtgaggaaaggattcgatcaagaaagcccgttatctgaaatggttgatccatcgctgctccaagaagtgcgtgttaagaaagaggtgctggctgtgtttcatgtagcactgtcttgtactgagggagaccccgaggctaggcctaggatgaaaactgtctctgaaaatcttgataagattggaacgtaa

SEQ ID NO: 74442 - DNA, 340 bp, Glycine max
  Peptide Sequence Number=SeqID_191220
gtttaatttccatccgaacctattcgtttccgtccaccgcaaacacgccatcaacgacctcgccatccacccctccggcgaggtagccctcaccatctcacaagacaagtgtttcgccgttgttgatctcatgcatggcctcgtcgtggactgccggagcttctgccgcccgctcggcaaggaagagagtttgagtttggtgaagttcaatgctgccggcgacaggtttttcgtcgcggcactggagaaggtctccgtctacgtcaccaagactgagcggtttttgttagaatttgagtgctcgaagcgtgttctctgtgccgcatcttctagggtttaa

SEQ ID NO: 74443 - DNA, 201 bp, Glycine max
  Peptide Sequence Number=SeqID_191221
atggaagaagcgaaagaatggaaacgcacgaagcaaaagaagcgatcagagggcgtgggtggcgtgaaccctaacggcaagggattgggagtgttgggaaaaggtcgtggctgcacactgcttgctccaactggaatggcgagggaagcttccgtcaatggggaggatgagcaatgcaagctagggttagtacgtaattag

SEQ ID NO: 74444 - DNA, 117 bp, Glycine max
  Peptide Sequence Number=SeqID_191222
atgacatttacaggaagagcagtgagagtgagaaggagcaagatatttgaagaacctaactttcaattctataaaaaaaagttctacatcggttctgagacgatcgatgtagaatga

SEQ ID NO: 74445 - DNA, 1224 bp, Glycine max
  Peptide Sequence Number=SeqID_191223
atgggaatgtggcacgtgcgtagcagcaacattactatcaataccccaagtctggagaatatcgtcgaagaagacagttgcgaatttcctcagaaaaggccgaagaagctcgttcatggtggcctgaaagcactagtgatgagaaagggctatggctatggcagatcatatctacctccaacatcgctacaacttggcgctcaagctcgtttttctgggagaaagggtaccagtagggcctcacgttcacaggttgagtattgggttgtaagtggatgtggaacaggtgctggtattggtgaagaagaagatccagcaaaggatgggggtgtggtgtcagtagaaagaggggtgggtgtagtgacacgggtgaggtggtataaggctgaaatactattggtttgggccaaacgtcgaacttgttgggctgaggctgggctggggtgcatgggaacatttggcgtggagagaaatgagcatgtcgtttcgatggtgtttccattgccaatcatcactcgcattgttggctcgggtacttgggggaagatgcaaaaaggcaacgaggcgagcttggataaagttgtgggtgctaccaccatccacaagtataatcacctgatgatgggcaatgttgccgtaaatgcgaaatgtctccggtgccggcatttccgccaaggcgttgaggctaatctggggggtcgtgagtgggacgggggaagcaatgtgatcaatgaaggggcgacaacggtgaccgagaatccatttctcgtcacaatggtagcacaaccctttgtcccgacggacttccagttcttcagcggaaagacgcttaatcggtgggcgaagtggaggtccgggtatagtcccgagatgaaacaactaagcaacaccgtgggagagaggccgatgattcaattcgctagacgttcgaactctgtgggtgcaaatcgtgactccaaagcttgtaatagagtaagtcacgacgcgatgaacccattgtgggtcatccattggtaccatgacaaagatcttggccgtcaaattagggtacatcaagcttcatatgaggtttgtatgaaagtggtgagggtgtgggcgctggggatgggtgggtatgcggtgaagctggttgaatggagagggtggcgagatgttcgagcatggaatccattttcaggttcatggaagtttgggtctgggctaaggaagcatggtcttggataa

SEQ ID NO: 74446 - DNA, 327 bp, Glycine max
  Peptide Sequence Number=SeqID_191224
atgaacactctccctcaaacaccagggaaaaccatcccagatgcctgcgactacaaaggtcgcccagcagagaggtccaaaaccggagtggaagcatgtgagaggttaacgacaatgggtgttgccgtgaatttggcgacatatttgacgggtacgatgcatttgggcagtgctaactctgccaacacggtcaccaacttcatgggaacctctttaatgctctgtttgttcggtggttttgtagctgacacttttatcggcagatacctcactattgccatcttcgcaaccgttcaagccactgtaagacattattgcaacgtttaa

SEQ ID NO: 74447 - DNA, 899 bp, Glycine max
  Peptide Sequence Number=SeqID_191225
gtaacaacattgacgaaattcaaagcattactgcacttcttgatcaaacattcaaaataaaggatctagggaacttgaaattttttctcgggcttgaaattgctcgtactgcacaaggtatgcttggttgtcgtccacattctactccaatggactactcaacaaagctacaagctacgtcgggaacacctctaccagtagaaacttcttcttcttatcgaagactagttgggagacttatttatcacaccaacacacgtcctgatattacatacgctgttcaacaactcagtcaatacatggccaaccttactaccagtcatcatcaagctgcatttcgtattttacgctaccttaaggggacaccaggatcgggacttttcttcgcaaccacaggaacacatcagcttcaggctttcagcgattcagattgggcagggtgtcgggattcaagacgctcaatcactgggttttctatatatttcggttcttcattaatatcttggcaatcaaagaagcaatctacggtttcccgcagttcttcagaggctgagtatcgtgccctagcatccgccacttgtgagttgcaatggttaacgtaccttcttcaagactttcgtgtttcctttatacagccagctaccctctactgcgataaccaatcagctattcaaatcgcgaacaacccagtgtttcatgaacgtacgaagcatatcgaaatcgattgccacattgttcgaaacaaaatcaattcaggactcatcaagcttcttcctatttcttcctcgaaccaacttgccgacatcttcaccaaggctttgtctccggcagtttttcaaggtctttgcaacaagctgggaatgatgaatatacattcccagcttgcggggggctcttag

SEQ ID NO: 74448 - DNA, 102 bp, Glycine max
  Peptide Sequence Number=SeqID_191226
atggcacagcgaaggctccacaacatcggtgacaggacggcacagtggaggcgtgggatgtacactgatattaggtcgaaaacatccatattcctccggtaa

SEQ ID NO: 74449 - DNA, 1425 bp, Glycine max
  Peptide Sequence Number=SeqID_191227
atgaacttcattgcatctgttgaaacacaatttgatagtaaagtcaaaatcataagaagcgataatggccccgagttcctcatgcatgatttttacgcttccaaaggaatcattcatcaaacgtcatgtgtcgaaacccctgaacaaaatgagatcgtagaacgtaagcatcagcatcttcttaatgtcacgtgtgctcttctttttcaggcaagcttaccacccagcttttggggttatgctttgtctcatgctgcatatctgatcaactgcatacccactccctttttgcataacatatcgccttatgagaaacttcatggacacccacgtgacatatctaatcttcgcgtgtttggctgcttgtgttatatcaacactcttaaagcacattgtcaaaagctcgatcccagagcgcatccatgcatcttcattggttttaaaacgcatactaagggatatttagtctacgattttcattcgcatagcatcaattgttcacgaaacgtcgtattttatgagaatcatttcccacatttccctgaaacatcatctttgaaatccacttttactattccaactccggagtcattctccagcgaccaatatgaaccaccagttgatattatcattactatacgcagaacccaaaacggtcctactcaagatgagccttcttctccacaccttcgtcgatctacacgacaaaaacatgcaccaacttatctacaagattatcatcgaggtctcacttcgtctgctaccagtgcttccactattgctcgttatccactaagctcggtcctatcatactcacgcctttcaccatctcatcaacactttgtcatgaccatttcctcaaacatagaaccttcttcctatgctgaagcctctcgccatgactgctggattaaggcgatgcaggctgagttacatgctttgcaggaaaacaaaacttggactctcaccaaccttcctcctcacaaaactgctataggctgtcgctgggtgtacaaaatcaaataccatgctgatgggtccatcgaaagatataaagcgcgcttagttgcaaaaggttatacgcagatggaaggtttagattaccttgatacgttctctccagtcgcgaagcttaccactgtgcatcttctactggcattagctgctcttcatcaatggcatctgcgacaacttgacgttaataatgccttcctccatggagaactcgctgaagaagtgtacatgcaaattcctccggggctttcgatcaaggaccctaacctcgtctgtcgtcttcagcgctctttgtatgggctgaaacaaactagtaggcagtggttcaccaggctgtcgagttttctcatttcccatggttttcgacaatccacttctgaccactctcttttcctacgattcactgataat

SEQ ID NO: 74450 - DNA, 276 bp, Glycine max
  Peptide Sequence Number=SeqID_191228
atgttgtcatctacctctacctccttctcactaccaccttcttccccctatgatagcatcggtggcaacattgcccacaacatcgccacagagataaactctcctaatctcggaatcgtgctacaacaactccattgcactgcacctacactaccacaccaccacatgttagaaataatggtggatgaaaccacaaaccaagaggggagattatggtttaaacaaagataccatacgcataaaaaaatgccaagtgttaagaaccttaaccaataa

SEQ ID NO: 74451 - DNA, 237 bp, Glycine max
  Peptide Sequence Number=SeqID_191229
atggtgtttggaaataggaaattgatgatgatatcaggatgtggtgtaggaggaggagggaaaggaaaatcatcatggagttcttctacatcgtcatgggtaaccacaatcttggtgtcaatgttgacattaggtaagaatggagggtttcaaatatgtgataatgttgttagctttgggtatggtggtgccatggcaacacgaagggtttgtggtgtaaacatgaagggtttatga

SEQ ID NO: 74452 - DNA, 970 bp, Glycine max
  Peptide Sequence Number=SeqID_191230
atgatcactgcgttaagtgccaagaacaaactggaatttgtggatggaagcgcgcctgaacccttgaaaactgatagaacgtatggagcgtggcgtcgatgcaataacatggttgtttcttggattgttcatttagttgctacctctatcaggcaaagcgtgttatggatggacaaagctgaggaaatatggcgtgatttgaagtcgcgatattcacagggagaccttctacgaatctccgatctccaacaggaagcatcaacgatgaagcaaggagcactctcggtcacagagtactttacccggctgcgagtcatatgggatgaaatcgaaaactttagaccagacccagcttgttcatgcaatatcaggtgttcttgttccgcgctcaccattatcgcacaacgaaagcttgaagatcgtgccatgcaattcttgcgtggtttgaatgagcagtatggaaacatcagatcgcatgtgcttcttatggatcctctacctgcaatttcaaagattttttcatatgtggtgcaacaagaacgtcaactattaggtaatgtttcttcgaaccttaatctagaacctagagatatatccatcaatgccgcaaaagttgtttgtgatttctgcggacgtacgggtcacatggagaacgtctgctataagaaacacgggatgccactcaaccacgatggtaagaacagaaacaacaataaacatgggtacccgccgggatacaaagctttcaatggaagatcaagcgtaaataatgtgatagcggtagaggggaaggtcacagatgatcaagaacaacgtcatgaatcccaagagattattagcttttctccagagcagtgcaaagccttactcgctttaatccaacagtcatctgcaggaagcacagcttctaaccacccacaaaccaaacaggttgcctccatatcttctactgatacagtgactaacccag

SEQ ID NO: 74453 - DNA, 174 bp, Glycine max
  Peptide Sequence Number=SeqID_191231
atggctgttgatcaacctggttgtgtgttttgtgcacatgatttggagagcttgaatcatcttttcgcacaatgcacttactctcatcagcgtaattccattatattcatgggtggtgttcttttagaatttcggagcattttaagtcaaattcagagattgtcgtggacttag

SEQ ID NO: 74454 - DNA, 1398 bp, Glycine max
  Peptide Sequence Number=SeqID_191232
atggctgctaatattgaacctgaggccactgccttgcatgacagtgaataccaattaacaaagaatgaattttcaagtctaggacgtggaaaatatagtgaatgcagtactactgaatcatctgatgatattgagaaacaggagatggaggaagtgtcagatgaagatgaaatctcatattatgacactaaagagtattttacagaacatggttttaggtgtgggtcaacaggagatttggattcaatgaacatgtctggggaaggtaacacacagtgcattgatttggagaacagtcttgttgggaagacgatcaatgattttgggtaccctcagatagcaaggcgaaagaagcttccagatcctgttgagaaagagaaaggcgttagtctttggtcaattatcaaagacaatgtgggcaaagatctaacacgagtgtgtcttcctgtatactttaatgagccaatatcatctcttcagaaatgttttgaggactttgagtactcttttcttctggatcgagcttatgagtatggaaaatctggaaacagtctccttcgggcactgaatgttgctgcctttgcaatttctggatatgcatcatctgaaggtcgtcattgtaaaccctttaatccattgttaggggaaacttacgaagctcattttcctgacaaagaagttcgcttcttttctgagaaggtgagtcaccatccaactgtcgttgcctgccactgtgaaggtagaggttggaaattttgggctgacagtaacattcggtcaaagttttggggaaggtcaattcagcttgacccagtgggagttctgaccctagagtttgatgatggtgaaatatttcagtggagcaaggtcacgactacaatttataatcttatccttggcaaaatatattgtgatcatcatgggaacatggacatccgaggtaatcgtcaatattcgtgcagactccagttcaaagaacaggcgattcttgatcgaaaccctcaccaggtacatggctttgttgaagatgtaatgggaaaaaaggttgccacattatttggcaagtgggatgacagcatttattatgttaatggcgaagttaatgtgaagccaaaagatttcactatgtcagacacaaacttgctgtggaaaaggactaagccaccttctaatctcacccgctacaatttgacatcatttgccatcacactcaatgagcttactcccgggctaaaggagaagcttccacccacggattccaggctgagaccagatcagcggcatctagagaatggggaatacgagaaggctaatatggaaaaacaaaggttggaaaagaggcaaagaatgacatgttacatcataacccattttagaatggttgatgacatggcatga

SEQ ID NO: 74455 - DNA, 855 bp, Glycine max
  Peptide Sequence Number=SeqID_191233
atgcgagtgaaggaaatgcacccgttgtgctgcatctcgcttgagagtccggggatcgggagcgactcgccggagccggaggcggcggcgctgtcgaggacgaggagtcttccggccggcggatctgatggcattgcgcggcggggatcggaggccacggtggccggagttctctataagtggactaattacggcaagggatggagatcccgctggttcctcctccgcaatggcgtcctctcctacgccaagatccgctggccggaaaacctcaacctcctctctccggtcgacgacgtccgcctcatcggtgaagtcactgccaaccgcctcgccagagaagccgcctccgccgccgccaccgtgcggcggaagaatcacaaacctccttcctcctcctcctcctccgccgtcgtccatctcaagatctcgtcattcagggagagcaagtcagacgatagacggttctatatattcacatcaacaaagactctccatctgagaaccgattcgaggaaggaccgtgtggcgtggatacaagctttggtttcaacccgcggattgtacccacttcgaccactcagtgaccatctctccctcgcgccaaataatatatctgtgtcagccgagaggcttaagaaacgcttgcttgaagtgggtagcagtgagagtcttgtcaaggattgcgagcaaatcatgctcgctgagttctccgaattgcaagagcaacttcagatcctatgtcaggaacgaatgaatttgcttgatacaataaggcagctggagcttagaacactattgcgtattacttcactcctcccacgtacaacaactcctccatttcaaatttggtag

SEQ ID NO: 74456 - DNA, 322 bp, Glycine max
  Peptide Sequence Number=SeqID_191234
atggcagaaccatcgaaaaagcggaaaggaacttcgagtcagagtcagcggcattccgggtcacaggaagccctaattcctccctccattccctctggatcattattctcatcagaggaacagcgtatatggtacacaaacctcttttcctctcgttccattgtagacccaaaattcatagatatggagttcttctcaaatgagaattttgaatgcttccaaacatttgaaaactccaatgttattccatttatgtctccgaaattacctgtctattctgaattagtcaaatctttctattctaatttagaaatccatgaag

SEQ ID NO: 74457 - DNA, 237 bp, Glycine max
  Peptide Sequence Number=SeqID_191235
atgacatcctactctaatatgtacaaagataattggacccaaccttggcccatgggctcagaaatctaccctgaggttcatgagaaccctagggccttctcttgcttctttggtccaatcttcttggaatcttctatccaatgcccttggggggtaggattgcatcagtactgcctaaggcagttgccttatttgctggcagtttcgaatgactcgcttagcgcatggactcgctaa

SEQ ID NO: 74458 - DNA, 759 bp, Glycine max
  Peptide Sequence Number=SeqID_191236
atggaagcatatcttgatgctaacgatgtatgggaaacagtagaagaggactacgaagttcctcctttgccaaataatcccactgttgcccaaatgaaaagtcacaaagaaaggaggcttcgaaagtccaaagctaaatcaattttgttcacagctgtatctccagtcattttcaacagaataatgatgatgaaaacaacacacaaaatctggaattttttgaaggaagagtatgaaggcagtgagaaaatcaaaggaatgcaagctttgaatctgattcgagaacttgagatgcagaggatgaaagattcggagacaatcaaagattatgcggacaagcttcttggcattgcaaacaaaatacaaaaatatgaagccacattgacttccttggagaactcaaaagatctttctactatcaccttggcagagcttttgaccgcacttcaggctccggaacaaagaagactcatgagacaagaaggtactactgaaggggctttggtagctaaatcacttgaaaaaaaaagaagggcaagtcaggaagtttcaaccacaaaaatggtagcaaatcctctcatgattttccatcatgtcctttttgtaaaaaaaaacaatcatccacagacgaagtgttggtggaggccaaatgtgaaaggccataaatgtggacaattagggcatgtggagaaaatctgcaagtcatcacaaaaacaagagaatgtacaagctgttgttgaagaggtggatgaagaataa

SEQ ID NO: 74459 - DNA, 681 bp, Glycine max
  Peptide Sequence Number=SeqID_191237
atgacttacgatcaagaattattcaaagatcttgatgcaacctacaacacaaatgtcagaattggaaacggagaaaaaatagcagtgaagggcaaaggaaccatcatgatcgagggttgcacagacaacacgctggtttggcataaaaggatgggtcattttcatcaaggcgctttgctctatttgaggaagaatgatcttgtacaagggttgcctgaatttgaagacaaatcacccgtatgtgttgcttgtcaatatggaaaacaaacgaggttgtcttttccaaaaggcaaatcttggagagcaacaagcaagctacagttagtacatacggatgtcgaaggaccacagaaaaccccatctctgaatggtagtaagtactatattgcttttattgatgatttttcaagaatgtgttggatttatttcatgaaaaacaaaactgaggttgccagcatattttacaagtttaaagcatgggttgaaaatcaaaatgaaagaaaaatgcagatattaagatctgataatggtacagaatatacttatgataagttcagcaagttttgtgaagatgcggggatagaacatcaattgacaacaccgtataccccacagcaaaatggggttgtggagcgcaaaaaacagaacgatcttggaaatggcaagatgtttacttcatga

SEQ ID NO: 74460 - DNA, 2111 bp, Glycine max
  Peptide Sequence Number=SeqID_191238
atgggggcgtcatcgccggcattctcgaggaacaccgacaatgaagatgctcactggtgcaacaaatcgagcacggattgcacttggttctcgatcgccggaaaattgcccaaggttgctggctcattggcttcaagggcggctcaagaacttgagaggcctaaagcttgtgccagcagatgttgggttaatgttgatgtcactaagtttgactatgagatatgtggtgcccagttagattttgctctgtcttcagcttcctcttttgaagagcagcatagagcaactaggagagaggatacccatcagactccctcgggaattaggaatggtcatggacagaggtacagtcaagatagttggaggggacggacagatattgtttcgttctatttcactcgatttctagagaaggccactgagaaggacttatggaaacatttcaagaagttcggtgatgtaagggaggtttttatacccaaaaataggaacaagacaggcagaaggtatgggtttgtcagattcaaaggtgtggaggatgtgcatagtctggaaagaaaacttgacaatgtcgtctacggcggtcttaggatttatgtcaacacacccaaatttgcaagaacccagcagtcgaaattagaattgaaacaattcactcctgttgagcacaggggagtggaggtaaggtggccaaggcagatgcaacccaggccgaatcaaggctcatatgcggatgttgtgactgggaatcaaagaggaacaaggaataaaagaatagtagtcactgaaaatagcagcaatgaaggctcatggtcttcggtgtatctcgaagtaccggaaacagggattaactggctcaaggaggcatgggtaggaagattgaaaaatctagtcatgtttgacagacttgaagatgacgtatattggggcgacaacgaagacctagcattgaaatacttgggggatgatatggtcctgatcctaggcctcaccgacgaaagagctgagaagatgatggcagaagaaaatgaaggaagagtcactccattccactcattggaaaaatggagcccgaagctgcgcacgggatacagattgacatgggtcagttgctggggtataccattacaggcctgggacagcatgcaaataagcaaaataatggcttttattggtgacatagtggatatggaggatgatgttgatgcagcttggaggctggacaaggttcgggttttgctgaaaaccccacgaaggccacttataaggcacacagcggaggtacacatcaaaggggaagtgtacagggtgtacatagtggaggaaggaggaggaggaaacccagacagaactcactgtacgagttggggagggtatggatcatcggaagagatagaatcatttgttagtgatagggaggatgactgcagtcccatggcagagcttggaaaaacggagcagaagtcactactgaaggcgattcgaaacgcgggggcaacctcttcggctccctttgccttggtccaaggccgtcgcgcgatgccagtagtggaggagcaacctgagccgcgaaaaggacccctgtcggcgcccaaaatggatgaacagcccatcatccttgcgcgtggagcgttgacagacgtgacctaccacatgcacgtggcgtcgacatccaccgcatattccgaagtgcttgcagtcgcggcggagcagagcacggaagacacactcgtggtcgcggcggagcagagcacggaagacacactcgcggccaaacaggaccagccggcgataatggcttcagtgacctcagaggaaacacaggtgcatgtgtttgggtctttacccagtgggtattcaaaacccaaatgtcttctggacaaagaaattacccaagagatccccaacctaacggctactgtgcactgcggggctagtgacacagctctgagtgctacagtgaataccccaccccaggatcagctccatgctcagcagggtactacaatagaatttaaccaaaatgaagaaaggcagggccctgaggtgaagaaaggcagtgcagagaggactgaaaagggaagcctagctgaaactattgaaaaagtgga

SEQ ID NO: 74461 - DNA, 984 bp, Glycine max
  Peptide Sequence Number=SeqID_191239
atgggagctctagatgtcctctactggtcaatgttccaacaattaggcataccagaaagccaaatagagcccttcctggaaccacttatcaatttcgtgggagaaacaatagacactataggatacgcccacttgttgaccactttcaaagataagaaagccgaccagataacaacacaagagtgttacactgtaagcctcagagtcggcaaagagaagaagggaaccaaacccaaggcacaactagtaagatgcacctctctcaacaatttgagggatatcgaacttgacccaagagaaacaaatggaagaccaaagctgacagaagtggtcaagtcttttcaacgtggcaaagaaacatcccagtacaccagaatcgggtgtcagatgaacccagaggttgaaaaagttgttacccgagtattagaagcaaatgaagacttattcgcatggtccatgaaaaggaaacttagccccaaaagaggaaaaatcgtggacaaggaagcaagaaaactgctaagcgcaagactcaagaatgttggagccacttaccaaagactaatggacaagatattcgccaatcaactagggaataacttggagttttatgtggatgacatggtgtcagttgagttgccaaagtttggaatcaagtatgagtcaaggggtcccgtgaaggcacaatgcctagccgactttgtaattgaactatcaaccaatacaaagtcagaatccgagtggtggaggttgtatgtagatggttcatctaacagaaaagggagtggggctggagtcattctagaaagtctagacgaagtcatcctaaagcaatctctaaggtacgaatttgaaataccacacaaccaagtcaagtatgaagctctagtggccgaactgagaatggctaatgaaataagggtcaaatacttaaaatgttggagtaactccaaactcttcatcgatcagttgaatgaagaatactag

SEQ ID NO: 74462 - DNA, 594 bp, Glycine max
  Peptide Sequence Number=SeqID_191240
atgcaacaacaacctcctatggttccacgacatcgaaaagttttccaccagcgttgttttgccatggcaacacatctgcaaactccaacctcgtcaaatgcgttcttgttcatctccaagggctggcgtgaggacctagcgacgtcgtttgaccgcgagctcgagaacttcttcgatttcaccatgtcgccattctccatgtcagcgatgtgctctccgctgcccaaggagattgagttcatcaagagtctgggccccaagctgacgcagattagaataaacctttccgcaattaagaacgtgattgtgttggcggaggaagggattgtggattttgaaaagaggagaaggaggaggttgagtttctgggaggagtggaaaaacgatggtgagggtgaatctagggattgggaactgattcaagtcttgaagacgcaattcaaggtgtttgagaagtgtggttcgtcttttgaggctttcaagaacagtgaatctgtcgagaaagtcaagtctagcttgaaatcaatgtgcaaggaacctcaggagtcaaagtacacgaatccatggatccttaagcagctcctctatgcataa

SEQ ID NO: 74463 - DNA, 507 bp, Glycine max
  Peptide Sequence Number=SeqID_191241
atgtccttttccggggagggttctgttcgctttgatgatgaccgaatgttttcacagaaggtccatcctataggagagagttccaacaataatcccatccatcttcatggtggttctaacgttgctagcggccaagtctcagatgttcgtgtggctaacgctatcgttggtggtgtcacagttcctccggatgctggccaaatcccttggctaaatcctcctccaaatgttatagatttgggtttagaggtgacaactatccagagtgttccaaggattcctttcttctggacttcatctcctatgaagttcataaaaaatcctattgcttacatgtctgactcggatcaggaaaacatggttgttcttctgataatgggcaagttcgactaccattcaatcaagaaggctcaggtggagaaggatgagaaagccaaggctgagaagatggaggaaaaattgaagactgatttcagtgaagccgaaactgagattctaaagacttaa

SEQ ID NO: 74464 - DNA, 3522 bp, Glycine max
  Peptide Sequence Number=SeqID_191242
atgttagagggcttgggaggggggtcaaatggccaacaattaaaagattggtcattaggcataaggttgacatgctttgtttacaagagacgaaaaaggagtttattgataagtccacttgccaagctctgtgggggggaccctaatgtcagctgggagtcacaacccgcatcaaattcagcagggggaattctttgcatttggaacaacaaaactttcaagttagagagaaaagttagtggaccaggattcttaatgctggaaggaaagtggcaccaagaggaccatcttatccatatcatcaacatatactccccgtgtgatatccagaataagagagttctatggaacaatgtccagcagctgaaaagtcaaagccaaaggggcctatggtgcattctgggagattttaacaatatcaggcacccatctgaaagacttagtgcctatcacagggagttgggggaaagtaacatcaacgagttcaacgaatggatcgatgagctagaggtagatgacgcgccatggttgggaagaaaattcacttgggtacgaccaaatggtaccgtaaggagtaagttggatagattcatgctctcttcagaatggcttgccaaatggccaggaagcacacaacaggcattggacagaaatttctctgatcattgcccaattttgctgtcatccaaaattgttgattggggtcctaaaccatttaggatccttgattgttggctttcggacaaatcttttagcaaaatggttcaagattcatggaactctactcagcaaagcggttggggagggttcgtgctcaaagaaaaaatcaaaaaattgaagcaaagtatgaaggtttggaacacacaacattttggtgacacttttaaaaagttcaagaaaattgaggaggagctaaacaagatggagaatgacacatgccacagacacttaacccctgaagaatcattggtcaggaagcggcttcaagaagaactgtggatagcggcccaatcacatgagtcgttattaaggcaaaaggcgagatcaagatggattagagaaggagattgtgattctagatattttcatttgctgatgaatgccagccgcagaaatagttgcttgaaaggagtcatgatagatggattatggattgaagagccggtaagggtcaaagaggcagtaagatcattctttatgcagcgttttcaagaaccggtttcagacagacctaggttggatggtatatcattccagatcattgatagactgcataatgatatgctagtggagcggttcaaggaagaagaggtaaaggtggccatgtgggaatgcgggagtgagaaatgtccaggcccagatggactaaatttcaaattcatcaagaagtattggaatctcatcaaaccggatgtcctgaggtttttagatgaattctatgttaatggaaaatttcccagaggttgcaatgcatcattcatagcacttattcccaaagtccacgagccacagtgtttgaacgaatacaggcccatctctttgataggttgcatatacaagatagtggcaaagctactggccaatagattgaagaaggtcatgcctttcatcatagacgaaaggcaatctgcattcattgaaggaaggcatttgctacatagcgtggtaattgcaaatgaggtggtcgaggatgctaggaggggacagaagtcgtgcattgtctttaaagtagattacgaaaaggcttatgactcagtatcatgggactttttgttgtacttactgcggaggatgagtttccactccaagtggattcaatggatagagggatgcctaaaatccgcttctatctcaatgttggtcaatggtagcccatcgcaagagttcataccacaaagaggcctgaggcagggggatccattagcaccgtttctattcaacattgtggctgaagctttgaatgggctagtaagacaagctattgtgaaaaacctgtaccggggatactcagtggggccaaacaatgttgacatcagcattctccagtatgcagatgatacaatcttttttggggaggcatccatgaggaatgtaaaagcaatcaaagcaattctgcggtccttcgaactcgtatcgggactcaaaattaattttgcgaaaagcagtttcggtgttttcggcatgtccgaccaatggagaagtgaagcagcagattatctcaattgtagcctgttgaccattcctttcatttacttgggtatgcctataggggcaaatcctagaaggattcccaagaagatggtcgacaagctagttcgcattcagagaaagtttttgtggggaggagcgcttgatcacaacaaaatagcctgggtcaagtgggacacggtgtgtctcccaaaggacaaaggggggctggggatcaaggatgtaaacacctttaatcatgcattactagcaaaatggaagtggcatcttttccagcatcatggacaattatgggccaaggtactggaatccaaatacggcggatggcggggtctagatgaggatgttagaggcagcaaagaatccatctggtggagggatctaaaggaggcgacccatcatccggagcatggcgacgcagtacagaagagcacagtatggagggtcggatgcggggacaaaattaagttttgggaagatgattggatagatggcagtggtgcattagcagcaaaatatcctagattgtatctcatatctagtcagcaaaatcagacaattcagcaaatgggggtccacaaagaatcagggtgggagtggcagttcacgtggaggagatcattgtttgataatgagatagacacggctattgcatttctaaaggatatagaaatccagcaaattcagccacaaaggtcagatgggtgggtgtggatggcagattctagtggccaattctcagtaaagagcgcttactctgccatgagggaggctccatcagaaatgacagaaggtacagcttacgtagaattgtggaacacgaaggtaccgaataaaatattagttttcgcttggagactactaagagatcggcttcccacaagaagcaaccttcataggcgacatgtggagataaatgataggagatgtgtgctgtgtggcagcatggaggaggacacagaacatttgtttttccattgtagcaaagtcattcctctttggtgggaatcgttgtcttgggtgaactatgtcggcccttttccgcaaaacccaaaacaacatttcctacaacatatacatggtgtgactcagggagttaggagggacaggtggaggtggtggtggttggctcttacatggtcgatttggcagcagcggaataagataatcttctccgatgacacattcgatgctaataaaatcatggatgatgcatcttttctactgtggacgtggctacggaatttagagaaggactttaacattagctacagtcactggtccagcaaccttagatcaggatttgtgtattag

SEQ ID NO: 74465 - DNA, 243 bp, Glycine max
  Peptide Sequence Number=SeqID_191243
atgtcttcgttgacatctttcattttaaagggtgtggccatgacaggaggtatactagaagtcgtatctaatccttggaggtttatactagaaaactggttatgtgactcagatctagataaccctactagaattgaccgggtccttattgaaaaagaccttcttgctgatgcatactcagattgtcctgaggcctctattctggacgagaaagagtttctcctactgaagggacaggtctag

SEQ ID NO: 74466 - DNA, 225 bp, Glycine max
  Peptide Sequence Number=SeqID_191244
atgcctcataatggaaaatggaatggacaaggagagagaaagtggcgagtttatggagggctgaatggaagggatttggttcaaagtctaaatgtgtttggatggagaatgatgaaaaaggagaatgaagaaggttgttggaagaatcactcctccggaattggtgttacacacaagatggtgttccttgataaaccaattttcttgaatcactcaagtaactaa

SEQ ID NO: 74467 - DNA, 690 bp, Glycine max
  Peptide Sequence Number=SeqID_191245
atggtggaaagggaaaaatttgatcatatagaagaaaggctgagggccattgaaggaggcagagattatgcttctgttgacatggtagagctatgcctagtgcccgatgtcgtcatatctccgaagttcaaggtgttggattttgacaagtacaaggggactacttgccccaagaatcacctgaagacgtactgcaggaaaatggaggcatacgtaaaggatgaaaagctcttgatgcatttttttcaagagagtctggatggggtggctatcacttggtatactaatctagaacattcccgggtctgtttctggaaggacctaatggttgccttcattaggcagtatcagtacaattctgatatggcttcgaatagaatgcaactacaaaacatgtgtaagagggagcatgaatcttacaaagaatacgcccaaaggtggagggatctggcagctcaagtagcacccccaatgatggaaaggaaaatgataacaatgatagaagacacattacctgtgttctactatgagaaaatggtgggatacatgccttcgggttttgcagatttagtgtttgctggagagaggattgaagtgggtctgagaagaggcaaatttgattatgttgcttcaggaataagaagcctagggaaaatggagagaataaggagggagaaacccatgttgtga

SEQ ID NO: 74468 - DNA, 693 bp, Glycine max
  Peptide Sequence Number=SeqID_191246
atgtccagttccgatcctaacaaccgtaaccgccacgctccgtctctgcatgagcccaagcccatgccgccttcttcttgggccaagaaaacgggcttcaggcccaaattctccggcgagaccaatgtcaccgattccggcccgatatccacgccgccgcccaacgtggatctcgaggccggtcgtgttcgaactccggcaaccgctaacggcgtcgccaacggcgacaaggctcccgtcccggttccgccgccacctgccgcggcgaggaagcggagagactccgacggcgggccgaggagttctgttcccagcaccaacggacaagcgccggcggcggagacggctccaccgccgcggaggacggcgaggcacgaggaagtggtggacggcttgccggcggatgacgacgggtttgtgtcgcggcactcgcatatgaagtatgaactcagagattcgcctggtttagttcctattggcgtgtacggaattcagcactacttttcgatattaggttcgttgattctgattccgcttgtgattgttcctgccatgggaggcactcactgttttgattttggtggcaaagttgttaatgtgttagtgagtgtaggaggaaacttctatggtggtatcgaccgtgctctttgcctcgggggtgactactctcttgcatattgcttttggctctag

SEQ ID NO: 74469 - DNA, 915 bp, Glycine max
  Peptide Sequence Number=SeqID_191247
atgagggagctccagggggctataattattggctccgctttccaaactttacttggatatactggacttatgtcgctgttagtaaggctgatcaatcctgtagttatatccccaactattgctgcagttggactttcattctacagttatggcttcccattagttggtacatgtattgagatcggtgcagtacaaatattagtggttattgttttttctctttatcttcgtaagatatctgttcttggacatcgcatttttctaatatatgcagttcctctgggtctggcaattacatgggcatttgctttcttgctgactgaagcaggagtttacagctacaaagggtgtgatgtaaatatacctgcctcaaatatggtttcagagcactgcagaaagcatttttcaaggatgaggcactgtcgggttgatacttctcaagcattgaaatcctctacatggtttaggtttccttatccactacaatggggtactcctgtcttccattggaaaatggctattgtaatgtgtgtggtttccttaatctcatctgtggattcggttggctcataccatgcatcttcattattggtagcatccagaccgccaactcctggagttcttagtcgaggaattggtttggaaggtctttccagtgtcttggctggtctctggggaactggaactggatctacaactttaactgaaaatgttcacacaattgctgtgactaaaatgggaagccgcaaggcagttcaactgggtgcatgctttctgatagtgttatcgcttgtaggtctggctcagtgtgagtgcggcctggaaagggaaatacaatatgacaatgctccagagaaattagaccctggactctctcctaaagaccttacactgttcaacaaccagatcccttga

SEQ ID NO: 74470 - DNA, 317 bp, Glycine max
  Peptide Sequence Number=SeqID_191248
tcatggtcgagctcctccttccttgttgtgtctgatttggtcgaggtgcattgttacggtggttcgttggaagtccatggttgtcgtggtggttggtgttgcgatgtaatgacagacgaagatcagtggatatatgacaacataatgtctgaagaagttaataagaatgaagacaatatagaggaatttggtgtgtttgaaaatattgattgtcctgattccttcaatatttctcaggtgtttgttactcgtgatgacgttttacattggggtcgctttgttgcgtatgatattggttttgtggcagtgataatgag

SEQ ID NO: 74471 - DNA, 387 bp, Glycine max
  Peptide Sequence Number=SeqID_191249
atggccaacattaacaacatagctgctctcaagctccagctttacaaccacatccgctccatgcacgatgagggacttgtcaatcaacaattccttcagcttcaagtcctgaggcaaccttttcgttgcgacatcatcctcagacttgtcaccacctactgtaattcctgcaaggatctcttttcttctctctctcaccaacttgaccaggagagggttaattatgaacgacttaatgatctcgctctggatttctatgcgaggacatccagcattggtgcagagggtgtaagacgtgcatgtgctagccttattgaagcatgtgagaggaaagataagaatgggatgagtgatatatttccaccaaactatgttccaaatcaatga

SEQ ID NO: 74472 - DNA, 270 bp, Glycine max
  Peptide Sequence Number=SeqID_191250
atgggtcaatggagagagatggtagatgggtttaagagtttagatggaggagaggtaggatcaaatgaaaaggaagtgtttaagtggctatggcaaatcaaaatctcaaataaggatgacttggcttcttgtttgtctggtcaaggtgaagaggatatttcacatgcatgttcttttctcatgcaaagtggctcaagctatttggtggagatgctgtatagccatgttggctgcctttcaaactcttctgtaattgcttcagcatctctg

SEQ ID NO: 74473 - DNA, 759 bp, Glycine max
  Peptide Sequence Number=SeqID_191251
atgttgggggtaatctaccgcgacctgaagccggaaaacgtgttaatccgatcagatggccacataatgctcacagacttcgacctttccttaaaatgcgacgattcctcatcaacggcacaaatcatctccgatcaaaaaacccttcccacagtcccacgcaacaattcccacgtggaacccgcacgtgccacctcttcttcatgcatgatctccaactgcatagtcccaacggcatcgtgcttcaacccaaaacgcagccgaaaaaagaaacaaacacattttaacgggcccaccttcgtggccgaacccgttaacgtccggtccatgtcgttcgtggggacccacgagtacttggcgccggagatcgtgtccggtgagggacatggtagcgccgtggactggtggacgttgggaatattcatgtttgaactgttttatggtgtgacaccattcaagggcatggaccacgagctaaccctagcgaacgttgtggctcgggccctcgagttcccgaaggaacccgcggcttccgccgccatgaaagaccttatttcgcagctgctggttaaggacccggcgaagaggctggggtcggtgatgggggcttcggccatcaagcagcacccgttttttcaaggcgtgaattgggcattgctgaggtgtacgcctccaccctttgtaccccctcctagtagtgtgaatgctgtatatgatgatcatgaaagttgtcctgagattttcattgactgtttttaa

SEQ ID NO: 74474 - DNA, 803 bp, Glycine max
  Peptide Sequence Number=SeqID_191252
atgatggacatgatgatcttgggaatgtgtatgcaccccatgcacatgaggatgcatgggggctaatacatggtgtcggtgttgaggacacgtggcatgatgtgattggtgggatgagggtgagtggggaagcaaagccgtcggaagcaccatttcaggaggagaagtttcgagacttacgccaacccttgcgcccttgtccttacactcagggttcctttgcccctcaccctccacaatctaactcaacaccaactccacccttgcttccacctcaactgttattacccacacaaacaaaaccttccatacccttcaaatgcctttcgcctaaagagatagccatatgcaaagagaagggactctgctttaactgtgacgaaaggtttagtcacgaccatcgttgctcttccaaactattcatactaatagttgatgatgataaggtttctccagaagaacttccacctactaacacatttcctgttgcaaaggagcatgatgaacaggtttctacccaaatcagcttccatgtcatttcaggacacatggccccagaaacactacgcttggttggatcaatctcaagtcagaaggttctcattctagcagatggaggaagtactcataacttcatccatgaacatttagtcaccattctaggccttcaagcacagcccactcaacctatacgggttatgattggcaatggtactgagattgactatctccatgtttgccgacacgtcaagctacacatccggggtcatgatttcatagtggatttggcggcgcggacttag

SEQ ID NO: 74475 - DNA, 714 bp, Glycine max
  Peptide Sequence Number=SeqID_191253
atgaatcgcatcattgaacaatatttgcgtgcttttgttcatcatcatccatcttcgtggggcaagttcttaccttgggtcgagtggtcatataatacttccagaaatggaagcactggaacgacaccttttgaaatcacatatggcaagaaacccctgacaataatgcaatacctctcgggttcttctccagtggaagcagttgatacgctactcacaacaagggaaactgtttttgagagtttgcgcaaaaatttgttaaaggctcaagctcaaatgaaacacttcgctaataagaatcgccgagaaatctattatacagaaggagactgggtcctagtcaaactttgtgcccaccgtacttttgcttacaagcttctccttccgaaaggctctcgtatccatcatgttttccattgctctctcctcaagccctttcaccatgatgccatcactgagctgcagccacttccgctatcggaaaaggacttcgataaccacccggcaatcacacccctcactattctcggtacccactggaacggtcctataaatgactcacacttacatgtactagttcaatgggtcgacctacctgttgacgacacctcgtgggaagacttggcttccttaaaggcagattatcaccttaaggacaaggtgattcttgatggggtcggaagtgatagaccaagtacgatacatggagcctaa

SEQ ID NO: 74476 - DNA, 462 bp, Glycine max
  Peptide Sequence Number=SeqID_191254
atggcggcatggcttttctcactcctactcagccctatcccgccattgtgcggtagaggtgaagggaaaatggagggtcttgagtgtgtagccaatgaagaccatgatggtcgaaacggtgcagtgttatttttatggggcagcacatggacaacatgggaagggacaacagagaagccaaattcccttaatgatgacttgctcgcgtgtgctcaaggagtcacaggacggtcttgtcattggactcatggcctagatctcgggttaaggtttggggatgagacgggtgagttaggtggtggtgttgtctgtatgtgcagtggaggagatgaagttttggaggcattgagttttgcttctaagtgtgggtgtcagagagcaaacacaaggttgttgaaatggacgatgaaaacaagggtaagagatgacgggaaggagggaatggaagaaaatggtcaataa

SEQ ID NO: 74477 - DNA, 858 bp, Glycine max
  Peptide Sequence Number=SeqID_191255
atggttgtgtatccgcaatatggtggcaacttgacaatgaagtcaagggataaatcttcccatgggcgagtaggaacaagtaatagggctaacaacccaactagtttcttgttccacttgagagtaaggaactctgggttatcagctaactcacctttgagttctgtgataaaggtgaaatgtggcatcggcagagcaaaaatcattcccttgttgggtttgaattgtctgggccatgagttccttgaggctttgatggcttggagaagtttagggcataattgcttactaaaaaaagcaattggatggtgttattgggataggactgcccccatgccagaccttgacgcatctgtctctagggtaaatggaagagaaaaatctggtaagcgtaacacaggggcgatgctcattgcttgttgcaaagctgaaatgcgtgaatggcttccggtgaccagaccaggtggtctttggttaaaagctggattaggggccaaagggcatcacatggaattcataatggccatagtgagtacagaacaccgttttatgcacatcttcgtcacgtataaggatctgatgatatccttgcaacaaatcaagtttggtaaaccaacgagagcgccacccagttcatctagcaactcatcaatggttggaatggggaatcaatccttaatgcatcagcaaggagaacaagctctagctaggtctgatgatagtgctgcacaacatggtttcgacttgagtctcaatctcgtgcttatgaaaatatggatatctgtaaggctggacgttaacaggaatcgagccgggaagaaggttaatggagtgggaaatgtcacggtgtgggggtag

SEQ ID NO: 74478 - DNA, 276 bp, Glycine max
  Peptide Sequence Number=SeqID_191256
atggctcccggggcaaagttctgcttgcttttgaagataataaggtcttcaaaaattggggttaggtttgataaatcaattccagatggcaatgatcttggaggcctttgtgaggatgatcgtgggttcttttgttctgatgaccttgaagcaacttgggcgtcttttcccaaacaaagtgacaatacagctgcctcagcaactgaagctggagcaaatttcattaacatttcaatgtccagcattacttcaaagaggagtgggaatgcgggatag

SEQ ID NO: 74479 - DNA, 519 bp, Glycine max
  Peptide Sequence Number=SeqID_191257
atggcgcgggtgacagtagttgaagaaaccttaaagggaaaagaaaccattcattcggaaatcgtaattatttctgttgacctggagaaggagacttgcagatcactgtttcttcccgacgatttttgctttgttgatacaaatattggagtttttagagactcgctgtgcgtttggcaagatagcaacacccatcttggcttgtggcagatgaggaagtttggagatgacaagtcttggattaatttaataaattttagttatttacatcttaatattcatccttatgaagaaaaatccatgatttttccattgtgcatgtcaaaaaacgaagacttcttcatgctgaaattcactagaaatgctgatgatgaataccaaacaattctgtataaccagagggatggtaagtctcaagtttctgtcgttccctcagatagttcagaacgttgttgtggcgcaacctcaagatttttaccaaaagtttggtcataccttattgaaattctacagatttaa

SEQ ID NO: 74480 - DNA, 1314 bp, Glycine max
  Peptide Sequence Number=SeqID_191258
atggaagggggagaagatatacaaaccgtgtttggacgcttccaaaccattctaaatgagcttcactctctagccattaagaatcttgattctatgacccccgaagagctcatcggaatccttaatgttcatgagcaagagctttctcaagatgaaggaataaagaaagggaaatcactagcccttatagttcaaaaaccaaaatgtaactttgcatcgaaagagtcatcatccaaagtctttgccataaatgatgcttcagaaaaagaatccgatgatgatgactctgatgaagaagattatgaactaaggcatttcaagttggaatgtcttgaccttgaaaagccaaaggataagaagaagaaattcttcaataaggtagaaccaacactggacacgagtttagatgatgaggactctcagcctaaggacactgtcaactctgatgctgaagaggcagattgtcagcattacaaaaagatgtcttttgatctgaactataagcttaaggaacatgaggtcttgagggaactacctcctgagattgtgcaaagaaaccccaaagacaaatctgggcatggttttagagacaacaagattgtacatgggcaacccaccaagggtgatgcaatcctcccaaggaggggacccatcaccatagccatggctaggagactccaagaagattgggccaaagatgcaggggaatgccctagggttctcatgagccttaggtccactgccattgatcttcaagaagcaaaggactccattgatgaagaagatccaaggcctacaagctctacatggagctacatcaaaggggataaccttggaaagtttgactccaaatgcgattctagaatcttacttggatactccaaatcgtccaaggcatatagagtgtacaactctagaacctttattgtagaagaggctattcatgtaagatttaatgacaacaagtttgacactacaatgttagagctggataattcttttccagagatgaaaatagaaaatatcgtcaagtgttcttctgcgtctagccaagatgagcttgcgtccaacagaccagtggatgatcaacctaaaaaagtcagagaaccaataggacccttgctaacaaaacatcatccaaagcctcaaatcattggtgatcctaaggacaaagtgaaaacaaggaactctctcaagcatacagtgctactatcaaagattgagccaaaacacatagatgatgctatgtttgatgaacattgggtcaaagcaatgcaagtagagctggaccagtttccgaagaacaatgtctag

SEQ ID NO: 74481 - DNA, 144 bp, Glycine max
  Peptide Sequence Number=SeqID_191259
atgtctgctagtggggagagtaactttgacgaaggagatgacagtgacatctcaaaagtggatgatccagaggtcaagatggatcttacggatgacttattacatatgttgccgtcaccaccgcgagcgccaccaccagaatag

SEQ ID NO: 74482 - DNA, 456 bp, Glycine max
  Peptide Sequence Number=SeqID_191260
atggctgaagccgcaaaacctgtcaacaatgttgaggcttccaaccccacgccactgacaacaatctttgctaagccattgcttgatatctcaaaaattgagttgtctttgctttttccactcccaaacatgatgtcgttgttgatgccactcaaccttaacaatgggttcgagctaataaggtacagagttgtaagaaatgacaatccttataagccgagggctaacctggttgagggagatggcattattgctgcgtatgtttaccccttacattatgtgggggatggagaagaacaagtttatcttagtgatttgagaactatttcggttcaaggaaaggggaaagttcttcttaagctcacatctaggaaaacaccggctttgaataatgtgctacatgttccttctatcagagttaaccttatttctatagcattgttgggaaatgttggg

SEQ ID NO: 74483 - DNA, 606 bp, Glycine max
  Peptide Sequence Number=SeqID_191261
atgcatcatcatcgttggatcaatgagacgatctttgaaaattatcataatctacaaattcatcaacagatgcactggatttcccagaatttgaacacttcacaatacaatgagggccactgtaaaacaaaacaatatatcacatttctcgataacatatgcaatttgccattatcccaattcagaaatgaacatcaattatgccgccaacgaatacgcacggcagggcgaggttgctacggtagccgctcgcggaagtgggtgatgctcttgtgcggccgtgagctggcggccaaggtaagagtcaaaggaagcaccatcaggggttcaaaggaagcgcaagagtctagggatttcaaattaaagtgcacgcatggaaattatgtaattaggggaaaaaacaataacgtttttatatataaacccattgttgctttccagcactcaaaacatgagcttcaatattgctctcgtggagctgtgtttgtcagctccgccaacgtagatgctgccaatgaatacgcacggcagggcgaggttgctgtggcaaccaaggacgacgtagagctcttcgcggaagtgggtgatgctattgtgcggccgtga

SEQ ID NO: 74484 - DNA, 738 bp, Glycine max
  Peptide Sequence Number=SeqID_191262
atgttccttccctggtggtgttcattcaaattttactgcatagatcaagccagtgatcacatagcccttctcaaagcttttgaaggatggaaggaggcaaagcgaagtgggaacgaaaagcagttttgttgggataatttcctttcccctgcaaccttgcggttgattgacaatatgagaatgcagtttctcaatttattatctgacattggatttgttgacaagtccaggggtgctaatgtttacaaccagtatagtcatgatttggagatggtttgtgcaattctttgtgctgggctctaccctaatgttgttcagtgcaaaagaagaggaaaacggacagcattctacactaaagaagtagggaaggttgacatccatcctgcttctgttaatgctgggatctatctcttccctcttccctacatggtgtatagtgaaaaggtgaaaactaccagcatctatattaaagactctacgaacatttcagattatgccctacttctatttggtggtaatcttgtccctagcaaaagtggtgagggcattgacatgcttggaggttaccttcatttctctgcttcgaaaagtgtcatcgagttaataaggaaactacgtggggagcttgacaagcttctgaacagaaaaattgaagaaccaggatttgacgtttctgctgaaggaaagggagtggttgctgctgctgttgaattgctgcacagtcaagtcatgagataa

SEQ ID NO: 74485 - DNA, 693 bp, Glycine max
  Peptide Sequence Number=SeqID_191263
gatattgatgtagatactaattacaaaaattacagcttgggtgttagaaaatctctagaagcttggtcaggttcgcagattgatttgggtttggtagaggcaacaattgagtatatatgtcgcaatgaagctggtggagcaattcttgtatttctcactggctgggatgaaatttctaaactgcttgacaaacttaaaggaaataacttagttggagaccctagcaaaaaaatcgtgctagcaacaaatattgctgagagtagcatcaccatagatgacgttgtgtatgtcatagactggggaaaagcaaaggagaccagctatgatgctctaaataagcttgcttgcttgttgccatcatggatttcaaaggcttcagctcatcagagacgtggtcgtgctggtcgagtgcaacctggagtttgctataggttgtatccaaaactgatccatgatgcaatgcctcaatatcagttagctgaaatccttcgaacacctttgcaagagttgtgccttcatattaaaagtttgcagcttgggactgtaggatcatttttagaaaaggcacttcagccaccagatcctttagctgttaagaatgctattgaacttctcaaaacaattggggcgttagatgaacaggaagagctcactccacttggtatattatgctggatatgtttgtctccttaa

SEQ ID NO: 74486 - DNA, 861 bp, Glycine max
  Peptide Sequence Number=SeqID_191264
atggcgagtgcgtgggtgaaatcgtggcagtgcaagtcaagagctttcgaagacgtgtaccacccacaccccaaaatcctgagtgcaagctgcagaaagaccatggaaagcataaaagaaatggtggaaatacccaagcccaggcccaggcccaggcccaagccaaagacacccttggagaaacatccgagctccaaatacccatcatcagccaccaaacctgaattcgaagcacgaaccaccatgacacgttcccgaagcagcacgacaacgacaacctcgtcgcgtggcatcattgaacttcccgaaggccacccttcgcgcaatgttgtcgaaatcatcttccacaccagctggggccccaagccgttcccgggtcgggtcgagctaattttcaagctgcagaacgcgccgcgcacagtgtcgcgcttcgaggagtttcgcgaggcaatgaaggggcgcgccgccgcggggctcgccgagggcaacgacggcgaggagaacgcgcggtgcatcgccgacgggaacgaggtcatgcggtttcactgcctgggtcccgccggggacggtgggccctacgacgctggatgtgcatggtcgtttccggagaagaagggggcggcgatttgcacgttttctggcagcggcggcgcgcatgaaaccgccggcggaggtagggggagaagggccatgttggtttgtcgggttgtagcgggtcgggtctcaaagcaactcgggtttctggactcgttgttggacaagcgagtcgggttcgactcggtgagtagggataacggcgagttgctagtttttgactcgcgtgcggtattgccctgctttcttattatttacaggttgtaa

SEQ ID NO: 74487 - DNA, 1272 bp, Glycine max
  Peptide Sequence Number=SeqID_191265
atgacttgtgtggaaattggggatggtgatggcaggctaaaaatgtatgtaaaagtggcctggctgggatttgacactaggatcaggcagttcacaaaaggacttagtgtcactagctcttggtgctgtacttggtctggccaattttttggctaccctaaggtgcatattgtacttgtgctactgattaaaatgtccacagacattgagagaagggtaggaaatcttttgaatagctcacagtcaactggggcaacactgtctagtcttccttctatatcagctgaccttggacaaaaacaatctgcagcccctataaaatatgtttcttcacgacagactgattcttctaaggagaaacttagtgttgcactcaaggaaaggcaagaacttgtacaggcaagtgatagtttgaaggaaatgaaatcatttagggagaagcttcctgcatttaaaatgaagtctgagtttctgaaagctgttcaagaaaatcaggtattagtagtttcaggagagacaggttgtggtaaaacaacacagttgccacaattccttctggaagaagaaatatcttgtttgcgcggagctgattgcaacataatttgtactcagcctcgtcgagtatctgcaatttctgttgcagctcgaatatctgctgaaagaggtgagagtcttggggaagcagttggataccaaatccgtcttgaatcaaaacgttctgcagaaacacgccttcttttctgcaccactggtgtattacttcggcagttggggggagaaaaagggggggtcaggggaggttgcatgtctcatacttgtagtaaatataaaaccatttatgaaccttcttctaatagcgtacaagacccagacttgactggtgttagtcatttgctggtggatgaaattcatgaaagaggcatgaatgaagactttttaattataattttacgtgaccttcttcctaggcgtccagatttgcgtctcattctgatgagtgccaccattaatgctgatatgttctctaaatactttgcaaatgccccaacaatgcacataccgggatttacttaccctgtggcagagcacttcctggaagatgtgttggagaaaactcgatacagcatcaagtcagattttgacaattttgaggggaattcaaggaggagaaggaaacaacaggattcaaagaaggatcctttgactgaaatgtttgaggcatgtatatttgacccatcaatccatgtctttaaaatcttcatgatgtattag

SEQ ID NO: 74488 - DNA, 514 bp, Glycine max
  Peptide Sequence Number=SeqID_191266
atggtcatccgcacaccttttcgccatccagagacgatcgagtccgatggcacgcagagacaaattatggtcattctgcacttttgtcatccaaaggcggtgagcccgatgacatgcggggaaccatttggtcccgcactttttcaccttttgtcatccagaggcggcggtgggcccgatgacatgcggggaaccatttggtcttgcacttttttcaccttttgtcatccagaggcggcgggtctgatgacatgcggggaatcatttggtcccgcactttttttacctttgtcatctagaggcggcgggcccgatggcatgtgggaaaccatttggtcccacactttttacaccttttgtcatccagaggcggcagactcgacgcctgatagcacgcagagactaaagtcgtcttctgcaccttttgtcatccagggacagcaagttaggtggtgggtgaagataccttatggtcatctgcgcctttcatcgaccgaggggaacgaattcggca

SEQ ID NO: 74489 - DNA, 256 bp, Glycine max
  Peptide Sequence Number=SeqID_191267
atgtcaaatcataaaagcactgagtcagcactgaaaaaccttgaggtccaggtgggacaactggccaagcagatagctgacaagtcatccaatagttttgtggcgaatacagaaaagaatcccaaggaggaatgtaaagttgtgatgacaaggagtaagaggtttgtggaggcggaggatgaggacagtggtttcgtgcccaagaagaaagctgttgaaaagaaaggtactgatgataagaaaggtgatgtgagag

SEQ ID NO: 74490 - DNA, 183 bp, Glycine max
  Peptide Sequence Number=SeqID_191268
gtgacacagggatccttcgtcccccgtggacgtcaagatgttctcatcgctgctattggatgtccagagcaccgtggacgtgttcgtgctgctggagctggtgtcaccatcaagcaatacttcggatcggctccacggacatcccatatctcttcctcactgcctcctgaagaattgcaatag

SEQ ID NO: 74491 - DNA, 252 bp, Glycine max
  Peptide Sequence Number=SeqID_191269
atggtgcagttggctttttcaacgtcaaggacatctgctcctaggattgtttcgtggtctcctcctttggatggtggagttaagttgaatagtgatgggaattctcaagggaatataggcttgtcgggatttggagggctgttacgtgattcttttggtatctggattcatggttattctggattttgtggttatactagtattcttaatgaagaattgcttggtatcttgtatggtatgaagctcgcttga

SEQ ID NO: 74492 - DNA, 753 bp, Glycine max
  Peptide Sequence Number=SeqID_191270
atgcaagacgaagaccctgctgcagcccttcgactcctgctgaacaccagtcaagccaacacctcaagtgaaaagaatcctggtgcttcgtcctcatctgatgccgaaataaattcttcagtacgccaagattgcctgctcctgaagttatctatggaatacgcacgggaagacgtacttaaatccattgaagagaacccctctgctgcttttgggcacctgaactttttgaagaaactgcacaacccccttacttctgatgagattctgggcaaagttatccaaatcgagtccattatcgatcaatttgcaagtactgtgcagaaaaaatgcgaaaatggcgccagactcgatgcccagaaacaggcccatatccttctgctcgagaaagcccgagcggctcaacgtgaagtcgaacgtctcaccaaagaggcaaaagaaggatcttctgaggtcaaagcctgcgatgataacatctcctcctgggaagcaactattacggatttgctgtctcaggtcgatgatctaaggcaaaaaattgtgacagagcaggcaaaacgccaagaacttcaggagaaggctgctaactcgattcagaaactggttgctgaaaaagggagggaaggcctgaaggcctttagcgcatctcaagctgtagcagatgaggcgagagttatggagagtgctgaccaggtcttgagcaaagagatggccaccttgaagaaactatatgaggacttagtcatgcattag

SEQ ID NO: 74493 - DNA, 364 bp, Glycine max
  Peptide Sequence Number=SeqID_191271
atggatgagccatatttgggtgtagatctaggcaatgttgatgtcttggttcattttgtgggaatgaaagatgaaccatgtgaaatccacaacgtggatcctgacaaaaataaagaagagctttggcatgaacctcaactggctacacctgttgtcaatgaacctatcaataagggtataaatgagcaatctggtgagtatagttcctttgatgaacatgtagagtcaatagatggggatgtcttaagtgactttgatgaatcagtggatgccaatggagctggagttgctgatgactacatatggaggatccatgcatctccagttgtagacaaagaaacttatcagataaagtcctatgaag

SEQ ID NO: 74494 - DNA, 255 bp, Glycine max
  Peptide Sequence Number=SeqID_191272
atggttgcaatggttttaaacatggttggtcatggagtaggcatcacacatgatgcatgtgtattcgagaatgctctcacaactattttcatgaatttcccacatccaccccccgatgtttgcaatttagaatgtatgcctaagttcaaatgtgaaacacaaagaagaaaaccttcgtggaagggatgcagtgggagcaagatcgtggggcacagaggtggtgatcgtggagcaagaattcttcatgttgtgtaa

SEQ ID NO: 74495 - DNA, 1008 bp, Glycine max
  Peptide Sequence Number=SeqID_191273
atgaacgacttgttctccggttccttctcccgcttccgcagcgaccagtcctccccggaccgccaccacgacatcgagatgggcgccaccgcctccagcggcggtcgcggcggcgaggtgaaccttgacaagttcttcgaggacgtggaaggcgtgaaggaggaactaaaggagttggaaggtttggctcagagtctaaggagcagccacgagcagagcaagacgctgcacaacgcgaaggcggtgagggacctgcgcgcgcgcatggacggcgacgtctcggcggcgctgaagaaggcgaagctgatcaagctcaagctcgaggcgctggagcggtccaacgccgcgaaccggaacatgcctgggtgtggaccgggttcgtcctcggaccggacccggacctccgtggtcaacgggctcaagaagaagctgaaggatgctatggagagttttaacgagattcgccagcttgtgtcctcggagtaccgcgagaccgtgcagcggcggtacttcaccgtcaccggcgagaatcccgatgacaagactctcgatctcttgatctccactggtgagagtgagactttccttcagaaggccattcaagagcaaggaaggggtagaattctggacaccatcacggagattcaagagaggcatgatgctgtcaaagagatagaaaagaatctcaaggagttgcaccaagtgttccttgacatgacagtgttggtgcaacatcaaggtgagcaattggatgatattgagagccatgtggcaagagctcattcgtttgtgcgcactggagctgagcagttgcagactgcgcggaagcaccagaagaacaccaggaaatggacctgctattgtatcatacttcttctggtgatcatcttgtttgtggtgctcttcactgtgaagccgtgggaaaatagcagtagtggcggcaatgggggtggtcagcctgcaccagctcaaacacctccatcaccttcacctcctgttaatgcttaa

SEQ ID NO: 74496 - DNA, 273 bp, Glycine max
  Peptide Sequence Number=SeqID_191274
atgaagaatacgtgtagaatggtagcagacagaaaaagggttaacggtactagtatgcatattgatggtcttcctccgcgtttagtggtgtgtacggcgaaacggattaaacttgcaagctgcaatgtagaatttaggtacgagagtggtcatgggggaatgttcgtattaaccataatggaatggtatgcagagtcttccaaggttagtgattgggaattatggttaagaaattcaattaaatgggagtggtggccacctatatatatataa

SEQ ID NO: 74497 - DNA, 993 bp, Glycine max
  Peptide Sequence Number=SeqID_191275
atggcgatgcaaaccgtttatctgaaagaacatgaaggacttgtccacagttctgttgggcagttgtcatctgtaacttcagctccctggtggagtgccttaggatctcaaccagtttacggggagtattgtggtcaaatgaagtccttttcattggagatttccaactatgtggaccaatttggtgctggtaagcaagcggcacgaggagttgagcaattgttggataaaggacatacaactcagtttaccatctttccaggtatctcttcttcagatgattgtaagatgtcaggtgatgcacaaaatcctcaggcaacattatcactgcaatcatcactggctgagccccacaatcgttttgagataggggttaatcagcctatgggacggataatgcttccaattaacttgacatccgatgaaggaccaacttacgtaaatgctaagcagtaccatggaattatcagacgtaggcaatcacgtgcaaaagccgtacttgagaacaaaatgataaaacgtcgcaagccttatatgcatgaatcacgccatctacatgcgacgcggcgaccaagaggatgcggtggtcgcttcttgaacacaaaaagctctactgatggaaatggtaaaaatgaaagtgaagtgattaaaaccagcggccgacaattccagtccagtgcctctcagagttctgaagtcctgcagtctgaggttggaatgttaaattcatcaaagcagacaaatcgaagcagtccaaacatctctggttcagaggtgactagcatgtattcaagggaaggttttgatggcttttctgtcaatcctcttggatcttccgtccactctctagcagacatgataggtagtgagcatggtatcattaggcccactaaatgggttgcagcagtaccaggtgaagaagttctttttccgtttcctgtgttcattgtgacgaattttgttttggaggcgtgcctctacatctggttttag

SEQ ID NO: 74498 - DNA, 2289 bp, Glycine max
  Peptide Sequence Number=SeqID_191276
atgcacacaaaagctgagactcgcaaaatcatcattgatttcgttgcatatattgaaacacaatttgatggtaaagtaaaaattataaggagcgataatggagctgaatttcttatgcatgatttttatgctctaaagggaatcattcaccaaaccacttgtgttgaaacacccgaacaaaatggcattgctgaacgcaagcatcaacatctcttgaatgctacacgagcccttttatttcaggcaaatcttccactcaatttttggtgctttgcactacctcatgcggcatatttaatcaattgcattcctactccttttttgcataataaatctccttatgaaaagttgtatgagcatccatgtgatatctctaaccttcgggtattcggttgtttgtgttacatcagtacccttaaaacccatagacaaaagcttgaccctcgagcccatccatgcatctttattggcttgaaaccacataccaaaggatatcttgtctatgaccttcactcccacaatattatagcatctcgcaacatcgtcttttatgaagaccatttttcgttatttcatgaaaaccaagcctcaaacaccacacatacctctctttccccaactccattttcgagcaaccccgaaaattttgactctcctatcacacccattgtcaacccgtcttcttcacatgctcacgaccctcacctacgacgatctacgagaccgaagcatgcacccacctacctccaagactaccatcgtgatctcacttctctcactgttaccacctcgcccaatgttcggtatcctcttaactccgtcttgtcttactctcgtctctctccttcgcttcgtcacttcgtcatgtccatttcggtatctactgaacctaagtcttatgctgaagcttctcgatttgactgctggattaaagcgatgcaggctgagttacaggctcttcaacagaatcaaacttggactcttaccactcttccacaacataaaacaaccattggttgtcgctgggtttacaagatcaagtataatgctgacggctccgttgaacgatacaaggcacgcttagtcgcgaaagggtatactcaaatggaaggtttggactttctagaccccttctcccccgtagcaaaactcactactgtgcgtttacttcttgctctagctgcccttaataactggcatttacggcaactagatgtgaacaacgctttccttcatggagatcttaacgaagaggtctacatgcatcttcctaaagctgatcattatcttttcttgtactctactaataacaatatcacaactattcttgtttatgttgacgatagcattttgacaagtaataatctagctactatacaacatatcactatgctacttgatcaagctttcagtataaaagatcttggcactctaaagttttttcttggacttgaggttgcccgttctagtcacggtattcatttatgccaacgcaaatatgttctggatattctatctgactccggcatgcttggttctcgtcctacttcaacccctatggactattctacacgcttgaatgctttaatgggcaccccattatcaaacacttctgcttcttcatattgccgtttgattgggcgtctcatttatctaacaaacacacgccccgacatcactcatgttgttcaacaacttagtcaatatatggcaaatccaaccactgcctattcgcaagctgcctttcatgtttttcgttacctcaaaggcacccctggctctggtatcttcctcgcagctcaaggcagtccccaactcaaagcctttagcgactcagattgggcaggctgtcgtgataccagacgttccatcaccgacttctcgatttatctaggtaactctctgatttcctggcaatcaaagaaacaatccacagtttctcaaagctcttctgaggtagaatatcgagccttggcatctaccatgtgtgaacttcattggctcacatatctccttcatgattttcacgtctccttcattcaacctgtgaccctctattgcgacaaccagtctgccatccagatagcttctaaccctgtcttccacgaacgcactaaacacattgaaattgattgccatatcgttcgagacaaagtcaatagcggtatcctcaagcttcttcctgtttcgtcttccatgcagctcgctgatattttcacgaagcctctatctccagctctctttcaaggtctctgttccaagctgggaatgatgaacatccattcctag

SEQ ID NO: 74499 - DNA, 177 bp, Glycine max
  Peptide Sequence Number=SeqID_191277
atggacatgtcatggcctccgccaaccgtcacgcgagttatttatagcaaccaaattcatcgtcgtcaaagtcataaatggaccaacaactctaatgaattattggatcagatgaatactttgggaggcaagaaaggaaaatcagacttgcagtttgcaaatggcagggtcaaatga

SEQ ID NO: 74500 - DNA, 648 bp, Glycine max
  Peptide Sequence Number=SeqID_191278
atgagcctgccagctccgccttggccctatgccttttggccagctcgtctggacttggctttgaccggtctgcccccctcttgcaaggattcggcgcctccacttgatgctttacgcccacgcttcgttcaggcagcgctactcggatatgtcttgccaatcgccaaagcagtgctacttccaggatttttttcggccaagctcgggaaccttccctttagtgaaaggctctatcccgggacgaagagaaagagagggggaaggccaagtacgagatcacagggatcgggctggtggagcttgacaagagcgatacaggaaaccatacaatcgaaggctagcaagaagaagcaaaaagatagtcaaagctcaagggattcatcacgaaggcaagtgctccagcggaagctatcaattcaaagggaagaccgggtagtggtagttaaccgggggagggagcagctcatccgtcaggatgggatccctctacttcacgtttttggcttatctttttcttgcgttgacgcttccaaagcggctccgtctccgcctccgccttctgcgctcccagttgggtatctccgaggacttgagctaagggattgtttactgaacgtcccatacttgacctatcgctccattcggtga

SEQ ID NO: 74501 - DNA, 318 bp, Glycine max
  Peptide Sequence Number=SeqID_191279
atgcatgatgcaatcaaggaatatgccagaggactatatgagacaatgcatcatgaaaagaggaaaactctagatgaggcttcactgctgtcgcaacctacccttcggcgggagggcgacgcgagactcgcgggatgcgtgttccacaaaaggaatacgcgcggagtcaccaccaacgtttatttgaggaaaacgtcggaaaaaccgggaaagacgcgatctacgaactttttaagtgaaaggttcgggagtttgtatttacgcgcggggaaggtattagcaccccacacgtccgtcacaagggacgacggcctttaa

SEQ ID NO: 74502 - DNA, 570 bp, Glycine max
  Peptide Sequence Number=SeqID_191280
atggagcggggcagattcaacaagcaggcctcaatacgaagataccaagccagacgatcaacagcagacagaaagaaacgtgtcacctttcgcggagcagttaatgagggtgatggagcttctggacacaaatctcgaaggaaaagcgaagctaagataaaaggctctacggagatctacgaagtgatgggagaaacgtggtgtcgcaagagatcgacggagctgagaacttaccacaagaactaccaggttgaaacgtggagcaagattctgagttctcttagccctaaaggtttgaacgagaacgggaaggtgcacaagccggtgctgaaggagcgcttcaagagcttcaacgcggcgtttgaggagattcacaagacgcagagcgcgtgggtggtgtacgacgaacagcttcagtcggagcttagggtttctatttccgcgctcgtgattccggcgtacaggtccttcttgggaaggttttcgcaatacttgtatcccggaaggcaagtgttaaaatatgtgtgcatgtgtgtgtgtgtgcgcgcgtgtgtgttgtatgcggcatga

SEQ ID NO: 74503 - DNA, 348 bp, Glycine max
  Peptide Sequence Number=SeqID_191281
atgtcgcgggggtcaggagacctcggggacgtcagagtgctgtgtaattcgtgtttggcctctggtaatcgattaccaaggctgtgtaatcgattaccagagatgaaaagccttgagatcgtgatggcggcgcaagtaatccatgatcgagtggagatggagtgcctagagggagcttgggagaccctcgaaggcaatgcgaggtgccgatttcggggcacgattcgattcatggctacttcattggtgcatccagaggaacccacgcgcacgcttcagcgcactatggagtggatattacccacgccaacaccatatcgtctagtggagccagtccaagtgatcaag

SEQ ID NO: 74504 - DNA, 935 bp, Glycine max
  Peptide Sequence Number=SeqID_191282
atggcatccctgatgatgtctttggtggtgctgcttgtgggcctggtcgtttggtttttcgtgaaccgcgccagttcacgtacgaacgagcagatcgaactgctggaagcgctgctcgatcagcaaaagcgccagaatgcgttgcttcgccgtttgtgtgaagcgaacgaaccggaagagaaagacgcgccgaaagacacggttgctgaagacaagaaagacgaagacgactttatccgcctggtggccgtggtctggaaaaatccctggtatgacccctccctgaaccatcacaccccaaacggttttcgtaatacccaacctggtggacatcaacccggcgaccttgaccgctggcgtaaagcacgtaaagaggccggtctaccgaaaccgcccacactgggttatgacaattttattcgccagtggtggcaacccgctgtgctcacgcaaccgcatgaagatggcgtatggtggctggggcatgcgagcgtgttgctgcagatggacggcaatatcctcctgaccgatccggtattttcacggcgtgcttctccgcttccttttctcagaccacagcgcaggacgcctcccgcactgtctgtcgacatgcttcagcaacttgatgcggtcgtcatctcccataatcactacgatcatcttgatgacgcgaccattcgccgtattctcaggcgtttccccaatgtgcagctctttgttcctcttggcctggctgcctggtttcgacgtcggggagcaaaacaggtggttgaactcgactggtggcaaagtttcacctggcagggaatgacgctcactgctgtaccggcgcagcactggagtatgcgcacgccgtggaaccgtaatcgctcgttatggtgcggctgggtcatggaaggacgacgtcaccgtttctggttcagcggtgacaccgg

SEQ ID NO: 74505 - DNA, 240 bp, Glycine max
  Peptide Sequence Number=SeqID_191283
atgcgcgtaattattcgaacgattatagtactggcgatactctggattggacttttgttaaccggctacggtgtgcttgtgggaagcaccgaaaatgcagcaggcttaggtattcagtgtaagtacgtaacagcacaaggcgtaagcacggcgcagtatctccattctgatagcggcatcattggtttaaccaactgcccggtactgagaaagatgtccgtcgtggttgataatggctaa

SEQ ID NO: 74506 - DNA, 240 bp, Glycine max
  Peptide Sequence Number=SeqID_191284
atggaggagttgattaacaaaacacaactctctcccaaatctaatcccaacttcatcacgtcggctcagcggctccacaacagaatctcacttcctgcaccctactgctgtcattctgctcccatgaacattgttcgcgatcatcacagaatgatgcatgcacttgacctcaactctcagatgcaatgcggtacgtaccgtatccaataccaaggaaatagcctaagtgtgtccacatga

SEQ ID NO: 74507 - DNA, 429 bp, Glycine max
  Peptide Sequence Number=SeqID_191285
atggccgcacgtcatcgagcaaaggagcccgttgacatgcagagactagtgtcgtcttctgcaccttttgtcatcctgacctatgaagggtaccgtatggttatccgcacctttcgtcaacccggggtaaatgagcccgttgacgcacagagactaacatcgtcttctgcaccttttgtcatccagggacagcgattcaggtggcaggcggagataccttatggtcattcgcaccttttgtcaaccaaggcgaacgaattcgacggtattaggatgatgttggtttactctcatcgtcctgagacattcaagcctgacgacacacaagattcttctctgcagggcggggggcgatcaagttcgatggcgtggggaaatgtcatgggaccattatttggtggcatgcacccttcgcttgatcgcctcgag

SEQ ID NO: 74508 - DNA, 1098 bp, Glycine max
  Peptide Sequence Number=SeqID_191286
gcgcaggttcggcagcgcgcggatgcggtcggcggggaacggcgtgcgttcgcgcatggcgacgatgacgtcgaacggcgcgagcgtggcctcgacctgctcgtcggggatgaagttgttgaagatccgcacttcggcgtcgccgccgagggatccccagtccgcgtagcgcttggcgacgtcgtggtaatcgtcgagtattgcgattttcaagttggtctccgggtggcatggcgctcgctgcgccagccgcccggccggcgcgacccgcgccggtcagttcagtcgtgccttgagttggtccagcggcagcgcgccgctggtgcgcgagccgtcggcgaagaacatcgtgggcgtcccgcgcaccatcaattgcttgcccagcgccagcaacttgtcctcgggcacgctgcaattggcggtggccggcttctggccgcgcagcatccagtcatcccacgccttgcccgggtccgccgagcaccagacgtcacgcaccttcacgttggagtcgggcgacaggatcgggtacaggaaggtgtagacggtgatgttgtcgacgtcttcgagcgtcttgcgcaattgcttgcagtaaccgcagttggggtcctcgaagatcgcgaccttgcgcgagccgtcgcccttgacctgcttgatggccaggtccagcggcaactggtcgaacgggatggaaccgagcttttcctgcgcctcgcgggtgacgtcgcggcgcgtcatggcgtcgatcagcggaccttccatcacccaggtcactttttcatcggtgtagatcaggtccatgcccaattgcacctcgaacagcccgtagggcgtgcggcgcacggcggtcacgtccatgccggtgaagcgctgcctgaaacgttccttgaccgcatccgccacgggatcggcgggcgccacctgggtggtggaatagctcttgctgcccttgcccgcctggccgaccgtgctggtggaaacggccttgtcgcccgttgcctgcgcttgagcgctggcggacaggcccaggcccgcggccatgaagcaggcggccagcgtggcggaaaaacggaaattcatggggactcctgtatttag

SEQ ID NO: 74509 - DNA, 333 bp, Glycine max
  Peptide Sequence Number=SeqID_191287
atgattgtgcccagctttaggcacagttataggaagagccttaggggcagaactcgacctattgctgaggatgttgagcatgtgaatcatgtggctaaggaggttcatgagcagcctcaggaggtagttactgtcgacgtagttgctgatgcccagggttttccaggcgagccccacaatacatcagtttttatggaatatgttcatcatgtgccaaccacagtttggaatggagaggaacgtcctaagttgaagttgtcctcccatggtaggaaggtagagaaatttggaaggcatgctccaaagattgaaggcatagtggttgccacatga

SEQ ID NO: 74510 - DNA, 414 bp, Glycine max
  Peptide Sequence Number=SeqID_191288
atggacgaagatcaatggatgcatgatagcataatgtctaaagaagttgatatgaatgaggaaaatgaaaaggaatctggtctgaatgaagaaaatggagaggaacccagtgtgcatcaacatgttgattgttctgatgccttcaatacttctcaggtgtttgttacccatgatgatgctttgcattgggctcaatgtgttgcatatgatattggttttgtggcggtgattatgagtgatatgacaaagtcaatggtcaaaccaagaaatattcttctaccattgaagaagcacaatgccaacagttatacaactatcaagcaagtatacaatgcaagatatgcatatcgttattccataagaggcagtaatactgaaatgaaacaactaatgaagcttcttgaatgtgattag

SEQ ID NO: 74511 - DNA, 276 bp, Glycine max
  Peptide Sequence Number=SeqID_191289
atgcctatttcgccagttctactagcggaacctatgggggatggatgcatgcatggccatgtgatggatgggatgaacggtgcttgcatgcacaatgggtttcgccaatggtggtggcgaaacccacatgcctgtgaatgctttttgctttttctgtgcaagaacagtgatgttgtaggatattttacggcaatggatttcatcaaagttgaaagagataacgagaatgaagaaaataagcaaggactgttgaaaggaggacccgacaatggttga

SEQ ID NO: 74512 - DNA, 273 bp, Glycine max
  Peptide Sequence Number=SeqID_191290
atggctaagcatggagctgagaaagaagtgcttgaagaagccttggttcaatttgatattgaagctttcctccatgagtctgaggatcatgttattgagacaggctttggagttgaacccattagatcaaatctagtgtctgatgctaatgaaagacaaattgatgttgtcttatcagaagtaataagtgaagacaccatcataagctttgaggctatatatggaccatcgaccactaataatattgcagatgtacaagcgggtctaaagtaa

SEQ ID NO: 74513 - DNA, 285 bp, Glycine max
  Peptide Sequence Number=SeqID_191291
atgtttccaaagaagagtgaacctaaccttggcccatgggctcagaaatctaccctaaggttcatgagaaccctagggccttctttagcaggattgcgggtagggttgcatcatcccttcccccttagaaaggatttaacctcaaatcccgagccccagatttcccttatacttggtggagtgggctcagaaatctaccctgaggttcatgagaaccctagggccttctttagcaggtctagcccaatcctcttggagtcttctatccaatacccttgggggtag

SEQ ID NO: 74514 - DNA, 210 bp, Glycine max
  Peptide Sequence Number=SeqID_191292
atgcatgattcatgttccagattttcaattcttgcatcacaattgtttttcgtgagaaacttcatcagaattgaaggattcaccgcaattgatgaagcttgtgagattttatcaccgattctacttgttgaagctagaatagatagtgagaatcatcaagcttttttgagatcggaggaaaagattgaagacgtagaagcgtacacatga

SEQ ID NO: 74515 - DNA, 300 bp, Glycine max
  Peptide Sequence Number=SeqID_191293
atgccacaaaagtgcaaagatcctggcactttcattatcccatgcaccatatgtgagagtacatttgtagatgtcatgctagatttaggtgctccccttaatgtcatgcctacatcagtttatagatccttccagcttggtgatttgaggccaactaaagtgttcattctattagtaaatcgaagcactgcacaaccacttggagttatggaggatggtaactatactcaagcatatgaatttcttcatcaggggatgatgaccataaagattgttgtttgtaaacatcagattttttaa

SEQ ID NO: 74516 - DNA, 510 bp, Glycine max
  Peptide Sequence Number=SeqID_191294
atgattctcatgtcccaatctagccagagtaatgtggtggaaaaatttctacagaatgctcaagtggtcagtataggtgaaatcaacaatctcagacaggattgttactgcttaactgttggaacagttgacgaaatcattattgatgctccatggagttatgacagttgtcctaactgtacaacgacatttgatccattaaaaggtggctcagcttgccgttcttgccataccagtgtggtcgatacagttccacggttagccatgatcattttttgtactgattatttatttacacactttgctgttttagaaaatttccctgaaatttctatggatgtcaaggttggggatgatattaaggtatttccaacatgcgttgatgaaatcctgttgaaaacttgggctgtcagatttaagtttcgttcacaattacgccaatcatctgtgttggatgtgagtgaagaactccatcatattcaatcattgatagccatccttgggttgaag

SEQ ID NO: 74517 - DNA, 135 bp, Glycine max
  Peptide Sequence Number=SeqID_191295
atgtatagcaacgctgcatttgacttggagctggagcaactccaagcggagctggttgcaattgcggttattcaatcaatgacttcgcattttccaggtctcccttcacaggaagctgcagtggctctacattga

SEQ ID NO: 74518 - DNA, 249 bp, Glycine max
  Peptide Sequence Number=SeqID_191296
atgagtcatccttcatctagtgttaatggtgagggtactagtcataaggaccctctatctagaatcttagatgagttgggttcccttaagttatggaaagaaaaactagaaagaaaagaaaaaggaaaagagaaggtagaaataaatcaagacgagagagaacaaataagagaggaagaaagaagaaaaataatgaaagaaatggaaaaagaaaaacatgcctcctacatgactcttgcaagagcctaa

SEQ ID NO: 74519 - DNA, 387 bp, Glycine max
  Peptide Sequence Number=SeqID_191297
atgaggaaaaacgctggtacttgggggcatatcactcggtttggaactcccttgagactcaagctgatcaccagggggaaagttgcctgtgcacaacagagtgatctcgacacttgctgcctagttttcaagatgagcaacagtaagtgtcttggaggaaagtcatttgttggagccgccaatcgtgagaagtgcgctaagcgcaattccaacccgagagggaattgcgttgagcgagaattgttgtgcttagcgcaagagaaattgtgctcagtgcaaattatcacgctcagcgcaaattccaacttgagagggaattgcgctaagcaagaattgtcacacttagcagcaaaagtggactctcgcttagccagacgagctcactaa

SEQ ID NO: 74520 - DNA, 609 bp, Glycine max
  Peptide Sequence Number=SeqID_191298
atggacacaacaacaatgacacaacctggacatcaacaacttgaagaagaagaagaagaagaagaggccacgctgccctctaatggaaaaagtttgactattgaaacgtttgacgacactagcaacctagatgagcaacttgatgtttacaccacacaatcgcctacacttaaatatagtggattcgttcaaaacactggtagcttgctttggcacacagtttacaaccaatcaacctcatcagctaacctcggtagcattagtcaacgttcacctagaaaagaaggagcctttttgaaccttcatgaaaagtttcaaaaagatagctttaaacatctgaaatctagacccggtagttgctatgcatcatctaataactgctctaaggggaaaatgaggctaagtcatgaagtgccaaaagtgacagttgagcttagctcatcagtgtcttcagccaggcttagcgcacgaatggcgctaagcccgaatccacttacccgtgctaagcacgaaggtggcgctaagcgcaacattccagagcacaccatagtgcctattttgggaaaagactctggaggcaagaggagcagcttttgcagagatacctag

SEQ ID NO: 74521 - DNA, 294 bp, Glycine max
  Peptide Sequence Number=SeqID_191299
atggcaagcaacaatggctcgtggcagtcaccggtggtcgtgggtggtggaggaggaggtttggggttttgggtgaggctagttgttgaggggaacttcatggacaaatggggagtagataccatggctccaaaggcattcaaggatgaacacatgagtgtcctcgattttggtggaccaacaatgtttagaaaaatggccttgggtggggtgttagctctgttagagcttggtccaagatatgggatctactcacacgaagagaggtataatgcgtgtagcagggttccctag

SEQ ID NO: 74522 - DNA, 411 bp, Glycine max
  Peptide Sequence Number=SeqID_191300
atgccattatcaggaagaaacaattatgattttggtaccggattgtacatcaatcttaattctcaagtgcatgacctgttgaagttgtacaatgatagcaatgtacctccgcaacgtctgttgtttaaaattccttccacttggcaaggaatagaggctgcaaggttgctggaatccgaaggcatacagacacatttgacctttgtctacagttttgctcaagctgcagctgcagctcaagctggtgcttctgtcattcaaatttttgttggtcgcataagggattgggcacgtaatcattctggtgacacagagatagaatctgctcagctaagaggagaggatccagggttggcattggtccgttctttaatcttctgttcatgcttttgctctattcttagaatttaa

SEQ ID NO: 74523 - DNA, 552 bp, Glycine max
  Peptide Sequence Number=SeqID_191301
atgaggggtaagggaacgtacgtcaatgggagcaagagtcatgacagtcatggcgattacgcaattgacctccgtggtgttgcttatggagaagcgatgaaagagagagaaagaggagagagaaagcagaatgaggaaggagatgaggggacgcgaaacgacggcaccgcgctagaggaaagagtcccggaaagggtgggaatcgattttggaagtccaatgtggttcgccttaagactcccagggcgttcttcttctttctccttctgcctgagttcgtctttgtcgcaaactgggctgcacttccgtgactgcaaccacattgtggagttcgtctttgtggagttcgtgtctaccacttatcgattgagctcgaagaaaactaggaaaggaaagagtcccggaaagggtgggaatcgattttggaagtccattgtggttgactttaagactcccagggaagccatcgaaggtgatttcttcgtgttctttagtcgctgtcaaggttcgttgttgcttgtgttctatgtgctactaagtgatcagtgctga

SEQ ID NO: 74524 - DNA, 2151 bp, Glycine max
  Peptide Sequence Number=SeqID_191302
atggatcatcgcaaaccattgctacccacttcctctgatgctgctccaaatccacacactcgcaaggaccttcttctagttatttgcggcttgctattactctcttcccttgttgcctttggagggtacagggcctccaacgcgccgcatgccgacgtggcatcggcaacatcgaacgatgagcaacgtagtccgacatcggtgccttctccgaaatggtacccggtttcgcgaggtgtttcttccggggtgtcagagaagtcatcaagcatgttgtttgcggttaaagatggagcttcgaaggcatttccatgggacaacagcatgttgtcttggcagagaactgcttttcatttccaaccagagaaaaactggatgaacggtcctatgtactacaagggatggtatcactttttctaccaatacaacccgaacggtgcagtttggggtgacatagtttggggacatgcagtttcaagggacatgatccattggcttcaccttccactggcaatggtggctgatcaatggtatgacatgcaaggtgtgtggacaggctcagccacaatcttaccaaatggtgaaatcatcatgttatacacaggttccaccaacgagtcagtgcaggttcaaaaccttgcataccctgcaaacccctctgaccctctccttgtggattggatcaaataccctgggaaccccgttttggtgccaccaccaggcattggggccaaggactttcgtgacccaacaacagcgtggctcacctcagaagggaagtggcgaatcaccataggttccaagctcaacaaaaccggcattgcgttggtttatgacactgaggacttcaagaactatgagctcaaggaggggctgcttcgtgctgtcgctggcaccggcatgtgggagtgtgtggacttcttccctgtgtccaaggagaatgagaatggattggatacttctattaatggggctgaggtgaagcatgtgatgaaggtgagcctggatgatgatagacatgattactattcaattgggacttatgatgagaagaatgttctgttcacaccagatgatgctaagaatgatgttggcgttggattgaggtatgactatgggatattctatgcatccaagacgttttatgatcagaataaggagaggagagttttgtggggttggattggggagtctgacagtgaatatgctgatgtggccaaaggttgggcttcagttcagagtattcctagaactgtggagcttgataggaagactggcagcaacttacttcagtggcctgttgctgagatcgagagtttgagattgagaagtgatgaatttaaaaatttgaaggctaaaccagggtcagtggtgtcagtagatattgaaacagccacgcagttggacattgttgccgagtttgagatagacaaggaaacccttgacaaaattcctcaatccaacgaggaatacacgtgcagcaccagtggtggatctaaacaacgtggtgccttaggaccttttggtcttttggttttggcagatgaggggctttctgagtatactcctcagtatttttatgtcattaaagggagcaatggaaatcttaagacttccttttgtgctgatcaatcaaggtcttctcaggcaaatgatgtccgcaagcaaatcgttggcagcgctgttccagttcttaaaggcgaaaagttttccttgcggatactggtggaccattctattgttgaaagctttgctcaaggtggaaggacggttgtgacatctcgggtttatccaacaaaggcaatctatggagctgctaggttgttcttgttcaacaatgctaccgaggccactgtgacagcctcactaaaactttgccctgagcttaagtttcttctattcacgcctcctctcatcctctttatcgtcaaggtaatcatcgtcgtagtcgataatgttgacgacggtgatgcagagcatgaagccaacaccgttttggagctaaaaaaggccaagcagaagaagccaaaggtgacggtggccgaaggtgtggtggtgatggtggttaggatttcaaatttgggggtggtggctgtttggtttggacatagtggtgatggtagttcaagtgtcatggtgatggttcaagtg

SEQ ID NO: 74525 - DNA, 291 bp, Glycine max
  Peptide Sequence Number=SeqID_191303
atggccaaacttggtgcacaaccatatgcatcccttggttctgaccttctctacggtcgttgcccttccttcgacaaatcctcttgcaatggtgttgataacacatctaggttggttgagggattttgcttccctttctctagaccggctttggctcctatgtctttcagttttgggagcacggtgtctgagtttgatgaggtcttcaatcttgtttttcaaaacactacattcctcaatggagtgtcctcggttgcaatgatatcgtcaacgcttggagaaatcggctag

SEQ ID NO: 74526 - DNA, 507 bp, Glycine max
  Peptide Sequence Number=SeqID_191304
atggtgccttcaaaaaagaggacacatgtaggtcgtccaaagcctttgtatgttgagaagctcatgagagacctatgcactattcttcacgaacaacagtcttatttttctgcatcttctgaagaggatcttctttttgaaagtgacacgccaatggtatcggttgagataggacatggaagcatcctcataaggcatcctagctctatagctcgtgatgaagagtttgaggctagcactctctcagttgataataaacaatgcctaatgaatgaagcatattcattttctagtaccattcctatgtatagtgattgcaataacatgaacttctcatctcatagagttgaaaagatcaaaaacttagttggccaaatcatgcaacaagagaaacttgaaagacatgttttcccagaccagtttacaatttttcattattctaggacaagtcttagcttgaaaaactacaagttcatagaaattatgatccaccattgcgttcaataa

SEQ ID NO: 74527 - DNA, 378 bp, Glycine max
  Peptide Sequence Number=SeqID_191305
atgtttggtctggtttggtttttcatggttttgttgcgcgaggttgaagacgagccttcttccgcggaaggttcgtttcttccacgtgtgtctgggtgccgttggaggtcgggcggaagatcgtttcttccgcggactccagcggaagatggaagatatggcactcccgtgggattccgcggaagaaccatcttccgcgagaaggaaatgtcacggactagatacccgcggaagaagcttcttccgcgtgtgtcaaagacgttcgcggaagagccatatcttccatcttccactggagtccgcggaagaaaggttcttccgtgggagtgcttttccttcctgcggaagaaccttcttccgcgagtacctattttatag

SEQ ID NO: 74528 - DNA, 217 bp, Glycine max
  Peptide Sequence Number=SeqID_191306
accaaagaaaaggcaaggaggtcgccggaaaaggttctgccggcaagcgcaagggcgccttcgacgataacatgcaagaccggtggcgaccgaaagagaaacaagcgaggtgtcctttagttatttctgacgacgaattaaatgctgcgccaagaaggatggacatgccagataagggccagagtagcaggccacgtgtcgtccctcaagaggaaat

SEQ ID NO: 74529 - DNA, 1419 bp, Glycine max
  Peptide Sequence Number=SeqID_191307
atgtcttcttcttcttcttctagagctttcttcttcttcttcttctttcttatcaacgtctccttgctcctcacactctcttctgcagcggatccattcgtttcctacgaatttgaggtctcttacatcactgcctcccctcttggagttcctcagcaggtcattgccatcaacaacaagttcccaggtcctactatcaatgttaccacaaacaacaacgttgctgtcaatgttcggaacaagttggacgagagcctcctcattcattggtctgggattcagcaaaggaggacttcgtggcaagatggtgttcttggcacaaactgtcctattcctgcaaagtggaactggacttaccagtttcaggtgaaggatcaaattggaagctttttctacttcccttcccttcatcttcagagagctgctggtggatttgggggtttcatcataaacaacagacccatcattccgattccttttgataccccacatggggacattgttgttttcattggagattggtacacccgcaatcatacggatttgaggaaggctcttgatgatggaaaagatcttggcatgccggatggtgttctcatcaacgggaaaggtccttaccgatataatgacacccttgttcctgatggcattgattatgaaacaattgaagttcatcctggcttctttaggcatagaaacatggaatccttgactaatacgcttgtccgaattgtgagaaaaacaatagacttaaaagttatggaaaacaagcaaaatctgtcttgtatactgcatactgcattatgcatgttcagacaaacttttctacaactattacaaggagaagaaggaaaaacttaccgacttcgtgtacataatgttggagtatcaacaagtctgaatttcaggatccagagtcacaacttacttctagcagagacagaagggtcttacacagtgcaacagaactacactagcttagatattcatgttggacaatcttattcttttctgttaagcacagatcaaaatgcaagtacagattactacattgtagcaagtgccaggtttgtgaatgaatcacgttggcaaagagttactggagttgctatcttgcgctatacaaattccaaggggaaggcccgtggtcctctcccaccgggtcctgatgatcaatttgacaaaacttactcaatgaaccaagcaagatccatcagatggaatgtatcagcaagtggtgctcgtcctaacccacaagggtctttcagatatggttccatcaatgtgactgatatttatgtattaaaaaataagccactggagaaaattaatgggaagcagcgagcaacactcagtggaaactcttttgtcaatccttccactccaatcaggcttgctgaccagtacaaactaaaggga

SEQ ID NO: 74530 - DNA, 417 bp, Glycine max
  Peptide Sequence Number=SeqID_191308
atgtctcagatgatgaacagcaagattctcgcagaggacgctctaaattggaacgctggacaagccataaggaaagagatttcagtgtcaacaactgggaagcctgcggatgaacctgctaaaactgttgatgttgataatcaacatctcttgttagctgaagcaagggattctgcagatatggaaaatagggatgctgatacaaaagaattgggagatcggcaccttgacacggttgagaggttgaagaagcgtagcgagcggttcaagctcccaatgcctagtgaaaaagagacccttgtcatcaagaagttagaaagtgaacctctgccttctgccaaaagtgaaaatccagtagtagattcagaagtcaaacaagaacgacctgcccggaaaagaagatgggtcactaactga

SEQ ID NO: 74531 - DNA, 312 bp, Glycine max
  Peptide Sequence Number=SeqID_191309
atggagctgctggtgaagacggagacattgttgggaaaatgctcacccactggttatgtcaacaaagcaaagctgtcctcaagtgtggaaggtgccagtatcaggctcaatgcctcaccagacatgccaatggtttctgaatgtcattgcatccaaccttggtcacgttcaccaataattctcattacccagatccatctagtgtacaataaatgtataggtagtaaggtctacaagatgacattactgaagtacaaattgtcccaaaccctacagatgccattttcaacgtttgatagtgatagaggatag

SEQ ID NO: 74532 - DNA, 3411 bp, Glycine max
  Peptide Sequence Number=SeqID_191310
atggaagacgacgacgagttcggagatttatacaccgacgtgctccgacccttcgcttcttcttcgccctcatcatcttctgcgcagcagctccaccaactttcccctgcgcccccctctctcgatctcaatctcaatcccaatcccgacgccgcacagatcccctgcgatgcgccccacacttattcccctgcaccaaccaatcccctccctgagcctgacccacgcgaaccgcccccggagtcgccgaaaattccggacgcggagcctctgccggattcaaacctcgtcgccgccgtcgtagcgggcgttgatccgatggacagggaggtgaaattcgacatcgaggaggacgatgacgacggcggatgtggtggagacgtcgtcggagagacggttattccggggctgtccggcgaggcggcggcggcggtgccgcctgagggcgagggagatgattgggacagcgacagtgaggatgatttgaagatagtgttgaatgagaacaatcacatggccatggagagaggaggggtggcggatggtgatgaggaggaggaggatggggatgaggagcttgtgattgtggctggcggcgatctgaatcagggcgtggaggagccggagtggggcgagaatgctgcccttgctgccggtgatggcgataggaaggacgctgccggagaattggccaaggtcggcggtgcggccgtaccaccgaagattgggtatagcaatcatggatatcacccctttcattcgcctttcaagtatcagtatgttaggcctggtgcagcgctaatgcctggagctgctgcttctgctccaggagggcctcctggtcaaattcgtcctctggctaacatggctggtcgaggcagaggggaatggagaccacctggaataaaaggtggtgctgctatgcaaaaaggttttcatgcaggtcctggattacctggttggggcagcagtgctgcagggcgggggtttggtggtggattggaattcacacttccttctcacaagactatatttgatgttgaaattgagaattttgaggagaaaccgtggaaatatccgaatgttgatatatcggattttttcaactttggcttgaatgaggagagctggaaagattattgcaaacagctggagcaactacgcttggagtctactatgcaaagcaagatccgtgtttatgagagtggtcgaacagagcaggagtatgatccagacttaccccctgaattagctgcagctactggtatacatgatgtacctggtgaacacacaaattctctaaagtcagatgttggacaaagcgatgttatgaaaggttctgggactggacgtgtgcgaccaccactaccaactggtagagcaatacaggtggaaggtggttatggtgaccggcttccttccattgatacccgccctccccgaatccgtgattcagatgcaatcattgaggatacagaagatgacgagtcctctgcaggaattgctcaagatccaccagagagtggagatccccatagagaggattttagagaagaccatgtagctggggatgaaattccaaggttggagcccaagtattttgatggttttccacaggattataatggtcgaaagaaagagattgcaggaagaagaatgccatttataaattcctgtgctgctaacatgcctaatggagatgaaaaattgttcttcccacaggaagagccaattgagtactctggctcaaggggccaaaatcgtaggaactatggtggcaattttagctcctctcatgacgaaaggcagatgcaaagaagagtgcgtggtcagtctcctcctattattcctattcaagaattggcaactgataacagtcaaaaagaagagtcagcggaaagcatggaaggtagacatagatcatcccctgccgttaaggatgtaggggagtccagtgtggagtacaaagatattgaacttgaggacactgagacagctgatggaagttcaagattggaaaaggaggaaacagtagacagagtagatacccttgaggatggggtagcaaagagacagaaagtaacatctcaagttgagccacctttgcctgatgaagttgatgatgattgggaggactcaaaggctgcaaaaagtagtgataacagcaaagcaagatcagcaagcagtagagataaccagaagcggcaagagggttttgaggaagaagtagttcaggatccacaatcagcacatctgggtagcatcagacagcaccctgatgaaattgagccgggattttataaaagagagcatgatgcaaagcaagaacctgaaagaaatcgcatgatgcttaaaggcagagagagatcatacccttacaaggaccggcatcctagctcagctcctcagttacacgcaaatacagatggatttgatggacaaaaagaaagggacaattctgaaatggattgggcacggagagatgatgatctctataacagaagggttagaaatgatgaacctagaaagagggatagggctaaggttcgagaaaatgagagaaacgacaaagaagatagccttcattctagaaaacagttggataatggtagctacagggttttgtatgaaaaagatgttgggtccagagattcaagacatagggaaagagacgagggcttgaggattaggtacgaagcagtggaggattaccgtggcaagaggaggaaggatgaggaatatcttaggagggagcatattgacaaagaagaagttctgcatggctacagggaaaatgctagtcggcgcaggcgagaaagagatgaagtattggatccacgaaagagggatgacctgcaaagagctagagataaccctgatgatcaatatgctactaggcagaaagatgatgcctgggtaccaagggagaggggtgataggcagagagatagggaggagtggcatcggatgaaacagtcccatgaagaacacctacccaagcgtgaaagagaagaaggacgaagttctgtaagaagtggacgaggggctgaacataaactttctgagaaagaataccaatccagagaagcaatgcggcaaaatgaccaattgaagagaagggatagaattcaggatgaaagtccacatcataaggggcgagatgatgcttctgcccgtggaaatcaatatactactgaggaaaggcgatctaggcaagaaaggtcaagtagtcgtagtgatcgtgttgctaatttttcagataaccaaaaagtcaagcatagagaaggctcaaggaaaagcaaagaacgtgatgttagtgaccttaatagtttaggcctgtccaagagaagtcaagaaaatcaaattggtccaaccaatgagaaggtatgcacacttcatgtgaaaacgtga

SEQ ID NO: 74533 - DNA, 531 bp, Glycine max
  Peptide Sequence Number=SeqID_191311
atggatgtatatacatggactataagtactgatctgcagaatgttggtatgattccgtcatttgaatcactgatgtcaattgaacctagcgatgacttgtcaatcctagtggttgctgttgataaatctagagatcctggtttgagagaactgcaaaatagggtagcaagtctttcaaataactggattaccacgaaagatgcaactgatcagcttgcaaatcttgtttgcaataggatggggggaggatctttaactgaggaaaatttaggtacacgctggaaggaatgcacccaacttcttaaaagctgcctgcattccgtcattcttccaattggaagcttacccattggcctttgtgtccatcgagctttgctgtttaaagtgttggctgacttaatcaatctaccatgccgtattgcaaagggctgcaagtattgtaggaaggatgtgggtgcctcatgtatagtgcaatttggttctgacagaaataagaaggaaagaagtggagaaatttctcgtcttatttga

SEQ ID NO: 74534 - DNA, 1167 bp, Glycine max
  Peptide Sequence Number=SeqID_191312
atggagctaaacacaaaagctcattataccttaacatatgttctctccaaaaatgagtttagtaagatatgcatattaaagacaactaatgaaatctgggactctctaagcataaattatgaaggaattaaagatgttcaacttagaaaagctgccactttgcacgtcactatgaaaatggttgagtctgacgcctcatatgacaactctgacgaatccatagataatgaaatggcccttacgtcaagaaaatccaaacaaatgatgaagaagaaaagaaagtttcggcacttctccagacgaaaagatgcaagatttaaaaagaaacacaaggagaagaacaatgagatcatctgctttgagtgtaagaaacatgttcatataaaggcaaaatgtccacagataaagagaaaaggacattctggagacaagaaaaagaaaagcctgatggtaacctgggatgactcagacaatgaaaagagcaacatcttagacgatgagcaagctaacatttatcttatggccaacacgaatgaaaaagtagaggtaaaaacatgctttgaatctaactcttcttcttcttcttcttcgttagacaatggagaagatatgccctatgatcttcttcaaaacagtcatatgatttctcttaaatggaaaaagtataaggaaaaatacaaaatatctgcttgtgaaaatactgaactgaagaaatcaaatgaagttctgcaagagaaaatccaggctttggaaaagagtttgagtcagaccagtaagattgatgaatcctatacagttagaaaaccaagagagaagatcacttgtcttacaaaagactttggaaagtttttggaaagttccaacactttaactcatgcttctaaaatttcatcaacatcttctaagtcactatttgtagcagaaaagtgtgacttctatggtaagtctgcacactgcaagttcagatgtatccataagaagaaacaaatgtctaagggtactaatgcttatggacccaaaaagatatgggtaccaaaatctcaaattgttcccattatagatatccttggtaggaaaaggctagggtttaagttggtacctagacagtggatgctcacaacacgtgatggaggaaaggtctatgttcctcaacctaaaacccattaa

SEQ ID NO: 74535 - DNA, 339 bp, Glycine max
  Peptide Sequence Number=SeqID_191313
gtgattcgaccgccgatcacccgggccttcattgagaagtattgcacgcctagacaggcacagggtgatgcaccgcaggccgcagacgcactgccaccacctcatcacgctgatccagctgggtcatttggcatggagcggtatttacaacacttggttcgccagcaggcggccaaccacagggggcagttcagggcggaggtcgcatggcctagagattggcctgaggcccaggcaggggaggcgcccgcagaggctcccggcgatgcggaggaggcccgcatggatgaggagatgacagatttactcggtttcttgggagggaatggagccacgtga

SEQ ID NO: 74536 - DNA, 645 bp, Glycine max
  Peptide Sequence Number=SeqID_191314
atggacggaggagcaaaaactcatattcctactcaactccaaggcttggatgtgatgttgtgtgctttatcagaagaggagtacactaaggtacacaatttcagaagtgccaaacaaatatgggacactctagttgtaacatacgaaggaacatcacaggtaacaacgctaagaacattaaagaatcttgattctatgtcccttgaggaacttgttggtacccttaagaacaagaaggcgccatcgtctaaagaacaagtctcgagaagttcatccaaagctcttaaagttgataattcatctgatgatgattataaggaagaatctgatggagatgagcttgccttcatttcacaaaagatcatcaaaatgtggaaagacaaaggtgggtcaaagtggaaaaattcctcaagaaaaatgcccaaagaaaagaaagataaagacaaaagctccataatttgtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaaaggttcgggagttgtatttacgcacggggaag

SEQ ID NO: 74537 - DNA, 216 bp, Glycine max
  Peptide Sequence Number=SeqID_191315
atgggcaaaaggctagagattccagggcatgtgaatcctcaagtggctgccttgattgagctctgctgggccacggtcagggtagtagcccatgctaaacaagtacttataaacatggttgccaaatggcagtgccatggagaatggcgtggtatattttatgccaactgccataggcaattttgtgaagggagccctgcaatggggacaccatag

SEQ ID NO: 74538 - DNA, 393 bp, Glycine max
  Peptide Sequence Number=SeqID_191316
atgaggtcctatggtggtcacagctcgaccggagagggagatgacaggtggatgcattttgcggagcacgtactacctatgggtaagctttgtctagtgcttgggcaggtaggtgaccagcccagagatgcaccagccgcagaccctgaggagtacatacagccgcccagcccccaggttccagtggcatttgacccctctccacatgcagtggatgattatgacggctatgaggtgattgcacagaggttggagcgtgtgctcaaccttaggatggtcactgcaggcacagagttatatgatattatgcaggattgcctgacgatcgccagagggggagccagtgctgatggaagtgtcagggctcgacagagacggcgcacagagcattga

SEQ ID NO: 74539 - DNA, 477 bp, Glycine max
  Peptide Sequence Number=SeqID_191317
atgagcaacaagcgtaaccttcaagttacgttctcaaagcgtcgcaccggaattttcaagaaggctagtgagcttaccaccctttgtggcatgaatcttgctgtaattatgtcctcacctggtaatcgggttttctccttcggcagccctagtgtggattctgttattcaacactacaccgcacagggcccacctcccctcctcaacctagagctgaatgaggcctccatagacgagcatgagctccatgtgcaccttaacaacttgtccgaccaaattgctgcagagaagaagcacaaaaaggatctaaatcgtatgttgaatgctgcggaggaacacgtttggtttgtcatgccaatcaaaagcatgaatgatgcccaactagagacgtataagaaaatgttggaggagctaaagacgtatgctaatgaaaaacgtgagaagctcctccagcgccttcccaacacctctatggga

SEQ ID NO: 74540 - DNA, 336 bp, Glycine max
  Peptide Sequence Number=SeqID_191318
atggagaaaggggtggcctctgcgatctggtggattcgctcaactgttgtaagtgcggaaaagagaggggaggaagaggaagagaaagaggttctccaatcaagcttaaagccgttgaaagcaaaaactaccaaggttgagagacgggccttgcaggaggcacagagagctgctaaagctgcttctaaagttttggtcatcactctgtatccagccgagggaagtaaagcagttgttgaatctggtcgagccaccctaggtaaaagtacaaagcaatcttcacaaaagaaaggtggtccttcctatgtgtctccagtggtcactgatataatttag

SEQ ID NO: 74541 - DNA, 309 bp, Glycine max
  Peptide Sequence Number=SeqID_191319
atgttgcatcaaacatttagacttccttccttgacttcatttttcacctttgtttcttcttcactgtttcatcttcgttccttcttcactgttcgtttcaccgtttcacactgtcttcaccttcttcaccgttcgtttcaccttaacctaaaacggggtccttgtagggagtcggggcacggggacaggacaataaatacccccacaatgaggaacggggaagcggatggagagcagggtaaggttcggggacggagagcgggagagtactctccgcccctgccccgcgcgggtgtcatgcctaattaa

SEQ ID NO: 74542 - DNA, 597 bp, Glycine max
  Peptide Sequence Number=SeqID_191320
atggacatatatgctgaacgaaggaagcgtgggaaaactattttgcaagaaggaaaaagacaacgttcagctactaatgaaactattgttatagacaacttgcagtgtatctcacaatgtagtccaactattaaccataataataactctgctacaagcttccaatctacaccaccatcgcacgagactttatctatagatgattctgaacgatgctcaaaaagacatgcaatcaatgtttcttccatccagagaaatttgatgtcatcttatgacaatcaaaaaaatataactgcttctacatccacataccaagccagtaatgcttattccaatataacacaattagacattcacatagatgaacatcagagaccaactgacactacacagcatgatcaatttgtcggctatgacagctcaaattctagtgatgatgatgtaaatatgacacaggaaaacattgatatagaatactcattaaatgacccaacaatagatgatcttgatgattatgatgaacagacctttctatctgcctcatctgcatacccaaatacaggtggtacttacattgatatcggagatcctgtatag

SEQ ID NO: 74543 - DNA, 282 bp, Glycine max
  Peptide Sequence Number=SeqID_191321
atggtttccacgttgaaagaggatggagttggaggaagtaaagagctacttttgcaagtgaaaaggagagtctcacccgaaagtgtctggtgcaagttgcaaggttggaaaattacggaatctggcactgggaagagagaaagagggaagtgcatgcaaatgggtacaaaaattgaggagagaacaatgaagcgcgtggcggccacggtcagactgtgggcgcggttgatcaaagaggatatggttttggagatgccgttttttggttctaatcaattttag

SEQ ID NO: 74544 - DNA, 327 bp, Glycine max
  Peptide Sequence Number=SeqID_191322
atgcatacagaaaagagaatccaagataagtatgagatttaccataacttcagtatcttatttaaccaactcaggcaaggcaagttgtatagacatagttggagcactgagattggagaagtgacggctcagaaagaatggcaaggcaatgcaatgcaatgccctcttcccttgatgagtattttgatagaattgacaaggcacttacatgctaatgctagtgaccaccccaatacatatcaacatcatatccttctatggataaaatgctataatacgttaacattatgttatgacgagacaaacaagaaaatgcgatacttatga

SEQ ID NO: 74545 - DNA, 177 bp, Glycine max
  Peptide Sequence Number=SeqID_191323
atgcattggcagaaaaggaagctcatgagggcattgcaactgaacaaaattaagaatgtcaaagaaggtaggggtggaaatgagccgaacagcttgtcgagggtcttcaattcgacctacgtaagactcggttcggcttggcttgtttattataaagacctagctcaagctttttaa

SEQ ID NO: 74546 - DNA, 1248 bp, Glycine max
  Peptide Sequence Number=SeqID_191324
atgtcattggttcaaaaatatccatttgaggataagaacagcaaattgtgtttcgtggccggtcggcgtcgtgcgaagaccgaacagtggaaccctaaggttcatcgccgtcagcttggtcgttctcatgaggtgcatttatccacaatttttgctcactcctcaccccattcaaacccaaacaaccactacactctctctcccacctctttcttcggcaccaggatcaccctcatacgcgccacctcatcgtcttgttccctccccaacaccaattgtcgtgcgacatcagccatcgtgtcgtttagcctcctcaccccgaaaccccttttggatacgcctaagaaaaccccaaagtggtcggcgagggctataaagtcatatgcaattggggaattggaagcgaggaagctcaagtatccaaacacgcgaactaatgcacttctcatggggattttggttgaagattttataaacactactacaaatagcgcattccacgacgtgaattcaaagtcggttgtagaaaaccgctttgatttgggggcgatggctctcaagaagaggagaagacgcgtccaccttccaaccgaacccaatgaccacctcccaccacccattcccgaaccaccttctaaccacccaccctacgccgagatgatatacacggcaatcgaggcgctgaaggagaaagacggttctagcaagagggcaatagcgaagtatattgagcaagtgtatacgcagcttccaccgaatcactcaaacttgttgactcagcacttgactcacttgaagagtaggggattgctccaaatggtaaaaaaatcttacggccttcctagatctgtgcccgtgtctattcctggacctgcacccaccgaagggacatcagtagtgccggctgctgttgttgccatcacgacgactccgaggcccagaggtcggcctcacaaggcccaaaatccagttcagaactcgcctctgcctcaggacattgtcaacgtgcaggttcagcagaatgccgaaccggtctggactgcgcttgggcttgcagacgagattgggttatctcatatacctctatatttgtatcccttccttaatacaactagtaagtccagattatttgagtatttgaggcttaccactattggaatcattggtgcctctaataaaactcctgaattgcttaaaatgaatcccattggaaaggtacgctttgcttgttcccgtcttactacttaa

SEQ ID NO: 74547 - DNA, 233 bp, Glycine max
  Peptide Sequence Number=SeqID_191325
atgacctcttacattttagaaacctgtgtggatcctcttatccacacgccacgaagtcattatctcacaaaacaattctcatttgcacaagttcctccactttgttatggtggcagaactgacaacatggctagttcaccaagactagtggtgcacgaccaccatgtttgccaccccaatcttaaccctaacccaaaacctaattcccaaatttgtcaaaaacacaacaccag

SEQ ID NO: 74548 - DNA, 135 bp, Glycine max
  Peptide Sequence Number=SeqID_191326
atgaggcttgaacgccaagtccaacttgcacggaaagtacctttgcacaaattgaatcattcaatgaaagcccacaatggcacaagcaatggtcaagaatacccctaccctcacatgccgaaagccaagatctga

SEQ ID NO: 74549 - DNA, 144 bp, Glycine max
  Peptide Sequence Number=SeqID_191327
atgaaaaaggagtggagactatctaagaattttccatcaaaggtgttagcttccacctggagccatatctacaaagaggctaaccatgtcgatgatgcgcttgctaaacaggatttgtcgagtagtcagagagatcaagtataa

SEQ ID NO: 74550 - DNA, 159 bp, Glycine max
  Peptide Sequence Number=SeqID_191328
atgaggttgtctctgtcgcgcactgccactgctagagaagtgaggcttccttctctgataacggtggttgtgggtacggggaactcgtttgcgatggtagtgtctctgcttagtaggagagccaaacttcacaaagagcttcacaatattgaaaagtag

SEQ ID NO: 74551 - DNA, 665 bp, Glycine max
  Peptide Sequence Number=SeqID_191329
atggagtcaacaccctcactcatcatcaacgtcgaagtcgagtacaacaacaacaaagagtgcgagatcaacggtaagggagaccacgagagcaacagtgagggacaccgaggggtaacactagctaggatcaagaagaccaaaggtcaacaaaagatcgagatgaagaaggtgaacaatgaacgttaccttcaagtgacgttctcaaagcgtcgcatcgagattttcaagaaagcaagtgagcttgcccccctctacagtgtggaccttgctccccatctcccactcttatcctacaacaccatggacgagcataagctccacgcacacctcaatgacctggccaaccgattagccaaggataagaagcacatagaggatttgaatcatttgttaaaggttgcagaggatcacttttggtgggccataccaattgaaagcataaacagtgcccaagtcgagaagtataagaggttgttggaggagctgaagacacatgtcgatgaaaaatgtggaagctcttattccaatgttaatagcactttgactatgcaccggccaccactaatgcaaaactatgtgggtgtgattgatgggagtatcttgtgccatcgtcaatttaacaacattcatataaatggacatggagatggacctactcttgg

SEQ ID NO: 74552 - DNA, 285 bp, Glycine max
  Peptide Sequence Number=SeqID_191330
atgccatggagattctcatttggactgtttaagaatgtgggaaaattagctatgaagttctgctctccttggataaggaaaagcaccaagtggaaagacacatcacacaatggatatgtcagatcactctcactacgtaaaattatagagagaccagtcagggtcatgctgttttgcgagagtgctccaaccatgtgggatcggcacatgcttaaaggagcactcaaaccgggtgacccccaaggcctacacttcgaagagtccatcagggcctctccctcctga

SEQ ID NO: 74553 - DNA, 407 bp, Glycine max
  Peptide Sequence Number=SeqID_191331
ccggtgaaggtgctgaatcagaaggagaaggggagcttgatgataagaaagctgactatgatgttgaggttaaaggggttgaaatatatcctgatcccatcgcacgaggccagcctgctacattcagcattgctgcaactacagcgttatctggagggaagctagcgattgatgtgtcatatttcggatggcacatacatagtgagacccatgacctttgtggagaaactacttgccctgtttcagttggtgattttgtgattgctcattcccaagttttaccaggattcactctacctgtttcatactctttgaagatgaagatgttcgatggaaacaagcatgagttaactaacattacatttggttttgatattgggtttggttcttctgtggctgatagctaa

SEQ ID NO: 74554 - DNA, 234 bp, Glycine max
  Peptide Sequence Number=SeqID_191332
atggggaaagggtggttacggtggcgccttccggaagatccttttagggttcttccggatcttccggaagaaggttttctggaagatttttggaagaagggttcttccggaaatactgaaaggtcttccggaaaaactggtcttccggaaagcttccggaacacctcttccggaaactctccggaagaagtagttcttccggaaagtttctggaagaagggttcttccggatga

SEQ ID NO: 74555 - DNA, 117 bp, Glycine max
  Peptide Sequence Number=SeqID_191333
atgggcccagttttgtcagacccgcagagacccctcgtgggaggatgtgcggaaaaaggcacaggccatccagaaacaaaacactgccccccacgtgtgttctcgtcggagttataa

SEQ ID NO: 74556 - DNA, 306 bp, Glycine max
  Peptide Sequence Number=SeqID_191334
atgtcctcatcttcagaggactacgcgccctcgccttccgaggactacatgtcctcaccttccgaggactacatgaactcaccttcagaggactacacgtcctcgccttcagaggacaacatgtcctcgccctcaccttctgaggactacacgtccttaccttcagtgggctacacgccctcgccttcaaaggactgtgtaacatcccagaaatttctacccggagttttcggaaacaattgtatatgcctatgtgttcttggtagaagtagggatagtgggggcaagatacgcgggttaggctaa

SEQ ID NO: 74557 - DNA, 1548 bp, Glycine max
  Peptide Sequence Number=SeqID_191335
atgaaagcttttcgcctgctcctagcactactaattccttttttactatcctcttttgtttctggttattcttggaatgaggttaaactttggtgcaaccaaaccccaaaccctcaaccatgtgagtatttcttgagcaataatcctacttatcaatacaaacccctcaagcaaaaatctgatttcctcaaactttcattgcaacttgctcaagagagagcactcaaaggccatgaaaacactctctcacttggctctaagtgccgaaacccacgtgaaagagttgcttgggctgattgtgttgagctttatgagcaaactattcgcaaactcaaccaaaccctaaagcctaacaccaagctctcccaagttgatgcccaaacatggctcagcacagctctcactaaccttgagacatgcaaagccgggttctatgagcttggtgttcaagactacgttctccctttgatgtccaacaatgttactaagttgctgagcaacaccttggcccttaacaaggttccataccaagaaccaagttacaaagaagggtttccaacatgggtgaagccaggtgatagaaagttgttgcaagcttcttcaccggcttctcgagccaacgtagtggtggcaaaagatggctctggaaggttcacaacagtgagtgcagctataaatgcagctccaaagagtagtagtggaaggtatgtgatatatgtgaagggtggggtgtacgatgaacaagttgaggtgaaagcaaagaatataatgttggttggagatggtattggaaagactataatcacaggtagcaaaagtgttggaggaggcaccacaaccttccgttcagccactgttgctgtagttggggatggatttatagctcaaggtatcacatttaggaacaccgctggtgcaaaaaaccaccaagctgtagcattgcgttctggatcggacttgtcagtgttttacaaatgtagctttgaaggttaccaagacacattatatgtccactctgagaggcaattctatagagagtgtaacatttatggcactgttgacttcatatttggcaatgctgcagttgtgttacaaaactgtaacatatttgcaagaaaccctcccaacaaagtcaacacaatcactgcccaaggccgaaccgacccaaatcaaaacactggaatttccattcacaattcaagagtcacagctgcatcagatttgagaccagttcaaaactcggttaggacttatcttggaagaccatggaagcaatattcaagaacagttttcatgaagacttatcttgatggcttgatcaaccctgcgggttggatggaatggagtggtaactttgcattagacacgctttattatggagagtacatgaacactggtccaggttcttctactgctagacgtgttaaatggtctggttatcgtgtcataactagcgcttctgaagcctcaaagttcagtgttgcaaattttattgctggaaacgcatggctaccttccaccaaagtgccttttaccccttctctttaa

SEQ ID NO: 74558 - DNA, 1371 bp, Glycine max
  Peptide Sequence Number=SeqID_191336
atggctctctcagacacttccactcccaccagttgtcaggaagaaaaagggagtgactgtgactctccaattgaaagcaatgtttgtgatgatttgagtttgacaaaggagagaacttttgatcttaaaccagtgtcacctaattcttctggtcaaggtttgccatatgcacctgaagggtggcctaatcctagtgatgtatggggctggaaagtattgaaaaggacctccaatgctggacatttttgtgatagacacctttatcttccaaagtctcttcagatatcttctcacaagagacagagcttcagaaccaagcgtgatgttgagcgatacattgaatcaaattttcctaacatgggaattgaagcattctttggtttatttagctggaagatccccgctaccaagaaaactccccgaaaagtgaagtcactggagactgaagaagctggcaatgccacagaacagattggcaccaagttaaaacggaaaatacaaatctgcagtcaaccaactcggaaatcttccaaactacttcatcttcgtccacatatagtgcctgatcaggatgcaaatattgtcattgatttatgcgatcaggacgacgaagaggcaagagttgattcaactgagaattcaaaaggcatctcagattctgaagaaggatctgctatgcagacagcggtagagaaagatcccaaagcaatcaatgttctggagaatcttgataccttggagaattcaccggatcatgccactctagataatgaaattatacagtattgcaagaaaaagctttctttccttcttgatgtagacttcccttctcttctctcttgtaatgatgttgtggtagaagttgcgacacttgcatcacaaattcgcaaagatcctacactcagtgttgagcaactggcacaggtaaagttggtggaacaacttccattagtcagtgaggcctttcttgaggccaagggggacattgaagaggcagacaaattcttaggtgtcttggaggcaaagaaacgtaaagttcttagtctgaaaaatgactacaaggaaaaagtagctcagagagagtccgaaatggatagaaacactttggcaatccaagaaattgatgatcaaatccggcaacttcaatcaaaacggagcgaattatctgctgctctagaaagcatgcaaaagggtaaagttgagctgacttctggggaagcaggtgttgccaactcaattctatcccttgttggggagattaatcatggattatctgaaaaatcaaaatgggagatgaagaaagccaactctgcccggcgtgtagctgagatacaaaaaaagttcatcaatataagagggctaaaattttaa

SEQ ID NO: 74559 - DNA, 189 bp, Glycine max
  Peptide Sequence Number=SeqID_191337
atggtttcagatgaaaaaatgaagaataagaaggttgtagtagctggtgtctcactaagcgatgcatatgcgcttagcgagcaacatccgctaagcgagacatcagcttgcttagcgagtgaagagaatctgccatgcatccacgcgctcagctcgctcagcgaatcatttgtctcttctgatgcttag

SEQ ID NO: 74560 - DNA, 213 bp, Glycine max
  Peptide Sequence Number=SeqID_191338
atggaagtgagagaaaaagccactaacaacaaggaaatgataaaaaatgatcaagtgagagaaaaagccactagcaacaatgaaatgataaaaaatgatcaaaatgacttggaccaaaacatggacgtggtcaatgcaaacacacaaactcctgctggccagtatgacatggtgccagagacacaacttgaggttcagatggtcacaacgtag

SEQ ID NO: 74561 - DNA, 273 bp, Glycine max
  Peptide Sequence Number=SeqID_191339
atggttctaggatgggtcatgagttgccccggtaaagaaagtagtgcacagacgaatcatcagaagaagaggatagccatctatagtgatcatgacagaatacaacttttctttcagtatgttgtaagagataaaatcatccatcccgtcaaagccaagaattttgacccatcgttgaacgattttattttccacgacgttggatacaacgatggtcatccaccgtcgttgtatcctgttttccaccgtcttagaatcgcgtttttgcagtag

SEQ ID NO: 74562 - DNA, 186 bp, Glycine max
  Peptide Sequence Number=SeqID_191340
cttgcggattttgaaatggcgactcgggacgttgttttctctgctaacgtagatggcaatggcggctccggcaaagagccacctggcagcggcgacagctataccccacaacgcccaactgtggatttaatcaaggagaaagtggccaaaattgtctttgaggaagataatccttcaaagcctatg

SEQ ID NO: 74563 - DNA, 168 bp, Glycine max
  Peptide Sequence Number=SeqID_191341
atgacaaagtggtggaattacatgaattacgtggaaagggtgtcacaagtgatacatgaaggtgttaaagggttatatcaagaaccaatatcggccataagcctcaattgtcgaaagttaaacttgtcagtcttcctgaaacttgacatgagcatacacgacgagtaa

SEQ ID NO: 74564 - DNA, 758 bp, Glycine max
  Peptide Sequence Number=SeqID_191342
cgaagaaaacactgagactctttcaagtctcacaagttatccagaactacgtaggtctgagttcctcattggaggatacgtaggagcaagagcctcgcttttgtcgaccataccgccttttgttgccatgactcaagagctggtagcccgcggagataccttacggttattcgcacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggccgatgatacgcggagataccttacggttattcgcacccttttgtcatccagaggcggcgggcccgatgacaagcagagaccaaagaccaagtttggtcattttgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaatttggtcattctgcaccctt

SEQ ID NO: 74565 - DNA, 207 bp, Glycine max
  Peptide Sequence Number=SeqID_191343
atggtgattttcaaccatggagttgtagcgaaagataaaggagaagagcctagcacatgggaagcttccttgagaagcaaggaaggtagcttccttgggaagctagaggaagaaagcttccttgagaagcaagaggaagaaagcttccttactacaaaaactactcaaaatgccctgaaatacaaggctaaaaccctatactactag

SEQ ID NO: 74566 - DNA, 597 bp, Glycine max
  Peptide Sequence Number=SeqID_191344
atgagaatgttggatttccggaagtacttcttccggaagttgctaaggccatttccggaagaagttgttccggaagacactttcggaactacttcttccggaattggcgctagcaacttccggaagaagttcttccggaagttactaaggcccattccggaagaagtagttccggaagtggaattggccttagcaacttctggaagaataaatttttggatgtggttatatgataatttgaatgtacttgtgtatgatgcatatgtccttaagatggacgaagatcaatggaggtacgactatgcgatgtcacaagaagttcatatggattatgattatgataatgaagaagaatgtggggtgaatgaaccacatgtggattgttcaaatgcttttaatacgtctcaggtattcggtactcgagatgatgttttgcaatgggctcgaacaattgcccatgaaaatggatttgttgtagtgattatgaggtttgacacagagaccagtagtagaggaagaagttcatttgtcttaattgggtgtgaaaggagtggcttcgtgggaaaccagtgcatggaagggaaggttggatggtga

SEQ ID NO: 74567 - DNA, 312 bp, Glycine max
  Peptide Sequence Number=SeqID_191345
atggttattcccaagttcaaggtgccggactttgacaagtacaaggggactacttgccccaagaaccatctaaagatgtattgtcgaaagatgggggcatacgcaaaagatgaggaactactgatacatttcttccaagaaaatcttactggggtagctgttacctgtgtcagtacaattctgatatggcttcagataggatgcaactatagaacatgtgcaaaaaagagcatgaatccttcaaggaatacacccaaaggtggaaagatctggcagcctaagtggcacccccaaagacagagaaagagatga

SEQ ID NO: 74568 - DNA, 710 bp, Glycine max
  Peptide Sequence Number=SeqID_191346
ctcctgcgccagctggtttaactgctcattcacgcggttcagctcgcgctccgcgcgatcgctgcgggagatcagccgccaggtttcgcgcatcaggcgctgatagtggcgattcaggtgcagcagcgcctcgcggtaatcctgcgcgctcagcgtgttttgcgccgccacatgctattaacctgcagatcggtaaaatccagcgccagttcctgaccaaactcttccgcgatgtcatcttccgcatcaaacagccagttgagcgtgacgcgctgaccgcgctgcgccagctggttaaacagatcgaacaggctgaacagcatcttggtgctggagctgttgaagtagcgcagcgcgatagtgacgaccaccgcgtcgttgtcggtgggttgccactgctcaagggcatccagcagcgggcgataaaacgccgccgcgttctccggccacgactcgccgcgcagcgcaaactggcgggtggcaaaatcaaaactcacttcgggcgtgctgtcagtggcagcgataatcaggttttgcatacaacctcaatcctggtgaatggtggctttaagccaaaacgtggcgtagccgctggcgggcagcggacgcagttcatactccagcggttcactgacatcacgggcaagcgtcagcaaaccgatattggcccctttgctggtggcggggctctcggtgcgcagaccgacacg

SEQ ID NO: 74569 - DNA, 1509 bp, Glycine max
  Peptide Sequence Number=SeqID_191347
atggcggttgatcgctcccttacgaggtgctgtagcctcgtactgtggtcgtggatgttgctgaggatgatgatggcgcagggtgcagccgcgagggccaaccggaaggagtgggactcggtcataaagttaccggctgaaccggtcgatgctgactcggatcatgaagtgggaacacgatgggcggttcttgtggctggttcaaacggctatggaaactacaggcatcaagcagatgtgtgccatgcgtaccagttgctgataaaaggtgggctaaaagaagagaacatagtggtgtttatgtacgatgacatagctacagacgagttaaatcccagacctggagtcatcatcaaccaccctgagggacaagatgtgtatgctggtgttcctaaggattacaccggtgagaatgtgacggcccagaacctctttgccgttattcttggagacaagaataaagtgaagggaggaagtggcaaagtgatcaatagcaaacctgaggacagaatatttatatactactctgatcatggaggtccgggagttcttgggatgccaaacatgccatacctttatgctatggactttattgaagtcttgaagaagaaacatgcatctggaggttacaagaagatggtcatatacgtggaagcttgtgaaagtgggagcatgtttgagggtataatgcctaaggatctgcagatttatgtcacaactgcatccaatgcacaagagaatagttggggaacttattgtcctggaatggatccttctccacctccagagtacatcacttgcctaggggatttgtacagtgttgcttggatggaagatagtgagactcataatctaaaaagggagtccgtgaaacaacaatacaaatcggtaaagcaacggacttcaaatttcaacaactatgcgatgggttctcatgtgatgcaatacggtgacacaaacatcacagctgaaaagctttatttataccaaggttttgatcctgccgctgtgaacttccctccacagaacggaaggctagaaactaaaatggaagttgttaaccaaagagatgcagaacttttcttcatgtggcaaatgtatcagagatcaaaccatcagccagaaaagaagacagacatcctcaaacagatagcggagacagtgaagcataggaaacacatagatggtagcgtggaattgattggagttttattgtatggaccaggaaaaggttcttctgttctacaatccatgagggctcctggtcttgcccttgttgatgactggacatgcctaaaatcaatggttcgggtgtttgagactcactgtgggacactgactcagtatggcatgaaacacatgcgagcatttgccaacatttgcaacagcggtgtttctgaggcctccatggaagagcttaaaaacccggttgatgatgtaatacttctctattgcattctccctactggtttctgctgcatgtgtcaaattttctctaaactagagtag

SEQ ID NO: 74570 - DNA, 510 bp, Glycine max
  Peptide Sequence Number=SeqID_191348
atggctacccaagcaaatagtttaggttcaaaggatgtatggtatgttgatagtggatgcacaaacaacatggcaagggattcaagtttcttcacctctttagacaaagctattaaaaccagagtcaagcttgaaaatggagaaattgttcaagttgaaggaagaggtagtcttgatgatttatgtgatgcttttcaactagggaaaatgcacaaaaagtcttttcaagccacaaatgttacacgagcaaagagcaaattggagtttgttcacactgatttgtgtggtcctatatatgagcataccttctctaagccaaaacaactacaccctaaactgaatgtagtttctaagaggacaaacataacggtcatgaagatgacaagatgcttaattgcagaaaagaagctaccaaagagcttttggattaaagctatttatacaacaacatatctctcaaataggcttccaacaagagttgttcaagagaaaacaccaattgaagcttga

SEQ ID NO: 74571 - DNA, 1773 bp, Glycine max
  Peptide Sequence Number=SeqID_191349
atggccgaggaagccaaagccaaaggcaacgcggccttctccgccggcgacttcgccgccgccgtccgccacttcacggacgccatcgccctctccccgtcgagccacgtcctctactccaaccgatccgccgcccacgcctccctccagaaatacgccgaggccttagccgacgcccagaagaccgtcgacctcaagcccgactggcccaaggcctacagccgccttggcgccgccctcctcggcctccgccgccaccgcgacgctgtctccgcctacaagaccggcctccatctcgaccccgacaacgccgccctcaaatccggccttgccgacgcccatgccgccgcctcccgcccgccccccaccagccccttcgccaccgccttctccggccccgacatgtgggcccgcctcacggcggaccccaccgcacagggtcatgcatgccgttggggtcttgctcaatgtcaaaattcaaaccccctaacgacgacaacgcccgacgccgccggtgatgacgtgtccgaggatgaccctgtatcccagtccgaatccgaatccgaacccgaaccggagcctgaagtggcggaggaggagaaggaggcgagggataggaaagggcaggctcagaaggagaaggaagccggcaatgccgcttacaagaagaaggatttcgaaaccgcgattggacattacaccaaggctttggagttggatgatgaggatatttcctaccttactaatcgtgccgctgtttacttggagatgggaaagcatacgttgtgttctttaataatgaaaatgatatgcaaggttgatgttagggaacggttggtggaggctggtgcaaggcatgaagtagagtgtgggattgaaggagaggctgaacaaatgaaaaagaagacgggaaagcttccctcagccgtttattttgaggactgcataaaagattgtgaaaaggctgttgagaggggaagagaactaagatcagattacaagatgatagcaagagctttgacaaggaaaggtactgcattggccaaaatggctaaatgctctaaggattttgaacctgccattgagactttccagaaagcacttacagagcaccgcaacccagacaccttgaagaaactgaacgaagctgaaaaggctaagaaagaactagagcaacaagaatattttgatccaaaattagctgatgaggagagagaaaaaggaaatgaattattcaagcagcagaagtatcctgaggctattaagcattatacagaagctataaaaaggaacccaaaagatgctaaggcttacagtaacagagctgcatgctatacgaaactaggggcaatgcccgaaggtttaaaagatgcagagaagtgcattgagcttgatccaaccttttcaaagggttatactaggaaaggtgcagtgcaatttttcatgaaagaatatgaaaaagctttggaaacatacaaggagggtttgaaacatgaccctaacaatcaggaattgcttaatggcataagaagatgtgtagaacaaaacaataaggctagccgtggagattttactcctgaggagttaaaggagagacaggccaaggcaatgcaagacccagagatacaaagcattctgcaagaccctgttatgagacaagtattgactgatttccaggaaaatcccagagctgcagaggaacatgcgaagaatccaatggtgatggacaagattcaaaagctgatcagtgccgggattgtccagatgagatga

SEQ ID NO: 74572 - DNA, 669 bp, Glycine max
  Peptide Sequence Number=SeqID_191350
atggcatcaaaactactactaaccctttctctgctactcctaactctcatccttcacacgtttggcaccaccgcacttgccaaacgaaccaacccaaacccacccccaaaccaaaacccaacaacaacagaattcatcaagtcctcatgcaaggccacgcgctaccccgccgcgtgcgttcaaaccctctcgggctatgccagcgcgattcgccagagcgagcagcaactcgctgtcacggccctctccgtgagcgtgtccaagacgcgctcatgcgcgtcgtttgtgaagggaatgaagcccagagagtacaacgcattgcgtgactgcgtagagaacatgaacgacagcgtggaccgtctcaaccaatcggtgaaggagctcgggctcgtgggtatgggtatgggtatgggtaaggccaagggtaagggtaaggcaaaggacttcgcgtggcacgtgagtaatgttcagacttgggttagcgctgccatcactgatcaggacacgtgtctcgatgggcttgatgggccccacgtggacgccaacttgcgggcttccgttaggcccagggttgtgtatgcttctcaggtcactagtaatgctcttgcgttggttaatcactttgcctccaagcgatcacgcggtcttcctttacaagcaggagactag

SEQ ID NO: 74573 - DNA, 636 bp, Glycine max
  Peptide Sequence Number=SeqID_191351
atggagaagtccctgtccacaattcccaggatcgaaatggcacccttatgcccttcattttcttggagaaggcaaatctcatatcccagcttcacccttagcatggtcaaatgtgcagtggggctcgtaaagacaaatgatgataagcttgtatcttttggtcatactagtagtgtatcttctactgtgagggttcacgacaccacgaatattccaggagagcacactcagaattgtactatccatacaaaactaataaagggaggagcagatgagagccctactgaggtccaggatcaaagggagacgcaccatgttcctacccaggatggaaaacccgagtttagcattgggttgggaatgcttgatcacgctcttaggggggtaggcctaggagtagcactacactccttgtccaaattctcctttttttccccacgagttggagttttgttggctacctggaaagaggatgtagcatgtgtccctggagtggcacgttgtgggcatcgattaacggtctactggatcaaatttgagataatccaattgattgatatgaagatatgtgacttgtatttctcgttcacaaattacgatggctttaacggtggatgtttcaacattattatatag

SEQ ID NO: 74574 - DNA, 450 bp, Glycine max
  Peptide Sequence Number=SeqID_191352
atgtgtggggattttagtgaagttgtccttccttcggaggatagcggtggctatttctcgacatctacggcagagaagtttcttgatgtcatcaatacctgtggaatagttgggattgaagctgaaggtagccaattcacctggaagcttaatcatccctggcacttcttgaccgcatggtctcgtcactacaaattccatggcgtcgttgaggatgcatggaataaggagcaacatgagatatccggaaaattagatgaggtgggttcgaagtctcaaaattttaataagaatatttttggaaacagcttttgcaggaagagaagaattgaggtccttaaacaagaggaaagtctctggtatcagaagtccacagagggtagagagcaagaggcacagggagtagggtgggggagggaccagggttgtaggcttgtagctgagagctag

SEQ ID NO: 74575 - DNA, 501 bp, Glycine max
  Peptide Sequence Number=SeqID_191353
atgagttgtacaggttcgctaagcgcaccgcttcatctcactaagcgcaccgcttcagttcatccgctaagcgagaaaggcgcgctaagccaaaaatcactaacgtgcgctaagcgggccataaggagtttggactgggattcagagctttgcatgtctagggtttctagagagagaaaggtccaagttctagagagttttgagagattttgttgtacaaagatctgcagagaccagagcttgaagcaagagccggcttcctggtatggaaagctaaatcctctgttggatcttccctgtagggctgagttgtcgtgctttcatgaggaatcagggtgcgataatttagttgagtatgtatgtcttaatgcggtcttggttgagtttagtcttaaaggaggaatctgtggacgatgcttgatcaaaattaggctaaactatcatgaggaatcggggttcttttctatcctatgggagtgtgacctatgccttccttcgtaa

SEQ ID NO: 74576 - DNA, 306 bp, Glycine max
  Peptide Sequence Number=SeqID_191354
atgggtgagattcatggagcggaaattgtcgatggcatgactgatggtttgaagaagcatgatgatgagcttgccagaagggggagggtgcagaggtcggaccaagagaggaactggaggaggatgtgcgaggtagacgttggggacgacgagaatggagaggaagaagcggttcgagagatccacggtgaggggtgtggcaaaggcaaggagggaggtgaattggaagagctccagcacagtgaagaggagggtaatgaggttgttaatgtttggagagagaggtttaaagaaggagacacatga

SEQ ID NO: 74577 - DNA, 663 bp, Glycine max
  Peptide Sequence Number=SeqID_191355
atgtggctccttcaaggcatttgtgattcccttgatattgctactagacaattcatctgcggatcaacttcatctcattggcttctcgctaagccaatctatcggcttagcgagccatccgttgagcgcaccattcttgcagctgagcgtgaggaagaatttggaagaaggatgagctggacacactccaacaagagggatttgaggatgatgcttgatcaggattgggctagactatcacgagggattggggatctctcacttaagcatgatcgctcatctgataagggaatcatatgtaaacagctcgatgtcatagatataaaggatgggtcttatactgctagatccgtttttcgttggcttattcaagctcgtcaacccactgttgcattaatggggaggggtccttggaaggcttgcaacaacgaatttttctcccacaaggtcattcgagacttggttctggtcaatcaaattcataccttacatgatttgacgatcaaggctttcaaccagaaggcaagaactcatcaacaacggttggttcagtgggatccaccaactcataatagctataagcttaatgttgacggaaacgcgtttggaaaccccgacaatgcaggctttggaggactggtccgtgacactaatggcagatag

SEQ ID NO: 74578 - DNA, 111 bp, Glycine max
  Peptide Sequence Number=SeqID_191356
atgggtgggttaatcgccctcaatcttgcccatgaaaggtttctagacgataccgaagcaagtacttatcatcacgcagtaacaaagtccattggagattcactgagttaa

SEQ ID NO: 74579 - DNA, 833 bp, Glycine max
  Peptide Sequence Number=SeqID_191357
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccgaagtgatccaagccagatgggcggacaccagatgatttatcttgcagagtctggggcagtcaaatatctgcatctgatgcaggactgctttcatgataatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 74580 - DNA, 321 bp, Glycine max
  Peptide Sequence Number=SeqID_191358
atggggtgggagtgggagggattattattacttggtgttgttgttgggtttctgttggccgttgtgtcaaagggtatcttggctgctaaattaagtgaacagtggcatctctgcaaagactgtcatgtttcacactcaccaccagtcacttgtgtcctaaactatggttttaagtttcaaggtggttacagttcaacaacacccaccattcaaaacattgaaaaatggcattccttgcatccatttggcctaatctcggaaattggttgctgttatgctatcttcgtcaagctagttgaaagttgcattgtgtctttctga

SEQ ID NO: 74581 - DNA, 1839 bp, Glycine max
  Peptide Sequence Number=SeqID_191359
atggctatgaatattcgcagtgtatgcggtgcactgaaaaggttcactccgcttcactcctcaaattgggtttcgaagaagaataagggtttctcctgcaagatgtcaaccgagtcaacttccttgacccacaccatcacactgcccaataaacacaatgaacccgttcacgtagttgctgcccccggtgtctccccttctgatttctggagtgctgttgaatgctctttattcaagcagtggttgcataacttgcaaactgagaatggggttctagctgatggtaccttggctctgagacaagttctaattcagggagtagacatgtttggaaagcgcattgggtttctcaagttcaaagctgacatttttgacaaggaaacagggaaaatggttccaggtattgtgtttgcaagaggaccagctgtggctgtgttgatgctcctggaatcagagggtgagacttatgctgttcttactgaacaggcaagggttcctgttggaagaattattttggaattgcctgctggaatgttggatgatgacaaaggtgattttgttggtactgcagttcgtgaggttgaagaagagattggtatgaagttaaatgtaggagacatggttgacctcactgctttccttgactctgcaactggatgcaaagttttcccttccgggggaggatgtgatgaagaaatcagtatttttctgtacagagggcgtgttgataaagagataatatcacaactacaaggtaaagagacaggtcttcgtgaacatggggagctaattaagcccaaaagaacaattgttggaagtgattcatattttgtgaagctgtatgcttcaatggctatgaatattcgctttgtatgcggtgcactgaaaaggttcactccgcttcactcctccaattgggtttcgaagaagaataagggtttcttctgcaagatgtcgaccgagtcaccttccttgactcacactatcacactgcccaataaacacaacgaacctgttcacattgttgctgctcccggtgtctccaattctgatttctggtgtgctgttgaatcctctttattcaagcagtggttgcataacttgcaaactgagaatgggattctagctgatggtaccatgactctcagacaagttcgaattcagggagtagacatgtttggaaagcgcattgggtttctcaagttcaaagctgacatttttgacaaggaaacagggaaaatgtacgcatattgtcttaaccttctctataaatattatctagattattgtgctacaatatctgagggtaagccgagaagcaatggcattgtatttgcaagaggaccagctgtagctgtgctgatactcctggaatcagagggtgagacttatgctgttcttactgaacaggcaagggttcctgttggaagaaacattttggaattgcctgctggaatgttggatgatgacaaaggtgattttgttggtactgcagtgcgtgaggttgaagaagagactggtctcaagttaaacgtagaagacatggttgacctcactgctttccttgactctacaactggatgcagagttttcccctctgggggaggatgtgatgaagaaatcagtatttttctgtacagagggtgtgttgataaagagataatcacacaactacaaggtaaagagaccggccttcgtgaacatggggagctaattaaggtacgtgtagtaccatacaagaaactttggcgcacaacagcagattgcatggttctggtggctgttgcactgttagaaatggctatgaaagaaggcctattgcctactttgtctacctaa

SEQ ID NO: 74582 - DNA, 177 bp, Glycine max
  Peptide Sequence Number=SeqID_191360
atggctcttgattgtggacatgttttcgccacctgctacttagcagagagcataactgtacaccaggcttggatttgtacaagtcttagcgtccaaaaacacttggtgaaaatatctctggcttgttggctggaattcaacaaaatgatggtacaaggtccctacaagtacctacag

SEQ ID NO: 74583 - DNA, 462 bp, Glycine max
  Peptide Sequence Number=SeqID_191361
atgaagaaaatcctagggaaagtgtcaaggagctctgagaaccgctctaagatccattatgaacttaagcacgaaggctatgcacgcaattcaatgaaaagatgcaagaagattgaaggaaaaggtacatgggggtatagtgagtggagaggtttgaagaacctaggggaattaggaactcataggcctcactttgctactcttgaatggcttctagactatagtttttggagttgggagcttggggatcgatatacgttgtacccgtatgtggtgatcactcccaactgttatccatgtggttgtgtaagaccactagtacctaagaggcttggtggcattgttgggctctgttatgtgtcaagtaccgacatcaaaggagaccatgatgatctcatgcctgcgacctgtggagatagaggagtacaaataactgttgtggctgttagagccttcatctaa

SEQ ID NO: 74584 - DNA, 540 bp, Glycine max
  Peptide Sequence Number=SeqID_191362
atggagtaccgcaacaaactcgttctcgcccctatggttcgcgttggcactctcccatttagattactagctgctcaatatggtgcagatatcacttacggcgaggaaatcattgaccacaagatgctcaagtgcgaccgccaaatcaacgaactcattggatccactgattttgtggagaaggggacaaaaaatgttgtgtttagaacctgcgatgaagaaaaggatacggttgtatttcaaataggcacatcagatgctgtgagggccctagctactgctcagttagtgtgtaatgatgttgctgctgtagatattaacatgggttgcccgaagtcattttctgtgagtggtgggatgggtgctgctctgttgtccaaaccagagcttattcatgatatcttaacaacattaaggaggaatttgaacacaccagtaacatgtaagattcgacttctaaaatcgccacatgataccgtggaattagccagacgaattgagaaaactggtgtttctgctcttgcagtccatggaaggtaa

SEQ ID NO: 74585 - DNA, 486 bp, Glycine max
  Peptide Sequence Number=SeqID_191363
atgtcataccttaattttgtccggggactattgttcatttatcttttgatccttgctagtcgacttacggtgttaaacgccagttacagtgtgaaacaaatgattgttcaatgttttgatcaagaatgccaaagataccaaaaaggatgggcaaaagggctagcctctggcttgcctgggccctcaaattacttcaacctaaaggaaccagctcgcctaggcgagccagttacttcaggagtaagtcttggctcgcctgggcgagctgctatggtcccaagtccctttttttctataaataggtgtgaaggggagttggggaaggggtttaagcattcagcattgagagaaataagggagaagaagaagaaagaagagaaaacgaagccgaggcactaccgaattgtgattgtgatcaatctctacatcgttctttgttcggtgttcttcgtgcgaccatcagttagttttgtttttaagatttga

SEQ ID NO: 74586 - DNA, 156 bp, Glycine max
  Peptide Sequence Number=SeqID_191364
atggataaaagcaaagaatatagagagaaagggagagctcaggcttggaatgctaagagaagtgctctgaggcgaggtgtagaaatgggctttgggccttcaaaggcgcgcttagcgcgacaacacgcgcttagcacgtttagattgtgcgcttag

SEQ ID NO: 74587 - DNA, 282 bp, Glycine max
  Peptide Sequence Number=SeqID_191365
atgggaaagtttaagttttgggaagagattgatcaaccttgttattgccaagccacgggtagccatagaaggtcgttaatctccatcgtgaaaggatttttccagagcggtgccaaaccaccactacttccattggcatccactaagaacaagaatcaagtttggagcaaaggatattcgagccctagatcattcccatcaaggttaaggttctccatgtctggcatctccatgcgaagggaaggtcaaggattaggagtggttaagggagaaagcgggtaa

SEQ ID NO: 74588 - DNA, 306 bp, Glycine max
  Peptide Sequence Number=SeqID_191366
atgggagatggagctagggagttaagtaactgtggcaacagaaaagtttcaggggatgtctcaagtcacaatcacaacacatgggagttatacaatagcaccctgactcccggtattccagctgggaaagcatctgtgacactgaactacaccgctacggagggcacccattgcggtgaggggccgctcgccacagccctatattgtgctattctcatccctgctagacttcatacctcatcttttgacatcaatgtgaagcaacgcccagtctggccagctcttgcagttctaccagctcgatga

SEQ ID NO: 74589 - DNA, 1242 bp, Glycine max
  Peptide Sequence Number=SeqID_191367
gcatgccttattcatatacacgcggttctgccatggatgcgtcaccctgtcgacatcactcgctgtccagaactccccgtctgtagtgttcctttgatgaaacgcaggttacagtcggtactggaggagaacatgggaatttccaagctgttccctgttcaggtcgcactttggcaagaaacggttggaccgggtgactttgagcgagacctttgcataaactcgcccaccggaagtggcaaaaccttggcctatgctcttcccatcgttcaaaacttgttcaccaaccccggtggccgcctccgtgctttggttgtagttcccacccgcgaccttgctttgcaggttaagcgcgtcttcgacgcccttgcatcgccgctgggtctccgtattggcttggctgctggtcaatcttcgcttcgccacgagctttctagcctcatttatctacctggagaagacgatggtccagatcctgggtttttgtctccgttgtggttccaaagcaaggtcgacatattggtagcgacccctggaaggctagtggaccatgtcaacaagttgtcattgaagcatcttcgttatctcgtggttgacgaagcagatcgattgctacgtgaggactaccagtcctggttacctactgtgcttaaattaactcagtctaggctggcaaagatagttttatctgctacgttaactcgggacccaggaagacttgctcaacttaatttgcatcaccctttattcctgagtgctgggaaaatgcgttatcggctcccagaatatttggaatgttacaaactgatctgtgaaagaaaggtcaaacccttgtatttggttgcccttttgaaatccctaggagaagaaaaatgcatagtttttacaagatctgtggaatcaacacatcatctctgcaaattgctaaattgttttggtgatctgaaaattggtatcaaggagttttctggtctaaaacatcaacgggtaagaagcaagacagtgggtgaatttcggagaggggagtttcaagtgcttgtatcttctgatgcaatgactcgtggaatggatgttgaaggggtaagaaatgtcattaattatgacatgcccaaatacacaaagacgtatgttcatcgagctggtagaactgcaagagctggccagactgggcgttgcttcacattgatgtcaaaagatgagatccagcttatgcatttgagccaaagaaagaagctacaatga

SEQ ID NO: 74590 - DNA, 1461 bp, Glycine max
  Peptide Sequence Number=SeqID_191368
atgaacaaggatgtggagtctccttatgtggcactctcttccagtgattcatcagggatggtttgggaattggatgatgatgataacatttcttatttcatcaaaaagaagcttcgtgtttggtgtaggcaaccaagagggcagtgggaactaggaacaatacagtcaacttcaggagaggaagcatccatttcactctcaaatggaaatgttattaaagtggtcagatcagagattctaccagcgaatcctggtgttttagagggtgtggatgatcttattaaacttggttatttgaacgagccatcggttcttcacaatctgaagttgagatattctcaaggaatgatttataataaagcagggccaattttaattgccctcaatcctttcaaagatcttcagacaaatggaaatgattatgtctcagcttataggcagagaattattgatagtcttcatgtttatgctgtggcagatgtggcttataacaagatgataagagatgaagtaaatcagtccattatcataagtggtgagagtggatctgggaagacagaaacagctaaaattgcattgcaacacttagctgctcttggtggtggtggcagttgtgctatagaaaatgaatttcttcagataaatcgtatactagaagcttttgggaatgcaaaaacatctaggaataacaactctagcagatttggaaagttgattgaagttcatttcagctccatgggtaaaatatgtggggctaaaattaaaaccttattgttggaaaagtctagagttgttcaactggccaatggtgagagatcatatcacatattttatcaactttgtgctggatcttcttctgatcttaaagagagactgaatcttagagcagtctgtgaatataaatatctagttcagagtgactgcacatcaattgatgatgccgatgatgctaaaaactttcctcagctgaaggatcaagagatgatctttaagatgctcgctgcaatactatggctgggaaatatatcattccaagtagacagtgaaaatcacattgaggttgttgatgatgaagctgtaaccagtactgcccagctgatgggttgcagttcccaggaattaatgacagcattatgtagccataaaattcaatctgacgaggatactattgccaaaaatctgacattgaggcaggcaatcgaaagaagagatgcaattgcaaaattcatctatgcaagcttgtttgactggcttgtagaacaagttaacaagtcacttgaagtgggtaaacaatatactgggaaatccataagtatcctagatatttatgggtttcagactttccagaaaaacagctttgaacagttttatataaattatgccaatgagaggattcaacaacattttaatcggcatctgtttaaacttgagcaggaggtcagtaactatgttatgtgttaa

SEQ ID NO: 74591 - DNA, 4974 bp, Glycine max
  Peptide Sequence Number=SeqID_191369
atgagaggagagagaaaagatagagagagaaatagtgggtgggagagagttagaactaggagggagaagagagagagcaacaaagagagagctagagagggtcaatgtctgcagtttgccggcaacagcagaggacataaacaagactacactcgagtaaattggagagaccataaggatgttgcatccttctatttcacacggttccctgaagacacaactgaggaggcattatggcaacatttcaaaaaagcgggagatgtaagggaggtgttcatagccaagaaaagaaacaaaaatggaaggagatatggctttgtaaggttcaaaggagtggaggatttgcagcagttagagaagttagacaacatcgtctttggagggctgaagatgtttgtcaacatcccaaaatttggaagagctgtccaaggaaagccacaaccagtaacttggggatgcccgtacactaagtcaaatgaggaggagagcagagatacgaacctgagagtgcagcaaagagggtacctggggaagaagagtggatcatatgcagaggcagtcaagaggaaaaatacaggagcagaccaacggagaccagcagacaaaagggagttatctggccattggtcgcagtcaaaggtgcacctagacatctccttgacagagcataaatggctcacagaagcatgggtagggcggttaaaaaacttgtcattgtttgataaagtagaggatgacattctatgggatttaggagctaatgtatcaccgcggtacatcggagacgatatgatattgctcctaggcctcacagacgaccaagcaagacaaatggagactgaagaaaatgaaggagggtccttgtttcacactgtggaaaaatggaatccgcggatgcgtcctgggcataggctaacatggatacactgctggggaatacccctgatggcatggaacatacagcaaatgaagaagattgtggcaggtatcggagatgtggttgaagtcgatgacaacatagagggacctcggaagatggatatggcaaggatcttaattaaaacaccgtggaggccacttatacagcacactgtgtgggtgcacatacaggaggagatatttcaggtgcatatcatagaggaatgcggaactccttcaaacacttgcctgtgtcggcgcgacacggagtatagttcttcggatgagattctatcaaaggaaagtgaaggtggctcgctgtggtggatattggggcaaacaacgaaggagaaggagggctcatccagctggacagtggcaccatcgtcacaggaaggtcgacatgacccgtgcaccttggaggagaacgacgcgacgactggtgacgcaacttcatcggaaaggcgaaacccacaatggtactgtcacgccaagaagggtaatggcagcgcagaggtagaaagatggtgggaggcacatcgaactcaaggttctcgagacggaaacgacagcgatggcggaaatggaggccaatcagcgtgcgccgggaaagggaggccaacaccagttgtcggtcaagcaaaagtcagcactgatagcaacagtgctaccaaacaacaaactgcaaggatgggccacggcaccacagataccaaacagtggacaatgcacgaaagaagggggaagcaggcaatggggatatgtacctcggatggaaggggagagaatttgcatgagaaaggaaagatgggagcagaaaggaccgttggggcggtggagaaggatgttttaaacacagacaagccacgtgaccaagaggcagaaaatacaaatgggctcatttctgctattcacacccccaccaagctaatagacaaaaatatcaatagctcatccacaagtccgaagggcccaaatacctcttccaaggtgtattacagaaaacgtgggtgcagcaagcaatctgtttcagttctagaagatgacatgggccaacaaataacaccaacaacacccaaaatgcaggggaatgtacacaaactggacaggaaccatgaacaaacggctcatcagctctcaacacggatagcagcaattgatgaagcaaagttggtcaacattaacattcaggaggcagaaacactatgggacatagcaaaaatattaggggttacagaagggcagtttcagaggaataatttgcagcaactaataattgacatggaggacagagacacaaaagaggctgcgcgattgggaaggttagggagggggtcaagtggccggcagttagaagctctatgggaaaattctgacgttaggtgggaagcacagccttctgttaactcctcaggtggcattttgtgtgtttggagtgcaaaatcatttaagttggaaaggaagatcaatggggttggcttcataatgttggtggggaagtggaggcaggagacacaaacactttacatcatcaacatttattcaccgtgtgacattcaaagtaaaagagtgctttgggataatattaagcaattgaaaaatcagaatcctgaggggttatggtgcatattgggggattttaatagcataaggacccctgtagagagagttggtgtttgcaacaggggggtggaggttaacaattctagggagtttaatgattggattgcagaattggaggtagaggaagcgccgtgggttggaagaaagttcacatggatcaggccaaatggaacagcaaggagtaaattggatagattcctggtatctccggagtggcttacaaaatggccgggaacatctcaatacacactggatcggaacttctcagatcattgcccattactgcttagaggatggggagggtatgtgctaaagcaaaaaattaaatctctcaaggacaggctcaaggtgtggaacagagatcagtttggagatgctctcaggaagtataagaggattgaggaagacttaaacaagatggaagaggaatcagttgttagccagaaacaaatgcaacaggatctatgggaagcagctcaggctcatgaaaataatggcctgcaaggagtgatgattgatggggcctggaatgatgatccgaaaatagttaaagaggaagtcaggaggttctttatgcaacgcttccaagaatcccattttgacagtcccacattggatggtattcaatttcaaaccattggaagccaacataatgacatgctggtggagcattttcaggaggatgagatcaaaagggttgtgtggagttgtgggagtgataaaagtccaggcccagatgggcttaatttcaagttcatcaagcaattttggcagcttatcaaatctgacttcctgcggtttctggatgaattttatgccaatggaatctttccgaagggatccaatgcatctttcatcgccttaattcctaaggttttggatccacaaacactgaatgaatacaaacctatctcactaataggttgcacatacaagatagtggctaaaatcttggctaatagattgaagaaggtcatgcctttatttatccctaaaaggcaatcagcatttatagaaggaagacatatgttacatagcgtgttgattgcaaatgagacgattgaagaagccaaacgatgtcacaagccatgcattgtattcaaggttgactatgagaaggcgtataattcagtatcttgggagttcttcatttatatgatgagtaggatgggattttgcagcaaatggatcaaatggatggaggggtgcctaaaatcagcatttgtttcagtcttggtgaatggtagtccctcatctgagttctttccccaaaaaggtctaagacaaggagatccactatctcctcttcttttaaacattgttgtagaggcactaaatggcctcatgtcacaagctctggcacaaaggctatataagggatttttagttggctctaacaaggtggaagttagtatccttatgcagacgacacaatcttctttggggagtcattttggtgcttttggggtgccagatcagtggaaaatcatggcagccaattacctcaattgtagtctgatgtcctttccgttcacatacctcgacgttcctattggtgtaaatccaagaagaagtcagacatgggaccctattattagaaaggttcccaaaaagttggtcaacaagttggtgaggttacagaggaatttcctatggggcggtgcgcaggagcaaaataaaatagcatgggtcaaatgggaatcggtgtgcatgcgaaaagaagtcggaggtttgggagtcaaagatattaattctttcaacttatcattgttgtggaaatggaaatggagtttattccagcatcagggggagctgtgggccaggggacttaaagttggtgactcaacacccgcaacatgggcagatattgaacaattcaacattatggaaggctctttactagacaagtatcctaggctatataccatttcttctcaacaaaatcaaattatacagcacatgggaactgtcaaagactcagggtgggaatgggagttcaagtggaggagaccaatgtttgataatgaattagacatggccatatcatttctaaaagatgtggagagccataatattcagcagcaagagagagatcagtgggtgtggatggccgattccaatgggcattactcagttagaagtgcctataatgtgctgagagaggatatagcagaagagatacaggatggagcttttgaggaaatgcggaagctcaaggttccaacaaaaattgctacatttgcatggagattattcagagacaggttaccaaccaagacaaatctgcgaaagaggcaaattgagttagatgattttctgtgtccgttttgcatagctatggaggagactacagacatcatttcctccaacacatccatggaggttcggaggaatttaaagctaacagatggaattggtggtggctcgcattga

SEQ ID NO: 74592 - DNA, 1290 bp, Glycine max
  Peptide Sequence Number=SeqID_191370
atggcgttgattggactaagttattccactttctcgggaaattgggctgttgttatggttgtagttttatttgtttctacttctggactctatgttcagaaacctcacggtctactctctttattggatgaggagtcaaatttagccaaggcttctgatttaacatttgccaacaaacttaagcaccacctgaatgctaatccttgcttcaaaggagaaaaaggcagagctttccgtgttcgtcactatgcaggggagttgttctccaaaatgtttaaccagtctcaaatgcagagtgttgcaacaaagttcaagttggagagtaccacacctcactttattcgctgtataaagccaaatactaagcagcttcctggcatttttgatgaagtccttgtcctacaacagctcagatgttgtgaagttctagaagttgttagagtttcaagggctggatatcctactcgaatggcccatcaagagttttccagaaggtatgggtttctgctttctgaggccaatgtattgcaggatccattgagcatctcggttgctgttttgcaaaaatttaatatcccttctgaaatgtaccatgttggctacaccaaattgtatcttcgagcagggcagccggacttgtccaaagagccggttcagaatctgctttcagctttagcagatctccaaaggcgagttgacaaggctgatgcaattgtgaagcaaaaggaagacgaaaataccgaattgagggaacagctaaaacaatctgagaggaagaggatcgaatatgagacaaaaatgaaatcaatggaggaggcttggcaaaagcagatggcatctttgcaaatgagtcttgttgctgctagaaagagccttgctcccgagaatgcttcagttcagcctgtaagacgtgattttgtgctacctcgtggttatgattctgaagatgctacatccatgggatctcgaacacctggtgggagcacaccaatgctttctggtagtctatctgcctctgatgcagggagacaggtcaatggtacattgaccacagttggcaatctgatgaaggaattcgagcaggaaagacagaactttgatgatgaagtgaaagctttgaacgatgttaaaccggagcagtctgccaatacaaattcctttgaagagcttcggaaactgaaacagagatttgagggatggaagaatcaatacaagcataatgatattcagttttcaaactcatttgctgagaatagaaatgctggagaatccgcaaaattggcaaaatga

SEQ ID NO: 74593 - DNA, 398 bp, Glycine max
  Peptide Sequence Number=SeqID_191371
atgctgaaaacccttttggtttcacttttagctttgagtcctatccttgatgtcaatgtccttgattcaagaagtgagagatgttcctactttctaatgatctatgaggcagatcctttctttcacgcggttgagattggaaagacccgtggggatactgagaaatttgacaagttctataagaatagactgcaaaatatcatttggtttggaaagaagagtctctcaacagtcaacacaaaaaaagatggtcagttactcagttttgatagtgacacaaaaataataatatgttgtcctgttttgtggagtccacgcgctctgacgcttcggaattccagaatgagagaagaggttatcagctccggaggcaccgttgatccaacacctgctgccag

SEQ ID NO: 74594 - DNA, 414 bp, Glycine max
  Peptide Sequence Number=SeqID_191372
atgcccaatagtatgaatttaatgtgtttcaacttcagtttcaacgcatcatcagcttactcagcaaggcatttgtctcttcccccgctaagtgcgcctagctcgttcaacgaatattcactaactcgcactatgcacgaaattggcgctaagcgagccttcgaggacaaaaagccctttttaaggctgaagttgggaaaatcagcgggtcggctaattcaaagcatagagagtagaacagaggcgaaaaacaaagcaaggaagccaaaaacctcagctttcaagaggatcttaggtttaggagtaaattctaggttcttagagctgaaaggtgctgccttgcaatggaaggcttgcttttggtctgatcacccattggctaagttcaatgagacatcagagaaggaggtttaa

SEQ ID NO: 74595 - DNA, 492 bp, Glycine max
  Peptide Sequence Number=SeqID_191373
atggacaggcacattgatgtggccctggtcaaggagttttacttgaacctgagcaccctggaagctcttgaggaaggatctaatgacactggcccagacttggagtgtgttatcatactccaacctcgcccccacttctcatacgtccaatttggcatactggaaaaaagagaaaaattggaaggtgtagcagctggagtctcactaagcctggccaatgtgcttagcaagtatcatccactaagcgagacatcggctcgcttagcgagtaagagtaatcttgaagggaatctgccatgcaagcacgagcccagcgcgtcaccagctcgcccagtgagtcatttgtctcttctggcgcttagcacgcctggctcgctcagccaaagatcacttactcacgctaagcgcgaaaatggtgctaagtgcgccttcgaggatagaatgccctttttaaagcctgaagtgaaagaaaagatagggcttggcgaatag

SEQ ID NO: 74596 - DNA, 366 bp, Glycine max
  Peptide Sequence Number=SeqID_191374
atgtccactacacagctagtggtcaacatgaagggacgacccaagatcaaggggatcttagtgtcctcttcgatgtccatcactacaaagtcagctgggaaaggacctatgaccaggagtaggaccaaacagtcaatggataccctccaacaaatggtaacaggcatacttagcaaggcccaagtggagaaggacgaagaccgaagtggaaaaggacgaagccccaagtggagaaggatgaaggtgcaagtggataaggacaaaggcccaagtggagaaggacgaaagatccaagtggagaaggatgaaggcccaaaagcaaaggcactactaagcatattaattgttgctgaaggcccagactaa

SEQ ID NO: 74597 - DNA, 168 bp, Glycine max
  Peptide Sequence Number=SeqID_191375
atgttagctagtttggatgttgctgctctgacacaacacaacagatcgggaagaaccctaaccaaacaagaaagcaatggatgcagagttaaggcaatagacggtggagctatccaccctcgtcacatgtgtcgcaaacctacccttcggcgggagggcgacgcgtga

SEQ ID NO: 74598 - DNA, 306 bp, Glycine max
  Peptide Sequence Number=SeqID_191376
atggagcattcacggacaatgttcacttggatcaatagctaccactacagctacatggtggaggaagagacacgcctccacgtgcactttggttgcatccgacgccactttttgcaattagatgagccccaaataccaccaatcatcatagagaaaccgctcgctggaacccacagaacctcctatcgaagtatagtcgaagaaaagcctacattgctgttggaattgtgggtcgaagaaaaccctagacgctcttggaacagtcgcgggtgctcaaagctcaaagctttgtacgctgccagttaa

SEQ ID NO: 74599 - DNA, 1417 bp, Glycine max
  Peptide Sequence Number=SeqID_191377
tcatgaagctgaaatccacggggctgatatatctgtgcacagagctgatagtgttgttggtgaaatggaacagagagtagaagatgctgaaaaccagggacagacaggtgaatctgtttcagatccaggtctaatggatgagtttatccctgatatgaacagggaagatcctattggtgatagccaggagatgatgtctcactctgcaggaagaacagacagtgggtcaaaaattggctgctctacagaatctgttgaaagtggtgaaaagattagtcaaaactgcaatcttctacctgctaatagtagtcacccttctcagatcatgaagcatgataaatcatcatttgccaacaattgtgctctccctgaatcagattttgccattgcaaatgggataggccctccaaaaggagagagtaattatgaagctgcagagtttgatcctattgtgcatcacaatcaatgttgcccttgggtgaatggcaatgttgctgctgctggctgtgctagttctgttccaagtagtgatgcaattgccctcagtgtttggcagctgacgatagatgctttggatgctttgtcactggggcacaatgcaattccaacagtaccatctgaatctgctgcatccttgtacaagcaatttgttgttaatctagttgttccacctcattatctcaccggggatgatcgcattgctgatcgtgtcaacccagagtacgaaacctgggaagttcaagaccgaacgcttcttgtttggctgcagtctacgctttcgaagtccgtgttatcaagagttctaggtctcaatcattcgtatcaggttttggagttaatgatactaagtcccaggattgtgaataccagacttagaccttgtttgcatagggtgagcgttaactgggatagagttgggctaaaggcccaagtggagaaggacgaaggcccaagtggagaaggacaaagcccccgagtggagaaggatgaaggtccaagtggtctttttgttcagctacactataattccttgttgaaccaatctcagacttatcaaggtaatccttgtggcgtctaccctgacttatcttccttcaccggaagtggcgtctaccctgacttatcttccttcaccggaagtggcgtcatccaaacctccgtagcctgtatcaaacgatccactcctactcaggttcacatcacaaggtacagaaacagtggtgaaaaggattctaagatatctcataggcgctctacctcagggactgctatttttcttagcccaaacttagtctcttggtggtctcacaaacaaaaggctgatgttctaactaaacctctgtctgcatcaagatttgaagctcttagaggcaaactcaatgtgaagagtgtttccaatgaaaactctcccccttga

SEQ ID NO: 74600 - DNA, 234 bp, Glycine max
  Peptide Sequence Number=SeqID_191378
atgcccaatagtgtgaatttaatgtgtttcaacttcagtttcagcgaggcttgtgcgcttagcgagaatcgtgcgctaagcgaggcactcagcctgcttagcgagttgggtgaatctggaggagaatctgagaagcatctgagaagcatctgcgcgctcagtgcatcatcagcttgcttagtgaggcgtttgtctcttcccgcccgcccagctcactcagcagatattcactaa

SEQ ID NO: 74601 - DNA, 399 bp, Glycine max
  Peptide Sequence Number=SeqID_191379
atgatgatggtatcaacaacaaacaacaacaatagaaataatagtgatgatcacaataacaatgcgatagatgtgacatttggttgtgatagtgacgatgtggtggtgacagccaatgatgtaatgtcgatgatattggtatggagtagtggtggtagcaatgttggtaagggtcgcaatgacgctagtagttgtggtcatgaaggtggtattgttgttgttcgtaatggtggtgatgataatgataacggtgaaagtgacatggatgatgatggtggtgataacaatattagtagtgatgataatgttagtggtaacaatggtgacaataacaatagtgttggtggtgtttgcaatcacattagtgatgattgtgctggtaacaatgatcacccgtga

SEQ ID NO: 74602 - DNA, 411 bp, Glycine max
  Peptide Sequence Number=SeqID_191380
atgataaagaagataatcacagaaggtggtccagaagtaggtgctaaagagaaaatccccgctcaagaaaaactgctaaaaaaggatataactacagctggagaaaaagttacagattcaacaattaacaaagcaactaaagcacaagcacgttccacaagcccctcaagagagaaagtgcatgagctcgagaagactaaagaattgaatcttctagatgatgaagaagaaatatcttctcaagcaatggacaaaagtgctaaagaaatgagaaatagagatggtctggaatcaattgcacaactttatggagaagcatttgaaactcatactgatatggaaatatctgagcatgtgcatattttaattctagatgcaaaggtggatcttgaaatatcacatattcaatag

SEQ ID NO: 74603 - DNA, 2385 bp, Glycine max
  Peptide Sequence Number=SeqID_191381
atggctacatcagataaagaaagaaagaaaatttggattctgggtatcatccttgacattgtacttgcagtatctgatcaccctgttctttgtcttggtgggaattctggtcttcacagtattggtgtaagtatgttcatcgtgactaacaacggatcaggtcatagtgttactggtttaaggtataaggaataccaacttcaagattttagttcttggtttctcaaagagttaaacaattctcgtaactgggagaggttgaaggtttgtcttgtcaaatctgatgactgcaataacctatccaaaaaatataagactcctaaacaatataaatcagctaaattgtcaccaattgaagctggctgctgccgaccgccttcccaatgtggatatcctgctgtaaatgcatcctactatgacttgacctttcatccagttagcccaaacaatgactgcaagcggtacaagaattatcgggccgtcaaatgctatgattgtgactcttgcaaggctggtgtggcacaatacatgaaaaccgagtggagagttgttgcaatatttaatgttgttttatttgttgtcttgtctgcagcaatgtggggttggatggtcggggaagcgcgtagggcagcgtgcaactggaactgggtttcgctccgaagcatgggtggcggtcccagaacctttcccggcggtgtgaacaagtggaagtggaagcgcatgcacgagaagctcgccagagacaaacagaacagactcatccaacaagagaagcagctctacccagctcgcattcgctcccacatccgctcctccctctcccccgaccaccgctccgccgctgccgccactcaccgccctctctcccccaacgaccacttcaaagccctcgccgaccgcttcgtcaaagacggcgccgaagacctctggaacaaccacgacggtcctctaactccaaacccgacaacaccgaaccttgatttttgccccaagcacaccaggggttaccgtgctgttcccgaggttgggaacagtcgtgttggggcccacaaatataggttttggagaaagggtagtgatgattcttcttctggtgagagcgagagtgagattgaagttgaattgagtatgaagaagaggggtagtagtgcttctttaggggagtatgatgtcaagagagagcggagggttgtgcccaagacttctccagagtttgagtttattagttatgagcttaataagaggaagttgagccaaattgaggaccaacagagtgagcaacaacaaagcaatgaaagcattctaagcaacacaagactaaagtggttgatgcagcctcaattatgcttgcagagccttgacgagtgtggcatatcgccgctgacggtcaaggcactttcttcagctggctatgttcatatgacccgcatacgagaggctagcctacctatttgccttgagggtattgttgaaaataatcgaagtcccatatcggctaaaagtaatctcacattagaatatataagtgaggggcaaccctcaccccttgagctagcttttgggccctcgctttgtggtgacaaacatcaaccatttgaggggcaaccctcaccccttgagctagcttttggggggatggatgctgtagtcaaagctaaaactggcactggaaaaaatcgcaaacagcttcctgctattgaaacagttctgaaagctatgagtagcaatacgtctcaacgggtgcccccaatatatgttctaattctctgccctaccagagaacttgctaatcaagttgctgctgtagcaaaggttttgctgaaatatcatgatgccatcagggtgcagactcttgttggaggcatacgatttaaagttgaccaaaaacgccttgaatcagatccatgccagatacttgttgctacacctggtaggttactggatcacattgagaataagtctggaatatctctgcggttaatgggcttgcggacgcttgtacttgatgaagctgatcatttactggacctaggattcagaaaggatgtagaaaaaattgttgattgtttgccccgtcagcagcaatctttgctgttttctgcaaccataccaaaggaggtccgttgtgtatctcagcttgttttgaaaagggaacacaaatatgttgatacagttggaatgggttgtgtagaaactcctgttaaggcaagttatagcaactattgtcattgccatactctaaaaattgcaaaagtgaagcaatcttatcttattgctcctcatgagtcacattttcagttagtgcaccatattctgaaggagcatatcttgcaaacacctgattataaggttattgtattctgtataactgggatggtgaaatga

SEQ ID NO: 74604 - DNA, 406 bp, Glycine max
  Peptide Sequence Number=SeqID_191382
caacgacgaagaaggcggagaagtgcgtgtagtggaggaggaaggcagtgcaattgtagtagtagaggaggacggggaggaacgtcaagagtgtgatgaggacgatgaggacgacgatgttgaggaccatgctctcgagtttctgcgaggcggtgtcggtagggttctcaacgtagacgaggttggcggtggtggtgatggttgtggcgatgaacaacgaggagagcgagtaaaccaacagaaccacaaggaacatgcaaatcgagacagggctcatcatgctgattatctccatatatgtccagagacattccagaactcaattccattttcacaaattttaggaattttttggttttggaaattgttcttagcgcctgttattaacaaactccattttttgtga

SEQ ID NO: 74605 - DNA, 423 bp, Glycine max
  Peptide Sequence Number=SeqID_191383
atgaagaagaggaataaagagaaatcgtttgcttacaaaggagtagggatgtctcctccacctctaggaatcacacaatcgcttaaagactcacaaatctccctcaaaggtcagaacttggctcctggctttggtctctgttcgtctcttacgactttgtttgtagtctatttagacctctcttcttctgtgcaaatcaggcttaaaaagggctttctgacctcgacgtcgcgcttaatgccatttttgcgcttagcgcgagtaagtgaattttggctcagcgccaaactcgcgctaagcctggaaggtggcaaacgactcgctgagcgagttgatgacgcgctgagcgcgtgcctacatgacagattcccttctagattcctcctactcgctaagcgcgctaaggcctcgcttagcggatga

SEQ ID NO: 74606 - DNA, 684 bp, Glycine max
  Peptide Sequence Number=SeqID_191384
atggcagctttggatctcacaataagcatgttgacactcattgttgttgtttctcttggtttgtggagtggtgttcaaggtgcactacaagtgccatgctacttcatttttggtgattctttggttaataatgggaacaacaaccaactccaatctttggctagggttgattacttgccttatgggattgacttccctggtggaccttctagaaggttttccaatgggaaaaccactatgcaattgggagggcgtattagctttagtgggcaggtgcaaaattaccaaagcacagtttctcaattggtaaatttactgggaaataaggactcagctgcaaattacttgagcaagtgcatatactcaattgggttgggtagcaatgattacctcaacaactatttcatgcctcaattctattccagcagtaggcagtactcacaacatgagtatgctgatgttctcattctagcatatactaaacaaactttgtacaattatggaccaaggaaaatggttctatttggaatatgccaaataggtttcagcccaaatgaattggcccaaaacagccctgatggtaaaacatgtgtggaaaagatcaattatgcaaacgaggaaaacatgtggcatatatatacaggagtaggggaaaaggttttcaaggatgattttgaatcctaa

SEQ ID NO: 74607 - DNA, 387 bp, Glycine max
  Peptide Sequence Number=SeqID_191385
atgattttgattcctatgcaagataaaggtgaggactttgagtcatatgaggagtttgagtcctatgaaggcgaggactttgagccctctgaaggcgaggaccttgagtcctctaaggcgaggaccttgagccctccaaaggcgaggactttgagtcctctgaaggcaaggattttgagccctctaaaggtgagaactttgagtcctctaatggcgatgactttgagccctctaaaggtgaggactttgagccctttgaaggcgagaactttgagtcctctaatggcgaggactttgaaccctctaaaggcgaggactttgagtcctctaaaggtgcatgcaacctttgtcttgaaatgcagtaaatgcaggttccgtatgcaataa

SEQ ID NO: 74608 - DNA, 1719 bp, Glycine max
  Peptide Sequence Number=SeqID_191386
atggggtctcttcctctcaccagtagtaaacccttcttcacccagcttcactggttttcatcggacagaacaagaaccctttctctgaatcagagagtcaaggtctttgcctcacgatcacgaaatgaaggagaaaaagaaccacctaaattcgacagctacgacctcatggaactcaagttcggtcggttactcggagaggaccccaagctcacccttgccaagataatgggaagaaaggttaatcctgatgcttcttatcttgatattgagaaagccttttataagaacaagggtaaaattgtggaagtggagcaagttccatttgaaggctctaagggagggaggtcatcaaggaaattggatgaccagggcttggtgcgtcctgttcctgctaaggggatggaatttaaatccgatgatagcaaacctgcattggagattaagaaacccgtccgagcggaaaataaggtggggagtgttaggaagagtattgttcccaatgttattctcaggaagccagccgtgcttaaagatgacggtgatggggacacgttgacatcaaggttgagaatgaggccaaaaatgcaggatgagcaagtgaaggacacgtttagtgacatgacactgttgaggaagcctgaagcagcagttgccaagaacacagatgcaatccaagagccttcttctagtgtggatggccaagggaacaatgatgatgagttgaagatgtggaacgaagagttaagtgatgaaattggtggctttaccttgttggaacggccacacaaacctagtggtgaaaaggaagagaagttagaagaagtgaatgtcatgatcccaaatgatggattggagcaacatgagcagagacagctggagttccatgaggagccgaatgatttatgtcaattgtcagatttaaagtcagatgattctagagtggagttgtctgcggaagctgcgctacaggcaaagccaaaaaggctagataaatatgtgaaacaaacctcaaaatttgttggagaagagggtgcttcccgtaatattggaggtcgcacaaacaatgatgatttagggaaaattgttgatatgtcagatttccaggaaagcgaagatgctgattggaccaggacacaagatttgattaagactggagatagagaagacgtggaactagtaagctgcaataccaaagggttcattgtttcttttggttccttggtaggatttctgccataccgtaatcttgcttccaagtggaagttcttagcttttgagtcatggttaaaacagaagggcttagatccatcaatatacaagcaaaactcaggcactattacaagttttgatgctgaaattaagaacttgtctcctgattctcctccatctctggagattgatggtaaagttgaagatagaatttcaccagatatgaaattggaagatctgctaaggatttatgatcaagagaaacttaagttcttatcttcatttgttgggcagaaaattaaagcaaatgtgttagtggcagacagaaaaatgagaaagctcatattctctttaagaccgaaagagaaggaagaattagttgagaagaagcgaaatctcatggttgaaggagtttctgcattaattcatcagtctgaattatcgtgggatgccactttgaacccagcatcatattttcagattggtcaggtgtggcatgagcaatga

SEQ ID NO: 74609 - DNA, 123 bp, Glycine max
  Peptide Sequence Number=SeqID_191387
atggctaaaaatacaatactatgtgaagaatattacagacttgattcttctataattgtgcttagggaaggactatcaatgcagcttgctcacgatggtttaagagttcccataaacttatag

SEQ ID NO: 74610 - DNA, 621 bp, Glycine max
  Peptide Sequence Number=SeqID_191388
atgaggtgtctcattgacccttcagatcctccatgtcctgtatgtgcttactctctctccttccctcctcacctcaatcctaactacaggtgcaatagctctctgttaatcgattattactgtcgaagcgatgccactcacaaatatatactgattgatgctggcaagacattcagggagactgcacttaggtggtttgttttccatcacattcccagagtagattctattgttttgactcatgaacatgctgatgctgtccttggattggatgatgtgcttgctttgcagccgtttagtctcacaaatgatactgatcccatccccgtttacttaactcagcattcaatggatagcgtcgaaaagaggttcccttatttggttaagaaaaaacacaaagaaggacaagaaatgagaagggtagttcagctttgctggaacataattgctgatgattgtaatgggccattttttgcatcaggcttaaaattgattcctttgccagtaatgcatggagaggattatatctgtttgggatttctttttggtgagaaaaatagggtggcttatatatctgatgtttcacggattccagctagtatagagtatggtgcgttttaa

SEQ ID NO: 74611 - DNA, 294 bp, Glycine max
  Peptide Sequence Number=SeqID_191389
atgaagttcaaggcatataaaaggcacaatgctgttgtattgtgggagaatagtaagaaagcatctgcggaggcacatcttaaaaggattgaggaaaaattggacagaaacaaagccaagtgtgtagaaaaaatgcaaaataaagttgcagaaattcatcgaacagcagaagagaaaagggcaatgatagaagcctacaagggagaagaattcctagaaatagaggagaaagcagcaaagtttcgtacccgtggctattcacccaagaaatatctaccatgcttcggcagttaa

SEQ ID NO: 74612 - DNA, 441 bp, Glycine max
  Peptide Sequence Number=SeqID_191390
atgccctcacctttagaggactgcacatcctcacctttagagggctacaagctctcacctttaaaggactgcatatcctcgcctttagaggactacacgtcctcaccttcagcagagtgcatgttcttgccttcagagggttacacgtcttcaccttcagggggctacacgccctcatcttcagagggctacacgccctcacctttagagggctacacgctctcaccttcaaaggactgcacgtccttgcctgcagagggcttcacgtccttgccttcaatggactgcacgtcctcgccttcagagggctacatgccctctgtagaagcaaccttcatgatgatgaatcaagttgattcaagtagttttgatgatgacaaagatgatgacaaaaagcccaatataatgatttcaagatggagtcaacaagttcaattgtga

SEQ ID NO: 74613 - DNA, 132 bp, Glycine max
  Peptide Sequence Number=SeqID_191391
atgggagaatcggggaaccaacgaggcaaggaagtggaggacggagacacttcaagcggtgttagacaagagtatgcaatttctccactcaatctatgttttaaaggtttacaagaattcttaattatttaa

SEQ ID NO: 74614 - DNA, 822 bp, Glycine max
  Peptide Sequence Number=SeqID_191392
atgcagggtatcacgcgcatggatgctgccctggacgcaatgcgtccacttggatttaggacacaactgattctacgaacggttaatgagcttctcgatgtgtatggtggaaatcaaggatggtgctttattgaagaggcctattacaagctcctaatggaggcccttcccggtccccctggcgccgttgaccaaaaataccgcactgcactcaaaaccgcaatgcaattcttcgatgatgggagccaagcgaagttggatctatcaaaagggatgtatgatgttggggataacatgaagtttggtttttcgatggcttttacagccacggtgcagtcttggtccattctggaatatggagatcaaatggatcacgttggccagttagacgccgctcagtattcgctcaagtggatcactgattttctcatcaatgctcacccttctgagaatgttctttatattcagtgctattgcgtcatgcttatggtctgggatatccagagctcaatgtcacctttgctctttgtcgtggcacctggtcctcaccggcagtcttgcgagatgtggaaagagttgcagactaaggtggctgaattacctaaggccaaacctcaaaagaggaaactgcaccaaggaagaggaggaaactattatcaagctacaccgaaaagaatcactgagggacaaaacaatgtggtaattattgatagaatgtgggctaggcttctatcttcaacaaatctgcccagctttacgattgctaagactgtctctaaagaaaaaaggcaagaagaagcaaacgatcatgtccctgagtaa

SEQ ID NO: 74615 - DNA, 3228 bp, Glycine max
  Peptide Sequence Number=SeqID_191393
atgacgaatctaaggttcgaatttctgcctggagagatggtgcaatctgcggtggatggtttggtgctgtctatagttccaggggacattggaaaggtaactacgaggttagagaaagcagcagttcgtggtggagtttgtagatgggagaatcctgtctacgaaacagtgaagtttgttcgggagccaaagattgggaaattcaatgagagattatatcattttgtggtttcaacggggttatcaaaagctagctcctttggggaagtttctgtggactttgccgagtatgctgaggctacaaagccctccactgtctctcttcccatcaagaattctcattgtgatgccgtcttgcatgtatcaatccagagactacaagaaaataatgataaaagagaggaagaggattgtgaagatgccaaactaaaagccaatgatagaagtttgaggacctacttaagcaatggagagatagacgcaaactctaaaattgattcttctgaagatgtgtctgccaaagcaaacaccaatggagctgcactgagtgctgattgtagaacatctagtggttctgacattacattgtcaagttctgatggcagttccggacttgatactctgcgagaaaatggattaagaaatggtggcatccaccacaacgaccatggttttctttcagaggccagccacccttcagagccccaaaagcctgctgtaaatgcctctgcagtaatgtatgatattcatcagagatcacactgggactggtcagctcgctcagaacacagtttgagtaccgacagttcaactaatggttctcaggatgtgtttcctagggaaagatcccatcaaacatctgatatggaagttgaaagactcaaggctgaacttgctgcattggccaggcaggcagatgtgtcagacttggaactacagactcttaggaagcaaattgtaaaggaaagcaaaagaggacaggagctctcaaaggaaatcattagcttgaaagaggaaagagatgcactcaagcttgaatgtgacaatctcagatcttttcgcaaacgaatggaggaggccaaagtgagtaacagacctcaattggatagtggggatctttgtactcttgttgaagaaattagacaagaattgaagtacgagaaggagctgaatgcgaatctccaattacagttaaagaagacacaagatgcaaattctgaactagttcttgcagtgcaagacctggatgaaatgctggagcagaaaaatagtgaaatatatagtctttccaataaacatgaagagggtaaaaactcccatgagttagcgggaaagctctctaattgtgaaacagatgacgaagaacagaaagagttggaagagctagttaaggagcacagcaatgccaaggagtctcacttacttgagcaaaagattatagatctctatggtgaaatagagatgtataggagagacaaagatgagttagagatgcagatggaacagcttgcactagactatgagatattgaaacaggaaaaccacgatattgcatataagctggaacaaagtgaactgcaagaacaattaaaaatgcagtatgaatgttcatctcctcctcctgctgttgatgacgttgaggcccatattcagaatctggaaaatcaactcaagcaacagtctgaagaattctcaaattctctggctactatcaagaaacttgaaacccaaataagcagattagaggaggaactggagaaacaagccgcaggatttgaagctgatctagatgccgtgacacgcgacaaagttgagcaggagcaaagagccatccgtgccgaagaagctttgcgaaacaccagacataaaaatgctaacactgctgagaggcttcaagaagaatttagaaggctctcaacgcaaatggcttctacatttgatgcaaatgagaaggctgccatgagggcattgaccgaagcaagtgaacttcgtgcgcagaaaagactagtggaagcaatgctgcacaaagttaatgaagagcttcagtcagccaaagctgagtatgaggtaaaactgaatgaactatccaacaaaatagacatgatgacagctcagaaacaacagatgtttttggaaattgaggacaagtccaagcagcttgaaaaccagaagacgcgtgaggaacaagttagtagggatttctctgaagagatccaaatgctaaaagcagaaaatgaaaggcttaaagtggagatatcatgcctctctgagcaagtagaacaaaaagaaatgttaagaaatgacttggagcttatgaataaatcacttgaggaatctgaggctcagttacagaatagaacagtggaaagcaatgagctggtgagtgaaattgctttattgaagaaggaagcagaaaggtcacttgatgagctaaataggatgaagaatctcaaggatgaaaaagagatggcgggtagagtgttgcagtcagagttagaagcacttagagctcaatataatgacttgaaaagttatcttcttggggatgaggctgagaaagaaaatctgagaaagcaagttttccagctaaagggtgaactaaagaaaaaagacgacgcattaatcaacattgagaagaagttcaaggatagcaatggacgcacacagctttctgagggaactaaaacaaattcaaagaacaaaaagggtgcatcaattcctcagagctcaaaagaaatggcaaatctgagggagaaaataaaaacacttgagggcatgataaagtcaaaggaaacagctttggaaatgtcaacttcttcatttttggagaaggaaagggagctccaatccaaaattgaggaattggaggacaaagtggaggaattcaaccacagcattgctttgcaaaaggttgttgaggacaagaatactactacttcaaatggtgttgcagtgtcattattcaagagtgatgtacatttgtcggagaaagaagcagaaatatccacaatagatagtaatgagggtggctacctttgtgaaactttagctgaattatcgttgttgaaggaaagaaacaactcaatggaaacggagctgaaagagttgcaacaaagatactcagaaatgagtctaagatttgcggaggtagaaggtgaaagacaaaagcttgtcatgactgtacgaaacctcaagaatgcccggaaggcccaaatgactagttcatga

SEQ ID NO: 74616 - DNA, 325 bp, Glycine max
  Peptide Sequence Number=SeqID_191394
tcttttaaataatgccattttcgggaagagtggtgagaaagcttccaatgtggtctacaatgggaagcttgagaacaatcggttagttgttgtgaaacgcttctccaaactctctttgcctgatgctcaacagttcatggtagagacaactagagttggaaaagtgaggcacaagagactggtgaatctaattggttgttgtgctgaaggagatgaaaggctcttggtagctgagtacatgccaaatgatactttgtccaaacatccctttcactgtacttctcttctctgtatccattcattcaactttgttagctgtcattaa

SEQ ID NO: 74617 - DNA, 192 bp, Glycine max
  Peptide Sequence Number=SeqID_191395
atgggggtgaagagacagaaactcaacaagattgttatgcaaaacatacaaaggatgactgtggaatggggagtgatatttttgaagcagctgggaccagaccttaattttcagaaaatgcacacttcgatcaagaaggaaaaatgcagctgttgtggactgaaaacgattattcacttgcctagtggttag

SEQ ID NO: 74618 - DNA, 279 bp, Glycine max
  Peptide Sequence Number=SeqID_191396
atggtagttgcagcgatgtttgtagtgattgtggtgatgctaacaaagacgttggtgatgacaatgacagtggtgatggtaacaatattagtggtgatgataatagtgacagtgaaaatggtgttagtggtggcgatgggtgataatggtggttacaatgacattagtggtggtagaggttatattgatgatggggtagcgttggcaataatggtagtggtgatagcaaacaataatggtgacaatgacaataaggataatcatgattgtgacaattag

SEQ ID NO: 74619 - DNA, 175 bp, Glycine max
  Peptide Sequence Number=SeqID_191397
atggaaaactctgctagggtttccaattctccatgtaataaggcatcaaacaaggaggaagatatgttggatcgtagcaagaaaaaagttaaaacgtggaacatggagattgtagagagtggtgagaacaatggtcaagaacagtcttaccaggatatactgctaggggccgaag

SEQ ID NO: 74620 - DNA, 807 bp, Glycine max
  Peptide Sequence Number=SeqID_191398
atgatgggaaagctaaaggtgtatgcggatcgaatgtcccagccttctcgagcagttctcatattctgcaggtttaacggaattgactttgaggagattaaagtagacatttccaaacgccaccacctttctcctgaatttagagaagtaaaccctctgcagaaagttccggctatagttcatggaagcttcaatctctccgagagagtggtattagaaatggtcagcgtgaatgtcttttttatgctttattctgggttatgtgcatcatccttaggaaaccacgcaatccttgtctatcttgcttctgctttccctggaattgctgaccattggtatccaagtgatctttacaggagagccaaaattatctcagtgatggattggcatcactctaatttacgacatggagcaggacctgcaactggccgtccacttaatccaaaagcagctgctgaagcagagaaagttctattatcttctttatcgaaactagaggatatttggctcaatggagatggacacttcctgcttggtgtctctcaaccatctatagcagatctcagcatggtttgtgaactcatgcaacttgaggttttggacgagaaggatcgcagtcgaatattatccccatacaagaaagttcttcagtggattgaggatacgagaactgcaacaaatcctcactttgaagaagtgcataatatcctttatagagctaaaaagaaatttgaacagcagcgttcaagggtagctgaaactgggactgagcctagtaacaagatggggggtcattcaaagatgtga

SEQ ID NO: 74621 - DNA, 351 bp, Glycine max
  Peptide Sequence Number=SeqID_191399
atgtgcttgttaaagaaacttctttccttccttcaggaggaggctcgggccgttggtcagctcaggaaccaaagattgataaatctgcttggatgttgttgtgaaggtgaagaaaggttacttgttgcagaatatatgcccaatgatactttgacaaagcatttattccattgggaaactcagcccatgagatgggcaatgcgaatgagggttgctctgtgccttgcccaagctctagagtactgtaccagcaaaggacgtgcactatatcatgatctgaatgcctacagagttctttatgatgatgttaaggtattgttggatggtgctcagaacatgcagatatgttaa

SEQ ID NO: 74622 - DNA, 1971 bp, Glycine max
  Peptide Sequence Number=SeqID_191400
atgaagttatatacttcatttttgtttcttgctttggtttccatgctctcttttgtggcttctgtcatggtccctaaaaatgaagttttggcacttaaaactttcaaggaagctgtgtatgaagatccacatatggttttgtccaattggaatactttggattcagatctttgtgactggaatggtgtttcttgcactgcaactcgagatcatgtgatcaagcttaacttatctggggcttcattaaggggatttcttgctccagaatttgggaaaatcacctacttacaagaactgatcttgcatggcaacagtctcattggagtaatacctaaagaattgggcatgttgaaatctctcaaggtgttggatttgggaatgaatcagttaactggaccaattcctccagagattggaaatttgacccaagttatgaaaataaacctgcagtccaatgggttgactggtaggctacctccagaactaggaaaattgaaataccttcaagagcttcggctggataggaataagcttcaaggatctcttcctggtggtggaagttcaaatttttcttcaaatatgcatgggatgtatgcctcgggtgtgaatttaactggcttctgtcgttcgtctcagttaaaagttgcagatttttcatgtaacttttttgttggtagcatacccaaatgcttggcatatcttccaagatcaagctttcaaggaaattgtctccatatcaaagacataaaacagcggacttcggtgcaatgtgctggtgcttcagtagtgaacccaaagtaccaacctgctactaaacatgtgaccaagcatcaagaagcatcaaaacctgcttggcttttggctctagaaatagtgactggaaccatggttggttctctctttattattgctattctcactgcgattcagaggtgtaacaacaaatcatctatcattattccttggaaaaaatctgcaagcggaaaagattatatggcagtacatatagactccgagatgttgaaggatgtgatgaggtatagcaggcaggaccttgaagtggcctgtgaagacttcagcaacataattgggtcctcaccagatagtgtggtctacaagggtacaatgaaaggtgggcctgagattgctgtgatttccctctgcattagggaagataattggacaggataccttgagctctattttcagagagaggtggcagacttggcaaggttaaatcatgataacacaggaaagctgctaggatattgtagagagagcaatccatttacaaggatgctggtttttgaatatgcatcaaatgggacactttatgagcacctacattgttatgaagaaggttgccagttgtcttggacaaggcgtatgaagattatcataggcattgcacgtggacttaagtatttgcacactgaaattgagccgccattcactatctcagaattgaattccaatgccgtttacctcacagaagatttttcccctaagctggttgattttgaaagttggaagacaattcttgaaagatcagaaagaaactctggtaatgttagtagccagggtgctgtttgtgttctaccaaacactcttgaagcgcgccgtctcgacaccaaaggaaacatttatgcttttgcagtacttctattggagataatcagtgggagacctccatactgcaaggacaaagggtacttggtggattgggctagggactatcttgaaatgccagaagtaatgtcatatgtggtggatccagagttgaaacattttagatatgaagacctcaaagcaatatgtgaggtgataactctttgcatcagtcctgatccctctgtccgtccatcaatgcgtgaattatgcactatgctggagagcagaatagacacaacaataaatttggagctaaaggcatcatcactggcttgggctgagctagcactttcatcataa

SEQ ID NO: 74623 - DNA, 1863 bp, Glycine max
  Peptide Sequence Number=SeqID_191401
atggaggaagctccgtcttcagttccggcgacagcatcgtgctggagcaacgtggtcaagaagcaaccaccaccaccaccaccgcagcagcacactgagcgagtgttggtggaaaccagcgaatcccccaatgccatctccgttgccgtcgtggacgccaacgccgtcatccaatccggcgaaaagctccacggcctcgccgacaagttcatctccatccccgaagtcatggaggaaatccgcgaccccgtttcgcgccacaaactctctttcctccccttcaccatccaaaccatggaaccctcccccgaatccatcaacaaagttgttaaatttgctagggctactggggacctacaaactctttctgatgttgatatcaagctcatagctctgacttatactttggaggctcaaattcatgggacaaaacatctcagggaagcccctcctcccgtgcaaatggtcaatgtaaagaggttgcctgagaaggacttgcccggatggggttctaatgtccccaatttggatgagtgggaggcattggaacaaaccgaggacgtgtccaattccaattccaggatccttcctttgcaggacctgagcttgaacattgtttctcatgatgagcattttgtggatggttccgtggagcgtgcaagtgaagctgattcagggattcaggagggagatcagaatggttcgatgaagcctaggagatatctgccgaagaaaaaggagataaacatcgaggggaagatgatggtggctgatggaattgatgcgtcgcagggagaggttgatgatagtgctggtgattggatgccagctgtcagtcggagtactcataggagatatctaagaaggaaagctagacgcgagtatcatgagttgttgtcaagtaatcaagatcagcaacagttggaaggaaatgttgatggtagtgttggtgaagatgctagtgctttaaatcagcctgctcatcacaatgaagaacaacatattgaaaatgctgtgacagaggatgataacgtggtaaaagagaacaaagacaatgaaagtatctatgaaattatgcagcaaatgaggctgcaagaaggttcacttgaagttcttgatgaggaaagtaaaccaagttcatctcctgaagaactccagtcagacaatgctggattggtggaaaccgcatctgatggcaatgcaactgtggttaataaactatgtgacagtaggatagatacaattgatggccaatcaaatcaactggagattgcaagccagacaagtgaagctgctgatttttcatatgcagatgatgatgatagtgaccaaagttggatggttaggtctttgtctgaatcaagtgtagcctgtataactggtgactttgcgatgcaaaatgttcttctacaaatgggtttgcgcttgctggcacctggaggaacacagatacaccagctgcacagatggatactcaagtgtcatgcctgtaacactgttactgctgagattgggaggattttttgtcccaaatgtggaaatggtggcaccttaaggaaggtagcagtcactgttaatgaaaatggaatagtattagctgcccgtcgaccaagagttacattacgtggcacaaagttttcattgcctttaccccaaggtgggagggatgcagtgacaaagaacctcattctccgtgaagatcaacttcctcaaagggatgatgacttctttacaccagacagtgtcttcagccaccacatagacaagaaagctcctttccagcctcctgtaaggaaagcaatggcagttttcagtgggaggagaaatccaaatgacaatcactactcacgctctaaagcataa

SEQ ID NO: 74624 - DNA, 960 bp, Glycine max
  Peptide Sequence Number=SeqID_191402
atggaagaagagagccaaataacaaagggaaaatatgctgctgatatttcttccataaaagaagcacatgccagaataaaatcattggttcataaaactccgcttctgtcctccagctctctgaatgctatgtcaggaaggaagctctactttaaatgtgaatgtttacaaaagggattctgtaaagctcttctgattgttttctacaaaatcagtggaaaccatgccgcagcattggctttggctgcaaaactacgggggatcccttcgtatattgttattccaaaaaatgccccaacttgcaaaattgaaaatgtaaagcggtatggtggtcaggttgtctggtctgaagcctctgttcaatcaagggaagaaattgccaacaaagtgtggcaagaaagtggtgctatctttatacatccatataatgatggacgcatattaagtggccagggtaccatatccttggagattctggaacaagcaccacaaatagatacgctagtagtacccataagtggtggtggtttgatatcaggaatagcattggctgccaagtccattaacccagctattcgtatttttgctgctgaacctaaaggtgctgatgatgcagcacaatctaaagcagctgggaggataatacgattgcctgagaccaacactatagctgacgggcttcgagcatttcttggagatttcacatggcctgttgtacgagatcttgttgaggaaattataactgttgaagacagtgaaataataaaagccatgaaactgtgttttgaaattcttaaggttgttgtagaaccaagtggagcaattggccttgctgctgttctatccgatactttccagaaaaatcctgcatggaaggattgcaaccatataggaatagtagtttcaggaggcaatgttgatctggccatgctttgggattctttgaacaaaggaaagtga

SEQ ID NO: 74625 - DNA, 249 bp, Glycine max
  Peptide Sequence Number=SeqID_191403
atgacacattacaaggaaagtaacttaaaccacaatctcacggctactgtttcactcaagcacaagtgtttaagctattcattaatatcaactagcaagaggtccaatctttgcacttcatctcatgccataaagtcaaaaatgtataaacagaatcagaaggactttcccaggcttgtagtgaggcttggctacaaaaattcattggtttttctaggattcaaaggtttagattctaagagagcataa

SEQ ID NO: 74626 - DNA, 339 bp, Glycine max
  Peptide Sequence Number=SeqID_191404
atggaggagttcacagttcaggtggcctggccaagagtccaaccttctccttttgggggaggaaaggcttctgtagcccaaaagcctcagtcagagcctcagccacagccggaggccactctagagaccaccccgcgaacttctccaattactacactaggggtagaggtttttcatgaggaggatggcattgcagatacagattatgcagcaaatatggcagcagcacagagcacttgggatccatggcattttacagctcaggatatccctcagccagcccaggatgctctctcttcacctcaggacgagcccacagcagcacaggaggagccatga

SEQ ID NO: 74627 - DNA, 771 bp, Glycine max
  Peptide Sequence Number=SeqID_191405
atgaataaaaaattcgcctgtattggcattgttggccacccgcgtcacccttcagcgctggcaacccacgagatgctgttccactggctggtcgcccgcggctattcggtgatggtcgaacgccagatcgcccatgatttagggctgaaagacgccgtgaccggcagcctggcggatatcggccagcgcgccgacctggcggtggtggtcggcggcgacggcaacatgctcggcgccgcgcgcgtgctggcgcgctacgacatcaaggtaatcggggtcaaccgcggcaacctcggcttcctcaccgatctcgatcccgacaacgccctgcagcagctggcggacgtgctggaaggcgagtacatcgacgaacagcgtttcctgctggaaaccatcgtgcataaagagcaccagcagtgccgcatcagcaccgccatcaacgaagtagtgctgcaccccggcaaagtggcgcacatgatcgaattcgaggtgtacatcgacgatcgcttcgccttctcgcagcgctccgacggcctgatcatcgccacgccaaccggctccaccgcctactcgctctccgccggcgggccgatcctcaccccgtcgctggaagcgatcgcgctggtgccgatgttcccgcataccctctccgcccggccgctggtgatcaacggcgacagcaccatccgcctgaagttttcgcagatcggcagcgatctggagatcagctgcgacagccagatcgcgctaccgatccaggaaggcgaagaa

SEQ ID NO: 74628 - DNA, 339 bp, Glycine max
  Peptide Sequence Number=SeqID_191406
atgtccacacttatgaagttctatcctaacaaggtgtgtgcaagattgctaaccttgaactccaacaggaagaagaagacaaagcttattgcaccaacgtttcctattaggcatgctattaagtggcatatatacttcttccttagtgctaaaaaattgaagcgatcattacaagaagggaatgagttctttgaagatgatgcaagacatgtgaaagcttttatttgtcttgttcaaaaggcttgtgaagatggaaaagaacacataacaaaacaattctcaagatgggtagaagaggaccttgaaatgcacatgagaaaatatgcagtgcccaactaa

SEQ ID NO: 74629 - DNA, 276 bp, Glycine max
  Peptide Sequence Number=SeqID_191407
atgtctgctaattcaagcacaaggaggaatgtcacgtcaaaccgtctttgctattgtggtagaagagctaccattcaaacaacaaggacgacaagaaataatgggagactgttttatgcttgtccattaccacaagtaaacattgatgttggtgcaactgcaataggtagaatagaaccaataccagactttggtctaaggttgagacgggagattctgcaaagagaagttagggatcaatttgagagggaattcatcacgttttcaattagatag

SEQ ID NO: 74630 - DNA, 795 bp, Glycine max
  Peptide Sequence Number=SeqID_191408
atgtatttcttccctctaataaagagaatcatgcttttggtggcacagagagacacagtaagagcagcttcagaatttgcatcaagaaatcatctgcctcatcacatacaggatcaaatgttgtcacacttgtgtttgaaattcaagacagagggactgaagcagcaagaaacactaaatggcatgccaaaggcaattcgtgcaagcattgcataccatctatttttcccagttgtgcagaaggtctacctcttccaaggagtctctcatgactttcttttccaactggttactgagatggaagctgagtatttcccacccaaggaagatgttatactacaaaatgagtctcccacagacctttacatgctggtttcaggggcagtggatctcattcgctatgtcaatggccatgatcaagttctgaagaaggctattgcaggagacacaattggggagattggagtgttgtattgtagaccacagcccttcactgttcggaccactgagctttctcaaattttaagactcagcagaacttccttaatgaattccttacatgcatatccagaagcagcacaaattataatgaaaaatatcttcatgagcataaagaggcatgaaggattggattttgaatatccacctagggaccctggaatgcctcattaccaaatgcatgattgggacaacactggaggaagattttctgatgcatctacaaataactcacatggggaagccagattgcataacttgattcctgaggatggcaaaagagatcctcatgatact

SEQ ID NO: 74631 - DNA, 411 bp, Glycine max
  Peptide Sequence Number=SeqID_191409
gactacaatcctagactttcatgcttcggtctgatgaaaaatagtagggatgggagaagttacagtacaaatttggcgtttactccacctgaatatctgaggacaggcagagttactccagagagtgtaacatatagctttgggacccttttgcttgacctcctcagtggcaagcatattcctccaagccatgcccttgacctaattagagacaagaaccttcagatgctatcagactcttgcttagaaggagagcttacaaatgatgacgggactgaattagtgcgtctagcctcacgatgtttgcaatctgaaccacgagagcgtcctaatccaaagtcactggttgctgctctaatacctctacagaaggattctgaggttagctggtttgaaagtggttcagcataa

SEQ ID NO: 74632 - DNA, 450 bp, Glycine max
  Peptide Sequence Number=SeqID_191410
atggggagaatagattgcattgtttttagtcctgtaaaaaggggaacgaaaccaagacaaacattagaggaaattgttaggagggatcttatgctttcattccaaatgtggacgaaccagatgcaggaaacgttgaactcaaagaagaaaggggatgctgcttttcggcacaaggattttaaaactgcaattgatagctatacgatgttcattgatgttggaaccatggtttctccaacggtttatgtacgtcgtagtctatgttatcttatgagcaatatgcccgacgaagcacttaatgatgcaatgcaagcacaagtaatatcccccgtttggtacattgcgttttatttacaagctgttgctcttttagccctgggcaaggagaatgatgcccaagtggcacttaaagagggttcttcactggaaactaaaaagaacacaaattag

SEQ ID NO: 74633 - DNA, 432 bp, Glycine max
  Peptide Sequence Number=SeqID_191411
atgtcgtatttatcgtttgagcaatatgttgattatgctcttgatgttcctatgtattttgtctatcggaaaaacagatatatcgactgcactggaaagaccttcagggactttttggctggaagacttccttgtatccctggtgaattaccaactctcaatgattgggaaaatcacttgacaactatatttcctgaggtcaggctgaagaggtatttggagatgagaggtgctgatggagggccttggagaagattgtgtgctttaccagcattttgggtagggttattgtacgatgaactttctctaaaaagtgttttggatatgacagctgattggactccagaagaaagacaaatgttaaggaataaggtggaatccttaataacactattttcatttctgttgctattattcaacccagatgcatga

SEQ ID NO: 74634 - DNA, 443 bp, Glycine max
  Peptide Sequence Number=SeqID_191412
atgacattcgcaaacgaccctctcaattttgcttatatgggcacgatgtattcaagtgattgtattgaggtgttggactatatgtttccttctgaaggtacagtggcagaggctcttgttttgagtaaggatggtttggtaagggttggtggacaacataggagagatgcaaggaagagggttggcaggaaagatggaagcgatgggaaggaaaatgacgaggaaggaaaagatgaagacagggatggaaatgttttgactattacttttgataagacccccttacctcctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 74635 - DNA, 288 bp, Glycine max
  Peptide Sequence Number=SeqID_191413
atggtgatcagcctgggccacaagggagttcccaaaccgagtgacacacgccctagtacaagtagtcctcctcacaaggaactacaaggacatccaacaaggtcaatgcacccctccatgaacatacacaacatacgacgtatgaacgtgaacaccatcaaggacatccgacaaggtcaatgcaccccccaacatacacaacatccaacgtatgaaacatgggcaccatcaagtacactgaccatggatgaattaaaaattctaagacattccctcagagatgcttaa

SEQ ID NO: 74636 - DNA, 429 bp, Glycine max
  Peptide Sequence Number=SeqID_191414
atgggaaatcgacgcttcactcaggtcgcaaccagcgacgacgaggacgaagcgccgccggcgccggcgcctcctcccaagcagcaatcgtccgtcagtgcctccgaagaaaactgttcgaagcagcagcagcagcagcagcgcaagaggaagaggatgaagctccaagaagaagaggaagaggagaaagaggaagagaagaagaagaagagaaaaatcaaagacaagcaggaagagagatccaacgaagaagaggaaccgccgcaggaagacgccaagcccattggcgaaccggttaggctatccggaaagggaaggggccgcaaaaagcattatgaatccttcgagtacgacggaaaccaatacacgctggtactaccttttctcgttagtaggaattatttcaggctattcgatttgaacgcgtga

SEQ ID NO: 74637 - DNA, 156 bp, Glycine max
  Peptide Sequence Number=SeqID_191415
atgactacatcgttagacttgtcaaaaggagacgagcacaatggtgattgcgctagacaaggtgcaccaacctctgagatcactggagaaaaatggttgtggccggtgcagtggccgatggcgatgacggtggccagagatgacatacaacaatag

SEQ ID NO: 74638 - DNA, 628 bp, Glycine max
  misc_feature (623)..(623): n is a, c, g, or t
  Peptide Sequence Number=SeqID_191416
atgcagcattatgccaattttgtcaagtggaattgggtctgtttgagtatgtctttggattcatcaatgggacaagagttggagctggatcttgatgacaagtcttcagtgggtttgagtcccaatactgttcttccacctcatcaatactgtgtgaatgtgaagaagagatctaaaaagggaaaacccactgggaaagatgatttttttactctcaaggagggctttgctgggatcaaatttgctcgcttccgcagttcttcatgtaagagccatctctctagacctcatgaattggaaggtaatacagaaaccaggcgcagttccatgtatcagagttcagaggaagtgaaaagtataaaaaaaatgggcaccatggtagagggaaggagaaaaatagaaatttcaaggaggagtgacacctctttcgtaggtagcattgttgattctttatgtggttcagatgatgaaggttctgggctgagatcttcagagatatccaggtccaggacttgcaaggcgccagactctccaaatagctttattgaaatctgtataaattcagatgttaaaaataagaactctgccacagtacaagggagagaatctataaatttgaatcncagaa

SEQ ID NO: 74639 - DNA, 1716 bp, Glycine max
  Peptide Sequence Number=SeqID_191417
gaggaccctatacttctcacgcctgaggacaaagaccaaaagccgtatgtggcgattatcaaggacattactcaatccctgaatggcagcatgatggtcactggacagtggttttatcgtcctgaagaagctgaaagaaaaggtggtggcagctggcaatcatgtgacacaagggagctgttttatagtttccaccgtgatgatgttcctgcagaatctgttatgcataagtgtgtggttcattttgttcccatacacaaacagcttccaaatcgtaagcagcatcctgggtttattgtgcaaaaggtgtatgacacagtagaaaggaaactctggaagctaactgataaggactatgaggacaataaacagcaagaaattgatgagcttgttcagaaaactcttcaacgtttgggcaaactacttgacattgagcctgaagaacctgttgctgatcaggaagatctgatgaaaaataaaagaatcttaaggaaaaagagcatttcacctcttgatgtttcaaaggaggaggaaacaactcgtcaaggggaccaacctctgaaacctgaaacaccatggagttgtgtaaataatgcctcagaacattatcgcatattagtcgatttcaatgctctaacaggagatacccatcgtgacaaatgtttggagaagttgcttcaaagtgttcaattcatgtttaattctgatgacagcataaagaaggaagagaaaggaaatgacaattctggtgctgccaacaatggaagcaataacaaaagtttagaatctgctaacgaatgtgaagacaaggttcaaaagagttccaagccttttgtttggccagatgatgctgttccagctgtagttgctctggaaaaagcttcacatgataccttatcatcagattatcagaagtataaccaaaagctacgacaattagtatttaatctcaagaacaatgcaatcctagcacgccgtctactaaatggagagttggaaccttctataatattgaatatgacgcccaatgagttgaaggggttagcggttgagtttgtgtgggttggcatgtcggcctgtagctctcagctggtggtgctgtccattttggagtttgtgaatcagtttgaaggtggatttgggattatgcaaagtaaccaatctacgttgaaaagtgacaccaacacattctaccggactccagtgaagacgaaggccaggaggactgtgacagaggagagtgcgaccaacaggagtgtcaacaaatatagatcttttcacggatcttgttcattggctgaagtctacagattgcaggctcttgatggtgtcaagggagtgattggcttcatgttttcttccattagtgtattggagaaggagggtttgactgctgaggaaacaaccaagaaggagcctgatgagtcacaacacatgcagatgacaggtgcccgatgccatagatgcacagagggtaaggtgggcttgagggatattatccatgctggacatggtgatcgatatcagctggaatgtactgcctgtggtcattcctggtttgcttcccgtgatgaggtgtctgagctgactatagatgcatcagattcaaaaagaagtgtaggcacggcaccatgggccactgcaaaatttgaagatgttgagaagaagctgtctaggaaagatggaaacatccaagcttcaaaactcgctgactag

SEQ ID NO: 74640 - DNA, 3225 bp, Glycine max
  Peptide Sequence Number=SeqID_191418
atgcagtgggagcaggaggggcgggggaaagggggaactgacaaaggaaatgggtttcctcgggcaggtagccagcagcttgtgtctctggtgaagtggataaatgctgtgcttcctaattttaatctgcctttagatactacagaggaggagttgagggcacggttgagggatggatcagtattatgcagcattttggacaatcttgttcctggttcggtgaagggaagtggttctttgaatgagctaattggtgtgaaaaggtttctggtagctttggatgaattgggattgtctggatttgaattgtcagacctggagcagggatccatggtgcctgtgttgcagtgccttgagactctgaaaactcattttgcttataatactgcacaagaaaatatccaaagtggttcaagaaagagatgggaccagtcaaatttaacattctttgaggaatctgatagttgcctcaaggatgcttcaaaattgcaacatgctgttgatggttctgttgtatcagatgaaatcacttccatagatcatattggaataaagtctaatgaactgttccagttgaagcaaggattgcttgcagatttttctgatgccaaacttaatgaagtatttaaatcaaacaatttggatagtgtctcaactcaattgctttttaatataggaaataggattctgagtgatatctttgaaaggaaaaatggagatgtacctcaggctcatcgtgctgcatgcctgttgaggaaaattctgcaacaaaacaatcttttcaaggctcgtgagggaaagtatcaaacaagaataaatgcacttgaaaccttggcagtagggacaactgaagagaatgaggttgttacaagttgggttcagcagttgaaggttgaacaaactaagtttgaggagaagaagaaacttgaagagcaggatttttctcgtttaaagaaagaaaaagttcatagtgaaatcgaaatttctgcattgaagcaagatttggaaatagtcaaaagaacacatgaagaacatgtttcagagttagaattgcgagctactgaatctaaagctgaatatgaaaaaaggatagaggaacttaagcttcatcttgcagatgcaagaaagcaagtgaaggaactagaggcattttcagaatccagatttttgaaatggaagaataaagaggatacctatcaaactatcgtaaattttcaatttggagctttccaggaactgagagctgctatgaagtctgtcaaagatgatgtgataaaaacaaaaagaaactacttagaggaattcaagtactttggtaggatgtatttacaactaacaagatgtgcatatgtaggaatcaagttgaaaggtctagctgaggctgctgaaaattatcatgtagttctagctgaaaataggaaattgtataatgaagttcaagatttgaaaggtaatataagggtatattgtcgaattagaccatttcttccggggcaaagtcaaagtcatacaacaattgaatttgttggtgatgatggagaactaattgttggcaatcctcttaaacaaggaaaagaaaaccgcaagctttttaaatttaataaggtttttggtcaagcaacaagtcaaggggaaatattcaaggacactcaaccattgattcgatctgttcttgatgggtacaatgtttgtatatttgcttatggtcaaaccggctcgggaaagacatatacgatgagtggacctggcctatcatcaaaatcagattggggagtcaactatcgggcacttcatgatcttttccatatctcccagagtaggagaagctctattgtttatgaagttggagttcaaatggttgaaatttataacgaacaagaaaaacataccaagtattgtttccttgacttgcacacacttgggatttggaatactgcccaaccaaatgggttggctgttcctgatgcaagtatgcattctgtgaattcaatggcagatgtcctcgagttgatgaatattgggttgatgaatcgggcaactagtgccacagccttgaatgaaagaagtagcagatcacacagtgttctctctgttcatgttcgaggaacggatttgaagaccaacacactgttgcgtggatgccttcatcttgtagatcttgcaggaagtgaaagagtggatcgttctgaagcaactggagacaggcttaaggaggctcaacatataaataaatcactatctgcactaggagatgtaatatttgctctatcacagaagagttcacacgtgccatatagaaatagtaaattgacccaacttcttcagagttcgttaggtggtcaagcgaaaacccttatgtttgtacagcttaatcctgatgttgcttcatattctgaaactgtaagcaccttgaagtttgctgaacgggtttctggcgtggagttaggcgctgctcgtagcaacaaagaggggagggatgtgagagaacttatggagcagttggcatctctcaaggatgcaattgcaaggaaggatgaagagattgaacggttacagtcactcaaggctaaccataatggtgcaaagcttggtatgatctcagtaagacatgggtcatcatctccaaggagacattccatagggactccccgaattagcacgagacttgcaggagcaaggagctttggagtcaatggaaaggcagcttctgacatggataactgctcagagtatagtgataagcattcagaaactggttctcatcaatcaatggatgatttcaggaacaagtccagttcccttcggttgaagttaaccagagatcatatcagtcaaaatgtcaatgaagacattgacctcttaagatttggagatgcggattcagaggagagattaagtgacatatctgatggtggtctttcaatgggaaccgaaactgaaggttcaatcagcagtattgtggagtacactcttttccctgaacttgagaaggcagctgaaattacaccaatgaaggacaccacaaccgacaaccttccagctgagagcacagaaaagcctattatgccatccaaaattcccaaagcttctcaagtcccacaaaaagtgcagtcaaaacattctaggcattcaatgaacaaaacctcctcgaaggttctgtcaagtgttagaaaacccgcagccagtagctcttcttcggtgaagccccctaaacgatggcaatag

SEQ ID NO: 74641 - DNA, 1602 bp, Glycine max
  Peptide Sequence Number=SeqID_191419
atggtccactggctgcaaaagtcactctcagctaaggcagggatctctcacatgccatctccattaggaagtgattgctcatcaagatcaagtccaaaagtccaagtcacccattgcaggaaaaggttgaatcatttcacaaagtcaaaatcattgagaagtccagtgagtaagatactggaaaatagtgagatcaaatcaaatggcatagcaaacattgcaagacataggacttatcaaaaatcattgctaaatgacttatccaacaaaggaaagcattctgacattatttctgaatttatcagcagagaaatccagtattcaggtatagcttcttcaccagttcatctgcatggcaatctcaaaatggaaaataaacatggagtgctgttttttgagttcaaggtgaagtgccctgaagatgtgtttgtggccaagacatggagaacaggtaatgctttcaactgggtgtatacttttcactcaattgataatagaaagaagagcaatgccaatgggttgggatcccatgattttgacaaagattcctcaatagtagcacagatgctagtttcctgtaatttaggttctgaactagaagacaaagtatttgacaactttatggtgacagaatttgtgttgtatgattttacacactcaaggcagagtgtttcgcgtgaaaaaaagtctttctgtgaactagatggttctaaaactccaaaagcttcccatgttggattgaaggaggaaactttggggctggatgggaaccatgtggtaaaaaataaacttcaagacaagcctctatcaagcagtgttgaatttgatgatttaaattcttatccttacctgtccactgaatgctatccaaaccttgaaattgctgccattgtcttgcaaattccgttttctaagagagaaagcttgaagtacaaaagaggagaaagaaaaagtgctaaagaatgttccaacagaagtgatctctctgcagtaaaagatagaaaaagtcttcattatgaccaaatccaggaacaggtaaaggtggtaataccaactggcaatcatggtttgccaaatgctgaaagccaggctccctcgtcattacttgatcgactgaggcatggtggaggttgtgactgtggtggctgggacatggcctgtccccttattcttttaggcaatcctactattcaatttgccgaagactgctcactcatggaggaacatcaaccattggaactttttgttcagatgtatgcagccttaacccccccgggagcaaaaggaagcagtcctaccttcagcatgacaagaattgaagaggggcattatgctgttgattttcatgcacaattatccactttacaagcattctccatctgtgttgccattttgcatggaacttctgccttcagcaatgcaagtcaccagaaaaaccaacagttatctcagtgcagttcactgaaaatgctacttgaggaggatgttgatttctttttcaaatcagtcacaactgagaaggagactggttgcaagaatcagaaaggaattcctcgatcctatgtgctgaacccgcctttttctcctattgcacgcgtataa

SEQ ID NO: 74642 - DNA, 198 bp, Glycine max
  Peptide Sequence Number=SeqID_191420
atgaaggagaagcaaatgcagaaaaccgatttgagaggcaaaagagaagcagatcggcgcgaacctatctggaggaagcaatgtgggaaaaaggtgagggagaggaatctcacgcttcggaaagcagagatcaaatccaatgtcctggaagattgcaatgtggatgaaacagcaatgcgagcggatacggatcgatga

SEQ ID NO: 74643 - DNA, 1953 bp, Glycine max
  Peptide Sequence Number=SeqID_191421
atgtctggatgcaataaatcacccaaaaatggtcaacaatcattcaaatattggcggattcaacacggaggggcatcctctgaggccgttctttcttgtgtagattattcgccatctctttccaccaatgagaacaagcaatgctatggaagttctcaaccaaagtcccctcagatactgagcacatctcagctcatctcggctataggcctgatatgggattctgccagtcgcccgctttcggttttactttcgaaggaaactgtgaatcaggatgataaaggattccagaaagagaaaattctggatagcgttgatgagagaaaaaatgatttggtatatgcttcaaccgacattaagtactatcctgttactgagggaggtgcacagattgtgcagggaaaattggatttccctaaggtaatgcagaagatatcagtacttgactcttctaatgaaagtcaagattatattgattctttattcaagaggtgtttgctggctagtgataaaactacaaataaagattggaaagaaatggaacttaggagggaggaaatgtcttgtaaatcaggaaatgtatattggtgggtaggtaggaatattactaaggcgctaaattgtcaagtggatgttgcccaacctgagatcccggaatctaatgctccagttgctgggggtaacatttcagtagatacaagcacccctgcattggctattgagagtgacgtgtctagtcctaattcaatcacacatgaaactcaatcattatataatgctgcaactctgaacacaagaatagttagccctctttgttcagactattttcttcaagctgtgcctgatacttgtcagatcctttcttctagtatctgtgcggactatcatattaactctctagcttcatataatagtgcttctaatcagtgccaacatgagattgatgataacaaatctctggaaatccaaagaaggcatttcttggatatagctgatgatgaacctaaggttcagacctctgcaacccatctaaagccttgtaattaccaagccaagcaagaacatgttttttctggggcgttagctggtatatgtgtcagcctttgtctgcatcctgttgacacaattaaaacagtcattcaagcatgccgtgctgaacacaggtccatcttttacattgggaagtcaattgtttctgatagaggtttgcttggactgtatcgtggaattaccacaaacattgcatgttcagctccaatttctgcagtttatactttctcctatgaatcagttaaagcagctttgcttcctcatcttccaaaggagtattattcttttgcccattgcatgggaggtggttgtgcaagcattgccacctctttcatttttactcccagtgagcgaataaagcagcagatgcaagttggttctcattatcgcaactgctgctcttgtaaaatttctgtgtggtttggtcatgtcaaatatatatgtcctgtcaagagatgcttgttatgtctgtgttggagagctgtactatgccggaacgttccacattcaattatcaagttttacacatatgaaagcttgaagcaagtgatgccatctagtattcaacccaacacatttcagactttagtgtgtggaggattagctggatctacggctgctttattcacaaccccttttgatgtgatcaagactagattacagacacagattcctgggtctgcaaatcaatatgatagtgtgctccatgcactttacaaaattagtaagagtgaaggatttaagggcctgtacagggggttgattccgaggttgattatgtacatgtctcaaggatcactgttctttgcttcatatgaatttttcaagaggacattttctctggaagcatcacatcccactgatttatgcattcaggacaatgacgggaatgctgaagagtga

SEQ ID NO: 74644 - DNA, 555 bp, Glycine max
  Peptide Sequence Number=SeqID_191422
atgaagaaggtcgtgagcctgattcaaagtagttttgtgcctaataggcagagtagggacaacataatcataactcaggaggtaattcactctatgaagatgaaaaacggagagaaagggtggatggatatcaaagtagaccttgagaaggtgaatgatagattgagttgggatttcattattcatactctcaaagaggtaggccttccttctaattatgcagatgtttttcattgcgtttcttcttcatccattaaaatgctatggaatggggaggccttagaagaattctacccaactagaggaataaggcaaggagatccattatcttcttacctttttgtattgtgcatggagaggtggaagctattggatgcgattaaggcctccatcatagctgctatgacagttcaattttcacatgtttatagagagtgcaacaaggttgcaggcctgttagctaagaagggtctctcactagatgagggaatagtttattttttagattatctggctttgtggtatcagcttttcaagctgatgttgttagcctag

SEQ ID NO: 74645 - DNA, 1881 bp, Glycine max
  Peptide Sequence Number=SeqID_191423
atggtgccagagaacttgaagaaacaacttgctttggctgtgagaagcatccattggagctatgcaatcttctggactgattcaactacccaacccggggtgttgagctggggggaagggtattacaatggagacattaagactaggaaaacaagtcaaggagtagagctcaattctgaccaaatagggttgcagaggagtgaacagctgcgagaactattcaaatccctcaaaactgtagaagtcagccctcaaactaaaaggccttcagcagcactgtccccagaagatctcacagatgctgagtggtattacttggtttgcatgtccttcatattcaacattggccaagggttaccaggaagaactctagcgaagggtcaatccatttggctgaacaatgcccattctgctgattgtaaaatttttagccgttctcttctggcaaagacggttgtgtgctttccgtttagggaaggggttattgagctaggtactactgaacaggtctcagaagatttgagtgtcattgaacggatcaaaacttctttcttgaacagtctgcatgtcgatgttcccaataagtcagtagctacattgaaatcaaggaaacaggaagatctttcttatgtagcatttgatcataatgactataatgttgaatcgattccagaagttgggtatgaaatagccaacacaacctctcctaatggtagttcaaatgcaatccaagccaatcaaccactagatgacacacttatggttgaaagtataaccaatggcacttctcaagtccaaaactggcaagttattgatgatgaattgagtaactgtgtccataactccatgaattccagcgactgtatatcaccaacttttgccagccttgagaatattgcttctgcccccaagtgtaacaacccttctgatccttgtgcccgagattttcaaaagtgcaacaacccaaaaatgaccttagtggatcctcgaagtgatgagtggcattatcagagagttatttccacccttataaaaaacactgaccagttacttatgggaatgcatttgcaaaaatttcctcaggcatcaagctttgttagttggaggaaaggagagccaatggattcccaatggccaagagcaggaacctcacaaaagttattgaagaaagtattgtttgaagttcctcaaatgcacttggatgggcttcatgagtctcaagaagagaatgactataaagagggaatgagagtagaagctgatgaaaacggcatgaaccatgttatgtcagaaaggaggagaagagcaaaactaaatcaaaggtttttaacccttaggtcaatggtcccttcaatcagtaaggatgacaaagtttcgatactagatgatgcaattgaataccttaaaaagcttgagagaaggataaacgagttggaagctcacaggggtgtaacagatatagagactgggactagaagatcaccacaagatacggtggagaggactcctgatcattattttagcaaaaataataataataatggtaaaaaaccagggatgaaaaagaggaaggcttgtggtgtagatgagaaaggaagagagattaatttagatgctttaaaaggcagttatgctaatgatgttattgtgagtaccagtgacaatggaattgtgatcgaaatgaagtgcccctcgagagcaggaaggatgctagaaattatggaagcaattaacagtttcaatatagattttagttcagttcagtcaacagaagctgatggaaatctttatctgaccattaaatctgtgctcacaggaccaagggttgcaacagccaaaagaatcaaactagcactacaaaaagtggcttccaagtgctga

SEQ ID NO: 74646 - DNA, 126 bp, Glycine max
  Peptide Sequence Number=SeqID_191424
atgtcgatgctctggacgcagctgttaacaagcttcttcatatcccctgaaactggggggatgcagtcttgtacaaggcttcttgttgagaaacctatgaccatccatctttttgagatggattga

SEQ ID NO: 74647 - DNA, 213 bp, Glycine max
  Peptide Sequence Number=SeqID_191425
atggagaatgctagaaaggtcaaaagaaaagctgagaagggtgaggataatctaaagatggattgtgacaacgggaaagtaggagaaaaggagaatctgctagctggtgaagaggcaatccctttatcaacatttgatggaaggtgttatggcagcccagacaagcagataccaccacaatcaatatcaaaggaggaaatggagagattctaa

SEQ ID NO: 74648 - DNA, 276 bp, Glycine max
  Peptide Sequence Number=SeqID_191426
atggagattgggatccacattgggggagatgttgaagatagaccagtaacaaccatccagtctcgaggcaagtttgtaagaatttgcgtggaattggatctagataaaccgctacaaccaaaagtgattgctagaggatatttactgatcattcagtatgaagacttcactcctgaagatatctatgatagccaaagctcaaaaaacgaaggagtaacgatgaagatggattcgagtatcaacaaccttgagatgattatgcgtttggaacagaag

SEQ ID NO: 74649 - DNA, 1047 bp, Glycine max
  Peptide Sequence Number=SeqID_191427
atgtgtgtggattatcgtacgttgaattcactcactatccgcgatcgatttcctattccaacgattgatgaaatgctcgatgagcttgggaaaatagtgtttcgaacattgagaaaacaacatttcaaaacacatcagcggcactacgagtatcgcgtaatctcgtttggcttatgcaatgcgccttcgacctatcaggccgcgatgaacagtctgctggcaccattcttgcaccgctttgccatagtctttttttatgatattctagtctatagcgactctttaccatctcaccttcatcaccttgaaaccatttttcagactttgttgcagggtaagttctatttaaagcgcaccaaatgcatgtttgcgcaaactcagttggagtacttggggcatctcgttttcggcaaaggagttgaacccgaaccctccaaggttcgagccatggtacagtggcctactctggctatggcttcgcccaaggaactacatgcatttctgggccttacaagattttactgcaaatttattaagaattatgcgacaatcgtgactcctctcacttcactcatatgcaaggatgtgttcgtatggacttcggtctctcaatcttgttttgagcaactcaaactggccatgactcaagccttgttttggctctcccagattttaatgcaccattcatcattagaacttcacgctattgttacgaccgttcgcaaatggcgacaatatttgttcgggcattcattcacaatcttgactggccataagagcctccgggaactcatgtcccaggtaattaagactccagaacaatattactatctgtccaagcttttggggtatgattattcaatccaatataagtcaagtgcctccaatgttgtcacatatgctctttctcgatctgcccctgctactcctggccagctcctcttactttatgttcccaattttgactttatcgacgaccttcgtcgtaccttgcatgcaagccccgcctttcaggctcagctatctaaggtccgggacactccttaa

SEQ ID NO: 74650 - DNA, 1009 bp, Glycine max
  Peptide Sequence Number=SeqID_191428
atggtgccagcagactgttcatcgcggcctgataggtcgaaggcgcattgcataagccaaacgagattacgcgatactcgtagtgccgctgatggggaggaaggtgagttggtgtttggaagatggtctagaactttgatagcaaagcttcaatggcgggaatgggatgtgggagatgaggaggcgcttcacctagggagcaaaaataggttcgggcccaataactacatccgcgcgaagctcgattgggcggcccaaggggcgccacttatagggaggatatggaaggtgactgtgaatggatggccttggagggtgaaaggagtgtttgatggtaaggcgggcgtggtggataacgtcgaagaggcgaaaagtcttgggagagggaaggccggaaagggcgtggaggctgatatggggaatggaaggggaggtggtgtggtccgcaatgaagaggagaacatgacctttgcaatgatgagtggaactccacttttcatcgtaattgtagtaaaggcccttctcgtggcggagggccatttcgtttggggtgtgttgtacgaaaggggttttaggtttaggggtagtggcttgcgacaaggaaattggttgaagggccaacacctcgcgacaaaattccaacgacaagccggagatgaagcaactcagcaggaaagggggtggaaggccgatgacgtggttggccaagcgcttgaacttgagagcgtccttgggatcatcgtaaaagaaaggtgcaaagcgagactccaacgcttgcaagaagctagaccaggaggtgatgaatccattacggaacatgcactgaaatatacgaccgaagggatcgcgagcatcaaaatgggaaatatcgagtttcacaggattgcgatgaagatggagtctgtcaaggatcgaatcaaccttgctaaagagatcattgtacttatctgcgagcctatcagtggtggtcttgcgggtggcatggtcggaccagttgataagaggagag

SEQ ID NO: 74651 - DNA, 1404 bp, Glycine max
  Peptide Sequence Number=SeqID_191429
atgattatgttttcagggaggttcagacatttacctgtggtggagaatggagaagtagttgccatacttgacatagcaaagtgtttgtatgatgccattgcccgtatggaaagggcagctgagaaaggaaaggcaattgcggcagcagttgaaggtatcgaaaaacactggggaacatctactcctgcctccaattcgacattcatggagactcttcgcgagcagatatttaagccatctttgtctacaattattcctgagaattcaaattattatatcaagttaattcagcagatagtggcactttccagggttgtaacagtttcaccaacagactcggttttgactacaacaaagaagatgcttgaacttcgtgcaagttcagctgttgtgacgattgatgacaaaccttgtggtattcttacttcaaaggatatcttgatgcgggtaatagcacagagtcttcctccatcgtcaactcttgttgagaaggtcatgactccaaatccagaatgtggaacaattgatacaccaatagtcgatgcacttcacactatgcatgacggaaaatttttgcatcttcctgtggttaatagaggtggcattgttgttgctacggttgatgtgattcatatcacgcatgcggctgtggcgacagctagtcaggtcggaaatacgcccaattttaacaacgaagctgccaactccatgatacaaaaattttgggattcggccatggccttagctccaaatgaggaggatgaggattcacaaagcgaggcttccttgaaaatgatttccgagggaggagaaacagggagatccatttcttatcttacgtcaagcatgcagaacgtattttcgttcaaattacaagacaggaagggcagattgcataggttcacatgcgttttcagtaatgttagctgcacatattgtacatcccataattcaaataggggattgtgccttattaatactgagatgaataaaagagagacagagaaggagaaatggatgggtgatgagacgagagaaagaaagcaagaagatactcggagcttggcagaggttataacttccatcgttcagagagtcggtgatgatattgaccccatgaacctgccccaaattttgtatgaagatgaagacaatgataaagttgtactggcttcggacagtgatcttgctgcagctgtggaccacgcgaagacggctggtttgaagggattgagattgcatttagactactctggaacacatggttatggaactgattcaagttcagtaagttggaaatatgctaattcagaagcatgggcatcggcatacagtgccattgctgctggaactgcagttgttgctgccttaggtctattggcgtttgtgaggcgaagtcgatga

SEQ ID NO: 74652 - DNA, 585 bp, Glycine max
  Peptide Sequence Number=SeqID_191430
atgaagcacttcactgacaccctcatcagtgccaacataaaagtagtcaaggagaaaaatgctcttgctgaaagattgaagaatgctgaagctgcacgcaagagatttgacgaagaactgaaaagatttgcaacagagaatgtgacccgggaagaaatccggcaatcactcgaagatgaagttcgtagattgactcaaacagttgggcaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 74653 - DNA, 825 bp, Glycine max
  Peptide Sequence Number=SeqID_191431
atgataaacgataaagaagtgtacaatgttatggcagctcttgtgcccctatatgtgccaatgatattggcctattactccgtgcggtggtggaagatattcactccggaacagtgctccggcataaaccgcttcgtggcaatatttgcaattcctttccttacattccatttcctatcctccaacagcccttacactatgaacattttgttcatagccgcagacactcttcaaaaagttgtgattttgggtgccctatttctatggactgccttcgcaaagcgtggtggcggtctcgactggaccatcacactcttctctctttccaccctaccaaacacactcatcgtcggtgtcccgcttctgacagctatgtatggagactcatcagccagtctcatgagccaacttgtgttcatgcaaggtgtcttgtggtttaccctaatgttgttcttgtacgaatatcaaggcgctatgcacctctttttgaatcggatacctgatagtggagattccatcatcaccacattcaccgttgatcctgatgttaacactctcaatggcaacgagccgctactagttgacctagaaaagaaagaaaatggagaacttcatgtcatggtaagaagttcttcattaaaaatctttaaccgttcaaccgagatgtgttgtgcccatttaccaaagcgaagagcttcaagttttagtacaattcttgatctccaaagtgagggttttgaagagatgccgaagatccatgaggagaaaatgtgcaagagggacgcttttaagtatcttttgaattcaggtttgctttcttcttaa

SEQ ID NO: 74654 - DNA, 792 bp, Glycine max
  Peptide Sequence Number=SeqID_191432
atggagcctcgaaaaacacacagactttcgaagaagctcataaacaggaacaacctaagtgccaagattgaggtcgcgaaggagataaggaagatggttcaaaaattgtcattgctgttgaaaaagcatgcgaagcttgccacatcgagtgtgatcgagctgctcgttctctcttcttccaacctcgatgctcgccaatcctctctcctcaacctcgttattcacaacgaaggaagaagaagactagcggaagcttccagatttggtgacagcacatgtccaccacctactctcccaaaatctcccccaaatttccctcctctaaaccctaactctcttgaattccacaacttcctctgctacgcccttcacatcctctccaatcatctcacccccttcgttgcccccaacgccgctgccaccactgactccatcaagcgccacctcgcctccacggccattcctcccaaaccctctccttcgccaacctcttctccaaattcaagtgagaatgtcgacagggttggaaatgatgaggagaatagcgttgggggagtaacgaacgagaggcagaatggtggtgccgaagagggagaggttcctctagaggaggtcagagtcagcggtgacagaggaatcagcagaggcattgatcttggtgcaggggaggaaggtggtggtgtgttggaggtcgagcatcttgtcggggttggtattgaaagggacaagctcgtcggtgaaaagatgattaaatttgttgttgctgcaaaagtagaaaagaaaaaaagatga

SEQ ID NO: 74655 - DNA, 1419 bp, Glycine max
  Peptide Sequence Number=SeqID_191433
atgggcttaacgaagttcaatattgaaaagttctcaaggtccaatgattttggcttgtggagaatcaagatgcaagtagtcttgatacaccaaggattgggtgatgctttgaaaggctttgaggaaagtagcaagggaaccaacaactgcaacaatatggttgaagctggaatctctctacatgacaaaatccttgatgatcttaagaatcttgaagtgaagacgagggatgaagacaaagctctaatattgctcaatggacttccaaggagttatgagcattttaaggatgataagttgtttggaagggatcaaaccattacccttgaagaaggacactacaagaaggattgccctaagatgagaggaaaagatttaaagaaatctcaagaaccaagagatgtggacattgcgcaagcaagtaatgaaactattgatgttctagttgtctcaaattctgagattaagaaggattgggttatggattccggttgtaccttccatgtgtgtcaaaggtatgggttcaattcgactaaaaatgttgaatggtcaagaaacactcttgacaggtgtaagggaattaaaatgaacggtttgtatatcctagatggttctacggttatagcacaagttgttgttggtattcaaaaccaacatgataaaaccaatttatggcatatgaggtttggacatggagaagctgttacaactacttccaacctaatcaatagatgtcctttttctgcattaggttttaaagccccaatggaactttggagtggaaaaccagtagattactcaaatttgagagtgtttagggctttggcttttgcatatatcaagcaagacaagcttggggctagagctatcagatgtgcctatataggatatccacctggaatcaaggggtacaagctctggagaatggaaccgggtgaaccaaagtgtatcatcaacataagtgtaatctttgatgaaaccaaaatggctatgcaggttaaggatcaacaacaggctatcaatcaaggcaaaaacttagacattattgaagttgaagtggagctaccaacacaaagtgttcaagtcaagggcactgataatgatcaaaaacctgaacctgtagctaatgattacaacttagctagagacagagttagaagaaacattgtgccccttaggagagaagtcttgaacaacaaggaaagtgaagaatggatcacagacatggaagaagaaattctttctcttgagaaaaaaaacctagattctactccattggagcttgtaggcctaggatcttcttcatcaatggattcttttgcttcttggaagatgaatgacaatagaatggagaaggaagagagagaggagacgccacttcaaggagaagatgagtctagaagaagctcaccaccatag

SEQ ID NO: 74656 - DNA, 690 bp, Glycine max
  Peptide Sequence Number=SeqID_191434
atgggatcctcaccatcgccaccagccttcgatgacaatgaggaattgcaagaccattttgggaaccctggagggggagtcaaagatatgagagtaagagtaactctttcacagggggttcacaaggataaagggatggagaaggatgtaaatgtgggtgacatggcagaagatgttggtgttgagaggggaagagttgttgatgatttaaaggaattgattggtactacctataccgataagatgtatatactttttggtagctcatcacttaagaactctatagtcaaagtgcaagccattgagaagttgacactcaggggcattacaaatggtatcaaagcatacctcactttcattatggtgtggttcgaggatgaaccagaactccacagtgaagcgtgtttgacttggagcaattatggaatagtaaagtgttaccctgtgaagtgccatagagtgcaagccatcgagaagttgacaatgaggagggttacaggtggttttgaattggtggtgtttagtgagggtgtgggaaaaaacatggttgctttggaagacgaggaagaggtgtttatgtcgtggcggacagtgataaagatcttctacatgctgcaaaagtcaaggtactatgtaagtgatgctggaaatgtcaattggagagaagagatagaagaggggagatggtga

SEQ ID NO: 74657 - DNA, 444 bp, Glycine max
  Peptide Sequence Number=SeqID_191435
atgccacgtgctagtgtcatggtaaggctcactctctccatggtttggcggaatctcgtgagaaaccctaatacatacgcgagtttttttggattagtatggtctctcatatcatttaggtggaacatcaaaatgccatccattataaatggttccattttaatactatcacaaactgcaacgggaatagccatgtttagtatgggtctattcatggcattacaacccaagatcatagcttgtggaaaaacttcggcagcaatgtctatcgtagctcgatgtttggttggtcctgcagtaattggtgtaacctctatagtcatcggtattcgaggagttcttctacgtgttgcaattgttcaggctgctatacctcaatctattgttgcctttgtatttgccaaagaatacaatatccacgcagatatacttagcaccgcgtaa

SEQ ID NO: 74658 - DNA, 240 bp, Glycine max
  Peptide Sequence Number=SeqID_191436
atggttggtggtggtgctactgcagaaagaagcttaaaggaaacacccatatgggcagtagttgctgtttgctcagtgttcgtcatcatctctgtattaattgaacacggaatccattcacttggaaagatatgcatccctgtgtcaactggtgacataatgcttccatgcaagaaggtggaagtttcaaattcagatgatgactcaaatgacagaaggaagctacttttttttttttga

SEQ ID NO: 74659 - DNA, 2208 bp, Glycine max
  Peptide Sequence Number=SeqID_191437
atggcgagaagatctcctcctcgggttagccaaacgtacgagacaggctgtacgtggcgaatgttaagaatcttcaattttcgtgaaggtaattctgacagaagattggtttccaataggaggctgaatgctcatgctaatggaaatggaaattctagaagtagatcagatgtgcttagcacatttgatgagaagtaccttcaaattggtgtaagttccagaagaagaagagattatagttgtaaaagtatcagcggcatagagaatgaacaggtagcagattggagagaagaagtaacaaagatgattgttgacccgagatttgtgaataaaaattatcagggaaaagatggggcagactgtgagcctaatcagttcttggatgctttacagattttattttcaaacaaggagcttttcataaaacttttgcaagatcccaactctttgttagtaaaacagattcatgacttacaaagtactcaagtgaaagaaccatatcagcaggcaaggcaaaaaatgatgactaaattaaaaaagcctcaagatggtaatgctacacaatgtgtaaaaccttttaagccctttgatagatctgatttgaggttaagtgttaagcctcagtcctccaacagaatagtagttttgaagcctggcactgttaatgtggaaacaagctttgctagtcctccccattcgcctgatagcttcagatctcatgcacaaaatattatgccttcatattttccctttagttgcataaagagaaaattgaagcatgtcatgagagtaaggagacaagaacagcagtggaggacagatgatgaaatgtcaagtaaattttcctgcagttcccagggcttggaagatggtcaaaaagtaaaacaattggaaattgctgagagaaattcaccaattaatgcccatcctaatgctggaaaaaggttgaattcatatcttgatctgaagaagagggacaatattatcaagttggaggattctgagttatgtatggggctggaaactgcttcatttggtgaaagtcgtagtaagaactcataccatacttcagttggccattctgaggaaaatatacatgttgaaggtaggaaaggcccatctcagatgttaaactgtggaagtgaggaatgtgaacagtgcacaaactctctagggagatcaattcctcgtcctgactctttgtacttgccaagcatgcataggtactgcaagcacagttccattactgaaaggatgagacattacagcaactatcaaatggtccacagaaccaggttggggcttccaaaagaaggggaaaatggctcctataactttttggaaccgaaaatcaaggattcaccattggccattgttaacatgcatactgataagttgcaactttttggtgaagatattagaatcagaaatagcgttcctggcgacagtctatttgcacattatgatattcctagagaaccagatggcagatacagggacagccctactaggaacatagacatgaatgatataaccggaggaagtagatcgtttctggatttgcatccagagatccagacttttcctttttcacaagatgttatttcatcccgtcagagaacagatgattatgtaaacatgggaaacaaagttgaacacaccagtgctgaatctgttgttcagcaatttactaaggatgatgttaccaacccacaaatcaccacctttcaacaagatgagtcaccgatacaagtaatgcaagacaaatttgaagagagccattttgaagaccttataagactctctttggatccaatgaacaatttaaccttctccaaggacatcttacacaatgtatatcagaactgtggattcccacctcatgtttcaacaaaaaatccaaatgtccaagcatatgttgtgaagaaacttctggttaaagagattacagaactagttaagttgcactttcaccctcgtccatcacctttaacgttagaacaacttgctgaaaaggacttggcaagacgtggttcgtggctaaatatccaagttgttacagaagatattgcaatagaggtggagaaagatgttcttgaaaaaatggtattggaaattgcatctgagatggatgtcagaagtatgtctacttattactcgtgggatgataaagcactatggaaagattatcaagctaccattttctga

SEQ ID NO: 74660 - DNA, 1719 bp, Glycine max
  Peptide Sequence Number=SeqID_191438
atggatcagaggggggtttctgcttcatcccacttttttgatgacatttcctttcgctctgagaggaatgttggattgcagaaaccaaaatctattaatgaccattacccacaaggaaacaatggaatggtagcatcacctggcagcattttgaatgctacaccaccccttgatgtaaatgcaaaagttggcttactggtgccacaggctagtctacctgaggatagtatacattccacggaatcatcgaattgccgtcccaaatcattgtctgatgcatgtctgcagtcagcacctacctcttatggtttaattgggaacaagattgtgaccaatgctgccccttgtgaaagtagtttattctcaagctccatgtctgagatatttagccaaaagttaaggttattcgggaatgatgttcggtctgatcatctcattaatgctgattcccctcctgaggaagaaccatataaatctcttgaagaaatggaggctgacactatagggaatctccttcctgatgaagatgatctgttttctggtgttgttgatgagttaggatgcagttctcatgccagaacaaatgatgattttgaagattttgatctgtttagcagtgggggaggcatggagatggaaggagatgaacatttaagttcaggaaaaagaataagtgctctcgatggagattttggtttctttggaggttataaaggaaaacttccttttgttgaacagccttctagaacactttttgttagaaacattaatagcaatgtagacgactctgagctaaaggctctctttgagcaatatggagatatccgaaccatttatacagccagtaagcatcgtgggtttgtcatgatttcttatcaagatctaagggcagcacaaaatgcaatgcaagaacttcaaaataggccattgaggtctaggaaacttgatatacattattcaattccaaaggtcaatgctccagaaaaggatattggccatggtacactgatgctatctggtcttgattcacctgttttagatgacgagcttaaacaaatttttggattttatggagaaattaaagaaatctatgaatatccagaaatgaataatcacaaatttatagagttttatgatgtccgagctgcggaggctgctcttcgtgcattgaacaagattgacatttctgggaagcagatcaagcttgaacctggccatcctagtttgatgcaccagtctcggaaggggcaagaggagcgagatcttggtcaaagtattatagacaacttatcatcaagacaaaaagcaacagtgccttctggagtaattggatctggttgctttgaaaatggatataatcagagatttcaatctacagttaggcaaccgctgaatgcatttatggataatgcattcattcatgtgaattctggtattcacaacactgtgagaggggcacctgctggaaaagtgtccagtgtttgtgagtcaagtagctttattgatgcaatgaactttgcatctggttcgagatttcatcctcattccttacctgagtatcgtgatagtttagctaatggtagtccatataacttttctagctccattagcaacatggctaacaatataggtgctggagcaacagaagcctctgatggcaggcatattcagggaatgggctcaactgggaacttggcagaatttaatgcaggaggttag

SEQ ID NO: 74661 - DNA, 525 bp, Glycine max
  Peptide Sequence Number=SeqID_191439
atgaagattgggtggtttgagagttgcgttgagtggaaagtggggagtttggtgttggaagctttcttggagaagggaatggtttgtgtggagagggagttggtggataatttgatggagtctcttcatcatgtggtggttcatcgatttgagagagataggtgggcgtggttgagggagcaatcagggttgtattcggtttggaaattcttcattaacaagttggcaatgttgttgatgctacctcacatgacagaacaacacttttggcagcatgtgttggttggtgagtctggtagagtgaatgatagatggaaatatttgtggtgtgcaaatgtgggggggtttgaagctgatttcaatgtaagtttcatccaatgggaaattgattttgcagcatgcatcaggggaagtccatcgcgaagtacagggcacaggatcacaaaagcacatggatttaagagggagtgtggcctcggtattgaaaatggttcagaggcatttatggaagatgattgggaatga

SEQ ID NO: 74662 - DNA, 411 bp, Glycine max
  Peptide Sequence Number=SeqID_191440
atggcgatagttgttattgctgcgatggtggtggtgacaatgacaataatggcagtgagtggtggcgacgatggttatgattattgttatgatgacgatggtggtgatggtgacaatggtggaagtggttatgacgtagatgatgatggtagttgttatggtggtggtgattgttatgacgacaatggtggaagtggttatgacgcagatggtgttaataatagtgataatggtgaaagtggttatgacgtagatggtggtggtaattgttatggtgatgacgatagtagtagtgattgttatgatgacgatggtggtgatagtgacaatgatggaagtggttatgacataattggtgatgttgataatggtgacgactacaatgataatgatggtggaatgaggcggtga

SEQ ID NO: 74663 - DNA, 2142 bp, Glycine max
  Peptide Sequence Number=SeqID_191441
attgtggagcaaagttcgtgtggtttcgttgctgctgatgccactgcagaagatgtgaagagttcgtacttgaagaggcaggaaaagagcccatgtttggacaaagttgttctgctgcttcctcctgcctatgattcaatccgtgccataggggcctctgaacactttaaagttggtcgatttcatgaaattgatcactccacgctctcacccatttccccggtacaactaaaatctgttcgcattgtaatggtcagtgacataggggagcacctggtgtcgctaaggtacccgagcctccaatcacttcgcacgcacttcagcgaccaaagcttcgggaaaccagacgggaagaagatcccagcactggacgagaagtacgtgatggggatggacatggccatcaaagcccttgttaggagcatcccaactgaggaatttgcacaaaggagaaactcttggagcttctgggtctcctctccctctaacgaaaaccctcaagagtattatgagaatccacctcgcattgatgctgcaaggagcctcatttgtaagcagggttcttgttggtctcagcttaagttcacagggatggtgcagtggggcacacgccgacaagttcggttcttgggccgtcacgaggagcaaaaggttgaatctttaccaaaaatgtgtgagggaaaaagggtcagagttgaagtcagagaagaagggggcagtgagaagaagaggaagaaaggtgaagaagaggaaatggagggtacaaaggcagggtctttaggggttatgatgagggtgactcgtcaatgtaagaaaactcatattcaaaatgtgagtagtagcagcagcggggttaaaaaatttaagaaagcaaagaatgacgattccaagaataagaaggaactcgtggtttataaggacaacaagcgaaaaatcacgattaacaggtggtctgctgagaggtttaatttggcagaggagaacatattgaaggtaatgaaagagaaagaagctgtatatgggaacccgatattgaggccagacttgagaacagaagcaagaaagtatattggtgatacgggtcttctggatcatttgctgaagcacatggctggaaaattggcaccaggaggtgctgagagattcagaaggcgacacaatgctgagggtgcaatggagtactggttagaaagtgctgatcttgttgatatcagaaagaaagcaggggttcaagacccttattggactcctccccctgggtggaagcttggggacagcatttcacaggattatgtcacgcagagagaactcagagaggtcaaggatgaaatcctcaagctgaaacaagagatgaggtatttggcatcaaagaagggagaggaggaggcactagccattgtgactactcctagcttctggttgtctagtttgaattcggaggactatggctccttggctccaaagcaggaaatttatgcggagttggtgagtaagaaggctaaactagaggaacaattaaaggaaatttcactgactttgagtggcatggaggggcaactgaaaatgctgaaaccaacaacagtagaagaacaaacagtgtcagaatgggaaactccaccagcacttttgcctgggccaataacatcagaggcagaaaacattgggggagagacaaggaaggaaaagaaaatcaacaacaacaaagaaacaaaatcagcggaggaaacacaaatgcaagaggacaaggaggcaaagataaaaaggctgaaaagtggtttccaaatttgcaagtcacagggtacctttgtgtggccaaacataggcctgtctccgcaagttgtgaccacccatgatgatgatgatcacactgtggtcccaaccccaccatcagcttcctcttctacaacttcagctcgaaaactcaccatctccacaccccaaactcaacccttgcctctacaaagtttgacccatccttcttcccctgtgaagccacttgctgagaggcgccctgtgagcacagctactttgacccatgttactggccaattctcaccatcagggtcgaccccaagatccaaaatcaccacccccaccatcactattaatctcaatgagacaccccttacactcacaccctag

SEQ ID NO: 74664 - DNA, 216 bp, Glycine max
  Peptide Sequence Number=SeqID_191442
atgaacactattgtgtggagcccaatctttgaaggtgtgatgtccctcctcaacacagaccaaatttctgaattgaacatggagaaaatttctgggatttatcacatcgatgtgaagctaatttaccttgtgtttggacgatatatggagaatgaggtgattttgaaagatgcacaaccagacatggggagggtcatggctgggactgagagctaa

SEQ ID NO: 74665 - DNA, 225 bp, Glycine max
  Peptide Sequence Number=SeqID_191443
atggaaagagaccacttcctttggaagaagaagagaaagcgtttccgatttattcttctcggtcccagcaagacatatcggctgtggtatcggctcttgttcaagtcattggtggcaatccagaacacaaagatccaacaacagcgtctcagtcaagtgttgttggaaatgattcaaatgaacaatcacaaccaccacaacatcaagatagggctgaagacttga

SEQ ID NO: 74666 - DNA, 452 bp, Glycine max
  Peptide Sequence Number=SeqID_191444
gaaacgtaagaaggcactatagaggagtgagacaacgaccgtgggggaagtgggcatcggagattcgagacccaaagaaagcagcgagagtttggctgggaacctttgaaactgctgaggcagctgcactcgcttacgatgaagcagctctcagattcaaaggaaccaaagctaagcttaattttccagaaagggttcatttctctaaggaatttggttacctcactaatcgtccatcattgttccacgcctcggcgacgccactcagtgatcaacattctcaagtgtttggtggcactgcaactaataatgatgccatgcctcgtttatatgggactgacgtcgtgtttctttctgctgaacaagaccttctaccgttttccatgcagtcttctacttctgagcctcctaggaaaccaacatgtgatttggatggcaaagacaaactatga

SEQ ID NO: 74667 - DNA, 267 bp, Glycine max
  Peptide Sequence Number=SeqID_191445
atgagattgttgaggctgggcgtgggacttcatgttgagcatgggcttcctcttcctgggcgtgaagaagcttcaagattctcggaattggaattgatgcttggagaaaggtggccttgtaatacagtgtccttagcatctgatcgcgaaatctgtggatcacagcacaagtttgggattttgagtttgtgggatacgagattgaaaaataaaaaaaaagtggagattttatctaaaaataacattgatatattgatcaaaatttga

SEQ ID NO: 74668 - DNA, 535 bp, Glycine max
  Peptide Sequence Number=SeqID_191446
atgtggtttcttggttggaaaggggcatcagggttctcagcctcttccacagccgaacaagtcactcaagggattgatggaaccgccctcaccgccatcgtcacaggagcaacaagtggccttggtctggagaccacccgggttcttgcattgcgcggtgtccatgttgttatggcagtaaggagtctggacagtggtaagaatgtcaaagaaacaatacttaaggaaatcccctcggctaaaattgatgtcatggagttagatctaagctctatggcatcggaaggaagaatagttattctatcatcagaggcacacagatttgcttatcgtgaagggattcaatttgataagatcaatgatgaatcagggtatagcagttattttgcttatggacaatcaaagcttgctaatatcttacatgcaaatgagcttgcaaggcgcttgaaggaagaaggagtggaaatcactgtcaactcccttcatcctggatcaattattacaaatattctgcgataccatgattatattaatg

SEQ ID NO: 74669 - DNA, 222 bp, Glycine max
  Peptide Sequence Number=SeqID_191447
atggctgggactgaatgttgcgtctccaaagaaaacgcagacttcagaacagcttctgaaactccaaacaaaaatgacattatggatttggggcatggagcttattatccaggcatgcatttaggcgtacatgatccctcaacagctgtcgtgatacacaatcagccaaatatgacttctcatcacgaaattctatcgggtctccctggacagccctcctag

SEQ ID NO: 74670 - DNA, 423 bp, Glycine max
  Peptide Sequence Number=SeqID_191448
atggatgggatcaccctcactcacgacaaaaactcaactaatgctgggcttgtaccttgttcccaaaatcaatcattactctgtctatgcaaactgcaatcaattcccacgtactcggtggcactacagatctattgtagccaggaagaggatgattttatgattagaagattcctgcgtgctcgtgatttagatgtagagaaggcttcggcaatgctcctcaagtacttgaaatggagaaattcatttgttccaaatggctctgtatctgtgtcagatgttcctaacgaacttgcacaagataaggtgttcatgcaaggacacgacaagataggtcgacctatacttatggtcttcggtggaagacattttcagaacaaggatggtcttgatgaattcaagcgtatgtttaatttcaaataa

SEQ ID NO: 74671 - DNA, 498 bp, Glycine max
  Peptide Sequence Number=SeqID_191449
atgcatggcatgctttcctcggttgttcaaatattactgacgtctggaattgttcaggttgctagaaccatgtcaaaccaatcgttgatgatgcaaataaacataaaccacaccataaggataaactacataagctctaggtcaatcaacaatatagataactttaaagaggaaacaattatggataatgcgtcttcatgtccaaatacgcatatccatgaagtctacaacgacacaagagcacttcctatccatgtgctatccatgtacgtcaaatacaagatcatcataggcacgaaccacaaatgcaataatgcaaggtcacaccttgaccattcgaggagactcgaattaatcctatggaggaagtgtggttttataaaaaatggattagtgtcggtagttgcttaccttggtaagacttgcaaagaccttaacctatctaggaattcgcccaccagtccattctataggcctattcccattagtcaccactaa

SEQ ID NO: 74672 - DNA, 227 bp, Glycine max
  Peptide Sequence Number=SeqID_191450
atggcgacaacaaaacctccttggagccaatatcaagggcatccatttgttaaaaatgctatgctggaaagatccattttagctgccgttccttcagaagatccaactgccataataaatgcagtgagatctctggctattggacctgcaaaacataatttatgcttagactcagaagtggctgggatctatccacacagaagcttgagaactggttctggatcaag

SEQ ID NO: 74673 - DNA, 603 bp, Glycine max
  Peptide Sequence Number=SeqID_191451
atgaatccctatggacggaccaagcttttcctggaagaaattgcccgagatattcagaaagctgaaccagaatggaagatcatattactgagatacttcaatccagttggggctcatgaaagtggcaaactcggtgaagatcccaagggcatcccaaataacctcatgccttacattcagcaagtagctgttggaagattgactgaactcaatgtatacggtcatgattatccaacgagggatggctctgcggcgacaggacaggacattaggggaaaatgtgacactggacaaaatggccatattgctgccctgcgaaagctcttcacaacggagaacataggttgtactgcttacaacctgggaactggtcgtggaacatctgtgcttgaaatggttgcagcatttgaaaaggcttctggcaagaaaattccagtaaaattatgtccaagaagaccgggagatgcgactgaggtttatgcatctacagagagagctgagaaagaacttggttggaaggcaaactatggtgtggaggagatgtgcagggaccaatggaattgggcaaagaacaatccctggggttacgcggggaagccttga

SEQ ID NO: 74674 - DNA, 342 bp, Glycine max
  Peptide Sequence Number=SeqID_191452
atggacgaagatcagtggatgtataaaggtataatacctgaagaagttgatatggatgaaaatgaagaagaatgtggtgtgaatgaaccacatgttgattgttcggatgcgttcaatacttctcaggtgtttcatagccaagaggatgttttgcgatgggctcgatccattgcttatgaaaatggatttgtgacggtgattgtaaggtctgacacaaacacaagagtgatgagtataggtataggaagaaacaatgcgtttgaagagacactaggaccagaaaatgtaggtgtcccttcaaacttcgtggcaagccagtggttggaggacaaggttggatga

SEQ ID NO: 74675 - DNA, 273 bp, Glycine max
  Peptide Sequence Number=SeqID_191453
atgggtgaagtagaggaggtacaagagaagatgaaggccgacatggaggccatgaaagagcaaatggccacgatgatgaccatgatgagcatgaggaagataatggaagccaatgcagttgcagttgctgctagcagcactgttgctaaggtgaacccaatgcccccatcaggcctcaaccaaatgaatcatcgaacctcaactatgatttgggaagtagggacggcccccatgatgtgcaaaatcaaaacaagcacgccttcccgccatatg

SEQ ID NO: 74676 - DNA, 291 bp, Glycine max
  Peptide Sequence Number=SeqID_191454
atgaaagaacaaatcaacctattgaagaagcaacaagcttgttgcttcaaacctgaagagtctagtccctctagattgaaggagtcctccacaatgaaggataatgagattaaggattgcatgcatcttgggcaacatcttaacataacattcaagcaaagtctcgatttacaggttgtgcctcactcacagttgttgtcggttgtgctcttgctctcgatgaccactctccatggcggcgaggagtttatgaaagctatcggtattggcgatgaggatttacccatctga

SEQ ID NO: 74677 - DNA, 912 bp, Glycine max
  Peptide Sequence Number=SeqID_191455
cttcaagtgggattgcctcgatactattgcctggtggtagaacaacacattctaagtttgctattcctgtccctgcaacaaaaaattcgacatgcaatatccatcaagggagtgatttggctgaattgttgcatatcacaaaactcatcatatgggatgaagctccaatgtgtcacagatatagtattgaggcccttgacaaaagtttacaggacatcatgcacaacagcaatccttttggaggaaaggtcattgtttttggtggtgatttccatcaaattctacctgttgtgccaagaggtaatcgttctgacattgtctatgcaactttaaattcatcttacatttggaaccattgtcaaattctaaaactgactaaaaatatgcggttgcaatcaaatcctactgaccattccaacttggatgaactaaaacaattttctgagtggttgctagacataggtgatggtaaacttgcagaacctaatgatggttatggtgaaatcaccatcccagatgagtttcttatcaaggactttcaagatcctatccaggaaattgttgaagcaacatatccagacttattacacaactacaacaatggcgatttcttgcaaaaaagagttgaccttgcctctacaaaagatgagaaagagcattgtagtgctgattctgttgacaaatcagatgaactactcaatcctgcatttggagtactaacagttgaatttctaaactcattgaagacatcaggcataccaaatcacaagctcataatcaaggttggtacacctatcatcctactacgaaatctggaccaagctgatgggttatgcaacgaaactaggcttattgttacaagacttggttcaagtgttgttgaagcgaagattattactgggtccaacatag

SEQ ID NO: 74678 - DNA, 579 bp, Glycine max
  Peptide Sequence Number=SeqID_191456
atggtcattcccaagttcaaggtgctagaatttgacaagtacaaggggactacttgccccaagaaccatctaaagatgtattatcggaagatgggggcatgcgcaaaagatgaggaactgctaatacattccttccaagaaaatcttactggggtagctgttacctggtacactaacctgaaaccttctcgagtctactcttggaaggacctaatggttgccttcattaggcagtatcagtacaattctgatgtggctccgaataggatgcaactacagaacatgtgcaaaaagggggcacgaatctttcaaagaattcgcccaaagatggagagacttggcaactcaaatttggtcttcgccagcaaaaagatcgaagtgggtctgaaaagaggcaaatttaatcatcctgcttggacgaatgagaaaactggggcaaatgaagagggtaaggatgagggagaaacccatgttgtgactaccattcctgtacggccaagtttcccaccaacccaacaatgtcattactcaacccttctcctaacctactgcccatttatccacaaaggccattcctaa

SEQ ID NO: 74679 - DNA, 441 bp, Glycine max
  Peptide Sequence Number=SeqID_191457
atgcctcagggaagccttgaagtttttcttgttaatgccaaaggcctcgacaacactgattatctttgtaacatggacccttatgtgatcctcatatgtcgcactcaggagcaaaagagcagtgttgcaacaggtcacggaagtgagccagaatggaacgagaattttgtattcaacgtgtctgaaggcgtttccgatctgagattgaagatcatggacagtgattccacgacggctcatgatctcgtcggagaagctaccattccactggatgcattgtatattgaaggaagtatccctccaacttcatacaatgttgtcaaggatggccactattgtggagagattaaaattggcctaacttttacgcctcaggatcgcagcgaacgctgcctagaggaaaattttggaggatggaaggagtcaggctacagagactga

SEQ ID NO: 74680 - DNA, 372 bp, Glycine max
  Peptide Sequence Number=SeqID_191458
atgattatgaggggccaagacatttatagtagccaagatgaggctactacttcaccttcctctagtgaaagtgaagaagcaaaagaggaagaatctagtaaagaaatctacccccaagaagaaggacaacctttaacggttaaggagaagtgtaaagagggggttcccacgaaccctaagagaataaaggtcattcctgagtggcccactccaccaagtataaggaaaattcagggcttccatgacttaacaaacttttacaaaagtgtggagggaagaagcccagagtttcatgaacctcaggatttgaggtcaaatccttttcaagtgggagggaatgatgcaattctatcccctaagggcattggatag

SEQ ID NO: 74681 - DNA, 300 bp, Glycine max
  Peptide Sequence Number=SeqID_191459
atggcgttgcaggagaagctagacaagttcaagaagcagcaagagaagtgccaaacgacactttcgagcattgcagctagtaaggccgcggcaacccaaaaatccgccgctcatggctcggccaatggaagaaacgcggcccctgcggttaagttttcgaacgacacagagaggcttcagcatattaatagcattcgcaaggcccctgtgggtgctcagatgaagcgtgttattgatctccttctagaggttgtacctattcctttttcactaataatatattcccaccgatttggataa

SEQ ID NO: 74682 - DNA, 3048 bp, Glycine max
  Peptide Sequence Number=SeqID_191460
atggttgtggttgagaagtctactgtggaggatttaccacctggatgggtaaaagaattaaagattaggaagaacagcaagggcattcgaaaagatccgttttatatagatccagcgagtggatatgtattccgttctaagaaggatgtactgcggtatcttgaatctggtgatatacgttcatgtgcatttaggccaagtagaagacaaattcaagatgaagacaatttaactccaccacctgttgccaagagacagaaactgaagcagtctgcatctgaacaacagctttcttcagccacagaaatacttgataaaagcagcttagaattgctagatgctaacagctcaaggaaatggaaaaatgcaaatgtgtcatctggaacgatggttgcttctgttcccatgggtgaatctgttgtaaagatgcattcactagaggatggagctgcaaactcttctgaagtgaagaaaacatctgacccaggtagctcagcacttttgaatgaatccttgaaagaatcagaagaagtactttctgcagatgatgtgcaagaaaaggagcatgttttgaatgtgatggagaatgctaatgaaaagaatcacggtaaccatagcatatccaaaaacaggaaggagttcaatgtacctcaccggtcatcaccaagacttgctggaagtaaacctgtccagttggccaacaatctgatcaatgaacggactcttcaggttcctaaaagaaacttgaggaaaagtagaaacactctagatgttgatatttctgaagaccaaacagtttctaaagatcaaccacatcagcaagaagcagataaaatagaagacaataataagccagaaattcaaattagcccaaacaaatcaagtaaaaagaaagagtaccaccttcctcgtcgggcttcaaaacgattagctgcaattgaacatgagacaatgaactccaaagcaaaattgcagcaaagtgagtgtgggccagttacagtgcttgcagatcaagcgccaataaatggaaagtcagcaaataaaaggaaaaaatcagcacctcagctggagaaacgcgaaaatgaagaaatggatgatgagaaatcagaatctcagctgtcctttgcatttcactactcttggtctgacccaagcttggaatatgcaatcaataccctcactggtgtgttaccaccagctgaaactgatattccaaaaactttggttgacaatgttacgggaaaaggcgccactacagtccctgaaatcgatattccaaaaactgtggttgacaatgttacgggaaaaggtgccactacagtccctgaaatcgatattccaaaaactgtggttgacaatgttatgggaaaaggcgccacttcagtccctgaaactgatattcagaaaactttggttgacaatgttacagtaagaaacactgctacagtccctgaaactgatattcaaaaaactttggttgacaatgttacaggaagaaatgccactacattccctgaaactgatactcaaaaaactttggtcgacaattttgtgggaagaagtgcctctacaatccccgaaactgatgataaaaaaactctggctgacaatgatatgggaagaagtgccactacagttcctgaaactgatatccaaaaaactttgcttgataatgttacaggaagcagagacagtgaaaacaatttgcttgacactgttacaggaggcagcgacagaaaatctcaagtacgatcaaataaaccccagagaaagaaagaggtcaaagtacctatgcggttatcaaagcgacttgctggccttgaacctgaggtagcgcctgctgaaagagctattgaatattcgactagaaaatcatgcaaagaagaaccaactgcgactgctactttaactaatggagtgtctgaccatcatgatgctggggaagaaactaagcttactccgcaagcttctgacagtttgaaaacagaagtactaggagaatcattaaaccagagtgggaagtcatgtgatgcccaaactggtgacaaggaacaattgcagaaagttgaagctgaaaatattggtgatgcaagatcagagccacagctccccttactgtttggggactcttggtcagatccatgcctagaatttgcgatcaagactctcactggtgctttgcctgttgatgcgggtgacattatgcccgctttgcctcctggctttgataatccaccatataagcaattgcatgggagtctggcgacaagcattaatcaagaagctcacgataactcaaaccaatcccagaacaagaaagagcttaatatggttagccaacctgtgttgaggaccagctccacctcttatgagaatgctcccaaatttacaactagagtctcttatcttgatcaaggcaacataataaggaatttgaatgaagaacctcgtcacactggaaacacaacaccacctgtgcatcattctaggaatataaactcactaacacatgaagagccattaaagcaaaatggacagtttgtcgagggtggatttgttacaatggggcaacaactatttgaaactggaactgtaaaccatgataattctgaatcacagtatagtgctccgtttatgaattcttggtcagacccatgcctagaatttgcatttaagactcttacaggcgtgataccagtagaggaaaatttaacacttcaaggatgtttccaggaacctgttaactatcatgaacgaagggatggtggctcaatgttgccagatttaggatcttccagcttttctcaaagtgatttctcatttctccatgatacaggggttaagtccatgccggggaagcagtcatcaatgagctcttcattcctaccgttggaaaaaacaagcctgcagggtttcactggagttgatcctcaaacacacttttctcagtgcaacaataactttcaaagaagaaaatgctgtaagaggcttaagctcacaattgcgtttgaagtagcttactctgagaaaataatttttttttgttaa

SEQ ID NO: 74683 - DNA, 605 bp, Glycine max
  Peptide Sequence Number=SeqID_191461
atggaaggaaactatctgaacagaaacagtactactccacagagagaggatagctttggttttgaggagcattcatggggaactccatggcctgctagaaactatgcttgtagcttttgcaagagagagtttaggtctgctcaagcattgggtggacacatgaatgttcacagaagggatagggcaagattgagatcatccttatcttcgtgggtttccgaatgccctaaacctaaccctaataataacccaactcttcttccaccaccctcttcttcttcaccatctcctttgcctgatgagcctttgaactatgcacatccttctccactttgtagcccttgtctcactttgtcttcttcaccctccccagcttctaccagtggagacaagaaaccaagactcaccccttctcatcaatttcctcttttgattcctcaaagcgaaattaagatgatgagtatgaatacaaggagtgatttcattgctgatgaggaaatgaagggctgtgtggtggaggaggaggagcacaagggttttaagaataatgagcaaaacattacgttggagttaggaataggagtgcttaaacaccaagaggagaa

SEQ ID NO: 74684 - DNA, 1371 bp, Glycine max
  Peptide Sequence Number=SeqID_191462
atgcagtcaaatccagttcttgaagcatttggtaatgcaaaaactgttagaaatgacaattcaagccgttttggaaaatttgttgagattcaatttaataagtacggacgaatatctggtgcagccattagaacttatctgcttgagaaatctcgtgtttgccaaatctcagatcctgagcgtaactatcattgtttctaccttctttgtgcttctcctcctgaggaaaaggagaaatataagttgggagatcctagatcatttcactaccttaatcaatccaattgctatgaattaattggtgtaaattctgctcaagagtatctgagcaccaagagagccatggatattgtgggaatcagtcaggaggagcaggatgctattttcagagttgtagctgctattcttcatcttggaaacattaagtttgcaaaatcagaagaaactgattcatcagttctagaagatgaagaatccaagtttcatctccaaacaacagcagaacttctcatgtgtgatcctaattctttggaaggtgcactccgtgagcgtgtgatgattactccagaagagatcatcaaaagaagtcttgatcctcttggtgctacagttagcagggatggtttagccaaaacactatattctcgattatttgactggttagtccaaaaaattaatatctccattgggcaggatcctagctcaaaatgtctcattggtgttcttgacatatatggctttgaaagctttcaaatgaatagttttgagcagttttgtataaatttcacaaatgaaaagctgcaacaacacttcaaccagcatgtgtttaagatggagcaagaggaatacacgaaagaagggattgactggagctacttagaatttgtagataatcaggatgtactggatctcattgaaaagaaaccaggtggaatcattgctctgcttgatgaagcttgtatgtttcctaagtcaactcacgaaacattttcccagaagctttatcagacattcaaagatcacaaacgcttcatcaagccaaaattgacacgctcagatttcactgttgttcattatgcaggggaggttcagtatcaatctgagcagtttttagacaagaacaaagactatgttgttcctgaacatcaagacatgctaagtgcttccaaatgttcatttgtatctggccttttccctccaatttctgaggagacagccaaatctgctaagttttcttctattggttctcgtttcaagggtgttcttgaagcagtaagaattaaatgtgctggattccccactcactggacctttcatgatttcttaactcgattaggcattcttgctccggaggttcttcgggggaagtaa

SEQ ID NO: 74685 - DNA, 228 bp, Glycine max
  Peptide Sequence Number=SeqID_191463
atggaccacttacctcgaagaagattatccaaccaaggagaagaagaactgctacgaagaccaacacgaaccatagaggaagacgaaggatacgtggcagaggaagaaccacaaacaccaaccgcgaataggaacggtgacaggaagaaacaacaccgtaggaagaggaagaggaagaagaagcgtcataggaagagaaagaagaatgaagaagcgttgtacggatga

SEQ ID NO: 74686 - DNA, 738 bp, Glycine max
  Peptide Sequence Number=SeqID_191464
atgatacaggggattccagaaaatattgttgttggttctcatgtttgggttggagatccagaactagtttggattgatggacaggtactgaatattaatggtgaagaagcagaaattcaaactagtaatgagaagaaggttgtttcccgtttgtcaaaattatatcccaaggatatggatgcgcctaccgatggggttgatgacatgaccaagcttgcttatttgcatgagccaggagtgctgcataatttggaaaccagatacatgatgaatgaaatatatacttatactgggaatattctcattgcaatcaatcccttccaaagtctttcacacctgtatgatactaatgtgatgcaaagatacaagggagcaacgattggagacttggacccacatgtttttgctattgctgaatcagcatatagggcaatgattaatgaggaaaaaagcaactcaattctggttagtggtgagagtggtgctggtaagacagaaaccaccaaaatgcttatgcagtacctggcatatttgggtggtaacactgcatctgaaggaagaactgttgaaaaacaagttctagaagtaagaaggttatctaactctgattatggttgctattgtttctacatgttttgttgtgagttgtaccaaggcatattgtttaaagctatttgcatgctcttcctcttggccaaatttatggctaatatatacctcaccctgctgtatcattag

SEQ ID NO: 74687 - DNA, 213 bp, Glycine max
  Peptide Sequence Number=SeqID_191465
atgaagggaacgaaagagttttgttcgtctttgagttgcgcgaatggaggaggttgtgagagaggaaatgtccgaagcaaggccctgcaaaatcgccatgcttgtggactcgcactcttccctctcctctccgagccgcatggacttcgcgggtaccaacgataccgtttgaatacacacatgttgtggaagtatgtgaaatgggttaaataa

SEQ ID NO: 74688 - DNA, 711 bp, Glycine max
  Peptide Sequence Number=SeqID_191466
atgaaatgccaggttttggggacacctgtgctaaatgaaagtccttctatggaagaatcttcaaatcctgtccaagaagaatcatcaagtcctttccaagatgatgaaaacattgaagctatcagggattcctctagtcctctcaaagacactgaaaagattgaggttcttactgtagaaataaaaaacttgaaggaagaaaaacaaagaggtgatgaatatgaaaggaaatatgtagaagctcaaggatccagcgaagagttacgcaaaaagttagcagaaactgaaaaaagagtatatcagcttcaggactcgttgaacagcccatggtataccaagaggaaagcagatagaataaaggaaggagtgagacagccccagaataactgtgtatgggctgctgctggagttctctataagtatggcatccacttgatgaatatttcaaaagcttcatttatgatgatatcttccatgtcaagtcaagttgccgagctgaagacgatcttgagtacttcatcaagattgagttcaacttttcgacctattgctagggttgacattgcttccagtaactctgatacttcatctacagactctgatttcacatttccagctcctgtttcgaataccgaacctttgtcttccccagagtcaaattctttccaactagtagttcaggatgtcactgcaggggatggatcgggttag

SEQ ID NO: 74689 - DNA, 165 bp, Glycine max
  Peptide Sequence Number=SeqID_191467
atgttgaaggggacatgggggaacatgcaagaggtggtacctttggaacataaggcaactttggagggtgaaagtgcactagttgatggaagaggaagtggtaatgcgattagggtggagttagaagtggatgtggtggacacaaagtcgggaataaactcatag

SEQ ID NO: 74690 - DNA, 1315 bp, Glycine max
  Peptide Sequence Number=SeqID_191468
atggctttctccgcttcaattcgccctacctcttctcactctcagttgttttgctctgttaggttcaataggaggcaccatagcagtagccgaataggtttctcgtcgaacggcggaagaagatgtcgtcgtttacggaacagtgttaggtcggtgttgaacgacaaccggcctagcgcaagcgtgaacgacgattacggagcggcggagtctgctagggttttgttcgagagactgttcacggagaaccggataaccggagatgaaccggatcttcggattcttgaatcggatctcgaggcggcgctggcggcgctgaagatgaaggaggatcacttgatggaggcggagaggacggtgttgttggagaatagtaagttgaagctcacgaaggaggagctggagcggcaagagagtgaaattgaggctgctaggattaggtatgagaagcttgaggaggagatgaaggagacaatggttaaattggtttctcaggcgggggagattgaggagctgaagcttagggttaggggtcgcgatagtgagatcgatgcggtgaagtatgcgctggggttgaaggaaggggaagtggagaaaatcagggttgaattggaggagaggagtcgcgaggctgcgaattttgattctgagcttagagagaaggggaggattctggatgaagcgaatgaggttatgaagaagcaggaggctgagcttgaggagctaaagagggtggttcgagagaaagaggaggagattgaggttttgttggttcagagggaggttgagagggagaagctgagggtggctgaggcgaatttggagaagcaggcaatggactggatgttggcgcaggaggagctgaagaggctgggtgaggatgctgcgaggcatgctgaggagagtagtgagaccttggaggatttcaggagggtgaagaagcttctcaatgatgtgaggtctgaattagtttcgtctcagcaagcgttggcatcttccagaagcaaaatggaggagcaggagcggttgttggaactgcagctgagtgagcttggggagcagagggcaagtgtgatgtcctacatggaaaatttgaaggatgcacagattgaagtggagagtgagagaacgaaactcagggttgcagagtctcggaacagagagcttgaacgggatctgaagatggaaaaggagcttattagtgagttggaggaggagctgaagaaagagagaacttctttggagcaggcagtcaaagaagtggctttgcttcaagaggaattggagaagaaaactgccgagtctagagaaacaa

SEQ ID NO: 74691 - DNA, 441 bp, Glycine max
  Peptide Sequence Number=SeqID_191469
atggaaggcgattttataaacggcatgcccctgaaaaaaaagcctgaggctcttgacggggataaaaaatatttcctggaatcagtcctgccccagtcaaaagttgggcttgatctctcctctctgagggtcgatattgccgttccacagtctttgctggaaacacgaccggatgactatattccggcgagtgagtttgaggcgggcagtagcgttttattctcaaactatacggtaaaccagtatgagtcgcacagcgcctatggaagcgtgctgagctcaacataccttggactcaacagcggctttaatgcaggcaagtggcagttccggcagcagggcaatttcagtcgtaaccgttacggttcacggtggaattcatcgcgcctgtatgtgagacgcggtttacccgcgctgagaagtgaactgtcgctcggacag

SEQ ID NO: 74692 - DNA, 157 bp, Glycine max
  Peptide Sequence Number=SeqID_191470
atggcacaacctccaccctgtgagagcactctaagggaaatggctgcacctgatttcacctacgaaagcttgtgtatccaatactctaatgaggatatcccatattttcttaaaactggactgatccatttgcttccaaagtttcatggcctagcag

SEQ ID NO: 74693 - DNA, 267 bp, Glycine max
  Peptide Sequence Number=SeqID_191471
atgtggactaacagatgtaatatcataggcataggagatttcaccttaccttctccaacatataccatttcgaatgataggggaatgattcaaggcgggccaagcagcaagagaagggctatggtactggacggattggcccacttagaatataaagaagaggaagacgccaagagacagaatagggtagagaccaaccaccgaaacaagggactaatgagctatgggtcatcccaggaactaaactcccgaagacctcatccataa

SEQ ID NO: 74694 - DNA, 393 bp, Glycine max
  Peptide Sequence Number=SeqID_191472
caaaataggggaggagcttgccacccagctcgccctggtgagcaaggttgcttcctccagaagcaacaaccttctggaggaaggatctggaaggcccaactttcgaagaagttacggaaactcacggattgcgcaaaacacctcttttcgatttctgtcacattacggaattttcacgaatcgcatagatataaagggtctcaatttcttgaggaaggtgtggaagcaataccttctaaggttattttgatgatgccaaagaatcaagagttaagcaaattccaaagattcaagaatcaagtttcaagaatcaagattcaacattcaagaataatgaagatcaagattcaagactcaagattcaagaatcaagagaagactcaatcaagataa

SEQ ID NO: 74695 - DNA, 237 bp, Glycine max
  Peptide Sequence Number=SeqID_191473
atgttgctgaagggctcgctcagcgagccagattggctaagcaaggctaatccgcttagcgaggaagccaggtcactcagcgagagaaaaacccaaaagaatgttaagttagagagcagtgcactaagcacgcagccaactcgcccagcgaagcttttgtctcttctcgcgcttagggcgtccaagcccgctaaaggcccagtcactaactctcgctcagcgagacatgctcgctga

SEQ ID NO: 74696 - DNA, 357 bp, Glycine max
  misc_feature (36)..(36): n is a, c, g, or t
  Peptide Sequence Number=SeqID_191474
gaagctaagggagcctctggtaatcgattaccagcntgtgtaatcgattacacagagggatgggtcactgttcagcctctggtaatcgattaccaggcatatgtaatcgattaccagagacgaaaagccttaagatacccttcttacttgcatgtaatgatcgtgatgacggcgcagctaatccgtgatcgagtagagatggagtgcctaaagggagcttgggagacccttgaaggcaacacgaggtgccgatttcggggcaccattcgattcccgactacttctttggtgcatccagatgaacctgcacggacgcttcagcgcacggtggagtggacaactccttggattagtttg

SEQ ID NO: 74697 - DNA, 219 bp, Glycine max
  Peptide Sequence Number=SeqID_191475
atggaagacgcacccgtgagcttcgactcgcctgcccgcaaaagggttgttgttgttgttgataatgtcattgagacgagtgcactgaccttgtcggatggcccattcatgggggacaagcatgggaactccttgtggccccaggttgatcacctagggggggagttacggtgcatgactgggtggcctcaacaaatactgcatggtttcctaagtgag

SEQ ID NO: 74698 - DNA, 259 bp, Glycine max
  Peptide Sequence Number=SeqID_191476
atgaagttcttggagctcaagcaggggaatatgactgtggctgaatatgcagccaagtttaaggagctgacaaaaggggcattgtcgcaacctaccctgttgcgggcgagcgaggcgaggctcacgggtgcatcttccgaaggaggaaaatgcgtggagtcaccaccagcgttaatttgtggaaaacgtcggaaaaaccaaaggaaaccggtcatgaagaatattctagatttgggagttgtatttacgtttgaggaag

SEQ ID NO: 74699 - DNA, 288 bp, Glycine max
  Peptide Sequence Number=SeqID_191477
atgtcatttcacgttggttctatccctattgttgaagcagaagcatcatcactccttgcagttatcaacttgatcattgacttgaggcttcacaacgtggtttttgagattgattgtaaacaagtttttgacaatcttcaaagcaacaagaccatgatatttgaactgggtttcattttgaatgcatgcccttacagcacaaaagcacgtaaaaataaatttatagctcaaccaggcaggaaaccagagatactaattcctaggggagctaaaattaaacacaaatag

SEQ ID NO: 74700 - DNA, 297 bp, Glycine max
  Peptide Sequence Number=SeqID_191478
atggataaagttgatatctttgtccctcatcctctcacaaacgcatgtttgcttattcaactttcactggaatgtgggtgtaagccattggtctgtttgctcaagcaacctgcgctcctgagtgttgacttccaagaccgttcaatcagagattactcatcttgcacgttggtggggggacaacccttcccttgtgttcaagaatcctctactacaagagacccacggtctcttaatcccttttcagaaataagaagaagagaagaagaggtctctcgtaaaaaaggtagattgtaa

SEQ ID NO: 74701 - DNA, 153 bp, Glycine max
  Peptide Sequence Number=SeqID_191479
gacgtacctcaatggataagtgccaaagacgatctccacaaacacgatctccacaatgtggttgcagtcacggaagcacaggcgactttgacacaaggagaaagaagaagaacgatatggttcaagcgcaaggagaaagaagaagaacgatag

SEQ ID NO: 74702 - DNA, 426 bp, Glycine max
  Peptide Sequence Number=SeqID_191480
atgaggggagaagtgagctcagatcacctaggcgagctggttacttcacccctaagttttctaggggcccaggctagcctgggagagccaggggtaagtaaagataaggacactaatttcatcctagcaatcttgccatccgatcggccactagcggaaacccaagcagcaaaacctatgaaaagaaagaatataagaggtatcaggcgagcgcaaaaggctcacgggtgcgctttccaaaggaggaaagatgcgcggagtctccaccaacgtttatttgtggaaaacgtcagaaaaaaccgaacgaaaccggtcaaaatgaaaattctaagttcgggagttgtatttacgtttgaggaaggtcgacaaaagtggggcttttgctcctacgtaccccccatcgaagaggaaatcagacctacgtag

SEQ ID NO: 74703 - DNA, 177 bp, Glycine max
  Peptide Sequence Number=SeqID_191481
atgaggccgaggcgctttcgaattgctttcgtgactgattcctacatcgttcttcattcgttcttcattcgtcaaccgtttgtctatcaaaagggtatggatgatctaaacatgaatgttgggctaggaagtcagctaatgcttgacccttcatggcctttaatggaaaataattaa

SEQ ID NO: 74704 - DNA, 978 bp, Glycine max
  Peptide Sequence Number=SeqID_191482
atggccgggcagcagcgcgctggaatccttgcggccggcgcggcgcttgagcagggactcgaacaggtcgccgatgatcgacagcactcccagcaaggcggcgatcggcagggccagccagaagctccagcgcgcgaccagggcgtggccataggtgccgtcccacagactggacaggccgatccagatcaccgcgcccaatacgccggccaccgcgcccgccactgtcttgccggggctgacccgcggcgccagtttacgcttgccgaacgcgcggccggcaaaataagcggcgatgtcggccacccagaccagcgccagcagcgacaccacgaagccggcgccatgggtcatgaacatctgcgccagcaccgcccaggccgtgaaggcggccggcacggaaaacagcgaccaggccaggctggccggcgccgcgtcggaacggccgcgcatcaccgcggcggtggcgcccagcagccataccgcggcaaccagcggcgccgcgtagcgcaggacccaggcggggtcggtgacgccttcgcgtccgcccgagagccaggccgacgtcagtgccagcatggccgcgaacaacaggatcgggataccggcggcgatcagcggcgacggcggctgcggcaacgtcaggcgcagccactcccaattggcgcaggccgcggccagcgcgagcagcgccacgaaccaccagggattggcactcatcatcgccgccgccaggatggcgagcaggatgacggcggtaacgatacgctgacccaacatgtgacggtctcctcgaggaaattggaaatgcgctgctcgccgccggtgcggatgaacaggtcaggctcaggggcccaggacatggacaggtgccgcgccagccgctcttcgtcgaccagctcaggctgcgtcgccagggccggctcggccgccagcatggcgcgggtggcctgcaggatgtcccagcggccgccgtag

SEQ ID NO: 74705 - DNA, 914 bp, Glycine max
  Peptide Sequence Number=SeqID_191483
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatagtttacagtatcctaaaccacccgcgcaaataagggttaggtgttctgtgacactttgttttagccctaaaaataggcgtttttacaccgtttattcgcggatgcgcccaccggtttttccgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 74706 - DNA, 273 bp, Glycine max
  Peptide Sequence Number=SeqID_191484
atgtggcggaaatcgaaaagatgtgtttttacgcaatctcaatctggcccacttgggtcttccaaatccttcctccagaaggctgttgcttctggaggaagcaaccttgctcgcctgggcgagctgggtggcaagctcctcccctattttgctataaatagggggaggagtgaagaagaaaagggttcagccttcttggcacttctccctctctcgaaattgctgaggaaaattgtttccgtgaagaaaatccaagccgtggcgcttccgtaa

SEQ ID NO: 74707 - DNA, 147 bp, Glycine max
  Peptide Sequence Number=SeqID_191485
atggcaatggaagaggccgcgacggcgactttgtctccaccaactgggtgtcactgcgacaaagtaattagggtgtggtatgctatccgtgaaggtcttgtggtgtggtatccgtcaacgacggaaatgggcttaacttctagctag

SEQ ID NO: 74708 - DNA, 285 bp, Glycine max
  Peptide Sequence Number=SeqID_191486
atgatgctctcctacaacctaagacaagtgcaagaaaataaaaatcctgatcctgtcaatcatcctgtgcatgctcattcaggtccagtgctggtgcagatgatggatcctgagaaagaggcaggtccaacactggctcaagtggagtgggctctgaggtgtcagcagaagcatcctccagtggaggctgaggctcctgggatgcataggcctcaccccctcccaaaggagaaggttggactcctggccaggccaccttctaaagaaattcttcaacgctcataa

SEQ ID NO: 74709 - DNA, 339 bp, Glycine max
  Peptide Sequence Number=SeqID_191487
atgggtctcagagttcagagattgagagcagaaaggagattttttacactaagatggagaccatgcaaatcgcaaggagggaatggcgatttcgtcgtcgacgcgacagctggcaccggtgtcgccatcttcaatggcgtgttgcaggaagcttggactcgccagtttgactggcgagttgaggggtttgcagttcctaggtgcaggctatttccaacgctgcagtctgcaacctgcaatgggcagttcctaggtgcagggtgtcgccagctccaatggcgttttggttggacaaaatcgccagcacgatcagcgatttgccttgcttggggtttttaa

SEQ ID NO: 74710 - DNA, 232 bp, Glycine max
  Peptide Sequence Number=SeqID_191488
atggtgttacattgttcattacggttcaacgattatggaattcttgttgtgagacaagtggactcaagtgttggagcaggagcaatgagtggtgttggaacaacaggtggaacctccaaagggaaatctttaatagtgaaagaaaagaatggagtagtctataaaaatgcaacatcagcaaagaccaaataccctgaagttaaggagagaagcattggtaacccttttggag

SEQ ID NO: 74711 - DNA, 279 bp, Glycine max
  Peptide Sequence Number=SeqID_191489
atgaatcccatgccaacttatgagatcactttcttgaaccagttgcctgcagaactcacctgcaagggagggaaatctgcgatcgaggtcgcaaattatattcagagggttcttgcagggactctcgggtttgagtgcaccaatttgactaggaaggacaagtatgtcatccttgcaggaacagacgggaggcatgtcgttcaattggccaagtatcagccgaggcaaaaaaaagtcaccgagacaaacaatcatagcatttccaaaagacatcagtaa

SEQ ID NO: 74712 - DNA, 249 bp, Glycine max
  Peptide Sequence Number=SeqID_191490
atgctatttgggggtggagatttcatcgcgacaggggtttgggtttttttgggggttagggttttttgtagttttactggaggagaggggaatgggggtggtggtggtaccagggaaaaggtggagaaatgtaatggaaagaggagagaaaaggagaaggagaagacaactagggagtggggagaggaacagacgccagctgggaaagaaaaggaacaagtgccacatttgcgaaaagaagaggaatag

SEQ ID NO: 74713 - DNA, 330 bp, Glycine max
  Peptide Sequence Number=SeqID_191491
atggtgtggcgtctccaatcatctttcttctttcttcactccgctgccattaaacttcaagaagcaaaggactccattgatgaagaagatccaaggcctacaagctccacatggagctacatcacaggcgagatggtgttggcgttcgagttagtggcggcattcgccttggtagcctctcgaatcttaacatcaagctggatgagactcctcgtcccgagtacgcctatggcaccaaatcgtgtgaagtgcgaacgtacaagcaccacactgcgtccttcatatcctgagagttcaatagtcccaatagacagtgccccaggattctag

SEQ ID NO: 74714 - DNA, 384 bp, Glycine max
  Peptide Sequence Number=SeqID_191492
atgttgagaacaactgaaaaggtgtgctacactcctgattttaatgagaaaccaatcatgtttctcaagcaaacaagtgttggtggtggtggaaacaagaagagggtcacaggaacttggactttcagatttccaaaagaccctaaattttcacctgtgagattcttgcagcaacttggagcaaaagtggcaagtgctataagagttgtttccatgagaaggagatcctctaggaaggtttcttcatcctctttggtcagaacacgttctgtgtcagacccccctgattcacatcgtgccaaagctgttgaagattgtattgagttcttacattcttcttcatctagggagagacccagttcagtttctgaaagttctctctag

SEQ ID NO: 74715 - DNA, 425 bp, Glycine max
  Peptide Sequence Number=SeqID_191493
atggcaagagtagcaaaagtggtcaagatctcagcaaaagagctagatcgagcgaaacaaaacagaaatggggtggttgggataccaaggaagcgcttggaaaagaaagcaaaagctttggcagatcaaggaaagtggacttcattcattgatgttttagcactattggtgtttgggatcgtcctttttccaaatgtagatgagctagtggatctagcggcgatcaatgtttttcttgcttattaccacagcaaggaaagcccgatcgttgctgttttggccgatgcctatgacacattcgaccaaagatgcgagaagagcagtgcaagaattgtctgttgcacgcccgctctttatgtatggctggtctcccacatttttcgtcatgaaagtagacccgtttgtcccctacaacgtcttcacat

SEQ ID NO: 74716 - DNA, 672 bp, Glycine max
  Peptide Sequence Number=SeqID_191494
atggtcacactaagacaaaaacaagaagcagacctcaaggcattatgtgaggaaaatgacaccatccgagctcaactggtggaagccgttgaacatcgatcggatgatggaactacaaaccccaacaagtacatcaaagcatacgtgatgcaggagaacctattcaccgatgacaatttcatcctatgtagagtattttcgagctcatcaaaaggacttgccttgacatggtggcatcaactatcccccggactattgatacattcgacatacttgtcgagcgtttcggtggacaataccccacatgtcaaccacatcagagttgttggagttcaacgactttatgagcaacctcacaagtatagatcttcgaacaccagaatctgcttatgcatatatgcaaagtatgcccatacctttggttgcatcctatgcaagaagaggccatcaagcatggacgaactaagacatcacgttgccggcttcatacaaatggaagagttgttggagttcagcgactttatgagcaacctcacaagtatagatcttcgaacaccagaatttgcttatgcgtatatgcaaagtatgcccatacctttggttgcatcctttcaccaaactattgtcggcagttcttcaaccaatcaaccaaatattaatgacttcgtctag

SEQ ID NO: 74717 - DNA, 207 bp, Glycine max
  Peptide Sequence Number=SeqID_191495
atgccgcaccagatctacgctcatgcttgcaatgattttgaattggggtcgccgacgaggtcaatgatgtcattgccaacattgcagaagccggtgacgggcaacctcttgtgcttgttctcattagcaacagtgttcgaacatagtctcagagggggtgggatttctgatagggtggtgcgtttggtggtgagggagtgggattag

SEQ ID NO: 74718 - DNA, 807 bp, Glycine max
  Peptide Sequence Number=SeqID_191496
atgtcaacccccatccttcacctgcctgatttcacacatcccttcatagtgaagactaatgcgtcagggacaggcatgggtgcggtgttatctcaacaaggtcaccctattgcctactttagcaaagccttccctccgaaactgctctacgcctcgactatcgctctggtaacaccaacgtggtcgctgatgccctgtccagactttcagaaggtccttctggaattaaagacccggttagctcaagacccagaattttctcagttccggcaagccattgttgaccaccccgatgagccctcatcgtggggaaaactgctacgctgggttgaatggtcatacaacacatcctggcactcgagctcgagcttctctccatacaaaatcacttttggcaaaaagacctttaattatatacaatatctggcaggtgattctaacatcgatgttgttgatgacatgctcattgatcgagaggcagtttttgcggaagttaagaagaaaatggaaaaggctcaagctcatatgaggcactttgcagacactaaacataacaacgttcaatttatggttggagatttggttctggtcaaactcaagccacaccggcagacctctgtttcgggattatcgccggatgatacttcatgggaagactggaacatacttcaaactgattaccgccttgaggacaaggtgattttggaaggcatggggaatgatagcaacacagaaaaaccagaagcaacaaaaacaagaccacaaaggaagagcagggccccaacttacctcaaagatttcctataa

SEQ ID NO: 74719 - DNA, 390 bp, Glycine max
  Peptide Sequence Number=SeqID_191497
atggaacagaggaagaaattaatcacggccattaatgataagaatgttttggtaaccaagaaaattgatatcattaatggccttcagcaaacaattatcgatcatgaaaggatggtttctgccaaggctactgagaatgagaaattattcaaggatgtggagggtttgaatgataaactcaatcttgaaaatgtgcttgagttcgtactcatcaaagcagttaagcaaatgcattgtcaagtgggtaattcctgctccaccaacatagagcatccaccaatcgtcaccatcattgttgctcgttatagggggaagctcgacaatgaaatcaaccaaacattgagatttaatgggttctcaaggttcaaacttcaactcaaattcagataa

SEQ ID NO: 74720 - DNA, 480 bp, Glycine max
  Peptide Sequence Number=SeqID_191498
atggattgtgtggacctggaggcaatgaggaagatcacgatcatgggagaagtggggttgagagagaaagagagtgggtttttccagacagagaaaagggccaaggggagacccacattgaatgtgcttggagccatagtctttacaccacacttgacaatgaaatttaccttatcccatagggaaattgccactatcaaagccaatcagcaaaatgcttgtgaaagctatgttaaaagttgcaagattgaaccatacatcatggtgaacaaagagaactacaaagctctgaccaccagtgtcaacactgtcagcactgagtggaaggacctcgacctccgggcaaattctgaagatcggagaccaacccccattgaaaaatttgaaccattccaaattcgtaaggagtcacatcagtgcactaagattagtgagaaaatggaggaaggaagtggaacgagtgctcttaagaaatgttga

SEQ ID NO: 74721 - DNA, 711 bp, Glycine max
  Peptide Sequence Number=SeqID_191499
atgtcttactctatttttggtggagatgagtcttcagttgtctgtcaaaagtctatgttagatacaaaatatttcggtattggggaagagtcagaatcatcctctggctcttttgtttgcctttttcattctgatgaggaaactttccagaacttgatgaagggaacgaaagtgacctctaatgttaatgtttttgttagtgatattaatgccatccctattgagtctaatgaggatgaagaaaaatatgtttttgaccgtatttgggatgagccagatataggaggtgacaatatagttgttggtggtggcggattcaagtcttgggcagatcaactattgtctcccaaggaaaggcaagatgcagtcataattatggaatttcctaggagaatgaacatcaagaaagttctcaatttgccttattgtggcaatgttgagaacactttagagggaaagcattatgataaggaggttggtaaattttgtgacaagaatgaccaacctcaagtaaaagtggctagaattatggagattgggagtactaactttgagaaagagaagaagaaaaataagtctcctgaaaaagaaaaagagattccaaagacaattaatgttgaagaacccactattgatggtggaaatcctcctgatgttactcaacctcgaaatatggataagccaattaccactcttgatgaggctgcttag

SEQ ID NO: 74722 - DNA, 381 bp, Glycine max
  Peptide Sequence Number=SeqID_191500
atgaatgaatcttcgataaaaaccggcgaagcccaagaagctatgcagagcgtgcgcagaatgaggtttgggccattattggatggcttcaactttggccaacattggttcgaccccacgcgacaagaccacatgacccagcatagaatcaacccgggattcgattttggcttttttggtaatgcaagtaacggtagggtcgaacgtggacagggtctgagtttggggccaactgtatatggtggtctgtgggttgggaaggcagaagagcctggggagtttgaaacagggaagcaaatagggtcaaaagggattggattgcaggaatttcatggacaaagtagtatagtccgtgaggatggtgttagtatagagcaataa

SEQ ID NO: 74723 - DNA, 738 bp, Glycine max
  Peptide Sequence Number=SeqID_191501
atgacagacaagatcaagagctgctcccttgatagccagctcaacagaaacgccacgctcgacggcaatgagcgttgcaagctcgccctacacaacctccttgacaagatgtatgatatagagtgggatttgattatgatcgacatgccgaagggttcactgatggctgcgattacttgtttcatgggattgcaatatgggcatataattgtacatttgcagggccacaagcatagggtacgtctttggtttgtgttttccttctctctgttgctcatagggtacattctggagatcctaggaatgcctttatcaaaagcactatacacattaagctacacgtgtatcactgcaagggcatcaggcttagtcttgactgctatcttttacatttgttacactcatcctcaatcattgattcttttgtcatctaatggtcctaataaaaacacattagtgtataatgagtcacaagcaaagagatgtagggtgagagatgccaacaaaggaattactagtgcgtataacaaaggtagtggaatcgaatgtatggcattcctctgccaaatatttagccatagtggcttgaaattgtctcggggcaatgaaattcgtgaggttttggcaatgatatcagggaggaaaataagagagcatatagatgaattcttgtctgaattagacactgaagcatatatttatatcaggattcataaatgtaaggggaattacaattaa

SEQ ID NO: 74724 - DNA, 306 bp, Glycine max
  Peptide Sequence Number=SeqID_191502
atggtatcagagcaaactctaaccctgggacctcgcattcgcctccgctgcgacaagcacccaccatttgtggttcacgcaccaagcccaataatcccacatcggctgcctcaatccttggagtgcagcttatatatctgttgggcaactgatgacactaatggaaatggtgatgatgatgttgatgcttatgatgacagaaatgatagtgctataacaatggtgttgatgtcagtactagtagtgtcaatatgcggtgctgatgctagtgataataactaccaaaaagaccattatcaaatgtaa

SEQ ID NO: 74725 - DNA, 156 bp, Glycine max
  Peptide Sequence Number=SeqID_191503
atggtggatgaggtagatgagggtataggggatttgggcgtagccaaggtagtgataagggttttcactgagcgtcagttaatgagtggtgagcttggtaaaggcgtcctccaatctgtcagaggagaacttcgagcgggtggactccgccattag

SEQ ID NO: 74726 - DNA, 249 bp, Glycine max
  Peptide Sequence Number=SeqID_191504
atgttaatatcgtctaagcttctttttctccatcgtgctcgagaccgtgacaactcgtttccttacctaggtctgtttggggaactcatgctcactgcaaggactttgcagtccgtttggggtgctcactcgtgctcacaaggtctcattttgattgagaacaccatggcggccacttctcactttgagtgcgttgttccaatacttgtgaccactgtagttttggcagactttctaaaagtagaataa

SEQ ID NO: 74727 - DNA, 1248 bp, Glycine max
  Peptide Sequence Number=SeqID_191505
gccctgcacgccaagccgggtcagcgcaccggcaacctcggcggtctccacccactcggccaccacttccatctgcagctcgcgcccgagctcgctgatcgcgcgaactgtggcgtggctgactggatcagtatccatgtcccgcacgaaggcgccgtcgatcttcaggatgtccgcaggcaactggcgcagatagccgaaagaagacaggccggagccgaagtcatccagtgccatccggcagccccgcgccttgaccgcatcgatgaaagcacgggcctgggtgaggttgctgatcgccgcagtctcggtgatctcgaagcacagcttggaggccagcgcgcggttgcgctcgagcaggtcgcagacgaaggcgaggaagccgggctcggcgatcgactgcgccgagacgttgacgttgcacaggcccagctggcgcacgtgtgccgggcacacctgcaggtggcggaacagcagcccgagcacgtgacgatccagcgccaccgccatgccatagcgctccactgccggcatgaactgtccgggcaggtgcaggctgccgtcggtaccgcgcatgcgcaccagcacttcgtagtgcaggtaggtcggatcgcccacgcgggcgatgcgttgcgcatacagcagcatgcggttctcggccatcgccaggctgacgccctgcaaccgctcggcttcccggcggcgctcctccagcgccatgcggttctcattgaaacagtgcacccggttgcgaccggcctgcttggcggcatagcaggcgctgtcggcagcactcatgagccagttcgcatcgggggcgtcggcgctgacttcaaccacaccgatgctgcagctcagctgcgggctgccctcgctgatcgggaacgtggcctggcccaggttgcggatcacccgctgcagcacccgcttggcctcgtcctgcccggcatgggcgaggaacacggcgaactcgtcggcgcccaggcggccgacccagtcaccgtcacgcactgcagccaccagatagtcggcgaaactgcgcagcatctggtcaccggcggcgtggccgaagctgtcgttgaccagcttgaagtggtccaggttgatgtagcacagcgcatgcgtgccgccgtcgctgcgcacctgcagcagcgaacgttccagcagccgctcgatctcgcgccggttgatcaggccggtcagcggatcgtggctggcgtggtgttcgatctcgcgcgccagggcatg

SEQ ID NO: 74728 - DNA, 1014 bp, Glycine max
  Peptide Sequence Number=SeqID_191506
atggctcagcctcacaatggcaacaccaacaacacttcaaaccagcaattggtactccatgactttctgggtatgaggcccgccgccgattcccccaaaaccgccgatgtcaggttaccggagccttcggcctccgcctcttccaccggaggacgcggccccttctccgccacctccgacatcgcttccgaaaaacaggtaggaaatcatctcgagggagttccattctatggcccgaggagtgatttttctggcactgagataagcaacagattagtgggaagcaagagaagtaattctgattccacttttatgggttcctccagagatgccttccaattggtccctgattcctttcaaaactcacatttgatgaaggttctccggaatgcagctggaggagaaaggcctagaaggcccaatgatgatgcagtgttacttggtatgcagtcaatgaagccatcttcttctcagatatttcagcctcccaccagcactaagattgatgccaataaatgggaacggtctattctcatgaatgttggcccttccatgcagcatccaccgcgtggggtgcaattggcaccttttgtgcaccaaatggcttcaagcaagattagggataccaatgctggcccttcattcatttctcagtcagctgctgatgaaggttctagaactggaatcaagggccctggaattttaagttctgcagctgctacagccactgagaaaagtattccatctgctgtgatgcttggtggcagcaggccaaagcctggaactaatgtagtagaatcatccacacatccaagcagtcaacatgggctaacttctgccagccgccagatgactattttttatggaggccaagctcatgtttttgatgatgtccaccctcataaggtctggcctctacttgttagcatgacatatttgtttattgcatttagtgaaataacaacaacaacaacaacaacaacaacaacaatgacaatagccttatcccattag

SEQ ID NO: 74729 - DNA, 411 bp, Glycine max
  Peptide Sequence Number=SeqID_191507
atggctttgtgttcagtttttctcaatcttcatcttctgctttttgtttgtttgaccatagaagcgttaggtgtggcaaagccttcagtagctagttaccttagccaggagatactggcagagcaagaagctgatagagtgcatggattacttgcgcagcctccggtgaagttcaacaatatgttggttatatcactgtcaatgaaacacaaggaagagcactgttctattggtttttcgaggccactcacaaaccagaacaaaaacccattctcttatggctcaatggaggcagtggctggattaactcagcctaacaatccaaagcctattgctgattccattttttccaaggctaaactagaagattctttggactcacaattcaaaccgccagaagcttcacaacaa

SEQ ID NO: 74730 - DNA, 504 bp, Glycine max
  Peptide Sequence Number=SeqID_191508
atggcttcaccctccgtcacagacaccgaaacgaagccgttttccgttctcttcgtgtgcctcggcaacatctgcagaagccccgctgccgaaggagtcttcactgacttagtcaacgaaagtggcctcaattcgaagttcaaaatcgattccgctggcaccatcaattaccacgagggaaatgaagcggatccgagaatgagggcagcttcaaagaggcgtgggattctgataacttctatttcgaggccaatcaagccctctgatttcgttgactttgacctcattcttgctatggacaaacagaacaaagaggacatattggaggcctttaataggtggaaaggtagacattctctaccggatgattcacataaaaaggttaagttgatgtgctcgtattgtaagaagcatgatgaaagtgaagtcccggatccttattatggtggacatcaagggtttgagaaggtggaattgagggctgaaaccatcccaatagcataa

SEQ ID NO: 74731 - DNA, 1191 bp, Glycine max
  Peptide Sequence Number=SeqID_191509
atgtttatggcaaataagcttttgcggtggggtgggagggtggcattgggaatttctgtagaagataataatcttggagaagactgccctgtatttgacaacttatttgaattttgtcagatttatgctggtggaactatagatgctgcacgtcgattaaacaatcaattgtgtgatattgctataaactgggccggtggactacatcatgctaagaaatgcgaggcatctggattttgttacatcaatgacttggttttaggaatcttggagcttcttaaatatcatgctcgtgttttgtatattgatatagatgtgcaccatggtgatggtgtagaagaagccttctacttcactgacagggtgatgactgtcagttttcacaagtacggagatttgttcttcccaggtactggcgatgctaaggaaataggagaaagagaaggaaagttttatgccataaatgtcccattgaaggatggaatagatgacagtagcttcactcgacttttcaagactattatttccaaagtacttgaaacatatcaacctggtgcaatagttctccagtgtggagcagactcgcttgctggcgatcgcttgggttgcttcaatctctctattgatggtcacgctgaatgtgttagcttcgtaaagagattcaatttgccattgctggtcactggaggtggggggtacacaaaagaaaatgttgctcgatgttggactgttgaaacaggagttcttctagatacagagcttccaaatggaatgatggaaaaaactgtaataccaaaattttcctttgggagcatacgagaggttgcaatacattatgcatcttgtcttgcaatatttgcgcggaaaatgatttatcccccaaatgctttttatcttagcttcaagcttgtgcttgaggtttatgtccagatagaaaatagtggaaactttcttacctgcttgttctgtcttgcagagattccggaaaatgattatattaaatattttgcaccagaattttctttgaagattccaaatgggcagatagaaaatttgaatagtaaatcatatcttagcaccattaaaatgcaagtcttggaaaatcttcgttgcatccaacatgctccaagtgtacagatgcaggagcttgtttggatcacaccttgtggttcaaccatgctctttctttaa

SEQ ID NO: 74732 - DNA, 186 bp, Glycine max
  Peptide Sequence Number=SeqID_191510
atggcaaaaggggttgttgggtttcggtttctcagagttaataactttgcagtttacgaagaagaagaagagagcttcgggtttgctgttggattcattctcatccttactcacacgacattgtcctcgaatttgacgtcagaggagcaacactacatgcttcacccccaaccaattttggtttga

SEQ ID NO: 74733 - DNA, 663 bp, Glycine max
  Peptide Sequence Number=SeqID_191511
atggcagctagtcctgtttataagcaccctcaggagaaagagagccatcattccaagaaaaagataacaagaagaaaaagaacagagaaaactggccaaggagaggaaaagagtgctgtagattttggtgcaataatggcaacaccaaaacagtcatatgagcagcaacaacaacaacaaccaaatgtgcagcgagtgaggaactcggggatgattaacagcaaccagagtccaatgagggatgacaaggaagaggagatgtcaagatcagctttggcaatgttccgagcaaaggaagaagaaattgaaaggagaaaaatggaggtgagggataaggttcacgcttatctcggtcgagtagaggaggaaacaaagcgcttggctgagattagagaagagcttgagggtctcacagatccattgaggaaggaagttgcaatagttcgaaagaagatagacagtgttaacaaagagttaaagccactgggccaaacctgccagagaaaggagagagaatacaaggaagcccttgaagttttcaatgagaaaaacaaggaaaaagctcaacttgttaccaaactaatggagctggtgactgaaagcgagaagttgaggatgaagaagctggaggagttaagcaaaaacttagataccctgcattga

SEQ ID NO: 74734 - DNA, 267 bp, Glycine max
  Peptide Sequence Number=SeqID_191512
atggggtacgtgaagcaaaggggcttctcacctcgtaacgctccgaaccttcgtgttctcccacgaaggcatacctgcgaggcaacaaagcctgcaagttggcgcagaagaatcttcccaacgagttttacgagacagagtgggacaccgaaagggtatttggcggaggtgccggggaggatggcggcggtgttctccgccgcggtgatggcgaggaacaggaaaggatcgagtgtgatgcacatgtttttgcatgatgtggattga

SEQ ID NO: 74735 - DNA, 1509 bp, Glycine max
  Peptide Sequence Number=SeqID_191513
atggcggcgacagagagcacagtaacttcaaaccctagcaacagagaacgaccaaagccaaagccaaagctactagtcataacgggccccaccgcttccgggaagtcgaagctagccgttgatttggcctcccacttccccgtcgaactcatcaacgccgattccatgcaggtctaccgcggcctcgatgttctcaccaacaaactccctctctctcaccagaacggtaccaccctgatttttccccatcccaacaatctcttcccgtttctgaaatcgcgtttcgaatctgttgcaggagttccgcatcatctcttgggtaccgtaagccccaacgtggaattcactgccaaagcgtttcgggattccgctattcccattattgatgatatattggctcgtaatcacttgcctgttatagttgggggcactaattactatatccaggctcttgtgagtccgtttcttttagatgattctgcagaagatatggatgaaagctgtttgggtgatccaactgggtctggtaacaatttcattggtgaaaatgactgttcaaacaatagttatgacctgcttaaagatattgatccagttgcagcaaatagaatccatccaaataaccatagaaagataaatcaatatattaatttgtacaatcgcactggtgttcttcctagcaatatttttcaaggaaaggcagcagagaagtggggtcaagttgataacttaagatatgattgttgttttatatgtgtggatgcatctctccctgtactggacagatatgtagagcagagggtagattgcatgatgcatgagggattactcaatgaagtctatgacatttataacttgaatgcagtttatactagaggtttgcggcaagccattggtgtccgtgaatttgagcctcttcttagaacttgtgttgtcaaagacatgcatgaaagagagagggaattgactgaaggatccagcatagaaaagggagagacattatttaatcataatttgatggagttggtgagatcttcctctaatactgaatccacaattcttttggaagaagcaattgaaaaagtaaagcttaatacccgaagacttattcgccgtcagaagaggatgctcagtcgactgcaaactctgtttggttggaacatacactatgttgattccacagaatcaatatcaagcaaatcagaagatgtatggacccggcaagtggttgaatctgctgtgaagatagtcaaatctttcctgagtgagaatggaaccatctttgggacgtcaaatgacacggggatgaaaataatccaaagggacctctggactcaatacatatgcaaggcctgcggagatcgtgtgcttagaggatttcatgaatgggagcaacacagacaaggtcgagggcaccgaaaacgtatatctcgtcttaagagaaaggcacaagttcctggtttcgtggaagaggtgaagtattctgcgtctgaacagttagatatttaa

SEQ ID NO: 74736 - DNA, 762 bp, Glycine max
  Peptide Sequence Number=SeqID_191514
atgagtcttcattcttcatctagtgttaatggtgagggttctactcctaaggaccccttgtataagatattagatgagttgagatcccttaagttgtggaaagaaaaacaagagagaaaagaaaaaggaaggcataggtcacatcttagacctcactcccataggagagaaaatgaaagaaagcctcaagaggttaacattaaactcccatacttccatgggaaggacaatgtagaggctaatatagattgggaaataagggtagagcaacaacttaaaaggaagtctacttcaaaatcttatggctctcactcttatcaaaagaaagaccaaggtcaaggaatcttaggggtgagaccttctaagcccaaagatgataaggggaagacaatagaaaagcacccccttaaggctaaggacacatttacttctcaatgccccaccacaaaaaccatgattatgaggggccaagacatttatagtagccaagatgaggctactacttcaccttcctctagtgaaagtgaaaaagcaaaaggggaagaatctagtgaagaaatctaccctcaagaagaaggacaaccattagtggttaaagagaagtgtaaggaggcacttgctagcattgccacacctcttgggcttgagtttattcctcaagtaaagaagttgttggatgaaggtttggttcgcaagagcttaaatccttgtgctttgttggtgcccaaaataggaataatcaatatgaaaatacagaaaaag

SEQ ID NO: 74737 - DNA, 279 bp, Glycine max
  Peptide Sequence Number=SeqID_191515
atgttagaattcacaagcaattgtcctcctaaaattttagccagcctacatcaattagactttgcaccttatgtttcagggtcatacaatgctcaatggaatgccccggaactcccctataataagcacatgtcacgttggggttgtatcatttgggaaatagaggttaaaggagtctttgctgggattatggctaccattgcattattcagtagatatgggaatgtgcggcaggcaagctttgtggcttatttaggggtggcctttgtggatgattaa

SEQ ID NO: 74738 - DNA, 150 bp, Glycine max
  Peptide Sequence Number=SeqID_191516
atgaagctatttggtggcccaggcgagtcagaggctagcctaggcgatctagggtccaggaaaaccaaggaaaagacccttttgtccccctttttttgcgttcaacaccgtaagtcgactagcaaggatcaaaagatcaacgaacgatag

SEQ ID NO: 74739 - DNA, 208 bp, Glycine max
  Peptide Sequence Number=SeqID_191517
accatcgtctccgacaaccaccatctcgtgtccgttgcgtctcgttccgtttgaagccgccgccgacaaagacccttggttgttgttggttgtcttcattgtggtctacattgtacttggggtttatgtggggctcgttgatgaagctgacttgcgagcagtgagtgaacgactttcgggaacagcctgctgccatccttcatcagtg

SEQ ID NO: 74740 - DNA, 300 bp, Glycine max
  Peptide Sequence Number=SeqID_191518
cgctgttcatgcatcctccaccttcgagtctggagccccgcgaagttattgcgtagcgctccccgcgaagttattgcgtagcgctgttcgccaattctccattctccacttttttcggagccccatgaatttattgcctagcgctgttcatgtgtcctccaccttcgagtctggagccccgcgaagttattgcgtagcgctaaaaaaagaaggagtagagatgagagtcgtcatcacggaaagggcaggacgaacaaaatcagtgtcttatctttgctttcctcttatctccgatgagag

SEQ ID NO: 74741 - DNA, 159 bp, Glycine max
  Peptide Sequence Number=SeqID_191519
atgggggcatacgcaaaagatgagaaactgctgatacatttcttccaagaaagtcttactggggtagctgttacctgtggggtacgcaccgtcaagctttgcggatttggtcttcgccagggaaagggtggaagcggatctggaaagaggcagatttaa

SEQ ID NO: 74742 - DNA, 267 bp, Glycine max
  Peptide Sequence Number=SeqID_191520
atgacactaatttcattcgagcgatctggctattcaaaactggatgctagagaaaacaaaagaagtgagaaccgaagaaagaaaaaggacattaaaatcatgacgttgagtcctatgaaaaataaaggcgaggacgttgagtcctatggaaacataaaggcgaggatgtggagtcctatgaaagataaaggcaaggacattgaatcctatggaagcataaaggcgaggatgttgagtcctatgaaagataaagacaaaggactttga

SEQ ID NO: 74743 - DNA, 334 bp, Glycine max
  Peptide Sequence Number=SeqID_191521
atgcagagtgggtcccaatgtaaatcatttgatgtagaaataggagatcgcttggaggatatgattcgtgatcttggacacgagtcttttcaaccagcacatgtccctatgtataatacattgcaaactcattcaaagaagcctttgtatctggggtgcaagaattccttgacgttgttgtcaacggtgttaagtctagttaatgtgaaagccatatatgggtggagtgacacaagctttagttcacagcttcaagtcgtgaacgatatgcttccagaggcaaatacgttgccaaaaagttactatcaggccaagaagatattgtgtccgatgg

SEQ ID NO: 74744 - DNA, 234 bp, Glycine max
  Peptide Sequence Number=SeqID_191522
atgccatatcctgagggtggaaatcctgcatcatgtctagagaatagcttgatattgtctgaacttaattacaacaatgatgaggctagattagaattcgaaaatctttttctatcgatgacaggtacaggaaaaacatacatatggagaacattagcaagttcactgagggcaaaaaatccaattgtgattatggttgcttctagtggcacagcttctttgttattgccatga

SEQ ID NO: 74745 - DNA, 439 bp, Glycine max
  Peptide Sequence Number=SeqID_191523
atggtggcccaagcccgggctgttgatatgctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaaccccatacctgtcgggacccgaaagatggtgaactatgcctgagcggggcgaagccagaggaaactctggtggaggcccgcagcgatactgacgtgcaaatcgttcgtctgacttggaactggcgatgcgggatgaaccggaagctgggttacggtgcccaactgcgcgctaacctagaccccacaaagggtgttggtcgattaagacagcaggacggtggtcatggaagtcgaaatccgctaagga

SEQ ID NO: 74746 - DNA, 297 bp, Glycine max
  Peptide Sequence Number=SeqID_191524
atgggatttccaaagtttttaatagaggaatttatagctggacaattaaagaatagagtttcgtttcgtaaagcaatgaaaaaagctattgaattaactgaacagggcgggtacaaaagggagttcaagtacaaatttgcaggacgtatcgacggaaaagaaattgcacgtgttgaatggatcagagaaggtagagttcctctacaaaccattcgagcgaaaatcgattattgttgctatacagttcgaactatttatggggttttagggatcaaagtttggatattttctaaataa

SEQ ID NO: 74747 - DNA, 693 bp, Glycine max
  Peptide Sequence Number=SeqID_191525
atgcataaggcattacgggccaaggcacctcttccttatccacatttgattactctgtttttgcgtcactttcaaattctgcttgatgatgaaccctttgttcaagtcaagcgttcctttgcaattggtgctggtgcagtgacctcctttgggtaccgtaaagatcgaaatggtcaatggctgaagaaggatgcactccctcctcaagatgaacgtactccttcacctcctcctcaacgcgaagattccgcactcatgaatgaagtcctctccgaattatggggtcttcgttcttatgttggtgaccgcttcgactcgttagattcatgctttgccggtatggacattcgcctcacacagcttgaagaggatgtcagatacattcgtcagagtttcgatcttccaccaccacctccgtcttctaagattttagtttctgattataagtctttaataagccgtgtattttggctggtattgtattgtcatcatcaaaaagggggagattgtagatgcaaatgcctttggtgttttgatgatgatcatgatgatatgatgcaattgatgcaaatgggcttttcaagattaaattcaagacaatgcttcaagattacaagtcacaacatcaagatgatcactagtaaattaggaagggaattcctaattgaattagcaaaaggtttggccaagtaa

SEQ ID NO: 74748 - DNA, 1419 bp, Glycine max
  Peptide Sequence Number=SeqID_191526
atgcatgggtcagatatattatggcgaatgcgtcagattccattgtgtcttccacaatggaatctgataagtgagatatggaatctgataagtgagattccgggtaattgtttacataatcttcttctgtccgaagaaattattcatcgaaataatgagttactattaatatcgacacatctgagatcgctaaatgttcaggagttcttctattcaatccttttccttctccttgttgctggatatctcgttcgtacacatcttctctttgtttctcgagtctatagtgagttacagacagagttcgaaaaggtaaaatctttgatgattccatcatacatgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaagtaaaacaatctattccttgataagaaaaataaaaaacgtgaatggtgattggattgatgataaaatagaatcctgggtcttgaacagtaattcgattgatgataaagaaagagaattcttggttcagttttctaccttaacgacagaaaaaaggattgatcaaattctattgagtctgactcatagtcatcatttatcaaagaataactctggttatcaaatgattgaacaaccgggagcaatttacttacgatatttagttgacattcataaaaagtatctaatgatttatgaattcaatacatcctgtttagcagaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggat

SEQ ID NO: 74749 - DNA, 384 bp, Glycine max
  Peptide Sequence Number=SeqID_191527
atggcacgcagagaccaagtttggtcattctgcacccatgatacgcggagataccttacggttatctgcacccctttgctaggcagacacagttgtgtccgatggcacgcagagaccaagtttggtcattctgcacacatgatacgcggagatccttacggttatctgcacccctttgctaggcagacacagttgtgtccgatggcacgcagagaccaagtttggtcattctgcacccatgatacgcggagataccttacggttatctgcacccctttgctaggcagacacagttgtgtccgatggcacgcagagaccaagtttggtcattctgcacacatgatacgcggagataccttacggttatctgcacccctttgctag

SEQ ID NO: 74750 - DNA, 454 bp, Glycine max
  Peptide Sequence Number=SeqID_191528
atggaggcttttaaatcagacttcacaagtaaatgggcccttgcagccgatcaggacggtgtggacgacactgatgtgcggaaaaaggcacaggccatccaaaaacagaacactgccccccacgttttgtctcgtgggggttatgaatatttggagcaaaatctcctggttgagaagactaagaagaagctggaggaagctgcacagtcaggaagcgttgatggcgtcatcgaccctctatcccttgtcagatgccacatgaagtggaagatggctcgcaccaagaaaacaggggagatgacgactaaggccgcaaaggaaatcgttgagaagattgattcctttaaggagcaggcgtcacagggatccttcgtcccccatggacgtcaggatgttctcaccgctgctattggatgtccagagcaccctggacgtgttcgtgctgctggagctg

SEQ ID NO: 74751 - DNA, 210 bp, Glycine max
  Peptide Sequence Number=SeqID_191529
atggataagagcttgaaggtaggagaagatgagtggagggagaggaagagaaggagtacaaaattttgtgcctcaaatgagctatggttcaactcactaatccaagatcaagtccaagattctccaccaagtgtgtttaggtgtcatgagacatgtaaaacacgaaggacatgcacaaagtgtgactatatgagtggcaatggggtgtag

SEQ ID NO: 74752 - DNA, 583 bp, Glycine max
  Peptide Sequence Number=SeqID_191530
ggacctggccaaggcagggggattcgcctggggagcggttgcattagtccacatgtacgagcatctgaacgacgcgtcacaggcctctacacgtgctggatatacgagcactttcctacagtgcatacatccgtcgttcatgatgcttatgatgaggagagcccacgggcctgcaggtggcttacggggagtcaaaggctttgacttgatatcgtcgtacactggtcagctcagatggggtcagattgtggtatacattcgacctgagcaggttcttcgacagtttggctaccttcagacggtccctctgccaccggtttgtgattctttgacgggtgatgatatagatgaccggtggctgcatttttcagaccatttggtgccttcaggggagctctgtgtagttcctggacaggtggcgccagactacatggagtggttttttcggatattgcacccattcgtcatgtggaccgaggagactgctacgccgagacatccgcctccccctcatcatgaggagttcgtcgagccacccatccccgaggtttcagtcgcgaccgatctccctacgcatttagtg

SEQ ID NO: 74753 - DNA, 480 bp, Glycine max
  Peptide Sequence Number=SeqID_191531
atgaccaggagtaagaccaaacagtcaatggataccctccaacaaatgacttatcaaggttatccttgtggcgtctaccctgacttatcttccttcactggaagtggcgtcatccaaatctccatagcctgtatcaagcgatccgctcctagtcaggatcacatcactccacctcgtgagaggactcttagggaaatggctgcacttgatttcacttatgaaagcttgtgcattcaatatcctgatcaggatgttccgtatgttcttaagactggactaatacatttgctgcctaagtttcgtggtcttgcaaatgaagatcctcataagcatcttaaggagttccatattgtctgttccaccatgaagccccctgatgtccaagaagatcatatctttctaaaggcttttcctcattctttggagggagtggtgaaagattggttgtactaccttgctcccaagtccatttccagctag

SEQ ID NO: 74754 - DNA, 318 bp, Glycine max
  Peptide Sequence Number=SeqID_191532
atggcagaacaagctaaacaggtgttttatgttcaagatccttatgatgaaaggtggtcagtggttctacatggaaaaacaattggtgttaatgttgaagatgatgattcaatcgttgatacttgtctcagtcctttctccacacaaatgtcgcctaacgtcaacagagaagaagaaattgatgacgttcatgcaaatcgcacatggctacaccacccaactctcctcctcctcttcttgagtcagcagcacatttgctgtctacgccgaagaagacaagaaaagcaacacagcttagatcattggctactagactag

SEQ ID NO: 74755 - DNA, 219 bp, Glycine max
  Peptide Sequence Number=SeqID_191533
atgccgatctccccctgcggaagtatcagttggtctgtgccgtcccgacatagggatcacacccacaagacacccagtggacccggaaaagtccaacagggccctggggtttccagctctggttacgggcctctatcagtcctacagggtgcccgtacccccccggcaaggtcacgccatcatagggatcgcgcctgcaagacacccagtggccggtag

SEQ ID NO: 74756 - DNA, 357 bp, Glycine max
  Peptide Sequence Number=SeqID_191534
atgggtgaagtagaggagatacaagagaagatgaaggccaacatggaggccattaaagagaaaatggccacaatgatggaggccatgatgagcgtgaagaagataatggaagccaatgcggttgcaattgccgctaccagcgttgttgctaaatatggtaggcaaaagaatttgggaagtcgggcagcccccataatgtacaaattcaaaaacgagcacgccttcccaccatatggcttgcctctcaactatacgccacccaaagtggcgtacactcccaataagaatgtcaataactccactcctatacccattgagagccaacaaccccaaactgatcatgcacatgtctcttaa

SEQ ID NO: 74757 - DNA, 258 bp, Glycine max
  Peptide Sequence Number=SeqID_191535
atgagggttcactgtaatcaagcaagtcggagacctagcatgatcacggattcacctccactccttatgttcccacgaacccggtccccagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaaag

SEQ ID NO: 74758 - DNA, 342 bp, Glycine max
  Peptide Sequence Number=SeqID_191536
ggccgcccgggggcgcggctggcggacgggcgcgttggcgcgacaggcccggcgtgcagacccggcatcacggacggcgcggcccgctcgtcgggcgaggcgggcgcgtcaacggatggggtcgccggatggggtcgccggattgggtcgcttcaggcagcgaggatcacgtcgtcatactccggtgggatggcggccattctagcgcacgccccgctggtgccggcgcgcggagcgcggcaaggcatcgggcggcaaacccctgccgccaaagagattcgcggcccggatatcatgatcgccccaagacaacaccctttgaaccaggcatccacgccatga

SEQ ID NO: 74759 - DNA, 384 bp, Glycine max
  Peptide Sequence Number=SeqID_191537
atggcccgctcagccttggcctgccgtcagtcgcgccgtcagcgccgccatgtcctccagcagccagaacacgcggccgcggttggtctcgtaggcgaagtcgcgcagcgacttgctggcggccaggtgcgccgagatatcgcctaccaccgcgcaatgcaggcggtagttgacgaacttctggatcagctcgccggcgatgcgcgtttccagccggaagaaatcgggatgcacgcgcgcggcgggcagcgccagccactcggcctcgtgttcccaggcggcgctgatcaggtcattggtgtcctggccggtggccagggccgggccggtctcgccgtattgcagaacgcgcttgccgccgatgtcgacgagcctgggggatga

SEQ ID NO: 74760 - DNA, 216 bp, Glycine max
  Peptide Sequence Number=SeqID_191538
atgaatcaaacatatactgaaatgagagggatattgagatcgaccgaacaaacatcgatcctaaaagttgtgaggctataccgtcgtcctttcttcgtggaatttgttggtcatcatggtcaagtaaattacaatctttctaacgccaaacctataaagtgtgaatgcttggttgtgctttcttcgtggtattcgacgatcatcctatccagatga

SEQ ID NO: 74761 - DNA, 330 bp, Glycine max
  Peptide Sequence Number=SeqID_191539
atgacaacttctagcatgcagaaatcgcataggtcttttttcagatctaggctaggtcggagaacgctgatagcacgtcacaaagagatccaacgcctcattgaagatcgaaaccaacttccttcagagatgttgaaaaaggcacgtcaaaatagaaagcggttgttcggcgaacggaaaaggttttccgacgaggccagaaaacggaggttttcatgtccctacttctttcaatttattgacgcggcgcaacgaccgtataatgtgtgcttggccagagactatcgtggtggatggatgcggcggtgcaatgccatggctgttgtctaa

SEQ ID NO: 74762 - DNA, 465 bp, Glycine max
  Peptide Sequence Number=SeqID_191540
atggagagaaggggtgaggagcaacctggcaaccgacctgcacccagaataacccaaggaaaaaagaggtgttggattggttcgggcagtttttcgaattcaatcggtgtagaaacacggcttctaacgtgcgaaagccaaataggttttgcacggtacattcgatcagatgcttttaaaatcaatagtttatattttttcttcttctcatttttctttcctttttttgatacatcctcgcctcctccgtccttccttcaacttggagatctagaaggtgtgccgcacgacgttgtgctccgccgtggacggtggcctcgtcatgaactcgcagcactccgtgggttgattgctatgaagcacggagactccagccccttgtcatgttcggtgtctgatacgcgtccatgtagtgtccgacaccaacacgacacccatattatgttctatagtttggacttatag

SEQ ID NO: 74763 - DNA, 570 bp, Glycine max
  Peptide Sequence Number=SeqID_191541
atggagctgacgctggcgcagtttctcagtcgctttgtgctgcagccgccgctggcgaccgcgcacagcgtgatcagcggacgccgtgccgcggtgctggtaccggtgattgatggcgaccagcccgaactgctgctgacccgccgctccgcgctgctgcgcaaacacgccgggcaggtggcgttccccggcggcatgatggatgccactgacgattcgctgatcgccaccgcgctgcgtgaagcacaggaagaagtgggcatcgcgccgcagcaggtgcgggtggtcggcgtgttaccgccggtcaccagcagtaccggtttcgccgttacgcccgtggtcggcatcattccgccgcacctgccgctgcggctcaacccggatgaagttgaaagcgccttttccatgccgctcgcagaggcgctgcggctggggcgctacagcggactgacgctgcgccgcggtcatcgccagcaccaggtgtggctgtcgtggtatgaagattattttatctggggcatgaccgccggtattctgcgcgcgctcggccagcagatcgccctgccctga

SEQ ID NO: 74764 - DNA, 422 bp, Glycine max
  Peptide Sequence Number=SeqID_191542
gtgaggttgtgtttgtggatgacattccatcaccatcaaattgcttacatggagcatatatttatagtgcaaaacctttagcaagggttaggagtataaaactcacaccggaattgcaattggatggattgagggatatcatttcaattaaagacattcccaatggtggggaaaacattggatctaagactatatttggggttgaacctctctttgctgaagagatagccagatgtgttggtgaacgactagcctttgtggtcgcagatactcagaaacttgcagatatggctgcaaactcagctgttgttgattatgataccaaaaatcttgaaccacctattctatccgttgaagatgctgttgaaagatctagcttttttgaagtttcctcctttttctttatccaaacatgttggtga

SEQ ID NO: 74765 - DNA, 336 bp, Glycine max
  Peptide Sequence Number=SeqID_191543
atggaaaaatctgacaagatgaatttcaaagagaagaaagaaaagaaaggatatatcacttgggaagataatgtcataaattattcaagtgattcagagaagaaaatcataagtctggatatcatgatgaaagactatgaaaatggagaagagcaaagtcgatacattgatagcaatttctccaaacacatggcatgcatcaaacaaacaaaggccacatttctccccaagaaaagtgaatatgtgatatatggagacaacaaacacaggccacttgatcaacaaccccaacaagtaatatcaaatgataccaacaggtcacttgtctttgattga

SEQ ID NO: 74766 - DNA, 732 bp, Glycine max
  Peptide Sequence Number=SeqID_191544
atggagactgatatgacgttgaaaattggtattgtggtatttaatggcatcatcccttttcacctgtcggtgccgtatgccgtgtttgagaaagcgctgacgccgcaaggtgagccactttgtcagctggttgtttgcgccacgacgcctggtgtgcttaaaaccaatgcgggtttttctatcgtcgttgagcgcgggctggatgcgttggccggaatggatatggtcatcgtcccaagctgggatgtccctgagcatgctcctgaaccagaacttttgcaggccttgcaaaatgcccatgccgcaggagcacgtattgtcggtttgtgtatgggcgcgtttgttgtcgcggccgccgggctaatgaaaaaccggcctgtgacaacgcactggcgatgggcagctgactttcagcgcctttacccctgtgcgcaaatgaataatgacgtgctttatatcgatgatggtgacgttgtcacttctgcaggaacagcggccagtatcgactgctgtctgcatctggtgcgccaggcatggggagcagaagtggcaaacagcgtagcgcgtttgctggttgtaccgccccatcgtcagggtggacagcgacagtatgtcgaattaccggttcagaatacgcgtcgcgggataatttcaccaacgcgctggcctgggcaacggagaaccttgcgctcgccctcacgctggactgcgtggcggaaaaggcctgtatga

SEQ ID NO: 74767 - DNA, 295 bp, Glycine max
  Peptide Sequence Number=SeqID_191545
atgccggccgcgcagcaggtcgttgacgctggtcttgctgcgggtcttggcatcaacctgcttgacgatcaccgcgcagtacagcgaatgggtaccgtccttgctcggcagcgagccggacaccaccacgctgtacggcgggatgtagccgtaggtgatttcgccggtggcacggttgtagatgcgggtgctctggctgaggaacacgcccatgccgatcacgctgtggtgaccgaccaccacgccttccaccacctccgaacgggcaccgatgaagcagtggtcctcgatgatg

SEQ ID NO: 74768 - DNA, 836 bp, Glycine max
  Peptide Sequence Number=SeqID_191546
atgccggcgatggtcagcgatgtgcgcgatgtggtctacgtgagctggtgggtcgatgtgcgccacgcaccatcgccaccgccgggccatcattacgtggtccatgccggacgtacgccttacaccatcctcagctaccgtcacggccacttcgggccggcgttggccggaccgctgcgctccctgatgccgtctccaaggcagagcaactggcgctggtacctgcgtcgtgacgacgctccggacgggacaccggtggtgctgttcgatcgcaacgtgatggaccagctacccttcgtcgccggcgcgcgcgctctcagcgatgccatgcagccccacctgtccgtgcgcttcgagcacgtggtgcgcgccgatggcgatgagtacaccttgatcgaaggcgggcaggggagtgcgcctgccctgcacctgcagtggcgggccgctgcgggctgggaggatgaggcgtggcgggagggcatcggtggccgtcaggccctgctgcgcttcctgacctgccaggatgaggccattgcgcgcacctccgctgcagctggaaggcgagctgcagtgcccgcgcctgcaggcgatggacgtggcgctgcacgaggggctggccttccggctgccaagggtgccgttccggcatcacagatggccatgagcaccactgtctacggtttgaagaactgcgatacctgcaagaaggcgaccaggtggctggaccgcttcggcgtgccgtacaccttcgtcgactaccgcgacaacaagccgagcccggaaacactgctggcgtgggctgagcagctgggtggcctggccgcgatggtcaacag

SEQ ID NO: 74769 - DNA, 276 bp, Glycine max
  Peptide Sequence Number=SeqID_191547
atgaaagcggaagggccgatcttggtcgatttctgggatgaatggtgtgggccgtgcaagatgattgctccgattctggatgagattgccgaagagttcgaaggcaaactgaccatcaccaagctgaatatcgatcagaacccggctaccgcgcccaagtacggtatccgtggcatccctacgctgttgctgttcaagaacggtgaagtggccgcgaccaaggttggcgcgttgtccaaaggtcagctcaaagatttcctgaacgcgaatctgtaa

SEQ ID NO: 74770 - DNA, 246 bp, Glycine max
  Peptide Sequence Number=SeqID_191548
atgtcagcagtgcatgggtcacttccttctttggccacaataaactttatggctcttcagttattgctcgcatggcaagccataaattcgaaccatcacaaagtaggcacctggcaaagtcgcaatctcatactgttcggtttggctccttcttccctaactttggaagaggttgtttcagtgtggattgcctgtgaaatttacaagtggagacttttgtttgaaagggtgccaacaagtttctaa

SEQ ID NO: 74771 - DNA, 726 bp, Glycine max
  Peptide Sequence Number=SeqID_191549
atggccaccgcaccggctccggctccggctccggctccggctccggtgaagtcgcagcctctgcacaactttgccctccccttcttgaaatggggcgccagcggcaagaacaacaccaccaacgccgcccaccaccaccgcttccgccgtccctccgatcacgcctccgagcccgactcctccgaccccgactcccgcccccaccgcctcggatccagaaccgcgcgcaaccgattctcactccccctcaaaccaccaccgccgccgcctccaccacaaccaccgcacgacgacgacgccgacgactccgtgcagaagccgtggaagctacgcccccgcaaacccgcgctcctccccaacaagaccgccctcgagatcggcaccggaccttcccgaaaccaccaccaccaccaccatcacgccaccaacaacggagaattcctcgacggcggcgacaacaacccggcgccgaagtcgctccggctccgcgggttctcggacacgcagtgcagtgagaagaaggagaagaggaagttctggatcgctctctcccgtgaagagatcgaagaagacatcttcgtcatgacgggctccaggcccgctcgcaggcccaggaaacggcccaagaatgtccagaaacaaatggatagtgttttccctggcttatggttagtggggataactgctgatgcttacagagtcgctgatacacccaccaaggcttag

SEQ ID NO: 74772 - DNA, 772 bp, Glycine max
  Peptide Sequence Number=SeqID_191550
acgggatgcaaatcaaaatcacccgtcaggagattggtcagatcgtgggctgctcacgcgaaaccgtgggtcgtatcctgaaaatgctggaagatcagaacctgatctccgcacacggtctgctgttctcgttagtgcccgcctgctgcaacatggcgggactggatacgccgcacaaacgcttcttcaaacgcctgattgtgggtggttcgctgtttgccaccggcagtttcctgatgcaaatcctcaccgcttaccagataccgctgccgctgattttactggcgctgccgctgctgattggcgtaaccggcgaaatcggcccgctgcacgcgcgcctgctgcccgccacactcatcgccgccatctttacgctcagcttagtgggacgcatgccgatgtgggtgccgccgctgctctacattggcggcacgctgtggtacggcttgttcaactggttctggttctggctgtggaaagagcagccgatgcgcgaatcgctcagtctgctgttccgcgagctggcggattactgcgatgccaaatataccttactgacgcagctgaccgatccggagaaagcgctgccgccgctgctggcgcgccagcaaaaggcggtcgacctcattaccacctgttatcagcaaatgcatatgctgaacacatctccgtgagtttgcatcagcccgaagaggtgcagaaactggttgaggagagccacgccgaagcggtgattcgctggaacgccaagattatctcggcgcggctgcgc

SEQ ID NO: 74773 - DNA, 1056 bp, Glycine max
  Peptide Sequence Number=SeqID_191551
atggttgcgactttgagtcttccgatcatagacctctcttctccccatcgtctttccacagccaattccattcgtcaggcatgcgtggaatatggtttcttttaccttgtgaaccatggggtggacaccgattttgtgagcaaagtcttcgaccaaagttgcaagttcttctcgcttccggtccaacgcaaaatggacctggcccgcaaggaatatagaggctacactcctctctatgctgagacacttgatcctacttcactctccaaaggtgatccaaaagagacctattacattggtcctatagaagatacctctattgctcatctgaatcaatggccttctgaaggacacttcagaattactgccaaactggagacctacaatgaaatccttatattggaaactactaatttacatattcttcttatctttcccagggctgctggaaaaagtctgctgtctctgattgccttgtccttgaatctggaagaagattactttgagaagataggtgccttgaacaaaccagcttcttttcttcgccttctgcactatccaggtgaattgggatctgatgagcagatatgtggtgcctctcctcattcagattatggcatgatcactctcctaatgactgatggtgttcctggactgcagatctgcaaggataaagtcaaccaacctcaagtctgggaggatgtgcctcatgtagaaggggccttaatagtgaacattggagacatgatggagaggtggacaaattgtttatacaggtcaacacttcacagggttatgccaacaggaaaagaacgttattccgtaattactaaccacttcctcagttgctttaatctctatgggtcgagtgagtttttagacataggtgacagagcttgcgacccacactatctcatacacacacagaggggaggggtgaaaaattcacatgcaaattctgatgacaaaaaggtggcattcttctttgacccggcctcagactgtgtggtggagtgctttgaaagttgctgcagtgaatcatctcctcccaggtag

SEQ ID NO: 74774 - DNA, 165 bp, Glycine max
  Peptide Sequence Number=SeqID_191552
atgaacaaaggaaaggaacgcgtgggcgataatagtcaacctactagagacatgatgaggtggacggaggaacaacacaatcgtctacttcatgcaatgatggatgaagtaagactaggcaataggatagatggtagttggacaagtcaagcttatgcaaatatg

SEQ ID NO: 74775 - DNA, 765 bp, Glycine max
  Peptide Sequence Number=SeqID_191553
atgacgtattggaagagtagtgttcttgacaaatctccaattccaaaggtggtttcaagatctacaataccatgggtgtggacttgtcctcctgcaaaaccaattaagggttttggattaggttttattatttttggagagatgtctaaccttttaaaaatggacaagaagagtatatcaatgaaacttcctccatctattagaaattttctaacatcccaattggcgattccaaccgtaatcaccatcaggtcgtgtttctttggatcgactcacacaaagtcggcatttgtgaatgttattaaggggagtgatctcttagcacttgtggtcgggatatggtttacgcttctgatggcgtacaaatgcctttttcgagctgattttgtgcttcctctgctagcgaaaccatcgataatggatttaataactttgtgtctccctccttccccaactgttgaggccgttggcgaacaacccgggcttcaatgttatgatcatggaatacagtgcgacgctggggttgaggtcttgaattttgatggcaactactgctatctctccatgaatgaccttaacaattcgtcattagcatggcgtagattgaccaaagctactgaagttgctgtgaatgaatcaatagatcgtgggggtaggcgtttgtaccatgttagcgttggtctcttgagggaggtgggagctttaaaggatggagagtgtggtggagttagtggtggtggtgggtgggggagggggggtggatga

SEQ ID NO: 74776 - DNA, 363 bp, Glycine max
  Peptide Sequence Number=SeqID_191554
atgtttttcgagttcaagactttcctcgcaactccgtctatccttatttggcctacgccaaaagccgagttgttgttacatctatccatctcaaactctgcaataagctcagctctcttacaagaagaagaactcacgggaagaatcgtgacgtggttaattgagctctcgaagttcaacctacagttcgagccactaggccccatcaaagagcagtacctagccaacttcatagttgtactccctcctacaggggacaataacgagggtgggtggactttaaatgtggatggagcctccagtagcaaggacaatggttcaagtgttaccttcaaaggactagataacatctcaattcagtaa

SEQ ID NO: 74777 - DNA, 393 bp, Glycine max
  Peptide Sequence Number=SeqID_191555
atggttggatgtctccaatattggacctactcagtcaatgatgccttaccccaggaagtagtggaagccaaaaaggtgcatagggaaatttgcgaaatgcacattagaaggcgcaacatggaaataagagttatacgagctggttactattggccaaccttaaggacagattgtactaagtacgttaaaaaatgtaaagaatgtcaggaattcagcaatactcattatgcgcctcctaaagagcttcacaacatcacgtctccttggcctttcaccatgtggggaatggacattctcatgccatttcccacgaccaaaagccaaatcaagttcctcctcaccgaattgcgtaaaaagtctgtcaaagatactcaaggggttgtgggtagatga

SEQ ID NO: 74778 - DNA, 225 bp, Glycine max
  Peptide Sequence Number=SeqID_191556
atgaatatcttgacagcacacgatcaagggtgggaacaggagttaagtccttacaatcaatatgaagaagaaagaactcctaatcttgaaagtgtgttcgaagaattcatggcataccatgctagctcaaaagccaatcaaaattcaatgaaaaatcatgaaattcattttggcaagagctactcaatagaaaactttcaagggggaccagagttacagccttaa

SEQ ID NO: 74779 - DNA, 841 bp, Glycine max
  Peptide Sequence Number=SeqID_191557
acctactgatggagtgatagatattgctgtttctgagcatcaaattgccaaggaaatcactgccaaacaagtccagcattggccgaagaaagggaagctttcagcagggaagctaagtgtgaagtatgcaattctacacaggattggtgctgcaaactgggtacccaccaatcatacttccaccattgccacaggtttgggtaaatttctgtatgctgttggaaccaaatccaaatttaattttggaaactatatttttgatcaaactgttaagcattcagaatcttttgctgtcaaattacccattgccttccctactgtattgtgtggcattatgttgagtcagcatcccaatatgttaaactacactgactctgtgatgaaaagagaatctcctctatccctgcattacaaactgtttgaggggacacatgtcccagacattgtctcgacatcagggaaagctgctgcttcaggtgctgtgtccaaggatgctctgattgctgaactcaaggacacatgcaaggtgctggaagcaaccatcaaagccaacacagagaagaagatggagctggaacggctgatcaaaaggctctcagaaagtggcattgatggtgaagcagctgaggaagatggtgaagcagctgaagtagaagaagaagctgctgaagaagaggaagaagcagccgaggaagaagaagaagctgctgagaagaggaagatgcagcagaagagacagaatcagatgatgattctgaagccaccccatgatcatcagaccctttatgtttgcttttcacttttattagctaaaggggcatgtcccttgaacaattactaa

SEQ ID NO: 74780 - DNA, 585 bp, Glycine max
  Peptide Sequence Number=SeqID_191558
atgggcataaatatttttattgtcgcgcttattacatttgaaaaagaacccaacatcgtcattgtcgccatagccctagccgtcgtggtcattgtcgccgttgtggtcattgtcgctatcattgtttttgttgactacaagattccattgaaaagtagtcatcacagggcagctttgtctctcatggacgccaggatatgcagttcccaatgtagttatagatacaatcacagggacttgtactgtctcctgagcctcagagtttgtgaggggtcgacaatcatccacaacgtccttttgggaaatgatcaagtgaaggacggtgttgaggaagttcaagatgctgatgctcgtgtccctatacccactcaagaggataaacagggagctgagggatcgacgaaacttgttgataggttggaacttgatgacaatcccctataccagatgacattgacgatcccgcaactttttctcaagcctttgcaattgtcatgggatgcaactatgtttccactacaaaaaaaagagtctatttctgatggccataatccatcggaaaactcaaaaatccatcatcgataa

SEQ ID NO: 74781 - DNA, 1521 bp, Glycine max
  Peptide Sequence Number=SeqID_191559
atgtcagttttcttcttcactcttctagtgcccttcttagggtttctctttttcttcaaaaccacaaaacaacagcaacgtagtcataataacaaccatgcacctctctcacacccgatcattggatgcctcgtctccttctaccaaaaccgccaccgtctcctcgattggtacaccgaacagttagccaattccccgacacagaccatagtcgtgcgccgcctcggcgcacgacgcacggtggtgacggcgaacccccgcaacgtggagtacattctaaagaccaacttcggaaacttccccaaaggcaaacccttcaccgaaatcctcggcgactttctcgggtgcggcatattcaacgtggacggcgagctgtggcacacccagcgcaagttagcgagtaacgcgttcagcacgcgctccctcaaggacttcatcgtgaagacacttcaagaggaggttcaacaaaggcttgttccattacttgagcacgccgcacgtgagaatcacgtgatcgatctgcaagacgtgttgagtaggctgacgttcgatactgtgtgtaaggtgtcgctgggctacgacccgtgctgtttggacctctcgaagccgctgccgcctcttttgacggcgttcgataccgcgtcggaggtcagcgccgcccgcggctctgccccggtgtttctggtgtggaagatgaagagaatgctcaacgttggatcagagaaagcattgaaggaagcagtgaagctagtgcacgagtccgtgatgaatattataaaattgaagaaggaggaaattaggttcaatagaaaaaacggcacggatttgcttgatcgtttgttggaggcgtgtcacgaggaaattgtggtgagggatatggttataagcatgataatggcggggagggacaccacttcggccgcgatgacgtggctgttttggttgttatcaagacatagggagcaagaagcatcgttagtgaaagaggtttatgatgaaaataaccaaaatcagggtttgggtttggattatgagtgtttgaaggaaatgaagttgttgaaggcatgtttgtgtgagtccatgagattgtacccaccagtggcatgggactcgaagcatgctggtggtgctgacgtgttacccgatgggacccacgtggagaaaggggatagggtaacctattttccctatggaatggggagaatggaggctctgtggggggagaattgttgtgagtttaagccacaacgttggtttcatgaggagaatgttgataatgggattttaaagtgtgtgaatccttatatgtttccggtgtttcaggctgggccaagagtgtgtcttgggagggaaatggcttttattcagatgaagtatgtggtggcttctattctcaaccgctttgtgatttcgcctgtttctgatgagcaacctcgttttgttcctcttctaacggctcatatggccggagggttcatagtgagggtccacaagagaaatggaactgaaattgagaagtaa

SEQ ID NO: 74782 - DNA, 156 bp, Glycine max
  Peptide Sequence Number=SeqID_191560
atggccaaatttttaacttcttcatcaataggcatgttggctacaatcggggatggggatgttggaggtggagatggtgtaggtgcaacatcagaatccctgatcggaatagatatagtagacaaggatggggtagatgatgacagactatcttga

SEQ ID NO: 74783 - DNA, 544 bp, Glycine max
  Peptide Sequence Number=SeqID_191561
atgaaggcaaagatattagagaatgttttaatcatgtctagattattgcgatcctcttcccgtatctcttttcgctcaaattcctcctcttcatcttcttcaagaaacaccaatctcttaaatgatcaagataaccagacccaagaggtcgccccaaaacacaatctcttcgatgaggaagtccgattcgaagatattaatcaaaacatggatgactggaacattccagaaatccctcaggatcaactatacgttcctgaaacaattaaagacaaacacaactttgattacataatcaaaacagtagaaaacaatattcctctaggacaagatataggggaagaatttcatctactttcaaaaaattcaatttatgaacatagccgtaagtataaatatctacacatcggttgtgtacaagtagccatcaagcccttaattgatatgggcatagatgcagcagttttaatgtgtctaagagatattaggcataatcaatttgaagactccctaattggaacagtcgagaccagcctaggacaag

SEQ ID NO: 74784 - DNA, 1161 bp, Glycine max
  Peptide Sequence Number=SeqID_191562
atgggcacgctcatgtcgatggcgtcgccccacagatcatcaacccaggtgtcctcggcggtgcgcagggccccgaaatccacggcgggcgcgaaatcgggcgggggttgggtaattcgcatatgggggtgttgcgttcgtgaatcggagacccccgcgcgccgcgcggacgcggcgggggccgaagatcgctcagtcgatcttcacgttggcttctttggcgatgcgcttgttcttggcgatctcggccgagatctgtttggcaaacgcttcggggctgttggcggccggctcggcgcccagcgcttccaggcgcgacttgacgtcggcttcggcgctgaccttctgcacggcggcgttcagcttggccaggatcggggcgggcagcttggccggggcgaccaggccgaaccacgaggggtcgttgacggcgggcaggccgacttcggcgaaggtgggcacgttcggcaggctggccacgcgcttgggcgcggcgacggccatggcgatcaggcggccggactgcacgtgcggcagggtcgagggcaggttgtcgtacatgacgtcgacctggccggccagcgcatcgttcagcgccgggcccacgccacggtagggcacgtgcatcaggtcggtgcccgaggccatcttgaacagttcgcccatcatgtgcgagaccgagccgttgccggccgaggcgtaggtcagcttgcccggctggctcttggccagcttgatgaactcggccatgtccttggcctgcaccttcgggttgatggtcatgatgttcggcacggcggccaggttcgagaccggcgtgaagtccttctcgccatcgaacggcaggttcgggtagatggccggattgatgccgtgcgtgctgacggtggcgatgcccagggtgtagccgtccggcgcgctgctggccacgaaggcgctgccgatcgagccgccggcgccgccgcggttttccaccaccacggtctggttcagttccttgccgagcttgtcggcgaacaggcggccgacgatgtcggtggtgccgccgggcgggaacggcacgatcaggcggatcggcttgctcgggtaggcgtcttcggcatgggcgatgcccgaggtcagcggcgtggccagggtcgcggcggcgacacagagacctag

SEQ ID NO: 74785 - DNA, 627 bp, Glycine max
  Peptide Sequence Number=SeqID_191563
atggtggaggaattctcacatatgaaaagcgtagttattgaaaatggaaaggtcgcaataagagagctgccattacctaaattacagcaaggtgacgtattagttaaaatgaaggcttgtggattgtgtggtactgacatagagaagatttgtggacaatacactgcatcgcaaccaatattaggccatgaaccagctggaataatccaagaatccacggttgattggttaaagcctggagatagggtttttgcacaccatcacgttccatgttatgaatgctactattgtaaaaagggaagtccaaccatgtgtccatattatagaaaaaccaacttagatcctggtggattttcggagtacttcagagttccagcctggaatgttgtacgaggcggaatattaaagctaccagacaatgtgagctttgaagaaggggcatttatagaacccttggctaccgttattagagcgcaaaggagagtaatgattgataaggatgatatagtttttatcgttggagtaggtcctatgggattattacacgcaatgatggctaaggtaaataatgcgggagtcgttatagcatcagatgtaagtgagttcagagtcgaatttggatataag

SEQ ID NO: 74786 - DNA, 519 bp, Glycine max
  Peptide Sequence Number=SeqID_191564
atggacgcagccgagaggctgcgtccttttttattggcgatgcccgcttggggagggggctgccggtatacgctgaacggaacacggccagacatgtccgtgacctacgaggcacctgttgactttggtctgcaccgcatcaggcgtaatggtagggaagtcgccttgatctacgagggcgatgcccccgaaaagcctgtgccaggaagcacgccggatctgcgcttcacggatggcggatatgtcgtgtcggggtatgcaagggcggaaggaccttccacccggtacgacgtctacgttcgacccggatcatctggcgccggttcgctgcacatccgaggttctgcagcgacggctgatgaactcgccagcctggccgccgtcgttgggggattccgtgtctgcaacttccagcaaagcaggcgcgcacagacgttgacctgtccgaggcgtgccgagtgggggcagcgattgtcggagtgggtcatgcgtgcctccacgagcgggaagtcgaattag

SEQ ID NO: 74787 - DNA, 374 bp, Glycine max
  Peptide Sequence Number=SeqID_191565
ttccgggaacagcgacaggatgcggccggacagcgagatgtcacgggtttccaccacgatgctgcggtggcggtgtaggcgccgacgatcggcagcagcgactgggtggccaggaacggggcttcgtcggtcagcgtgtagaggatcttggacatgggggacttggactctgtagcaatgctcaggggaaggccggcgccagcgccgggccacgtgcaaccgtgtcgctttcccccgtcgccgtcagggtgggcgcgcggcggggaaacccctgcattgtcgcgttttcagccgcgcggggcaaagccacgccatacgcgccggtactggaccgctgtgtttcgtcgttggctcgcttccggtctggaagctga

SEQ ID NO: 74788 - DNA, 282 bp, Glycine max
  Peptide Sequence Number=SeqID_191566
atgacatggtggatgtacctggttgagcgatacatgaagatcttaaaagggtatacaaagaatttacatcgtcctaaagcctccattgttaaaaggtacattgcaaaagaaaatattgagttttgttcaaagtacattgaaaagaaaaaacttgttggacttcccgagtctcagcatgacgagagattgagagttcgtcacaaatccttagtcaaggaaagtaacccaaaaatgaccaagaatatggtgttgaaagagcataacaagactttcttaaattag

SEQ ID NO: 74789 - DNA, 606 bp, Glycine max
  Peptide Sequence Number=SeqID_191567
atgtcgcccaaatccaagaacgccctggaggtccagcctccaacgaagtctacccgctcctcaagtcgctccccgaggccgacaaaccgcaagaaggcacccgtggaaacgctgaattatggttcggatggagtgaaggacaacagtattttcagccttcctacttccgactacaaggccttggttctcgtcaccttggtcgctactgctgtccgtctctttagaatctatcagccgacaagcgttgtcttcgacgaagtccattttggtggttttgcgtcaaaatatatcaagggccgctttttcatggatgttcacccgccactcgctaaacttcttattacacttgcgggttggttggctggattcaatggcgatttcgatttcaaggaaattggaaaggactatttggcagcaggagtcccatatgtggcaatgcgaatgctcccagctatcatgggtgtgcttacggtgtccttgatgttcttgacattgaaagcatcgggatgtcgcaccacgactgccgtgctaggtgctggtgtggtgatattcggtgggttgatctatttttctcagtctggatacccacacacgctaactacttaa

SEQ ID NO: 74790 - DNA, 231 bp, Glycine max
  Peptide Sequence Number=SeqID_191568
atggtcattctgcgccctttgtcattcaggagcagtgagtcgagtggtgggcggagacaaattatggccattctgaacaccttttcgccatccagaggcgatcgtgtccgatggcgcgcaaagacaaattatggtcattctacacctttccatccaggcccgatcatgtccgatggttccgctggcggggagattgaccgaccgaatggtgtttcgctcgaacgaaattag

SEQ ID NO: 74791 - DNA, 285 bp, Glycine max
  Peptide Sequence Number=SeqID_191569
atgggtgccaagtacctcgaagtggtcaaacgagggtcgcatcccaacaatggatggtccccgaacgaaattaggacacgatcgagcctgggtggcaaggcgcagaatgaccataatttgtctctgtatgccaccagacatgaccgcctctggttaacaaaaggcgcaacagacgacgttagtctctacatgccattggacacgactgtgtatgaatggcgaaaaagtgtgtggaatgaccataatttgtctctgcatatcatcgggccccccgcctctggataa

SEQ ID NO: 74792 - DNA, 405 bp, Glycine max
  Peptide Sequence Number=SeqID_191570
atgcatacattaaaacatgcttacaacattgaagaagtttatacaagaacacaaaggaaaaggggaaccgatgaaagggaaaatacaacttttgcacaaaagattaataggcctaactctctaaaaacggtccccagtggagttgtcaactgtcgcaacctatccttcggcgggagggcgacatggggctcacgggtgcgtcttccaggcgaggaaggcgcacggagtcgccaccaacgtttattcgaggaaaacgtcataaaaaccggaacgtgtggtctacgaactttaagtatgaaaggttcaggagttgtttttatgcacggtgaagggtgtttccctcgctcctacgtatcctcaattgcgatgaggaaatcagacctacgtagttctttcgagaactaa

SEQ ID NO: 74793 - DNA, 252 bp, Glycine max
  Peptide Sequence Number=SeqID_191571
atgcctaaatcatatcccaacatgcctgtgaagcaagaagtatcaacaggagtcaagccaaggctattatgcaagcaatcaatggggcaaaacacaccgaataaaatagatgatgatggctcaaattatcaccaaggcgaaaaacaaggaattcaattcacaaaatgccaagaaactcctatttcaaaaacaattacccattacctgtacataacccaaaattcaaagagaaacatgcaatgttgtacataa

SEQ ID NO: 74794 - DNA, 252 bp, Glycine max
  Peptide Sequence Number=SeqID_191572
atgcttcactcagagattcatcaaggaactgatgaaatgaagagattgcagctttccccttctgcagtcttggactctgggaagtatttccttagaaacttttcaacaacttcttccgagaatgagaataggctgagtctaatagcttcatctatgatgcaatcctaccccgcaagggcattggctagaagactccaagtagattgggctagagatccaaggaaaggccctagggttctcatgagccttagg

SEQ ID NO: 74795 - DNA, 159 bp, Glycine max
  Peptide Sequence Number=SeqID_191573
atgcggggttactttatggttactcgtacctttcgtcaaccaggggcaaacgagcccgttgacgcaaggagactaacatcgtcttctgcaccttttgtcgtcctgacccgtgaagtcagaaataggagtagtgggggcaagatacgcgggttaggctaa

SEQ ID NO: 74796 - DNA, 102 bp, Glycine max
  Peptide Sequence Number=SeqID_191574
gcttgttggcttcgattgacaaagggtgtagaagacgactatgacagaaatcgtggagcggccgacaaaagcgaggctcttgctcctatgtatcctcaatga

SEQ ID NO: 74797 - DNA, 516 bp, Glycine max
  Peptide Sequence Number=SeqID_191575
atgattagagccaatgttgagctagatcaagaggcaactatggaaaggttcattggaggtttaaagaaggcgataactaatgtggtggagttccaacattatgctgaaatggaggatttgttgctcaaagcaattcaagtggagaggcaaatgaagtcaaaaggcccttccagatttgcttcatcttctaactctacatggagatcaaactggaagaacaataaaagtgatgcaattcctaaagatgatgggaaggctaagtactcagttgttgcacctaatgataaaatagaaaataataccttttctagatcatgtgatatcaagtgttttaggtgtcaagaagttggacgtattacttctcaatgtccaaataaaagaacaatgattgtgagggataatggagaaatagaaagggatcaagtgatgatgaaatgctaccattggaggattgtagtgacgttgaagttgctgaacatgtacatggagttgtacttgctacaagacatgctctaa

SEQ ID NO: 74798 - DNA, 348 bp, Glycine max
  Peptide Sequence Number=SeqID_191576
atgacaaaggtgatccgaccgccgatcacccggaccttcatcgagaagtattgctcaccaaggcaggcgcagggtgatgcacctcaaaatgcggccaaccatcgggggcaggtgcagatacatgagtgtctctaccggttcagcctcagtcagcaggggaagggtttcgttccttttgtgtgccctactccagagcagtttggggctgaggtcgcatggcccggaggctggcccgatgcccaagcaggggaggcgcctgcaggatcccccgacgatgcagaggaggcccgtacggatgaggagatgatggatttgcttggtttcttgggaggaagcggagccacgtga

SEQ ID NO: 74799 - DNA, 186 bp, Glycine max
  Peptide Sequence Number=SeqID_191577
atggtcattctgcgccctttgtcattcaggggcagtgagtcgagtgataaacgcgcagagacaaattatggtcattttgcgccctttgtcattcaggggcagagcagcaagtcgagtgataaacgtgcagagacaaattacggtcattttgcgccctttgtcattcaagagcagcaagtcgagtga

SEQ ID NO: 74800 - DNA, 384 bp, Glycine max
  Peptide Sequence Number=SeqID_191578
atggaattcactaatgtttttttagaatattttcctcaaggattacctcctttaagaggtattgagcatcaaattgaccacattccaggttctcctatcccaaataggtcaacctatagaacaagtctagaggaacaaaggaaattcaaaggcaagtggatgagttatcgcaaaaaggatttggaagggagagtcttagtccatattttgttcttgcgatcttggttccaaagaaagagagagcatggtgcaggcctaggatcttcttcatcaatggattcctttgcttcttggaagatgaatggcagtggaatggagaaggaagagagagaggagacgccacttcaaggagaagatgagtctagaagaagctcaccaccatag

SEQ ID NO: 74801 - DNA, 165 bp, Glycine max
  Peptide Sequence Number=SeqID_191579
atggattttggaaagactaatgaagcatccaattcaaagctggttcatgacttcgacttgaacattgcatatgtggaggaatttgatcatgtgaatgctgaaaacgagttttcatcgcccattctcgtgaatactactcagcaggcttgtaaaaatagcattgaa

SEQ ID NO: 74802 - DNA, 123 bp, Glycine max
  Peptide Sequence Number=SeqID_191580
atgtcggacgaagagcaccatttcgagtccaaggccgacgccagtgactctaaaacctaccctcaacaagcaagtaccattcacaagaatgactacatcgtcatcaaaggccgcccctacaag

SEQ ID NO: 74803 - DNA, 213 bp, Glycine max
  Peptide Sequence Number=SeqID_191581
atgacagaaaccgtttgtacggataaccgcttgggtatctccgtacgtcacctgacttcacgggtcaggatgacagaaggcgtgaaagacgacgtcacgatagcaaaaggtggggtggttgacaaaagcgaggcttttgctcctacgtatcctccatttgtgatgaggaactcagacctacgtagttctttcttttgtgatgtgcgagactga

SEQ ID NO: 74804 - DNA, 289 bp, Glycine max
  Peptide Sequence Number=SeqID_191582
atggctgagaagacaaagaaaaaattggaggaagctactcaatctagaagcactaagggcgtgattgaccctccatctcccattagacgacacgtgaagtggaagatgacctgcaccaagaaaattgggcagatgacgtttgatgcaacaaaggaaatttctgagaagattgattctttggaggagcaggcgtcacagggttcctttgtcccctatggacgtcaggatctcctgactgctgccatttggcgaccagaacaccctagccgtgtgcgtgctgttggagccg

SEQ ID NO: 74805 - DNA, 303 bp, Glycine max
  Peptide Sequence Number=SeqID_191583
atgggctcaaaaatctaccttaaggttcatgagaaccctcgggccttcttcaacagctctagcccaatcctcttggagcctcttgctcatggctctggtaactggtcccttcctagggaggattgcatcagatgctttgttgtccatggacgtcgggatgtaatggctactaccattgggcaaccagagctccttggtcgtgttcgtgcagctggagccggtgttatgatcaaaaactactttggactggctttaaggggttcccacacctcttcatccatggctcctaatgaccttgagtag

SEQ ID NO: 74806 - DNA, 234 bp, Glycine max
  Peptide Sequence Number=SeqID_191584
atgtcgttttacattggtcgcgaggcttccaagctatggaagagattttgtgcagagacaactaccgagctcaacctccttgcggagaattggaagtaccttctcgctggtattgtttttcaggaaaaacacaaggaactggtaactgctgcattgtttgtcatattctgcaactcagaggatgtggcattcgatgcatgctcaaaatttgatcaattactgcgtctcaaatga

SEQ ID NO: 74807 - DNA, 177 bp, Glycine max
  Peptide Sequence Number=SeqID_191585
atggtggaagttaccgacgagaggagacgtggagggaagcatgatgatggccacaagagtcacgtggttcatcaaggacctttctattgtaatacacgtggtccacaagagtcacatgatatatcaggtcttaggctttcaggccagacatttatgcaggtcagactcaagccttaa

SEQ ID NO: 74808 - DNA, 160 bp, Glycine max
  Peptide Sequence Number=SeqID_191586
gaccaccacccgacagcttgcggggtacttgacgctacttcagtgttggatctatgagcactttcctagtgtgcatcgtgtgacccccaaggcctacactccgaagagtccgtcagggcctctccctcctgatttaggtccaacccagaaaacattttag

SEQ ID NO: 74809 - DNA, 273 bp, Glycine max
  Peptide Sequence Number=SeqID_191587
atggctgagggatttgagttgaatgtcatggtggaggaacgaatggagtggatgaacggattgggctatgattgctggtcgtggacgaactgggcaagaggattgaaatgtgaggtggacggatttggtaaaacatctagagaaattgggtccaacaacccaggtaaatcgactaaaatcgtcaacaattgtaagaaaatacttgtggccatgaatggaaactttagagaatgggccccaaatatccatgtgaatgagatccaatatttttga

SEQ ID NO: 74810 - DNA, 264 bp, Glycine max
  Peptide Sequence Number=SeqID_191588
gatgcagaaattattctgcacaaagtggatgcaaatggagataagtcggctaatgtggacgcatatgatccaatgcgtggcctgataaagtacaactttgatatttacgacaagccagtggaattcaaatttgatgggagtatatgcatgagtggagtgaaaccttgggtcaaggttccagctatgcattccttgagccacagtcgttggtggtttcaaaggatacacatggcgaatgccaacaatatcttgaaagatggctga

SEQ ID NO: 74811 - DNA, 135 bp, Glycine max
  Peptide Sequence Number=SeqID_191589
atgacgtgtgaagaagtggcacgtgggagtgtgttgaggtttctgactgcaagacctccttggttgggatgcgctgaaagagacaaccctgatttggacccaagaggtcgtcccaaaacacaatctcttcgatga

SEQ ID NO: 74812 - DNA, 888 bp, Glycine max
  Peptide Sequence Number=SeqID_191590
atgactcttgctcaggtgtggagtgttctctcatattccaacctggctcctacttcacacacctcagacctgatagtagatagagctaggatgatctttggcctagtctctcagatggacatgaatgtgggagcccttatctctagccagatcacatctatggtccagtctaactcttctagacttgggttccttgctctgatcaccgccctgtgtaaggccagaagggttaattctgacagcttggtttttgagcgcctaagcctagtcatcaacttggcctatatcaggaaaaactgttggaatcttgatgatctaacagtttctatcagaggggccaggagggcaaggacgaggccagttgagcctccttccacttctacagctcctattccagcacgtacctcatcaacttcttctatcccagcttctgcagattttcagcgtcttgaaaccatgcttcagagatctattccttcagtggaacagttcactgagttcgtagcctggcacgggactcagtcttctcttcgcaaggaagatgaaggtcccacaacccaggtaccacagcatgtggaggatgattcatccaaggccaccattccagagccttttgtcagggggatggaggcagaggagacacaggaagctgcggccacacctgagagatctcttgaggcagcttctgagcccccagcacaaggggaggacataccctcacctcagcctgcagcagacccttccactcttgtcttggacttatcagagggtcaaaatgctccagtcctaacactgaacacttctcctccaactactccagtgcttcatctgacagatgaggaggatggtcagacacaggatacacaggaccagtcacaggaattttaa

SEQ ID NO: 74813 - DNA, 609 bp, Glycine max
  Peptide Sequence Number=SeqID_191591
atgggctacgcgggagtacgtgagctcagttggaggtgggcaacagtggatgtggtacctggagatatgtcgcgggggtcaggagaccttggggacgtcaggcgagctcctggcagtcaacagataaaaggaacaaagaccacaaagcaaggaggcttgtggtggctggccagctatgaattttgtgtgatatatgggttgtggcctctggtaatcgattaccaagggcttgaaaacgaggttgtggaggcctctggtaatagattaccagtctgtgtaatcaattacacagaggaatggggcactggtaatcgattaccaatcgtgatggcggcacagctaatccatgatcgagtggagatggagtgcctagagggagcttgggggaccctcgaaggcaacacgaggtgccgatttcggggcaccattcgattcacggctacttctttggtgcatccagatgaacctgcacggacgcttcagcgcacggtggagtggatactacccacgcctacaccatatcgtctagtggcccgggggagatggcgatcagcgtcggcatctgaggcagactctacggaggatagtggcccgggggagatggactga

SEQ ID NO: 74814 - DNA, 756 bp, Glycine max
  Peptide Sequence Number=SeqID_191592
atgggtgaaatagaggaggtgcaagagcaaatgaacgccaacatggaggccatgaaagagctaatggccacgatgatggaggccatgatgagcatgaagaaaataatggaggtcaataggggtgcagttgccgctaccagcgtcgccactgagcacctaatgttgcgcacactcccgatgagaaagtcaataactccactcccatactcattgagagccaaaaacctcaatctgatcatgcacgtccctcaacccatgggggagacacatgaagtacctcaccacaatctagccgacttcaagcctcgcctcggatatgccactgaggggcaagcagttggtggtgtacccctgccaaacactttggagggccctcaatttcgcccacaaccacaacccttgcattttgcggtggggagagtccctcctgctatggtggaaagggggaaatttgatcatatagaggagaggctcaaggccattgaaggaggtagagattatgtttttgctgacatggcaggattgtgcctagtgcctgacatcgtcatccctctgaagttcaaggtttcggatttcgataagtacaaggggactacttgtcccaagaatcacttgaagatatactatcggaaaatgggggcatacttgaaagatgaaaaattacggatgcatttcttccaggaaagtcttactggggcagtgtcacctggtatactaatttggaaccttctcgagtccattcatggaaggacctaa

SEQ ID NO: 74815 - DNA, 285 bp, Glycine max
  Peptide Sequence Number=SeqID_191593
atgaggttgagaatgagagaacagagcatcatcttatgggaagtacacaaaatctcatattttccagtacaggcagttaagaagaatatacatgggttggatgatctcataaagttagctgattatgtcgagtgtgctgcacggtttccacgggcatgtactggtacacatgcaccattcacttttaagaatcccatctccctcagggtagggaaaaatgtaattgctttgctatgcttgaccgttggcttacagctgaatgaggcttacacccaaaaagaataa

SEQ ID NO: 74816 - DNA, 505 bp, Glycine max
  Peptide Sequence Number=SeqID_191594
atggttggttgtgaccctaaagggaccttctcagttggggctaagctttcccgctctaggatcttttttggcttcctctcggactcgccatacgaggtcgccagtctctttgtcgatgattccccaccttctatggggatcatggtgtttgtgccatatgcctttagacttgtcaagtctagtacgcagggccctgagaatgactcgattagttgcctctgcatgtccgttagtctaaggatgttcaacagagtgacaaggtgcttgatccctatccttgtcagaagtcttcgtgaacttttccacctcgctggccgtaatttcttgaagtggtcttgcttctatccacttggtgaagtagttaataatgacaagagaagtgcatggaacgtctgcaaactcttgacatcttcggcatctcttggtaaagttgagggtgtctatcctaagtgttggttatttgtagcccgctcgcaccgctttagtggccaaggagcgtcctctg

SEQ ID NO: 74817 - DNA, 240 bp, Glycine max
  Peptide Sequence Number=SeqID_191595
atgcccttatatcatcttacctataagggagcaacaaatatacacggtgatggacggcgtgactcacggagggggcgagagcttcatgtcgtgacaacatcgaaggagctacaatggagcggtgagggaaggagctgtggtagtgcaggcgcaatcctaacaacaaagatgacaaaggttgtaaacaatattgcaatcatatcaatacttaatccaaacatgactctcgcaaaaacctag

SEQ ID NO: 74818 - DNA, 303 bp, Glycine max
  Peptide Sequence Number=SeqID_191596
atgttgtgcgggttggtattgagacgctctttgagaagtctctcgacttcctcctcagtgaaggcagtgtcggactcggcggtgaggggaatgagtaggttggtgaagaaaggggtgggggttgtggtggaagtgcatgaagaagaaggcaatagcggagatgaacaaggtaaggccctggaaggagaagtgagcatgaacattggtactacacaaaagaagaatgtgtgtcagaatgaggataaggctagggtgcgtgagaatgacactaattttaaagaaaaattgtctttgaatacttaa

SEQ ID NO: 74819 - DNA, 459 bp, Glycine max
  Peptide Sequence Number=SeqID_191597
atgcacatctacaatgatgaccacatgagcgtgcatgaactatttgaggaaatcctcaagaaagacccacttcgcgtggaagcgttccacgacctcatcatggagacttctaagacaaacaatcccttgaaagggctattgaagagagtggaagaagcaaataaggtgtgcaagaagcaaaaaagggattccgatgttagagaagtttacttgaggagattgaattgcaaaaacaatgggtgtgtcttcaaattcgaaggaatcgatggaattattctcttcttcttccccgatgatttgcatttttcaaagaaactctttgtcattggcctcagcgaaggactcatcactttcactagaatcttctctctagaagttgcttgtgacgtcatcaaagttgaaaggcattcttatgttttctacaaggccaaactcgatatctggatagtcacagtttga

SEQ ID NO: 74820 - DNA, 150 bp, Glycine max
  Peptide Sequence Number=SeqID_191598
atgcagcatcctacagaatctaaaaaattttgtgaagaacttaccaacaaagtgagagagaaacaaacagacttcggagatcccgaggaagatccgaaaggtgattgggcgaggaattcaatgcaggaaggaaccaaagctgagaagtag

SEQ ID NO: 74821 - DNA, 2832 bp, Glycine max
  Peptide Sequence Number=SeqID_191599
atgggatttggtttaagccttcgaaagaaaagctcaaagcagcaaagcaggtcaaagacagacaaggagagttctgatttgcctcaacccaatccatgttcaaaggattcacttaagcttaaatcaaagtctaatgttggtcaagcaagcagtgattcttgtcataaagcaaagcatgatgtaaaaggaaaggttcagcacttggatagtgcaaagggaagttcaactcaacctgatgaacttgtcaagtacatgtctaatttgcccagttttctcaagcgttctgatggaggagaaagcattcaagggaaggctttaaatgttggagttcttgattggtcacatcttgaaaaatggaagaacaaacaaacacatacaaaggcagaagctagcaatttcacatcatccaatagcagtaaagaaatatcctcaagggcagccactacatcatcgtctgccacttcgggtggccataataaaaagcttgatggtagaaaagtttcgagttcttcacgaagcaagggaccttataaagaaggccttcctagaagatctaaaatgtcttctcagaatgtcaagcactatcaacattctgaaactgaaacaaagacccttggagatgagcttgggatgtcaccctcggaatttggcaaaactcagtcagatacatcacttcgaagggtgaaagttaatgactatgatgaaataacttcagtagttgaaagctctgcatccaagtccaggcataatgtggtctcactagttccgaatgaaaattcaagtggtagggatgttgaagaaaagaagaggatggagggtttacagcagcatagcctcaagaaaaaggagaggagtctaaagtccagttctgataagagatttccatcattagaatcaaaaactaaaggagtctcatttgattctcagaagaaaatgatttccagcagcagtgaagccaagaaaaagatggatcagtggcaggagtcagatattgatgctggttatgaacaaaatcataggatgcctaataatattgtgttgcttcgtcccccaagagttctgcaattgaaatcagaagactattttcagcattctcaatcaagaacttcatctgaagaagattttttggaatcaagctggagtagtttgtcatatatgtccattcctgaggaggtttacactgaagatgtacattctaaaattcctcattcaagtgtactgccttctgtgactgagcttgcttcttcagaaacattgcaacatagtatcaatactgatctagatatggatcgttcttctgttttatctaagaaaccagcatgctcaaatagcatatctagtctccaatctgaaaatacttgcattgaaaaggatgtgttagatatcaagccaaaaaatcagtgtgctttcagtaatgtgctgaaatcactggaccatgaaactgctgagctgacacctcagaatccctcatctaattgtcggcttagcttaagcttaagcttaagccggattggaagaagttttagtttcaaggaagggtctatttcaaaacttagctccacgtatgttggtgcaaagtctggtccagtgacacctgaatcttatgcttatttgaataatcatagcgaagatatggtaaaaggtcataacagaactatgtccagccccttcctaaagttattagatcccatattgaagcgtaaggcatcaaacatacagttttcagatgaacaaagtgtgacatcaaaaggaagcatggattccatcagcttgaggacaatcaatctgtctgatgaaaagagcaaggaatcaccaacccaagcccttttgcagttaacaataagaaatggagtacctttgtttaaatttgtgctcaacagtgaaagaaaggttcttgctgcgaccatgaagagcttagcattgccggagaaggatgatgtagactgctatttcacattctaccttgttaatgaaattaagaaaaagagtggcaaatggatgaatcataggagtaaagaaaaaaattgtggatatgtctacaatattgttggtcagatgaaagtttctagctctaaaaccactgaatcaagcaacgagaactccaagagagagagtgtggtgaaagaatatgtgctaatgggagttgaagttgaccagctagatcaagaaccaccagaattcttcatgagcaaggagcttgcagctgttgttattgagatcccttgtgaaaacgtaaatcatgaaggactatcatatagtcataacttactgagaaaaagatgcttaaagtgcttggcagatgaaaaatgcttttgcagctcacaagaaaatgaaatctatggcaacattacagttatacttcctggtggtgtacatagttcaccaaacacaggacaaccttcaccattaatccatagatggaagttggggggaacatgtgattgtggaggttgggatgttggttgcaaattgcttgttctctctaaccaaaaccttagttcaaatattccaaggagttcaaaatcttaccttgagagatttcatctttttgttcaggaaggagctgatcaaaacacacccctattcacgttggttccattgaaggatggattctactcagtcgaattcagttcagaaattaatcatttacgagcattcttcatgtctgtggcagttttaagcagccataacttgccaagttccttggaaatcaataacatgcaagaagcaatcaataaagaattcagtcccaagagcaacaatgaacttcaggggaaagcacctttatattataatccaattcctccatactcccctgctgacagagtttaa

SEQ ID NO: 74822 - DNA, 1060 bp, Glycine max
  Peptide Sequence Number=SeqID_191600
accttcaaatgatgcagtggagagtgaagctgaaccttcacaaggtgcagtagatagtgaagctgaaccttcaaatggtgcagtggagagtgaagctaaaccttcacaaggtgcagtggagagtgaagttgagccttcacaagatgtagtggagagtgaaggtgaactttcaaatggtgcagtgaaccgtgaagctgaaataacaagtggtgcagtggagagtgaagctaaaacttcaagtggtgcagtgaagactgaagttaaaccttcacatggtgtagttgagagtgaagctaaccttcaaatgacgaaaaatgatgtagtgaatagtgaagctgaaacttcaagtggtgccctgcagagtgaaaaagagtcgtgtgttgtgtctgagatgaaaaacaataaagtggagagtgaagctcaaccttctgtcgatgtaaatcacaagaaaactaatgcagttgacagcgaaactgaacttttagttaaaggtgggctttctattgaaagtgaaggtagtaatcaaggagatgaagattcaagacctgcctcagatgctttggatggacataatgtgggtacaaaggccatttgtaaggatttcgaccaaaagtttagggctgcaatagcaacccatagagctgctcgtgacttgctcaaatccaaatgccaggaaatagattcagtccaatccataataaacatattaaacaatgtaatttttgttggggatatagatggcaagataagaagcatggaacacatgatcgagcatgaaactttgcctctaaataaagaaaagcaattgatacgcgagatcaaacaattgaagcagaactgtgaggaattgtcttctaatatgaaaaagcaggatcaatcacaacaatctgtagacaacaaggatgacaatattgaagagcactttaagcttttgaagaaggaaatggaagtgcttagaaataatgtcctgaagtcagatacaaaaactaaagccacaaagaagaaatataatgatgaatgtgatacattgaataagttccccttttactatacacactaa

SEQ ID NO: 74823 - DNA, 468 bp, Glycine max
  Peptide Sequence Number=SeqID_191601
atggacgctcctggtcacacccaaggctactggagaggattatccgtggaacctgctgagagcaagaggccattccgtgctctccttgacgttggtcttattaagactacaaccggtaaccgcgtgtttggtgcccttaagggagctctggatgggggtttggatattcctcacaatgacaagaggtttgctgggtttgataaggagaagaaggagcttgatgtagaggcactgtataagaaggttcatgctgccatccgggctgatcctactctcaagaaatctgataagcagcccccaaaggagcacaagaggagaatgttcttgagagtatctgcctctttctgcaagtacaacttgaagaagctgacctatgaggacaggaaggctaatgctgacgtcagcaatgttgtagaaattatatatttctacatcggtgattacctcagcaccgatgtgaaaacacag

SEQ ID NO: 74824 - DNA, 504 bp, Glycine max
  Peptide Sequence Number=SeqID_191602
atgtatgaaaatatacaaacagtaactacaaatccaaatagcaatagggtttctgatttcaagaaaaattccattgatgagctgaagaagctcctgaaagaggaattagaggacgaggaggtttccatctggggcatccctctcttgaaggatgacaggactgatgtcagtctcctcaagtttgttagagtgcgggagctaaaaacactctccgatggaggaaggacttcaacatcaacgcccttttggatgaagatctgggtgacgacttggagaaggtggtgttcatgcacggacacggcagagagggccatcctgtctgttacaacgtctacagtgagttccaaaacaaggacctctaccacaaggccttgtcctctcaggataattgaaaaaagtttctatgatggcatattcagttgttggagcgcagtattcagcacctcgaggataatgaagaagaagctacagtgtttcacgaaacgcacactaaggttcaagtga

SEQ ID NO: 74825 - DNA, 219 bp, Glycine max
  Peptide Sequence Number=SeqID_191603
atgaagcttcattctctagctagttaccttagccaggagatactggcagagcaagaagttgatagagtgcatggattacctgcgcagcatccggtgaagttcaacaatatggtggttatatcactgtcaatgaaactcaaggaagagcactgttctattggtttttcgaggccactcacaaaccagaacaaaaccccgttctcttatggctcaatggag

SEQ ID NO: 74826 - DNA, 457 bp, Glycine max
  Peptide Sequence Number=SeqID_191604
acaacgccacttgttggttctatgcaaaatttctgctactcttaaacctgcacaagatcaaaaacaagaaaaacacagcaagcaaacacaacagagcaagaacccaaagatttacgtggttcggcaatgtgcctacatccacaggaaagtgcagctcctcatcatcacattgatcatgaaattacaaccactctcaaaacccccactcactgcattacatgatcaagagtatatatacactctaaaagctagtcctaggaaaaaaggctatacattgttgagtctgcttactaaaaatgggaacaccaaggatgacctcaagcttcccactgatgagagtctgctcactcagataaaggatgggtttgttgagggcaaggatcttgttgtgtctgtcatgtctgctattggtgaggaacaaacttgcgctctgaaggatattgggcctaagaactag

SEQ ID NO: 74827 - DNA, 486 bp, Glycine max
  Peptide Sequence Number=SeqID_191605
atggcttgcaacatcttgagaaactgtaatgcctccaaagagcatgaacttgaatgttggaatctggaaaacaacaaactacaaggtccactaccacagtctttgaacaaagaaacgctagagatcagtcctccaattgaggcaccacaagtcactgtagttcatcagaaaaagcacaatgtacataaccatctagcaatcatattaggcatagttggaggagccacactggcctttctcttgatgcatatttcggtattgatatacaagactaaacagcaatatgaagcctcccacacatcaagggcagaaatggatatgcggaactggggtgctgcaaaagtcttttcctacaaagaaatcaaagtagctacaagaaacttaaagaagtcaaaggaaggggcagttttggatctgtttatcttggaaaaattccagatgaaaaatctgtggttgtcaaagttcggtttgacaaatctcaattag

SEQ ID NO: 74828 - DNA, 1260 bp, Glycine max
  Peptide Sequence Number=SeqID_191606
atggattcgtggctcaaagccgctgaaggtttatttgaagttgtagatcgacgagcgaaggctgttgccagtgacttatcagaggagcagggtgattctaagtctccagcatcaaatgggcaaggatctcagggcaagaggacaaaatcaaaaccaaaggctcaaaaggcactatccgactcaccaactataattagtgatactactcacgagaaaagtggatctccatcagcacctgtggacatagcaacttcaatagacaaagttgatcctgaaattgatgtgagcgcttccacgtctacaaaccaaccaaaggagccacaacctagcgatgcaacatcacccttgttaggctcttcattatcaaaaattctaggcgatgatgttggtaaacatgacacagatgatgcggaagcattagtaaatgatgctgatattggagttgccacaattgctggtaatggtgatcctgtccaagagagtgcttcagacatttgtgagatggatcctcctccagctcccaaaggaattgagggctccagtgatgaacccactagtactggccaaattatcaaatctagagatttagatgccagtaaaaatgtggatatagagaaatctgattctgtggcttctgacacagctcctaataatgatcctatactcaaagattctgatgtaaaagttgaatctgttgtggacgagaaaagccaagaggatcacaaagctgacatctcccccgaaaaagtacaggatcaacttgatgaggctcaaggattgcttaaaacaacaaaatctactggtcagtctaaagaggctaggttagctcgggtctgtgctggattgtcatcccgtcttcaagaatacaaatctgaaaatgcacagttggaggaacttctcacttcagagagagagctgagtaaatcatatgaagctagcataaaacagctacagaaggatctgtctgaaagtaaaagggaagtgacaagagttgaatcaaatatggttgaggctttggcagcaaaaaatgctgaaattgaggcacttttaagttctatggatgctgttaagaggcaggctgcattgtcagaaggaaatctagcttccctgcagagtgttatttatagttatggcttgggtaacactattcatatcttaccaggcaagtatggaatcaatgatgagaaatcgagaactaagcgaaacaaggatgatgcaagtttagagaacagagaaagagagaaaaatattgagaaatga

SEQ ID NO: 74829 - DNA, 171 bp, Glycine max
  Peptide Sequence Number=SeqID_191607
atgtcacacgtcatcttcaaggtaagggaatgcaaaaaatctggttgggccaaaccaatccagaaccaggctgccccaaatcagaatgtgcttacgaattcatcaatccctaacagccttgcagaagaacaaaaatggggtacattacattacagaaggtcgaaactatag

SEQ ID NO: 74830 - DNA, 471 bp, Glycine max
  Peptide Sequence Number=SeqID_191608
gcgcaatcggactcgcgtatttccgccgaggcgcaatatcggcgcggagtttcatcgctgctgatggtgctgctgttactggcgctgggcagcctgctgttgcaggggatgaatcagcagcagcgatctctgctggcgcaggtgagcgccgaaacccaggcgattcgcgatacggccgccgcgcagtcggcgctgcagtggggcaaaggggtgaactggccgctgcagagcgatgtgggcgtgctgcgctatttagcgcatggctggagcgatttttgcccgttaatggagagtgcgttatgcctgatgccgtagcgcgccagcgcggttttagcctggcggagtcattattagcgatggcgctgttaatcatgaccatcgcggcacttggcgctcgttcccccggcacagcccgcgcaagggcaaataagccgcttgcagacatccaggcaaagttgtgtcagcatcacg

SEQ ID NO: 74831 - DNA, 1092 bp, Glycine max
  Peptide Sequence Number=SeqID_191609
atcggtggccattacgccggcagcagccaggtcgccttcgacttcagctacggcgtggacctgtggggcggcaagcgcgccgcctgggaagccgccgtggacggtgcgcacgccgccaccgttgaagcgcaggccgcccgcctgaacctgtccaccggcatcacccaggcctatgccgacctggcctacgcgtggcagctcaacgacgtggccgaggaagagctgagccgttcacagaagtcacttgagctgacccgccagcgccgccgcgccggcatcgacagtgatctgcaggtgcgccaggccgaggcccgcgtgccggccgcgcagcagcaggtgcaggccgcccagcagcgtatcgacgccgcccgcaccgcactggccgcgctggtcggcaagggtccggaccgtggcctgtcgatccagcgcccgcggccgctgaatccggtggcactgcagctgccgggcgtgctgcccagcgaactgcttggccgccgccccgacatcgtggccgcacgctggcgcgttgaagcagccgacaagcagatcaaggttgccaagaccaagttctacccgagcttcaacctgaccgcgctggccggcgtggtcgccccgaatgtgggcgacctgctgaagagcagttccaccttcgcctacatcggcccggcgctgagcctgccgatcttcgaaggcggcaagctgcgcgccaacctggccaacaccgatgcgcagtacgacctggcggtggccaactacaaccagaccgtgctcgatgcgctgcgcgacgtggccgaccaggtcaacgcggtgcgctcgctggcgcagcaggcgcattcgcagcagcaggccgtggacaccgcacgctcggccttcgacctggcccagcagcgctaccgcgccggcatcggcagctacctggacgtgctgaccgcgcagtccacgctgttgcagtcgcagcagcagctggccggcctgcagtcgcagcaggtgcagacctcggtgcgcctgagcaaggcgctgggcggtggtttccagcccgctgacgccgaccgcgcaccgatcgcctcccattccgattcctcgcattcctga

SEQ ID NO: 74832 - DNA, 876 bp, Glycine max
  Peptide Sequence Number=SeqID_191610
atgagagagggagagacagagcgagacagtgagagagacagcgggtgggaaagagtgaggtcgagaagggagagaagagagaatgagaggacgagaggtatgaagggtccgtgtctgtctatcgtcagggaaaggaaaggaggtcaacaacgccgcatgcgagtcaactggagagatcatcggaatatatcatcgttttacttcacacgttttcctgaagacgcaacagaggatgagctatggaagatattcagaagagcgggtgatgtcagggaggtgtttatctccaacaagaggaataggaacggaagaaggtatggatttgtgagattcattggagtggataacgtccaacagttggaaaggagattggataacatagttctggggggattaaagttatatgttaacatccctaaatatgaaagaggtaggggtcgagtgcaaccacaatcaacagggggacgagaccataccagacatgtcgaacaggggcgcagagaaacttaccaggcacagaagcacacagcgatgccgggccagatacgcggatcctttgcagatgtggtagctaggagagaaccacgtatacagcaaaggaggacatcaatagttcagaatgctaaaaccaacacttcgagatcaaaagtacatcttgacagtcctatgacagcaccgaagtggctacaggatgcatgggtgggaatgctaaaaaatcttgcactccttgacagagtagaggagaatatgctctgggactggggattagacgtagtgccgaaatacatcggcgacaacatggtacttctccccagccttaccgaagacaaggcaaaacaaatggtggaggatgggactgcaggaaggggaggtgat

SEQ ID NO: 74833 - DNA, 648 bp, Glycine max
  Peptide Sequence Number=SeqID_191611
atggacacttgtagccgacaaggacagtgtggatgcactgtttgtgaaaaatacgacattagcaaggagaaatgggcccagttttgtcagatccgcagagacccctcatgggagaatgtgcagaaaaaggcacaggttatccagaagctaaacaccgccccccacgtgttgtctcgtgggggttatgaatatttagaacagaaggtgatggttgagaagacaaagaaaaaactggaggaagctgctcaatccggaagcactgaggctatgattgaccctccatctcccatcagacgacacgtgaagtggaagatgacctgcaccaagaaaactgggcaaatgacgtctgaggtagcaaaggaaattgctgagaagattaaatatatctgttatgtacaagattctttggaggagcaggcgtcacagggttcctttgtcctccatggacatgaggatgtcctcactactgccattagccgatgtgaccatcaagcaatactttggatcgactccatggacctcccggcttcttcctctatggctctagaagaactagagcagctgactcaacaaatcagggaccagctggaggagtcgatcacagaaaaagtgactcagcagctgatggcatccttcagccagatgtag

SEQ ID NO: 74834 - DNA, 198 bp, Glycine max
  Peptide Sequence Number=SeqID_191612
atggaattaaactttcacgagttgggcttagcggcaggatgcgctaagcaccaatcccctactgtttttgacatgcttcttgattgcgcgctaagccttacatctcaggctaagcgcatattacagaaaaattttgtgctgcagaaagtgctaagcgcagcctgtggcactaagccccagatcgtctatggaatttga

SEQ ID NO: 74835 - DNA, 872 bp, Glycine max
  Peptide Sequence Number=SeqID_191613
atgtccgaccgctacaagcacgcggacacggcctattccgattttatcgccaaagacaacgccgccctggtggagcttgcccgggcaaaccgaaacctgcagtccatggcctatggtgcgtatcagatcatggcttatgacgccaatagccccgacttcaagatcgtgacgcaggaatatgcgggggacagggcagaggtggtatcgcgcctggatgttgtcaaagccatttttccggaagagacagcaacactcgacaggctgttgcgagacgtcaaggccattatcgccatgacggataaggccgtggagttcggttcggccaaccgcaaccaggaatccgccgcggagcttctgaaggccgacgttgccatgcgcgctacgcgcgccgacatcgccaatcttctcgacaagcttgccaagggtgtcgtcaagggaagcgacgacctgagcgatcagaccaattcgaccatcctcacctcgctgatggctgtcggcgttgttttcgcgaccggcattattctggcgcttttcgtggcttcgcgcggaatcaccacgccgattgcccgcctgcgggagcgcatggtctcgctggccgccggtgaaacgacggcggaaatcgacggaatggcacgcaaagacgaagtcggccagatggcgcaggcggttcaggttttccgtgaaaattccatagagcgcattcgtctcgagcgggaaaccgaagcaaaccgcagcctgtcggaacaggaccggatcgaacgtgaacagcagaaggcgaaggaagtggccgacgtcaaattcgccgtcgacaatctcgctaccggtctctcgaaactctccgacggcgatgtctcctaccgcatccgcgagcc

SEQ ID NO: 74836 - DNA, 166 bp, Glycine max
  Peptide Sequence Number=SeqID_191614
gtttcatccatctaaggttgcgacaaaagctgttactttgttcattaggcaacaatctggtcacccttggcctacatggggagcaattccaaaagattgtgaggaactttatttccagcattttaaggagcttggtcgatctgtatacatagatgaggtctcttag

SEQ ID NO: 74837 - DNA, 690 bp, Glycine max
  Peptide Sequence Number=SeqID_191615
atggatcaaattgacaaacttaaggctatgtttagctttgaatttgaaatgaaggaacttgggaaggctaagaggataccaagaatggacatcaacataactagatcaaaaggagagctttttttgtctcaacaaggttatatgaagaaagttgttgaaaagtttagaatgcatgagtccaaacttgtctcaactccatcaggacaacatgacaagttttcaaccaaggatgcacctaactcagatgaagaaagggaaaagatggcattaattccttactctaatggagtgggaagcattatgtatgacatggtttacagcaaacccgatttagcttatgctgtcaacatgctgtcaaggaagctaggtggaataactcaagacaatgttattgttttctgtgatagtcagagtggaattgacctttcaaaacatcaagtttaccatgaaatgtctaagcacattgacgtacggctacacttcattcaagatgttattgaaaccaaggagattttggttgaaaagattccaactgaagaaaatcatgctgatgatcttaccaagtttgtaccacaatcaaagttcaagcattgcttggacttgataggtttctatgaagagtataagttgtgggaagaagcaaattgtgatctagagacaaggtggagatttgtgaatatgtgtctctaa

SEQ ID NO: 74838 - DNA, 1293 bp, Glycine max
  Peptide Sequence Number=SeqID_191616
atgggttcaaccaagttcgatattgaaaatttctctaagaatgattttggcttgtggagaatcaagatgcaagtaatcttgatacaccaaggattgggtgatgcattgaaagatcaaattgctgactttaacaagattcttgatgatcttgaaaatcttgaagtgaagatggaggatgaagacaaagctctaatgttgctcaatggatttccaagcaactgtgagcagtttaaggatgctatgctatttggaagggatcaaacaattacccttgaagaagtgcagtcatcaattcaaaccaaggaaatgcaaaggaaacaggaatccaagattgataacaatgcaaaaagattgaatgtgatgagggacaaagattcaaagaaatctcaagaaccaggagatatgaacattgctaaagcaggtggagtagtgatgctagtaaacaacaaaccatgtaaagtccaaggatacattgcacaaattgaacatggcatgatgaaaatatttaataactctgtgatgattgctaaaggaattaaaatgaatggtttgtatatcctagatggttctactgttatagcacaaactactgttgctagtcaaaacgaacatgataaaaccagtttatggcatatgaggttaggacatgttagtgaaaaaggaaaagctaaaagggccagttttggaataggcttgcatgctacaactagaccttttgaatatgttcattctgatctctggagtcttgcaaggaccatggctcatggtggttgctcttattttctatctatcattgatgattattccataagagtttggatctttgttcttaaaagtaaaagtgacacttttggaaaatttaaggaatggtatactcagatacaaactcaaatggaaaccaagaatcaaggtgtacaagctttggaggatggaaccaagtgtatcattagtagagatgtaatcttcaatgaaaccagaatgactatgaaggctaaggatcaacaacatgatagtagtcaaggcaacaacttagacattactgaagttgaggtggagctaccaaaacaaattaatgattacaacttggctagagacagagttaaaagaaacattgtgcctcctagaagatatggacaagttgatctaatctactttgctttgacaattgctgaagagattcaagctactgaacctagaaaattcaaagaagccttgaacgacaaggaaaatgaagaagaatggatcacaaccattgaagaagaaattctttctcttgagaagaagaaaacctag

SEQ ID NO: 74839 - DNA, 897 bp, Glycine max
  Peptide Sequence Number=SeqID_191617
atggcggcgatgatgtctgcctgtctgcaggccggcacgctggatgatatacgtgctcttgaagccggaaaaacgggcaggagcgcgccgtctatggaggccctcgcgttaccgaaaaacgacacggcgccggacaggaagcgtcctgctgaggacgcgtcgtctgcctggtacccgctgagcgatggccggaaagtgaaggtgcaggactggaaagtcgtgttgtttatgcagtccacctgccagtactgccgccagtttgcaccggtgctgaaagccatgtctcagcaaacgggtcttgaggtgttcgcaataagcctcgacgggaagggggatgccgaatttcccgacgttctgcctgcaacgccggacgtgatggtggaatacttccagagcggcatgccggtggccaccccgaccacctttctgaccaacgtccacaccatggagacatggccgctgctccagggggccgcagaggcagggaaaacaatgatgcgactgaaattacctggcctcgtcctggcgctgggcctctgcagtgcaggagccgcagaggccgccctgcaggacgacatgaaccgtttctttaatgacatgagctacgcgagcaacgccacgtcggctaaggcctggcaggggcaggccgcgcgctacgtctccggcggctcgttttatgcgcgcacgggcaacaagaacattcagctgatctccatcagcctgccttccatcaatgcaggctgtggcgggatagacgtgtatctgggcgcgttctcttttataaactccgaccagatcgccgcctttgtgaagcagacgatggccaacgcggcgggctatttttttgaccttgcgctcgaaaccaccgtgccggagctgaaggcggcgaaagactga

SEQ ID NO: 74840 - DNA, 336 bp, Glycine max
  Peptide Sequence Number=SeqID_191618
atgaagttgttcatcacatgcataagaagaaagttgtggcttggaagaggagaacattgttcatctcctaagagattgtacccgatccaagcaaatttgggttcaccttggcctggacaaattttcaaccttctactccgtggatgcggaaaactggttcaaaaattagcttcaaaagcaacatggtattctctttgtttgtgcttgttgcatcagaatcctgggttgtctggttttggtggtgattggctcatgggattttctggaaattgtggttttaccactaatatgcatgttgagcttctaactatccagcatggtcttcgagtagcttag

SEQ ID NO: 74841 - DNA, 699 bp, Glycine max
  Peptide Sequence Number=SeqID_191619
gttcacagtgtatgggcagcagcagaagcatattcagccccttctattgttctaacatcgcattcacatgatggaattcatgtatttgatgattttagagaggcttatgcgtggctaagtcataatacagaaatagatgataaagtggcatcttggtgggactatggataccaaacaactgccatggctaaccgaactgtcattgttgacaataatacctggaataacacacatattgctactgttggtactgccatgtcttccccagagaaggcagcttgggaaattttccactcattggatgtcaaatatgttcttgttgtctttggaggactggttggctatcccagtgatgatatcaataagttcctgtggatggttcgtattggagggggtgtattccctcacataaaggaaccagattatttaagggacggtcaatatcggattgattccatggccacaccaacaatgctaaactccctcatgtataaactttcatattacagatttgtggagacagatggtaaggcttttgacagagtgaggcagacagaaattgggaagaaacatttcaaacttacgcattttgaagagtgttattctgcgttgttccttcctaatctactatgtgtttaccttactaatgctttcaggtgttcacaactcaccattggatggttcggatttacaagttga

SEQ ID NO: 74842 - DNA, 300 bp, Glycine max
  Peptide Sequence Number=SeqID_191620
atggctcataagctccaatttaatgctacttccaagatatacctagtgtttcaagtgattggggaatgctgttgggaattacagaattgggatggaattgcccaaaatcatgaagggctattatatgatatgttaatagcagttgttgtcttaccttccaggagtgtgagtgaaggagatgttatgacacaaaatgagtcattgggtccaaagggtcagctgctacatcagttggcacatgggcccaaggtttggaaagttaacactaggaaggataaggaggggatggcagaattctga

SEQ ID NO: 74843 - DNA, 1497 bp, Glycine max
  Peptide Sequence Number=SeqID_191621
atggaaactgaaccgggcctcgacaaactgctccacaaccgaaccggtttaaaaaccgccctcgaaccgcttctcaaatgggcgcagaagcagattccagaaacctcccacaaaaccacttctttattcctctacgccaccgcaggggttcggagactccccttcgacgattcgaaatggttgctcgacaacgcgtggagctttctcaagagttcttcgccgttcgtgtgcaaaagggattgggtgaagatcatttcggggaccgaagaggcttacttgggatggattgcgcttaactacgattcaggtattctcggtgttaagccaaggaaagaaacctacggtgctcttgatttgggagggtcttcattgcaggtcacttttgaggggaatagaaataaggagcagcaaaatcaacagttattgaatagtgagactagtttgtatgttaggattggctctatgaaccatcatttgacggcgtattcgcttgcgggttacgggcttaacgaggcgtttgataagtctgttgcttatgtttttaagaaatatgggtatggtatggaggatgtatttaaggggaatgtggaggttaatcatccctgcttgcaatccgggtacaaggagaggtattcgtgctcacattgttcgaatgctgtgaagaaaggaggggagagtccgacagtcgaggggaatgggaatgtgttggggaagaaggatggaggattgaggactgtggtgacactcattggtgcgccaaattggctggagtgcagcgcgctggcgaaggtggctgtgaatttgtctgagtggagtgatgttaggcctgggatggattgcgaggttcacccgtgtgcccttcgcgataacttgccccgcccaatggggcacttttatgtgatttctgggttctttgtggtgtaccggtttttcaatttgactgcagaggccacacttgaggatgtgttggagaaggggagggagttctgtgagaagagatgggatgttgcgaggaagagtgtcgctcctcagccgtttattgagcagtattgcttcagggcaccgtatattgcatcgttgctgagggagggtttgcacattactgataagcatataactgttggctctggaagcatcacttggacgcttggggtggccttgttggaagctgggaaggcatattcggttaggtttgggctccatggttttgacttgcttcagatgaagatgaatccattgattcttattcccattttgatacttactttcattcttctgctttgtgctttgtcatgggttgtcaattggatgccaagatttttccggaggcagtatcttcctttattcaggcataacagtggatccagtgcatctggtattaatatcgcatctcctttccggtttcagcggtggagtcctatgaattctggtgtcttaaatgtttttgacaccaacatctctgtgacatgtgtcaggcactccttgttaggcgcttaa

SEQ ID NO: 74844 - DNA, 810 bp, Glycine max
  Peptide Sequence Number=SeqID_191622
atgaagtggaagctggcttgcacaaaaaagtcgggccaaatgacatatgaggcaacacgccaaattgttgataagattgattccctggaagaccaatctgcaaagggtaactttgttgcccatgaacatcaggatgtactaactattgtcattgggcgaccagagcaccctggccgtgtccgtgttgctggagttggtgtcactatcaaacaatactttggaccatcatcacaaagctctcacacatctacatcgataagcctagaagagttagatggattgaaacaaaattttaaaaaggaattgacacaaaatattaagacgagttgcaacagtcgatcattgaaaaacacaaagggaagatatgttgatccctcggggcaggaccctaacattgatatctcagacaggcataggttgtatgttgatgacattttttcctacctggttgcccttgggagagcttatgaagggttgccaaccatacaacacatgtctttggccaatgatatggtgaaggttggtattgaagaagttcgagatgctgatgctcgcgtccctatacccactaaagaggttcagttagtggggcaggataagcaggtgttgtgggatgcaactatgtttggggtgtacaatgataatattcccttgtacataaaacatgaagatcttagggaaataacacatggaggtcaatgtctaaacatcgttgttttaaaattttggattatgcatatgaatgagttaagtatgcaattggggaatggttctatgtatggattccttgacaaggcaatcacagtttga

SEQ ID NO: 74845 - DNA, 438 bp, Glycine max
  Peptide Sequence Number=SeqID_191623
atgaagaccctcccaaatcaagagcaccacgtagacacgtgtcccggtgctgccgcagtcgagaacgacgtagtatttgggggaggagtggtgggagtagagagtgtagaggaaaaagaggaggaggaggaaaaggaagaggatgaggatcaggaagaggaagaggaagaggtgtttgcggcgaaccggattgggaagttgaaccggtttggttttggagaaactggaggaggtgaagttggtgttgttgatgttgttgtcgggagtggggccatggccatgttcgaggtcatggcgataggaggagagatcttggagggaggaggagattcggaggtggtggttgttgttcttgccaaagaccatgtcgaggttgggatggatctggtgcggttatggagtggttcggtgcatggtgtggttgcttcagtgatatga

SEQ ID NO: 74846 - DNA, 2776 bp, Glycine max
  Peptide Sequence Number=SeqID_191624
atggagtcagtggttcttccactagagcttatacaactgttcaggagttcagattttccaagtcaacaagagtatgaagcttggttgagaagaaatttgaaggttcttgaagcaggactcctcttgcatcctcatcttcccttagataaatcagacccttctgcacagagtctacggcacataatccgcggagcatttgagaaacccatggatattggaaagaatggtgaatcaatgcaaacctttcgaactgttgttatgtctctttcttgcagatcatctgatgggtctatctctgagacatgccattgggctgatggttttccactgaacctctggatctaccaaactcttttagaagcttgttttgatcttcatgcagaatcttctgtgatagaagaggttgatgagtatcttgtcactggccaagtggagaatgatcttctgtttgcatccagtaatctattggcagaagttgggaaagatactggaggctcaaaagatcctatttacacaaaaatcttgaggaacacattgagtttgatactaagttgggcagagaaaaggctccttgcataccatcatacttttcataatggtaatattgaatcaatggaaagtgttatttctctcgcagtgttatcagcaaagatattagaagatatctctcatgactacaatcggaagaagaaagatgatgtggactacactagagttggtaattatattagatcatctttgcgtactgttttcattaaggcaagttccatcattcaagctcccttaaatatgaatactctctttcagatgaaattggagaaactggacctctgcaagcatccatctagaaaacagaataaagcctttcccattctttctgtccttgcacgagatattattgaactggctatcaacgagaaagcaatatttagtcccaaattgaagagatggcatccacttgctactggtgttgctgttgctaccctccatgtgtgttatggaaatgagttgaagaagtatgttaagggtattaatgagttgacacccgatgctatagaagtgctgatagctgcagacaaattggagaaagatctggtgcagatagcagtggaagattctgttgacagtgaagatggtggaaaatccattataagggagatgcaaccttacgaggctgaagctgtaattgctaccctggttaagtcatggataaatatcagagtagatagattgggggaatgggttgacagaaatctgcgacaagaggtatggaatcctggggcaaataaagagggttttgcttcttctgctgttgaagttctacgaatgatagatgacactctggaggctttctttctgttgcctatacccatgcatgcagatttgcttcctggattgatgtctggtctcgacaaatctctccaacagtacattttgaaagccaaatctggctgtggtagccatagtagcttcatcccaactttgcctgcattgactaggtgttcaacaagatcaaaaaatggtgtttttaggaaaaatgaaaagtcacaagtgactcagaggaggaaagcccatgttggaaccactaatggagacaattcagttgataaaacccagatgtgtgtttgcatcaatactatgcagcgcattcgcatggagttaggggttttggaaaaaaggatagttgccaatctcagcagttctatatccactaatgaggatatagcaaatggggtgagcttgaagttcaagctttccacatctgctgctgtggaaggcatccatcaactctgcaagtgtgtagcatacaaaatcgttttccatgatctctggcatgttctttgggatggcctatatgtcggagaagttgcatctgccaggattgagccttttcttcaggagctggagcagtacttggagatcgcatcatctacagtgcacgataaagttagaacacgtgtaattattgaagtaatgcaggcttctttcgatgggtttctgttggttttgttagccggaggtccatcacgtgctttctctctgcaagattctgttatcatagaggaagatttcaagtttctgactggcttgttctggtccaatggagatggattgccggccgaattgatagaaaagcattctaccactgtcaaaggtgtacttcccttgtttcatgcagataccgagcacataattcagcagttcagtcaacttactatggaaatgtacggctctacagccaaatcccggcttccattgcctccaacagcagatcaatggagcccaacagagccgaacacacttttgcgagtcttgtgtaataggaatgatgaggcagctgccaagcagcctgccatgcaatgcaagggcataatacgtcaaggaggaggaggtgatcgcaactctaaatattgtcaatcgtgcatgaattggagaaggaggaagagtgccttgagagggttggttgttgagggggcttgggttgatgacccgcatgatgtgaaggagggagttgagaaatttttccaagaaagatttagagaaacggaagagaataaacctaaactagatgaggtggagttcaaaaaattagtggttgaagataatattttgcttcttgctacttttgaggagtgtgaggtgaagacggtggtatgggaatgtggtgattcaaaaagtccaggacccgacggatttaatttcaagttaatcaaagggttttggaagcttatcaaggaagatgtgttgagatttttgcaagaataccatgtgcatg

SEQ ID NO: 74847 - DNA, 996 bp, Glycine max
  Peptide Sequence Number=SeqID_191625
atgcatagtattaactttaagcgacagggaggaatgcctggctctgcaagactacgggattgcgatgtgctgcgaaaaatcacgtgcagacaagctgaggaaaatagtctctacggtgctatttgtgctgctcctgctgtcagccttttgccatgggggcttttgaagaaaaagaaggtttccagaggactcacaaccagccgggggcctggaactagttaccagtttgctttgtccttggctgagcagctatttggggagtctgttgccaaggaggttgcagaattgatgttgatgagaacggatgatgataatgcagctaagaaggagttcaataaagttgaatggtctgtaggccaccacacccctagtatttcagctgcctatccttctgcatcaatgatctttacacatgaactcatacaatatgatgtccaggtccttgtaccaattgtacatggctctgaagagattgaagtagtgactgtggtagatattcttaggcgagcaaaagctaaggtcatagttgcttcagttgaaaaatctcttgaagttttggcttctcaaggaaccaaaattgttgctgatatattaattggtgatgctcaagagtcaccatatgatctgattattcttccagggggaactgctggtgctcaaagactaagcaaatctagaattctgaagaagcttcttaaagaacaaaattcagctaaaagaatatatggggcagtctactcttcacttgccattctacaaaaacagggcttactaaaggacaagaggaccacagctcatccctccgtcttagtcaagcttaaagacgaagaaataaatggtgctaaagtagatattgatggcaaattgatcactagtgaggtacttgccactgtaacggattttgcattggccattgtgagtaagctatttggtaatggaagagcaagaagtgtagcagaaggccttgtttttgagtatcctaaggagtgcatgtag

SEQ ID NO: 74848 - DNA, 675 bp, Glycine max
  Peptide Sequence Number=SeqID_191626
atggacgctgtaaactgtcacgacgctatggtcatggcaggtgccataccggaaatggtggacgccgctataaaacgccaaataacgcacaaacagatggcgctctatcttgtggtgtatttggatgacatcattattattgggaatgatgaaattaggattagagaactcaaggcacagtttcagacaaaggatttgattgcacaaaagtttttcttgggtattggggttgtggtgtttggtagagatgatgagcatactgcagttgaggccttccttggtgctgactgtgctggatcccctattgataggagattcactttagctgctggattcttgttggagtttgatggagttgaaactccaggggcagaggtgcataaggtagacgatgcactcaccggaaattgcgaccagaaaaggtgccgaatgtgctgtcacgcgccggtgggtgaagctgtttggctgaaaaagatggtgcatgtgaagcaccatgtagatcagtttggggtgacctggccagatccagtgagtggtcgtcggaaaagtcaccagaaagtttcccagaaaagttgtcggagttgcaccggtgaccataaaatgtgcaagaaacagggaaaatggccggagaaggaaaaagggtcgttagaaagcggaaagaggtcgtcagaatga

SEQ ID NO: 74849 - DNA, 741 bp, Glycine max
  Peptide Sequence Number=SeqID_191627
atgaagaattcaggtcttctcgagattgagatctcctactctgcagacgcatctgacttctgtggggtgaccggaatgcccctatactactgctgtcgaactgcatctgccctaaattgttcgaggaataactatgaagattccatcagctggatgttgccactgttatcaccaagaccatgccccaggcgaaacggtctatcctgtgaacctgcaattgttgggctgagtggggtctttattcttccatctcctgcaataccacaggttgcggatcaggaatcagaacacagcagatcagcagacctgcatgaccagagaccaggatgtgggcaggtgagcaaatcagcagaggatgcctgcaagcagttggtgtatcagaaaaaacactgccagcaagcagtggtccaagggttgtttagagtttgtattgaaccagaggagtcttcagatgaactgaaaaagaaaaaaatcatgacagcatatgggttggaaaactttaaaaaaggggcaaagatggatacagcacaaaaacatgaggtgattggcatcttgattgacatttggagtgtggagattgcaggacagagtttctttatattggcatgggaaaaccccagggccacggagaatacactgggaaagttgcaagccgtgacgccagctagattgcactgggagagccgggggaccaggctgtttatttttggacagttgagggtggctcaatatcagatctaa

SEQ ID NO: 74850 - DNA, 981 bp, Glycine max
  Peptide Sequence Number=SeqID_191628
atgccagaaaactgcatagcacccaaaccagaacacaataacaacaacactactcaccctgaggaaggaccacctgagatgactgagactgtccttcccataaaaacaaatgagcaatcttttccaaaactagctatgttccccataactttgaagtttgaggaattggtgtacaatgttaaaatagagcataagggtggtctatgttggggtagcacaaggagttgcaaagagaagaccatacttaaaggagtcacaggcatggtttctccaggagaaataatggccatgttggggccatcaggaagtggtaaaaccacacttctcacagcacttggaggaaggctcagtggcaaactatcaggaaaagtcacttacaataaccagcctttttcaggtgccatgaaaagaagaacaggctttgtggcgcaggatgatgtgctataccctcatctcacagtctttgaaacccttcttttcactgcacttctgaggctccccaactccttgacaaaggaagagaaagtgcaccatgtggagcatgtgatcagtgagctagggctgagtaggtgcaggggtagcatgattggaggccctttcttcagagggatttcaggaggggagagaaagagggtcagcataggccaggaaatgctcatcaatccaagcctcttgctgcttgatgagcctacctcagggttggactctacaactgctcaaaggatcataacgacaatcaagggcttggcttgtgggggaagaactgttgtcaccaccattcatcaaccctctagtcgcctctatcacatgtttgataaagtggtcttgctctctgaaggatgccccatctattatggccctgcttcatctgcaatggactacttttcttctgttggtttttccacatccatgattgtcaatcctgctgatttaatgcttgatcttgccaatggtaataatatttctttcttttcaatttaa

SEQ ID NO: 74851 - DNA, 1395 bp, Glycine max
  Peptide Sequence Number=SeqID_191629
atgaacttcaggaactttggtgttggagataaccaccccacttgggatgccatgcatgggaagacaccagcaaataataatgttactagcactactctgctgagacagccctcaacaatatactcattgacatttgatgagtttcagagcaccatgggtgggattgggaaggatttcgggtccatgaacatggatgaactcttgaagaacatatggacagctgaagagactcaagccatggtgttttcagccgttgccgccgcaggaggagtagaaggccataacaacaacagcaacaacaaccctattaattgtagtggtttgcaaagacaaggctctttgacattgccaaggactcttagtcagaaaacagttgaggaggtttggagggacttgatcaaagaaagtggtggtgaggccaacgatggtggaagtggtggcaatggtggctcatcaaatcctcaaatgcaagcaacattgggagaaatgacattggaggagtttttggtgagagctggtgttgtgagagaagatgttcctcaacaacaacaaaatggaaaaccaaacgacaatggatggtttggtgactttcctagaccaaacaataacaacactagcctacttcttgggtttcaacaaccaaatagaagtaatgggaatgggaatttgggtgagaacactaacttagtttcaaaacaacaacctcctcctttatcattaaactcaaaccactctcaaagacaagcacaacaccaacaccaacaccaacaacatccaccaccactttttccaaagccagcaaatgtaacttttgctggtgctcctacgcatttgttgaacaatgctcatcaacatgctagccctggcagaaggggagggttgattggagttgctgctgagcattcaatgaatgttggaatggttggtttagccacagctaatgtcacagcttctccctcaagtaaaatatcaccagatgtaattacaaggagtaataataatgttgataactctccaatatcaccacattatgtaatcaacaggggaaggaaattcagtgccatagagaaagtggttgagaggagacaaaggagaatgattaaaaatagagaatcagcagcgagatcaagggctcgtaagcaggcctacactttcgaactagaagctgaagttgcaaaacttaaggaattaaacagagaattacaaagaaaacaggaagaaatcatggaaatgaagaaaaataaggatgataagcatgtgttccaatgcacgttcaatccaacccatgtgcctagggtcattgagatgaacattcatttgaagtattggaacagaaaactaaacacacctttcctcgagtttttggcaccaaatctcgattcagattatttaaaa

SEQ ID NO: 74852 - DNA, 865 bp, Glycine max
  Peptide Sequence Number=SeqID_191630
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgacgcctccttgcgcacggtggtcttgacgccctgcgacgtggcgatccagtacgcgagccaggcggcccacggaacgacgatggcgatggtctgaacgatattcacggctggcctgcctcgttgggatgggaattcggatgcgcgggacgcgcccgctgcacgacggatggcgtcacgacgacagcgcgtgcatcggcgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 74853 - DNA, 106 bp, Glycine max
  Peptide Sequence Number=SeqID_191631
atggcatggcttgaagctcagctccctgtggaaagatcccataaggttgttcctcccgagcatgtaccagctagaactattgttcctcccggacctattgatcgag

SEQ ID NO: 74854 - DNA, 360 bp, Glycine max
  Peptide Sequence Number=SeqID_191632
atgcaacaaccaattccagggtgtccttcgcaacccttgaatattcatggcataacgctgaaaggcaaacaagatgaaaattgtgagcaactgttcacccccatgatcggtcaatggaacaagcaagttgattttagggtcgacgagacattacaatacatggtgtctcctcaagggaggaatacatggacagttgatgatctcgtgccttatgtggagaaaataacgattttattgaaagagcaagaaagaatcactgagcctgtgtcacatggtccagcatcagagcatcaatttccagcacaagagtttcacattctccagtcaagtgttgaaactcaaggcataggcaggcgaagg

SEQ ID NO: 74855 - DNA, 699 bp, Glycine max
  Peptide Sequence Number=SeqID_191633
atgaagagaatctcacatggagctggttttgtaatgcagatagccctgctcttcttcttctctgttttctggggattctaccctctctataatgctgttttcacatttccacaagagagaagaatgctgatcaaggaacgttcgtccggaatgtaccgtctttcttcctactttctagccagaacagtaggagacttgccaatagaacttgcacttccaactgcatttgccatcataatctattggatgggagggctcaagcctcatccagtgacctttctcctttccctccttgtggtcctctacagtgtccttgtctctcaaagtcttggcttagcatttggtgccattttgatggaggtcaaacaggccacaactttggcttctgtgacaacccttgtgttcctcattgctggaggctactatattcaacaaattcctcccttcatagagtggctcaagtacttgagctatagctactattgttacaagcttcttgttggtgtgcagtacaatgatgatgatcattatgagtgctcaaaaggggtcttgtgcaaagttggagagtttcctccaatcaaatcagtgggtttgaatcacttgttaccgactaattgcatatttagcactacagagaatgaggtagagctagctaagatgtgtacactagctacagaacttggaagagttttgtactaa

SEQ ID NO: 74856 - DNA, 231 bp, Glycine max
  Peptide Sequence Number=SeqID_191634
atggagctcaacacaaaagccatatgtactttgacatgtgccctaccaaagaatgagtgcaacaagatctgcagactaagaactacaaaagagacttgggattcattgagcataaattatgaatgcactaaagatgtcagactaaggaaggccacgactctaaccaaacactatgaaagcttcatcataaaggatgaagagttcgtggatgatatgtttagaagaatttaa

SEQ ID NO: 74857 - DNA, 135 bp, Glycine max
  Peptide Sequence Number=SeqID_191635
atggctagatcgtcatttgtctattcagcttcagtaagggtagtcttctccagcgaagcctggtggccttgtgagagatgcttcctcaatgatggactacgtccatttcttgacaacccaccaagtttctactaa

SEQ ID NO: 74858 - DNA, 614 bp, Glycine max
  Peptide Sequence Number=SeqID_191636
gttctcatgggcacggcggcatgggagcaatgctcaccgggggtgctgccgcggctgctgctgcttatggtgctcaccatgtctctcatggctcccatggctcctatggccaatatgctgcacatggtgctcacatgccccatggaaaattcaagcagcatggaaagcacggcaagttcaagcatggaaagcatggcaagtttggcaagcatggaaagcatggcaaattcggcaagcatggtggtgggttcaagaagtggaaggaggaagatgagtggcatttgctttctcttgggtcagctgaagggttgagtgttcaagtggatagaaggataagggttttgccttgcatgaaagacaagcttgaagcaaagcttgatgcaaagaatgttgttgaaaatgttgaagctaaaaagaagcaagacaatacagtccaggctgaaggaactccaaaggttgtggatgatgctattgttaatgatgtcctgattgatctcacatgtcaacatgatcatgcgtgcaatggcttgcatgatgtagtggtagtttactccatcaattttggtgctactcctatcaactacactgctccaacttccttaagtgaagattga

SEQ ID NO: 74859 - DNA, 2101 bp, Glycine max
  Peptide Sequence Number=SeqID_191637
atggcgggtttttggagcgtgttttgtggggaatctggttgttcagaggctggaagaatgccttgcagctatgattttaggcttctcattgatccttccacttgtgtcaaccatttgttgaattcttgctttgatgtgttgctgcttatcatgcttgcatgcattatgatccagaaatcatcattaaaaccatctcgtggtctaacacaggtgcaaagatattcatattttcagctagtttctgccatagccaacggtgctcttgggttgacacttttgtgctttggcatttgggttttagaagaaaagttgaggaaaaaccaaactgcgttgcctcttaattggtggttgctagaaatctttcatggattaacatggttgttagtgagtttaacaataactcttaagttgaaacaacttccaaaagcatggtcaaggcctttttctgttctaatcttcttggtttctgattttttctgtgcttcatcagtgttttatgcaattagtagcagagaactatcccttaagatctcttcagatattctatcttttcttggggcgatattattgttattatgcacgtataaggaatccaagcatagggacactgacagtgaaattgatgaaaatctttatgcccccttaaatggtgagtccaacaaaaatgattctattagatatgtaaccccatttgccaaaactggattctttggcagaatgacattttggtggttgaatccattgatgaaaatgggcaaagagaaaacacttcatgatgaagacattccgcggttgcgggaggaggatcgagcagaaagttgttatttgctgtttctggatcaattgaaccgacagaaactgaacgatcaatcctggcagccatcagttttgaggacaataattttatgccattggaaagaaattttaatatcaggattctttgcattgctaaaggtagttgctctgtcttcaggacctcttcttctgaattcttttatattggttgctgagggtaacgagagtttcaaatatgaaggttttgtgttggccatatcacttttctttacaaaaaacatagaatccttatcacaaaggcaatggtacttccgctgccgactcattggtctgaaagttaggtcgttgctaactgcagccatttatagaaaacaattgaggttatccaattctgctagattgatgcactctagtggtgagataatgaattatgtgactgtggatgcttatagaattggtgaatttccctattggtttcaccagacttggacaacaagctttcagctatgtatctcattagtaatactttttcgtgctgttggatgggcaacaattgcctccttggtggtgatagtaatcactgtgctttgcaatactccactcgcaaagttacagcacaagtttcaaagcaaacttatggtgacacaagatgatagattgaaggcttgttctgaggctcttgtgaatatgaaggtgttgaagttgtatgcgtgggaaaccaattttagaagttctatagagagattaaggaatgaggagctcaaatggttgtctgcagtgcaattaagaaaggcatacaacacctttctcttttggtcctctcctgtgttggtctctgctgcttcctttggggcatgttactttcttaatgttccattgcatgcaaataatgttttcacttttgttgcaactttgcgccttgttcaagatccaatcagaaccatccctgatgttattggggtggtcattcaggcaaaagtcgcgtttgctcggattgtcaaattcctggaggcacctgaacttcagagtgtaaatatcacacaaaggtgtctcaatgagaataagaggggttcaattttaatcaagtctgctgacttttcatgggaagataatgtatcaaagccaacactgagaaacataaatttggaggttagaccagggcaaaaggtggctatctgtggagaggttggctcaggcaaatcaactctcttagcagcaattctcagagaagttcttaatactcaggggacaactgaggtttatgggaagtttgcctatgtttctcaaacagcatggatacagacag

SEQ ID NO: 74860 - DNA, 1353 bp, Glycine max
  Peptide Sequence Number=SeqID_191638
atggcgtggagaaaagggtttgaggaagtggctaattcgaagcctctgttcctcacgatctacactgttgtcatcattggcatcgtggtttcttctttctacgtcttctctgctatatactcagccaaccctccttctgctcaatcttctgcatggctctcttccatttcgagtgatgcaactcatgttacggatcagacactaaatgtttctcagtcagcagcggtgcatactgtgccccctccttccccaaggccacgaaatgaatcaccaaggtctatatgggatgatccaccacccaataaaaagatgccacctttgaaggatttcaggctgaccaaagaattggttcggcaaagggtgaaggataatgctataatagtgacctttggtaactacgcgttcatggattttattcttacgtgggttaaacaattgacagatctgggggtttctaatttccttgttggtgcaatggacaccaaattattggaggcactgtattggaaagggataccagtttttgacatgggcagccatatgagcacagttgatgttggctggggttctccaacatttcataaaatggggagagaaaaagttattctgatagactcaatactgccttttggtttcgagctgttgatgtgtgatactgacatggtttggttgaagaacccgcttccgtatcttgctcgttatccagaagcagatgttttaacttcaagtgatcaagttataccaacagttgttgatgatagtttggaaaattggcctgaagttagtggcgcatacaacataggaattttccattggagacctacagagtctgcaaaaaaattggcaaagcaatggaaagaaatgctcctagctgatgaccagatatgggatcaaaatgggtttaatgatattgttcacagacagttaggtccatctgttgatgatgaaagtgggcttgtttttgtttttgatggaaaactgaagctggggattttgccggcaagtatcttctgtagtggacatacatattttatccaggctatgtaccagcaactaaggttggagccatatgcagtgcacacaacgtttcaatatggaggcactgaaggaaagcgccatcgactgcgagaagccatgcacttcctcgatccaccagaatactataatcctcttgggggtttcttgtcatttaagccacatattccaaaaaacttattgctaagtggggagcataatgttgaatcacattttactcttgttaattaccaaattaaacagattagggcagcacttgcaattgcttcccttttaaacagaacactgttgtgcagtgtaattatgttgtttgcttaa

SEQ ID NO: 74861 - DNA, 378 bp, Glycine max
  Peptide Sequence Number=SeqID_191639
atgacccaagcaaggaataataataagaaatatacttgcttgccttactctgtttctcttctccctgctctctttcttctcggaggttctggccctctaagcccagttcacggcccagccttcctagtgtggaagattatgttgaatagattgccaaccaagatcaaccttagagcaaggaatattcttgttgatgaagaggaattgagattgatggagatttggaaagcttgttatgtttggcttcatgtgtcaaagattataccaaattcctcagaacaacacttttggcaacatgcacattttgttcaaacaaaactagagcaagatatgtggcaagtggtgtgggtggcagctgtttcgaacatatgggtttaa

SEQ ID NO: 74862 - DNA, 1070 bp, Glycine max
  Peptide Sequence Number=SeqID_191640
atgagagtgggaacgagagcgtggaagaatcatgtattgctcgataatcattttgttctcaagctctctaagtgcttctttacccaatcgcaggtggagtacttgggccacttagtgtcagctcgtggggtcgaaccagtcgcggccaaggtggctgccgtatcccagtggccgataccccgtttgacaaaggcgttgcgcagctttctcgggctagctggcttttaccggagatttatcaaaggatatgccatgatagatgacacactggtcaaagcaactacgatggaccccttccggtggacccctgatgctcaagcagccttcgatcacctcaaacaagccctttcaaccgctccggttctcgtcttgcctaattttcagctaccttttactgtagagacagacgcttccggcatcggcgtcagagcaatgttatcgcagcaaggtcatcccttcgtgtacttcagtaaaccatttcccccgaagcttctgcgtgcttctacctatgtccgcgaactctttgctattacgtccgccgtgaagaaatggcggcagtacttgctgggccgccctttcacgataatcaccgaccatcggagcttaaaggaattacttactcaggtcatccagaccccagaacaacacacatatctcgtgcgcctcctcggttatgactatgtcattcattatcgctctgggtcccataaccaggctgctgacgcgttgtcacgacgaccagaccactctgcctctttgactctcatcctctccgttccttggttgacttttctcgaagaactacgtcaacaactccgccaacatccacaatacatccataaacaccagcttctcacacaatctccggcagaccaccccggttttaccatcgcgaacgacctgattatgaaggaaggtcgaatatggttaccgcgagaccttcccctgatccagacattgttgactgagtatcatgcttctacaattggtggtcacatgggtgtggccaagaccgttgctcggatttcagaaaactttcagtggcagggacttcgtgaagatgttgcaag

SEQ ID NO: 74863 - DNA, 183 bp, Glycine max
  Peptide Sequence Number=SeqID_191641
atgataagaggcagactaaaaaggatgttggaggaaatcatcaagggagatcttaggaaactgtttgtctccactgtggcgacagaggctttccagagacattggttttttgcaccgaatgtatggcttatgcgctgcataggtgagactcgggagtgctcccttatagttgggtttggataa

SEQ ID NO: 74864 - DNA, 636 bp, Glycine max
  Peptide Sequence Number=SeqID_191642
atgaaagatgaatgtggaccagctccaagggatgtagctaattttgatgtaggtgaagaagaaagtgtggcaagggatttagctaattctgatgaaggtttcaaatctgttccagtttctcaaggagctaccgataatgattcaggttgtgtagaattagatggtcatgtttatgcacaccctactattgatccaatctggaggggaagtatgtacttctgcaatgaaactaatggtactgtcaatggagttctggctcatatgtccaatttagcgtgctccaaagttgcggaggagacaggacatttcccagaagtgcttcatgctgaattgcttcccagagataaggtgtggcctgaaagtttcaagagtaggaggccaactgatcaggacattgctctttttatctttccagacactgaaggatctgaaaaggactttgataagctggttgaagatatcatgatcaatgagcatgtcataagaattgtggctaaaaaagcagagcttttaatttttcattctatcgagcttccaatccaatattggagatttgaagccaagtattatttgtggggtgtcttcagaagaaagcaaacttcagaagagacaaatgatgctgtgtacagagattga

SEQ ID NO: 74865 - DNA, 223 bp, Glycine max
  Peptide Sequence Number=SeqID_191643
atggaaaagatgctacaggtggggcttccttgtgtgctctctgactatgagaagaggccaagtgtaagagatgcgaccagaattcttgtaaaggaagcaccatttccttttttgccaaccagtaaaccaagaatgagaattaggcctctttgtcctgatgatacacccgaaacacagaatgttgttgcagattggctcagcacagatgaggctctagaagcca

SEQ ID NO: 74866 - DNA, 2058 bp, Glycine max
  Peptide Sequence Number=SeqID_191644
atgctttgtctcttcctcctcctccttcttcttctcttcaccttcccctccctcgttctcaccctccctttcttcccctctgataacctcaccctctacggtgacgccttcttcacccgcaacgccatcaccctcaccacccaacactccaaatgctcctcttcttccatcggaagagctttcttcatctaccccgtccgttttcttgacccgcaaacaaactccaccgcctccttctcctgccgcttctccttctccatcctctcctccccttcttgcccctccgccgacggcctcgccttcctcatcgcctcctccacccacttccccaccctctcctccggttacatgggcctcccttcctcctccttctcctctttcttcgccgtcgaattcgacaccgccttccaccccttccttggtgacatcaacgataaccacgtcgccgtcgatgtcaacagcctcgcctcctcattcgcctcagtcgacgccgcgtcccgaggcgtcgacctcaagagcgggaaaatcatcactgcatgggtggagtataggcatgcaatgagaatggtacgtgtgtggatcggctattcctcaactagacccccaactccgattcttgctacccaaattgacctttctgagagacttgaggacttcatgcacgttggtttcactgcctccaacggagaagggtcgagtgttcaccttgttcatcattggcagttcaagactttcggctatgatgatgattctcgctccatggatgtcgtggaggaaggtgactgtttcttgtgttatgaaggggattccacgggaaaaagggaaggttctagcatgtcaaataaggacgacattgagaggaggaaaaagattggggagatggctcttgggttggcagggttgacggcgtttgtggtgtcgggtttggcggcaatggttgtggtgtgtgttttcttgacaaagaataaagcttgtattaggaagaagaataaggaagaacaagggcaaagttgtaggtttcagacgagtaaagtgccaacaaggttgtcactttctgacattaagtctgctacaatggggttcaatcgagataggcttgttggggagggtgcatctgcaaaagtgtataaagggtatcttccttttggaggagacgtggcagtgaagagatttgagagagataacggtttggattgtttgcacaacccttttgccacagagtttgccaccatggtgggttacttgcggcacaagaatttggttcagctcaaggggtggtgctgtgaggggaatgagttggttctggtttatgagttcctccccaatgggagcctcaataaggttttgcatagaaacttcaattcttccattgttctttcgtggcagcaaaggctgaacattgttctcggggttgcttctgctcttacctaccttcatgaggagtgtgagaggcagatcattcatagggatgtgaagacatgcaacataatgcttgatgctgatttcactgccaagttaggggattttgggcttgcggaagtgtatgagcacagttctagcacgagggatgctactataccagcagggacaatggggtatcttgctcctgaatatgtttattctggtgttcctactgtgaagactgatgtgtacagctttggggtggtggtgttggaagtggcaactggtagaaagcctgtggaggatgatggcaccgtggttgtggattttgtgtggggtttgtggggaaagaggaagctcattgaagctgctgatccaagattgatgggaaaatttgatgaaaaagagatggaaaggatgttattggtggggcttctttgtgtgcaccctgattatgagaagaggccaagagtgagagaagcaacaagaattcttaagaaggaagcaccacttcctttgttgccaaccagtaaaccaagggtgagaattaggcctatttgtcctgatgatgatacctctgaagcacagagtgttgttgcggattggctcagcacagatgatgctccttatttgacccctagaagccagttttactag

SEQ ID NO: 74867 - DNA, 171 bp, Glycine max
  Peptide Sequence Number=SeqID_191645
atgattttagcttttggaatggacaatccgaaaaataagaaaaaaaattctcttaagggtgctgaaagttacttggaggtgcaggaagcaacaaccagaaagttggagtaccaatcatatccacactgcccatggatcaccaaagtccgaacagtacctttgcggagctag

SEQ ID NO: 74868 - DNA, 567 bp, Glycine max
  Peptide Sequence Number=SeqID_191646
atggctttacttaacaatatggaaaaaactgatgacaatattccaatgcctacctattttcgtttccttgctttacttgcctttaagatatttgcagcagagcaggtagatgttgctataatggaggtaggattaggtggaaaatacgatgcaacaaatgtggttcaggcacctattgtatgtggaataacttctcttgggtatgaccacatggagattcttgggaatactctgggagaaattgccggtgagaaggctggtatcttcaagaatcggattccagcttttacagtgcctcaacctgatgaagcaatgcatgtacttgaagagaaggcttctcaattaaatgtacctcttcaagtgctaactccattagatgccaaattgctaaatggtttgagacttggtcttgaaggcgagcaccaatatttaaatgctggtcttgccattgcactgtgctttacatggctgaaaaggactgggcatgttggagatattaatttggaacaaactatggggctcatagtcctgaaagcatggaagtgtgtgcaaggtggttttctctag

SEQ ID NO: 74869 - DNA, 435 bp, Glycine max
  Peptide Sequence Number=SeqID_191647
atggaggagtcttcgtacaccggtcttcccactagccacttgctcggttcagttcctgctgtcataactgaagaaaataatgccacgaaacatgtggccaccggtgcaaatatgcaaacattccctcccaacaatggaggagacagaggaccaggacatcaaactcttggcagtcctactgaagcttttgaacaacagccagcaaacaactggaggggaatctttagcatgtcatcatattcagagtatttcaatgtagacacagatgttgtcttaatcagattgataagttccttgaatccagttgctgcagactttttcagcaagatagatgctaaccctgatttgtgcgttatttttttgtgcccttgtgcttttatacttccaattatcaaaatagagatattgatttggattactattgaaatgtggtaa

SEQ ID NO: 74870 - DNA, 312 bp, Glycine max
  Peptide Sequence Number=SeqID_191648
atgaccaaggcgcctgcacgcactcgcctcgcccacgcgtggggactagggagcgggggcagcgtgacgtccttgtgtggggaagcacgagatttgaacggcgtttttcttcaattctaccaggttccggtccggttggagggggattccgtcgcaggaaaggtagaggtggtcggcgccgagggtgcggttccagtacgggaggtcgttgcggatgcgtgtaaggacacgcgtggagaagtctggggagaaagggtcgaagaaaaggtgcgcttcctcgggatcttgggtgaggtaggtgctgttctatag

SEQ ID NO: 74871 - DNA, 891 bp, Glycine max
  Peptide Sequence Number=SeqID_191649
atggaagatccaattggtcaagtattaaaaagaactgagctatcagatgggctaattttagagaagacatcatctcctttgggagtgctccttattgtttttgagtcacgccctgatgctcttgtacaggtaattactgaggccataccagatactgttggtggaaaacttataggacttgtgacctcaagggaagaaatccctgagctacttaagctggatgatgtaatcgatctggtgattccaagaggcagcaacaaacttgtttctcagatcaagagttccactaaaattcctgttttaggtcatgctgatggagtttgtcatgtctatgttgataagtctgctaatgtggagatggcaaggcggattgtacttgatgcaaaaatagattatccagcagcctgcaacgccatggaaacacttcttgtccacaaggatttgatagagaaaggttggttaaatgatattgttgttgacctacgaactgaaggcgttaaattatatggaggaccaagggcaagttctctgttaaatattccacaagcacaaacatttcatcatgagtacagttcgctggcttgcactgttgaaattgtggatgacgttgcacatactgactccatcgttgcagaagataaagaagttgctaatgtgtttctacgccaagtagacagtgctgctgtttttcacaatgcaagcaccagattcagtgatggggcaagatttggactaggcgcagaggttggaattagtacgagcaggattcatgctcgaggtccagtaggagttgagggattgttaacaacaagatggatactaaaaggaagtggacaagtagtggatggtgataaagggattgtctatacccacaaagacattgcaacttaa

SEQ ID NO: 74872 - DNA, 1146 bp, Glycine max
  Peptide Sequence Number=SeqID_191650
atgaaggcattgattctggttgggggatttggaacaaggctgaggccactgacactcagtttccctaagcctcttgttgattttgctaacaagcctatgattttgcatcagatagaagcccttaaggccattggagtgactgaggtagtgctagccatcaattaccaaccagaggttatgttgaatttcttgaaggattttgaatcaaagctcggcatcaagatcacatgttctcaggaaactgaaccactgggaacagcaggtcccctggctcttgctagggataagctgatagatgattctggagaacccttttttgttctcaacagtgatgttatcagtgagtatccacttaaagaaatgattgaattccataaaagccatggaggagaggcttccataatggtaacaaaggttgatgagccatcaaagtacggcgtggttgtgatggaagagagcacagggcaggttgataaatttgttgaaaaaccgaagttgtttgttggtaacaaaatcaatgctggaatttacctgctgaacccctctgttttggatcgaattgaactgaggcccacttctattgagaaagaggtgtttccaaagattgctgcagagaaaaagctatttgcaatggtcctgccaggattttggatggacattggacaaccgagggactatatttctggcctgaggctttacctggactcattgaagaagaagtcatcatctaagttggccagtggctctcaatttgtagggaatgtcattgtggatgagacagccaaaattggtgagggatgtctcattggacctgatgttgctattggtcctggctgcattattgagcaaggtgttagactcaaaagctgcacaataatgcgtggagtccgggttaagaagcatgcttgtgtatccagcagtattgttgggtggcattccactgttgggcaatgggctcgagtggataatatgaccatccttggagaagatgtccatgtatgtgatgaaatttacagcaatggtggtgttgttttgccacacaaggagatcaagtcaaatattctgaagccggagattgtcatgtcagttttttggattagaatgagtgatgccattgcattgatgaaaaggtcagcatctttgtaa

SEQ ID NO: 74873 - DNA, 1422 bp, Glycine max
  Peptide Sequence Number=SeqID_191651
atggggcagaagcagcgttcaagttccgaagccgacaacgaagtcaagaaacgacgccgtgttggtttctcaggcgttgattctggagttgaggccaaagactgcatcacaatctatctagtttcaagcaaggaggaattcgatgctccagagagttttgtcattcatcctgtggatctgaatagcttttttgatgatgatgggaaaatttatggttatgagggtttgaagattaccatctggattagcagcatatcattttatgcgtatgctgatattacattccagagttcatctgatcgaggcaaaggggtcacagatctgaaatctgctcttcagacaattttcgctgagactcttgttgatagcaaggatgaattccttcagaaatatttggcagataatgactttgtcagaacaaacatctcaaatggagaaactttgaagcacaaagcttttaaggagaacatttgtgattctaaccagcttacagattcttctacttctactgttgaggttgtccgtttggtggctggcaacatggctactggacaactttacagtcatctaatacccctcacactacttcttgttgatggtagcagtccaattgatgttaccgattcacagtgggagctgtatattgtgtgtcagaagaaaactgatcagcagggagagatccaatataggttgactggttttactgctgtttatcgattttatcactatcctgatgattcccgattgcgactaagccagatactggtattacctccttaccagcacaagggttatggtcgattccttctagaggtgctatacgatgttgctatatctgaaaatgtttttgacttcacagtagaagagccattagatcacttccaacgtgtccgcacatgtgttgacgcacttcgcctgcttcgttttggcccaattcagaatatagttactaaagccgtttcacttctgaagcaagaaaagttatcaaagaaagcacattgtcctcgacttttaccacctcccagtgctattgaggatgtaaggaaaagtctgaaaattaataagcaacagtttctccagtgttgggaggttttgatctacattggccttaatcctgttgacaagaacatggagaactttgttagtattattttgaaccgtgttaagtatgatatcttagggaaagattctgggacgtctgggaagcaacttattgaagtaccaagtgatgttgaccaggagatgtcatttgtcatgttcagatcagaagctaacgaagctagtactgtgcaaatggatgacaatcaggctaatcaagaagagcaactccagaagttagttcaggaaagggtgaaagaaattcagttgattgcggaaaaggtaaccctgcatcttgggagctcagggttggtggttaattag

SEQ ID NO: 74874 - DNA, 1215 bp, Glycine max
  Peptide Sequence Number=SeqID_191652
gaaactccagagcctttccctcttccaaccgaaacctctattgtaaaagctgcagcaggatgggctcattgtgttgctgtaacagaacatggagaagtttatacatggggatggaaagaatgcattccctctgggaaggtatttggtgaatcatcaacaggggtaagtcttgaaaaagatgtgccaggaaggcatactccattgttcacagagcaagtgagccctcgttctcaaggctcaagatctactggaggtactgcctccagtaacagtggagaagaaagtacaaagcgaaggagagtgtcttcagcaaagcaaacagctgaaagctcgtcatccagtgatgatagtctgacagcattcccatgtcttgtcacactaaatccagggataaggatagctagtgttgcagctggtggacgtcatacactagcattgtcagatacaggactggtgtgggcttggggctatggaggtgaagggcagcttggtctgggttccagaatacgtatggtttccactcctcatcttgttccttgcattgattcctcttattatgttaaagatagatctgctacactggctcgaggaaacatgggttcagagggacagacttttagaattcctggaagttacataaagagaattgcttgtggaggtcgacatagtgcagtaattacagtaaattcatatgtactaatattggaatatctatctgttgagctgacagatgctggagccttgcttacttttggttggggactttatggacagtgtgggcaaggaattaccgatgatgaactaagcccaacttgtgtatcttccctattgggtatccacatagagggaattgctgcaggactgtggcatacagtctgtacatctgctgatggtgatgtgtatgcatttggtgggaatcagtttgggcagttgggaactggtgctgatcaagccgagactctaccaagactagtggattcaccgagtttgaaaaatttgcatgctaagaatatatcttgcggtgctcgccacactgctttagtaacagagggcggaaaagttttctgctggggatggaacaaatatggacagctgggccttggggacgtgattgaccgtaacattccttctgaagtcaccattgaaggttgtgtccctaaaaatgttgcttgtggttggtggcatactcttcttctggccgagtcccacacttga

SEQ ID NO: 74875 - DNA, 354 bp, Glycine max
  Peptide Sequence Number=SeqID_191653
atggttattcaagtagactcttcctggggagatttctttggaaaggatggtgctggatttggatctaagagaaaatatatgtttcggaaagtgaccatccagctcaagcttgtgaagggtgactctgctggaactggaccatttctatctcaatgcattgagcttttctcaagtgcagacaacccgatttgcatcaatgaattgaatattaccggtttaggcatcatggagattcctatttgcttaggtggctccatttcatccactggctccactttatatgtgctcatgttttcctgcttttacaagatcgaatgtctcttggattccaatatatatgtcttaacttcttag

SEQ ID NO: 74876 - DNA, 192 bp, Glycine max
  Peptide Sequence Number=SeqID_191654
atgcatgcaagagttgaattaatgcaagatgttttcggtgttcattcagttatttctttgattcttgctttcattttggaccgtgctgctcatcatcacaggccagacaactaccttaagggaataattaacagtgctttgaaaggacttgatgatactccacaacctaaatccaaggctactgctaggtga

SEQ ID NO: 74877 - DNA, 234 bp, Glycine max
  Peptide Sequence Number=SeqID_191655
atgtatagcagttcgagctttttgggaaattgggttgttcagaatggtacaaaaaatggagaaagaaagatagtgcttggaagaaatattcacaccacgtgccttgaagtcactgagcctggtatagatgatgaggttattggggaaagggaagcttatatggcaggcatgttggctaaatacaaaaaatctctgaaaggaccaactatcattcaggatacccctataatttga

SEQ ID NO: 74878 - DNA, 334 bp, Glycine max
  Peptide Sequence Number=SeqID_191656
atggcggaggcatctagcggccagcatgaggccacatggaagcgcaaccacgtgggcgtccgacgtggcaccctcgttccgctgaaaatgattcgttcattttatgcgttggccactccaaagtccaaagtaacaaacagacgcactttctctctcttcagcgagaagaaaccgccagaaaataaaagggtgctttacatgtggggttaccttcccggagctctgccgcaaaggacgccgctcttgacgccggttgccgttagggttccgccgtgtgattattcttggaatgatgtttgcggcggtggctgtggattcgctattgctatatcag

SEQ ID NO: 74879 - DNA, 183 bp, Glycine max
  Peptide Sequence Number=SeqID_191657
atgttgggttacaagtgtgaggtgaagtcccacatcgggtctccttatgtggtggcttgtggtccacaggtgtacccctcgaatctccccaacaattggtatcagagccgatggttcaagttgatgaccggctcagacgagtatgcaagtaccacaggtggccatggctatactcgtggatga

SEQ ID NO: 74880 - DNA, 441 bp, Glycine max
  Peptide Sequence Number=SeqID_191658
atgggtttgctaataattagctgcagttggacccatgacaaggcggtgggtaattgcttcaacgtcgtttatcaagaacaatctcgtgaaatcgcattcaacatggcccctttacacgtgattccacgtttgaattttgtgcctcttgacaacaacggcgtatttggtaccattagaaaaagcatggtaacagtgaaaagagctactgttgcttccataaaagcaagatcaactgctggaccccactggccacaaatgttgcttataaatgcaaaatctagttcttctgaagtaaaatatgatctcatattttctccaaatcaactaagtgaaaaatttcttagagtgtcaaaacttggagcagatatgcctatggatactccaaaagacagttgcagtgcggcacatgttttcataataccccatttcatttctatatga

SEQ ID NO: 74881 - DNA, 249 bp, Glycine max
  Peptide Sequence Number=SeqID_191659
atggcgccaattctgatggcgccttcaagctggacgaggcacgtggccacggaaacgccattgtcagcagcgttttcgcttttgctgagctgtctatggaagcgccagcagcagtggcgactaggccctaggtcctttggaagcgccagcagcagtggcgactgctgtgcagaccctaggtccttgttgcagttgcagttgcagaggcttgcagggaagcgccagtccttgttgcgttttcacttttga

SEQ ID NO: 74882 - DNA, 933 bp, Glycine max
  Peptide Sequence Number=SeqID_191660
atggcggatgaagcaatcttgttattccatggtatgaaggaggactgtgttactgcaaataaaattaccttgactgcagtgctctctgcatgtgccaccattggcgctctggatttggggaaacagattgatgaatatgcatcacaaagaggatttcagcatgatatttttgtggctactgcattaattgatatgtatgctaagtctgggagtttggacaatgcacagagagttttcaaagatatgccccaaaaaaatgaagcttcttggaatgcaatgatatcagcacttgctgctcatggaaaagccaaggaggcactatcactatttcagcacatgtcagatgagggtggaggtgcccgccctaatgatataacatttgtagggttgctttctgcttgtgtgcatgcaggcctcgttgatgaaggatatagattgttcgatatgatgagcacattgttcggattggtacctaaaattgagcactactcttgtatggttgatcttttggctcgtgctggtcatttatacgaggcatgggatctaattcggaaaatgcccgaaaaaccagacaaggttacattaggtgctttgcttggtgcctgtcgaagtaaaaaaaatgtagatataggtgagcgggttatgcggatgattctggaggtggatccttcaaattctggtaactatattatctcatcaaaaatatatgctaatctgaacatgtgggaagattcagcaaggatgagattgttgatgagacaaaagggtattactaaaactcctggttgtagctggattgaggttgagaatcacttgcatgaatttcatgctggtgatggtttatgccttgactctatagatctaagtaacataattgatttgctctatgaggaactcaaaagggaagggtatgtcccaaaagttgttgaatag

SEQ ID NO: 74883 - DNA, 751 bp, Glycine max
  Peptide Sequence Number=SeqID_191661
ccatgccatcaaagatccttctagcagactccaattccccacatttagcatacatactaatcaaagcagaacctatataggagttaagagtcatgccacgttccacaacaaacccctccacccacctccccaactccaagtcccccaactccccgcaagccccgagcaaactcaccagactcatctcgtccggctcaaacccgtcccgcctccccatctcccgaaacacctccacagcctccctggcacaacccgccttggcgtacccggcgatcatggagttccacgacaccgagtcccggtggggaatttcatcgaacaccttgcgcgcggacgcgacgaggccgcatcgcgcgtacgcggtgatgagggagtgggcggtgtgggggtcggagtggagggcgagcttgaagaggagggagtgggcggcgcaggcgtgggagagggaagcgaggttggcgcaggagaggaagaagaaggggaaggtgaagttgtctggtgtgagggagagggacatcatgcgatggaagagggagagggcgagagggtagttgtgccacgtggtggtgagggcgcggatcatgatgttgaaggcgtagtcgttggggtggggagcgatgtgggagaagagaagggaggagtaggggaagttcttgaggtgtatggctttggagagaaggtggttgttgggggtgtggatggaggagttcaccaccatttgggtgtgaacttgttggagcgtcttcgttga

SEQ ID NO: 74884 - DNA, 240 bp, Glycine max
  Peptide Sequence Number=SeqID_191662
atggtgagcaaaggttggagctttgatggagcttcaatggtggaggaggaagggagaaaaagcaacgtgagggagagggaaaagcttctgcacttttggctgatccctcgcgtttctctgcacccgtcgggaccagttttcgaaagtaagcaatatatatatcaaaacgctcagactgaaaccccgagcgtggttcagaggttggttttgttaaattttaagttgcacgcaaaacgataa

SEQ ID NO: 74885 - DNA, 378 bp, Glycine max
  Peptide Sequence Number=SeqID_191663
atggacctcatgcattttagaagtgaattcttgccaacaacactcaatccatcttcaacttaccttcaattttctcctcttaaaccttttcaaaaaaccctaaacctaaaattccgatcacagaaacgctttgcagttgtttcattctcccaaagccataaaccaattagtgaattctcaattttggggcggaattcacggtgcacaagggacctcaggtcttacgctgctcgtagcaagaagtccggtggtgatggctcacccagcggtcgaattgaaggcaatgccgagttctggagacggttgaagcgcaatgacagggcaagaagcaagaagtatgctgaaaaacccgaagggaggtggaaactatcccgataa

SEQ ID NO: 74886 - DNA, 201 bp, Glycine max
  Peptide Sequence Number=SeqID_191664
atggaaaccccacaaaagaataatagtgttggattctttcagatgcctctacactacccaagatacacacaaaaagattatcaggacatgcccgagtggaagcttgatcgactcctcaaggaatatggcttgcctacacatggtgatttggcctacaaaagagagtttgctatgggtgcttttctttggcctaagtattga

SEQ ID NO: 74887 - DNA, 1461 bp, Glycine max
  Peptide Sequence Number=SeqID_191665
atgggagatcagaatcagacaagaatctcgtattctacgatgtcgccacgtgctagaatcctccggttggaccacatgcgtgtcagaaaaggaacaagtttcgacctaccgtgcgtccttccgattggtccacgtgttggatcagaaaagaagggctgggattgcatctgggtattaaatggttcgacgtcattccaactgtatatgtcgggtggtgcccgtgacggtgacgggcaggttgtgtggcccccagttgttggagaatccggagagacttcttcctcttcaatcgaacccacctcgcgcccctccgctcgccggagtttggaccttttgcctttgagatacatagctgctgacgtgtcagtcccggcgccggagaacagccggaagcgccagaagctggatcggtgcgtttcttccgcaagggagtgcgaaaacgcggttcagagttccaaatcgaaggtagctaaggctgttcggaatcgttcttccaagattcttacgttggactcgacaagtccaacagtttacgaggggtgtctgaggtatggggtaacgtccgtttgtggaaggcggagagacatggaagacgccgtttcggtccgtccatcgttttgccaggaaaatttatctcaagatgataagaaagagtttcatttcttcgctgtcttcgacggccacggatgctcacatgtggcgactatgtgtaaggagaggttacacgaaatagtgaaggaagagattcacaaagcgaaggagaatttggaatgggaatcaacgatgaagaagtgtttcgcgcgcatggacgaagaggttctcaggtggagccagaacaacgagactccaaattgcaggtgcgagcttcaaaccccgcactgcgacgccgtaggctccaccgctgtcgtcgccgtcgtcacgccagagaaaatcatcgtcgccaactgcggcgattcacgcgccgtgctttgtcgcaacaaggtagccgtcccactctccgacgatcacaagccggaccggcccgacgagttgcttcggatccaagccgcgggagggcgcgtgatatattgggaccggcctagagtgcttggagtgttggctatgtccagagccataggggacaattatctgaaaccgtatgtaatttcggaaccggaggtaacggtaacggagcggagtgacaaggatgagtgtttgatactagggagcgatgggctttgggacacggtgcagaacgacaccgcatgtaaggtggtgcggatgtgtctgaacgcgcagaagccggcgtctccggtgaaggagatggcggtggactgctccgacaagtcgtgctccgacgcctccattcttctgaccaaattggcgttggtgaggcaaagctccgacaatgttagcgtggtggtgggaggggatggacgtttttactgtggggggatcattcaaggggatgagaaaatatga

SEQ ID NO: 74888 - DNA, 966 bp, Glycine max
  Peptide Sequence Number=SeqID_191666
atgggcagacttgggaacaaggctaggtcatcgatagggcaatgtgctgcatggatgagacctgatattgtatatgtgaagaagccagtcttccagtgtaggtttgagccacaggatgactttttcaagccaataattccatttcttaatcctaaaacagaacaggattttctttttgagttagagaatgatgatggtagtgttgagttgtgtacttattttggtggattgtgtaagattgtgaaggtaaatcaaaaggcacttgtcaatgatgtggtgaatgcatatcagaaattgagtgatgagaaaatgtcaaaatgcttggagtttctgttgaatcatccagtggaattgttacatccatatactaaagagtggaaggctaagttggatgagatggagctgggttgtgatgctcctgatgaagaagatgatgctacttttgatgatcccgacgaaactgagattctagattggattgaggatgaaggcagtgatggtgatgctaacattactgatgaggatgaggatgaagaggatttgattgatgattatggtgacgaagaccaagatctagtcatggacatggaagaaagcaaagacggaaaatttcatgccatggaagaggatacactttcagatgaggatgagaaggactttaactggaacgaggagtttcaaaaggcattaagtagtggagaagcaatggaaaatctggcaaagaagactcttgagttcaataagaagttgagtaagaagcaatttatgatgaacaaagaagaggaagaaacagcgcactcagtagatggagatgaaactgacttgagaggcaagcaagcaaaggttaacctcaattttcaatgcataagtacaatgaaagcgcagaaaacacttcagactggcacggttagatgggcaccaacattcccaagttgtgacttgaaggctaacttgtcccttaactga

SEQ ID NO: 74889 - DNA, 303 bp, Glycine max
  Peptide Sequence Number=SeqID_191667
atgaatcatatacactttacctatgaactatgcaattcacacgactactcaattgttttcaaaatcattttaactcgtcgagttcccacagtggatcccatcacaatactcatcgcccttaaagggtcttacaattgtgtgattgcacagttcatagctcatgtcataacctacccttcggcgggagggcgacgcggggctcactggtgcgtcttccaagggaggaaaatgcacggagtcgccaccaacgtttattcgaggaaaatgtcgaaaaaaccaaaacgtgtggtctacgaactttaa

SEQ ID NO: 74890 - DNA, 1212 bp, Glycine max
  Peptide Sequence Number=SeqID_191668
ccttgcgcaacagaacgtcgaggccgcgctggcgatcgcccgccaacatcccctttatcgccccgatccgcaagatgatcggcatgagttattttacgcgctgctggacagcggccagtatcaggccgcccgcgactatctcgccacagtgaccaacggtgtcccctacacccgccgcctctacggctcgccgacgccgcagccaaacgatccgtggctgaacgcccaatcgctgaaggtacagtatctactgaatactaatgcgctgccggaagccgaacagctctccggccgactggccgccaccgcgcccggtaatcaggggctgcgcattgactacgcggcgatactgcaggcgcgcggtctaccccgcgccgccgaacgggaactgaaagcggcggaagcgttggagccgtcgaatatccccctcgaacgccagcaggcctacgtagcgatggatcttcaggagtggcggcagatggagctattaaccgatgacttgctggcgcgcagccctgaagacctgagcacgcaaaaattagtccgcgctcgcgaggtgcaccatatgtcggaattgcgtctcaacagtactcaggggatccactcggataacccggtcagcggtagccacgattttagctgggatgcggcgatttatggcccgccaatcgcggataactggcggcttttcgccggtaatcgcttcgccaaaggaaattttgatgaaggaaaaggctccagccgccagctctttggcggtatcgaatggcgcccgcgtgatgcctgggctgaactggaaatctccaacaacaatttcgccggcgacaacaaacccggcgcccggctgtccgcctggcaaagtttcaacgaccgatggcagattggcggcgaggtcgaacgtctgtcacggcagacgccgctgcgcgcgctgcgcaatggtatcagcgccaaccgcggcgagggctgggttcgctggtatcaaaacgaacgacgcgaatatcgctttagcgccgccgccagccgcttctccgaccacaaccgtcgtcaggaatataccttctccggcaaagagcggctctggcaatcgccaaccatcacgctcgatctggaacctgggctctccgccagcgccaacagccgggcggataccctctactacaacccgaaacgcgacttcgccgccacctcggcgctggtcgccgatcacgtcat

SEQ ID NO: 74891 - DNA, 2343 bp, Glycine max
  Peptide Sequence Number=SeqID_191669
atggaactaatgggccaagcccaaatgcaaggggagatggtgctgaaaaataaacagggacagcgagatagaggagccaagcatttggcatatcaggatctggttgacaggcaaaaaaagggcttgtgtttcaaatatggtggaccttatggcccattgcatcaatgtcccgtaaaacagcttcgtctcatcttagctgatgatgagttgcaggtcgaatgcgaagaagaagatgcgtttaaggatgcccaggaggaaggttacgtgattttagatggagaatgtagagctttatctctacaggggatggacaacggaaaaatggggagtcatagcaccatgaagctacaagagaagataagtggaattcccattcttcttcttgttgataatggggcgacccacaatttcatttcaaggaaattggttgaggctttaggttggacatgggaggaggcaaaatcaatgaatattttgatgggggatgatcatacaactgaaactaggggtatgtgtaaagaaattaaaattgagacagaggcagggaagttcacacttgatgctgttttgttcgatttggaagatattgacgttattttgggtatgtcttggctgaaaactttaggggtaatgatggtggattggaatactcagataataaagtttgaaacaaaactagggacgaagaccttgagaggagtaaatcaagaggatcctttgtttgccactgtgtgtggggtacttgatgaaagacaagaacggaaggagaatgggctgagcggtgagcagcaacgagatcttagagacattcttaccagttttgatgatgtctttgtggaaccgaagggattacctcctgttcgtgtgaaggagcatgcaattaacctgaaaccgggacatgatccaatcaatgtaaggccatatagatatccctaccatcaaaagaatgagatagaaagacaagtgaaagacttgttgaagattggtcatgtaaggccaagtcaaagtgaatattcaagtccggtaattctagataaaaagaaaaacaacaagtggaggatgtgtgtggattatagagctctcaacaaggccacgattccggataaattctcaattccgatgattgaagaactattagatgaattacatggttccacctatttctccaagttagatttgaggtccgaataccatcaagttcgaatgaagaaggatgacattcacaaaactgcttttaggacacataagatacattatgagtatttagttatgccctttgggctaatgaatactccttctaccttccaatctctcatgaatgaggtttttagaaagtttataagaagaggagtgctagttttctttgatgatatattggtgtacaacaaggaatgggaggatcatatggagcaattgaaaggtgtcttggaagttttgaggaaacaacatctttatgccaacaaggagaagtgtaattttgggcaaagaagcatagagtacttagggcatgtcgtttcaaagcaaggggtaaaggtggacccaaacatagtaaagagcatgctggattggccagttcccactaatgtcaagggagtacatgggtaccttggtatcacgagctatcatagaaaattcatcaaagactatggaaagatagctagacctttgaccgagttgacaaaaaaagatggctttgggtggaatgaccatgctcaaaaggcttttgaagaactaaagaagaagatcacttcagcccttgtcctaaccttgcctaattttgaacaagaatttgagcttgaatatgatgcatccggtttaggaattggggccattttgatgcaaaacaggaaatcggtggcgtactttagcaaggccttaagtagcagaaatgtcaccaaatctgcatataaaagagagttaatggcagtggcgttggctatacaacattggcgtccttacttacttggaaggaaattcactgtctattccaatcaaaagagtttgaagcaacttctccaacaaagaatcaccacaggaagccagcaaaattggctagctaagttgttggggtataatttcgagattgcatacaaaccgggtttagaaaacatgggggcggatgcattattaagaagcatgggggagatggagcttaattccttagcatacataccggtgtggttagattgccaaaatttaataactgaagtgcatgaaagttccacttggaggaaggttattgaaaacttgaagcaaggtcaagggaagcatctcagttttgagtataaacaaggtgtgttattcttcaaagacagattagtagttgttgaaacctcaagctag

SEQ ID NO: 74892 - DNA, 482 bp, Glycine max
  Peptide Sequence Number=SeqID_191670
atgaattagctatggacgcgaggatggaaaaggtggaaggtgatttggagatgatgaaatcgatgatggaggcgatacaagcaaaagcaaaagaagcaaaggagaaccagtcgaagatcctagaactggtgacgaaaagcttaatgatgaacgtcaacaatgaagaagagggagaaggatcacatggcggaggtcgcaaggccaaaacgaacagagagcatgatggaaaaaggccaaatccgagtagggctggtgcaggaaacgagcgacgaggtgaaggtgaggctcacctaggtatacaaggaagggaacaacgtatgagcaattatcggcgttgtagcagactgggagcgttgatgactacattccatggaggaaactcgagctcatttgaagagcttgcatgctgccaatccgttgacaagaagacgtttgatgaatacagcaagggtcgtcaaaatggagatggcaagcaaaaatag

SEQ ID NO: 74893 - DNA, 351 bp, Glycine max
  Peptide Sequence Number=SeqID_191671
atggtcaagcattgctacaatcacaaaaaacctgtgactcaacacactccttctttgatccaaatgtccccagaatcaagaaccccgtcaaacaccaatttggaatatgtcgaccttgtgggatccaatcaatggtggcacaatggaggcttagtgacattgaaaagtaaggagaagaggaggtcgttcgttttcaaggcaactttactccgacaatatggttcatgttgggacgaagtggaagggaggtggaaatttgactgtgtggatgattttacttatctggtgtttcatattaagattgtatttgggaaaggaaatgttccttcatgtgaggtggcttccctataa

SEQ ID NO: 74894 - DNA, 231 bp, Glycine max
  Peptide Sequence Number=SeqID_191672
atggatgaacaaaggagacaatgcatggcagcaactgtggggaaaccaggggtggcgctggacgagaagtttcttctggggctcattccgaatgctacgatggtgtttgcggggatcacattgatcttgatagctgaactttggcgcaggcctgctttggatgggttggagtgggttcaacggtggaggtccgttcgtggcgagcacggtggcatctctggccgtccttaa

SEQ ID NO: 74895 - DNA, 1728 bp, Glycine max
  Peptide Sequence Number=SeqID_191673
atggttgctgagcttgttcgatcccgagagaacccctccttcatttcagcaaccaccataccaagcttccatggctgccgtccatggctactacttgccgtacggagctcccacgaccgccttcaattgctgccactcaccatacgccactttcatgactgcctacctgatgaggacatgaccaagagcaagggcaaggatccacttgaaggacttggaggacctatgacaagggctagagcaaggaaagccaaggaagctcttcaacatgtgttgtccatactatttgaatacaagcccaagtttcaaggagaaaagtccaaggttacgatcctaagtcagcccttgtgccatgtgggttcatatcactaccaccacccacacaactcgtcgtcagccaccgaggaccgccttgaggcggccttggccaaacttgaggccgttacgcgccgcctcgacgcccaactggatgcccttctcctccgactacctcgacgacctggacctctgccacggattccgctcccacctccgccattgccgacaccaccgccgttaactccaccgacccctccgtcgttgccaccaccacctccagtcaagcacctgacccccgaagagttaagctcgcgccgggagcgcggattatgtttaacttgcgatgagaagtaccacacagggcatcattgcacctctaggtttcttctccttatcgcggaggcagatgagccctcttgggttaacatagagccagacgacctgaatccggctcctgacccgcccgacagcccgactcaatatcaggcccaaattaatctgaactcactttcgggccaatatttgaagtgcacaagcctttgtaaagttgtccctatgtctgcttactccaatgcctcacgaggtcatgcttccaaggatgatggtgtcaattctaggctcaacgtgatacgtattatcaacgagcctttcgcggcggccattgcttatggcctcgaggagaaggccattagctcaggtgcgaagagtgctctcattttttatcttggtggagggtcttttgatgtctctcttctcaccattgaggagggtaattttaaagtgaaagccactgctactaatactcacttgggaggtgatgaattcgacaacagtgtagtgacccaaattgttcaaaaattcaatgggaagcacaagctgactattaatggaaatgtcagagcatcgaacaacaagtccggtatgttgactcagtatggagctgccaacattgctagggtggtgttcgaaaaaatgcctaatagagacaagtcatcagggcctgccatgatatcagtcatggtgatcaaccttcccaaggtggccacgcaaacagggctccattcttatgctatagttgccaacttgctcattaacaaagaaatgcttggtagcctgaatccaacctttgttattcccgtttgtgtcttatctgcatataacagcataggcagctttgacatgtggaaaaggagcccatcttcactcgctcatcccgtcacccattttaatttgggatcccagttcaaattttggagccatgggagtgttagggaagtgataaggagcaacaagagacatactcaaggagaaagaaccaaaggtgcaagcaggggtgcaaatagtgaagcccaagagaaaggtcacaaaccagcatacctcaaggaaattggctatgtgcgattagtgtaa

SEQ ID NO: 74896 - DNA, 1428 bp, Glycine max
  Peptide Sequence Number=SeqID_191674
atggaactcagcactattatgttgtgcttgtttgcttctttcctatccattcttctgttcaaatcactcatcaaacctttcttcttctcttccaaagggagacaattgccacttcctcctgggaccatgggtttgccttacataggagaaaccttccaaatgtatggctccatgtttaagtcacacattttgggttatccttgtgtgatgatttctgacccagaagcagcaaagtttgtgctgaacaaagctcaactcttcaaaccaacatttcctgcaagcaaagagaggatgttgggaaagcaagcaattttctttcaccaaggagcataccatgctaaccttagaaagcttgttcttcgcaccttcatgcctgaggccatcaaagacaaagtctctaacattgaatccattgccctaagttgcctcaaatcatgggaaggaaaaatgatcacaactttccttgaaatgaaaacctttaccttcaatgtggccctgctttcaatttttggaaaggatgaaaacctctatggagaagctctgaagagatgctactgcaccctcgagagagggtacaattcaatgcctataaaccttccaggaacactgttccacaaggccatgaaggcaaggaaagagcttgcacagatcttggctcaaatcatctcaacaaggaggaacatgaagcaagatcacaacaacaacgacttgttgggctcgttcatgagtgaaaaagcaggactcactgatgagcaaatagcagataacatcattggtgctattttcgctgctcgtgacaccactgccactgtacttacttggattgttaagtaccttggtgaaaatccgagtgtcctagaagctgtaactgaagagcaagagtccttattaagaggcaaggaagaaagtggagaaaaaatgggtctgaattggtcagacacaaaaaatatgccagtgacatccagggtgatacaagagactctaagaatagcatcaattttgtcttttactttcagagaagctgtagaggatgttgaatttcaagggtatctcataccaaaaagatggaaagtattacccctttttagaaacatccaccacagtccagacaacttcaaagagccagagaagtttgatccttcaagatttgaggttgctccaaaacccaatacttttatgccatttggcaatgggacacgtgcatgtcctggcaatgaattagccaacttggagattttggtggtctttgatgggtgcaaaaaatgggattcaatatggcccttttgccattccacagaatggattgcccataacactatatcccaaataaaaagtggaggcacactaatcaaggcatggaagcaacttgctaaatatggaaaaataactcttccaaagatatttgaatttgttaaccagagaaagtga

SEQ ID NO: 74897 - DNA, 321 bp, Glycine max
  Peptide Sequence Number=SeqID_191675
atgttgggaagtgggaacagggttagctttggatttgcagctattttattgattgcagccacaagcatgaacagaaagcagccatatagggtagggtggttgaaaggtgagtgctacctagtcaaagggggaacctatgttggatcagccatattggtcctagtcacgaaaaaggttttagagagaggagaaattatcaactacactagacgccagcaagttgtagaggcaaaattcaaagttttaagcaattctgcaggtcgccaaggaatcataatttcacccagaaaaatagatattattcaaggaacaaactcataa

SEQ ID NO: 74898 - DNA, 2970 bp, Glycine max
  Peptide Sequence Number=SeqID_191676
atggagcaattgaagacgatcggtcgcgaactcgcgatgggatcgcagggcgggtttgggcaatcgaaggaatttctcgagctcgtgaagtccatcggcgaatcacgctcaaaggccgaggaggaccgcatcgtgctgcgcgagatcgaaaccctaaaacgccgcatcgctgagcctgacataccaaagcgcaagatgaaggagtacatcatccgcctcctctacgtggagatgctcggccacgacgcatcgttcggtcacatccacgccgtcaagatgacgcacgacgatagcctcctcctcaaacgcaccggctacctcgccgtcacgctcctcttaaacgacgacgacgacctcatcatcctcattgtcaacaccatccaaaaagacttgaaatccgacaactacctcgtcgtttgcgccgcgctcaacgccgtctgccgcctcatcagcgaggagaccatccccgccgtcctgccctccgtcgtcgacctcctcgcccaccccaaggatgccgtgaggaagaaggccgtcatggcgctgcaccgctttcatcataagtccccgtcctccgtttcgcatttgatctcgaattttcggaagaagttgtgtgataatgaccctggggttatgggtgctacattgtgccctctcttcgacctaattgcggttgatcctagcccttataaggaccttgttgttagctttgttagcattcttaaacaggtcgcggaacacaggttgcctaagagctatgactatcaccagatgccggtgccgttcattcagattaagttgctgaaaatacttgcgttgttggggagtggcgacaagcaggctagtgagcagatgtatacagtaattggggaaataattaggaagggcgattcgtcaagtaatatagggaatgctattctttatgggtgcatatgctgtgtctcttccatatatcccaatgctaagttgttagaagcggctgcagatgtcaatgcaaagtttttgaagagtgacagccataatctcaagtacatgggcattgatgcgcttggtcggctgataaagataagtccacatgttgcagaacagcatcaactggctgtcattgactgcttagaggaccctgatgattctctgaagcgaaaaacttttgaactactctacaaaatgaccaagtcttccaatgtggaagtgattgttgacagaatgattgattacatgattagcataagtgatgatcattataaaacctatatagcatctcgatgtgtcgaacttgcagagcaatttgctcctagtaattattggtttatacagaccatgaataaagtctttgagcatgctggagatcttgtgaatattaaggtggcacataatttaatgcgattgattggtgaaggatttgaagaggatgacaatgctgcatatagtcagttgagatcatctgctgttgagtcatatttgcgaattattggggagccaaagcttccgtcagcatttcttcaagtaatctgttgggttcttggggaatatggcactgctgatggaaaatattctgcttcgtatatcactgggaagctatgtgatgttgcagaggcatattcaaatgatgaaactgttaaggcatatgcggtttcagcattaacaaaaatttatgcatttgaaatagcagctgggaggaaagtagatttgctatctgagtgtctatcttttattgaagaactattagcatcccactccactgatttgcagcaacgtgcatatgaattgcaagctcttattggtttggatgcccaagctgttgaaacaataatgccccaagatgcaagtggtgaagatattgaggttgataagaatcttgctttcctcaatcaatatgttcagcagtctctggaaaggggtgctctaccctacattccagaggatgagcgcaatggaacagtgaatgtgagcaacttcagaagccaggatcaacatgaatctgcacaacatggtctgagatttgaggcatatgaagttccaaagcctccaatgccgtcaaaagttgctccagtttcactttcatcctcaacagaccttgttccagtacctgagccattatattctatggagactcacccaatgtcatcagtgggagcatcagagactggatcctcaggacttaagctgaagcttgatggtgttcagaagaaatggggtaggccaacttattcatccccaacatcatcttcctcaacttctacttcccaaaactcagtgaatggggtgactcagatggatgttgcaactgctgtaaattcaaaagcacgtgataattatgatactagaaagcaacgaattgaaatttctcccgaaaagcaaaaacttgcagataaattgtttggtggttcaactaaaactgataaaagatcatcaactagcaataaggttcctaaggctagtactagtgctgcagacagaactcaggaattgaaagctgcagctgtacccagtgaagtagctcgggagaaaactaatcaacaatctcctccgccagatttgcttgacttgggtgaaccaactgtcactgttgcacctccctctgtggacccattcaagcaactggaaggacttcttgacccaaaccttagttctacaacaaatcacagtggtgccgctgttacgaatgcaccagatatcatggcactgtatgcagagactccagcaagtagagagaccgaaagtggtggctattctatccctgtgactggagataatgtgaatattttatcagagttgtcaaatgcagctgccagaggtactactggagaaacaacagcgacgcctttgtcacagtctgtaaagggtccaaatgttaaagattctttgcaaaaggatgcaaaagtcaggcagatgggtgtgacaccctcagccacccagaatggggtgattccattaccaggaatgtctaaaccaggtaaagatttgttctag

SEQ ID NO: 74899 - DNA, 417 bp, Glycine max
  Peptide Sequence Number=SeqID_191677
atggcgatgctacaaagggagttggaggtggaaggcgtaaacaagctcagatgggggtgcaacacggggggtggagaccaacaaaggaaagggaaggagggcgaaaccacatacgcacatatatatggtacaaagaccttaaaaggaaaccaagagtatggaaagattaagctatgcaagattgctattgaaactgtcttagcccaatcacgtatatcagaacaagaagatgaagggcatcacataggacatggcgacaagagcgggagaaccaaaggaagagacctaggggaattagcaagtggtgactacttggcatttgatgcacttatttggtgtggggagctcacatgcttcactttgttattcttgtatgcctctaagactatgctttttgagttgggaactggggattga

SEQ ID NO: 74900 - DNA, 312 bp, Glycine max
  misc_feature (229)..(229): n is a, c, g, or t
  Peptide Sequence Number=SeqID_191678
atgccaaagcttggggttattgatgttggtggtggtgatattgttggtagatgggcttttatccttaccaactatcaagtaaaaaaggccttccttcaagttagccaaaccaatcgtcttcaacgtgcttttgtcctgtatttcacaagaaattttagaaagatcactagaaaagggctgccacttcagcgttgttcaccggcacctccacttgaggaggttgtgccgncaccagaagcagatttgttgttcaagagatgtgggcgacctgggtatttcaaatgtccaggagggtacccaaacttagagtag

SEQ ID NO: 74901 - DNA, 2673 bp, Glycine max
  Peptide Sequence Number=SeqID_191679
atggagagcaatggggagagccatagcagtagaagtggtagcttcagggaggggttcgggttggctccgaacgaggcaaaagttcacactttggttgagcttggtagtgttgattatacacacactactactactactagtcttcttcaagatggtgatgatgatgatgttggtgaggagagagagaaagagcaaagaaaacctcttacaaactctctatctcctaggcagatgaagtcccttgttgctctttgtgacaccctcttaccttccatcaacaacaacaacgttgtttggggctctgatgatgaatctgttgccaacttctacaagacttcggcttccatggctggaacacctgagcatcttgggatattgataagtgagaagctgaagcacccaagtacatggctgttgttgctgacactatggctactatccacatggtttggcacattcatactgtgtggtacgttgagcctctcaacaaagtttcctttcttccatagctacccagaattgtctcttctcaaacggcaaaaagttatgcagtcttggtctctcagttaccttcgaccccttaggatgttctttagaaccatcaagcttctcactctccttgtcttcttcactcagcataaaggttccaaatcgtttgtggaggaggaatggaggaagatacatgtgaagggatgggcagtctatattttgaaagaaaggttaaaaatcttaaagggcaaacttgaggagtggaacaaagtggtgtttggggatatccatcaaaagagggagaactctttgatggggttaatggaggatggttgttggaatgaggaacctagtgagctagatgaagcagaagacaacccatcatggaaggcaattgggtattgtggacctgatccagagttcaaatcacagttgaagaaccacttctttacaaagcaaagaggacaagaagaaaaagaagatgatggcactgaagatgttagaggacctctttacaaaggtcttatccgcataaataacccacgagacatcattacagattctctaagacgagttggattctctgtctctgctactcccaaaaagaccaaggcttctaccctatcatctccttctctagttataaaatgtgatgcagtggttgttggttctggctctggaggaggggtagtagctggagttcttgcaaatgctggttacaaagttctggtcttggagaaaggaagctattctgctaggaacaatctttcccttcttgaaggaccaagcatggatcaaatgtacctctccaatggtttggttgctacaaacgacatgtctgtgctaatactagcaggctccacagttggtggagggtctgcaatcaactggtcggccagcattagaactcctcaacatgtgtgcaaggagtggtgcgatcgccacgagctcgaactattcgagagtatgttgtacaaagaagccttggatgttgtgtgtgagaaaatgggagtgcaatctgagattgatgatgaagggttcaacaatgctgttttaagaagagggtgtgtagaaatggggtatcctgtgtgcaacattcccaggaatgctacatctgatcactactgtggctggtgttgcttggggtgcaaggatggaaggaagaaaggtacattggaaacatggcttgtggacttggtgaaatcagggaatggtgcaatcattccaagttgtgaggctattcaagtcttgcataagaaaaagaaaggaagacacagaaaaatagcaaggggtgtggcttttgcaattgaatacaaggggaaaaaggacatttgtgtagtggagtcaaaggtcacaattgttgcttgtggagcacttagtactccagcattgcttaaaagaagtggattgaagaatgaaaacatagggagaaacttgcaccttcatccagtggcaatggcttggggctacttccctgattcaccttcacctgagttgtggcctgagaaacataagaagagctatgaaggagggattatgacagcaatgtccacagttgttgcacagtttgacaaatctggatatggtacagtgatccagacacctgcattgcatcctggtatgttctcaattctaatgccatggacttctggtgcggatataaaagatcgaatgcgcaagttctctagaacggctcatgtgtttgcgctggcaagggatcaaggatcaggaactgtgaattcgccttcgtgtataagttatcagttgaaagacattgacaaagagaatttaaaggttggacttgagaaggtactgaggattcttgcagcagctggagctgaagaaattgggacacacaacaacaagggaaggagaataaatgtgaagcaagtgagctatcatgagtttgagaaatttgtgaaagaggaaagttcaatgtctttgacagacatttcaaccccattgtgttcagcacatcaaatgggaagctgtaaaatgggtactaatccaagggaatcagttgtgaaccaaatgggagagacatgggaagtggagggtctttatttggcagactcaagtgtgtttcccacagctttgggtgtgaatccaatggtcactgttcaggctatttcttactgcacagcacaatatgttcttgaagttcttagaaggaaaagaaagtga

SEQ ID NO: 74902 - DNA, 108 bp, Glycine max
  Peptide Sequence Number=SeqID_191680
atgggattgggagacctaagaaggaacactattggctcggagtttgaggaaggtaaggtctcagagttcttcctcatccagaagctccttcaaatacttgtcgtattg

SEQ ID NO: 74903 - DNA, 258 bp, Glycine max
  Peptide Sequence Number=SeqID_191681
atgaaagttgaacaaagaccaattgatgttgttgtggtttctggattaccatcaccggtcatttcactaaaaccgcttcagaacctaaaaacccgcaaatcaccggatcctgaccctggctcggagcgctgcggcggaggcaccacgtacatgttgccgagacacgagttatcagaaaatctttctcagttgcagtggtttcagaaattgaggtcccgaaaagggggaaaaagcgaagaagaaaaggcgaaaccttga

SEQ ID NO: 74904 - DNA, 338 bp, Glycine max
  Peptide Sequence Number=SeqID_191682
cacctcctccttgtgctccccaacccaccccctcatgccttgtcgccgaccagacccgacccgttgagctcgccggaaactttgcccaaaagggtctccgaattcgcccatggccctcgatttccgaccttagagacccttcaagcgctccgagccagggtcaggatccggtgatttgcgggtctaccaagcttggaagggtagcaattgttactatatgggaaggggttctaggtgatataggcggttttagtgaaatgaccggtgatggtaatccagaaaccacaacaacatcaattggtcttcttcatttgattgatgtgttaggtttaagctga

SEQ ID NO: 74905 - DNA, 279 bp, Glycine max
  Peptide Sequence Number=SeqID_191683
atgccaaagattgcaaggaataaaagtgtggaggttttatgtttgtgcaaaatttcgattgactcgcttagcgcgggtgactcgctaagcgagcactcagtgacatttgaatttttcaggattttaactcgtgcacttagcgggacaggcttgcttagcccaattcagaaattagaaaacccgagaaggttttgggctcaatgcacaggtgcgcgctttgtgagttatgcagctttgattggtctgcaacttccgctaagcgggacatggccaacttag

SEQ ID NO: 74906 - DNA, 732 bp, Glycine max
  Peptide Sequence Number=SeqID_191684
atggcatcagaggagacaacaatttggaaggcaatgataaaaactccagcctccatagtgttgataatttacacctttatatcaatgtggtttgtaggtggcctcactgccttccatttgtatttgataagtaccaatcagactacatatgaaaacttcagataccgatatgatcggcgagccaacccatataatgaaggagtgttgaataatttcaaagagatattctgcatcagcattcccctttcaaagaacaattttagggcaatggtgccaagagaaccagcattacctactcgatcagtgggtggaggctttatgaaccaaaatatgagaaaagctggggaggacatagagatgggcaggaaaacagtgtgggacatgggtgctgggattgatgatactgaagctcaaataaacaatgaacgtgtgactataaaggatggtgaattgtctccagaaattaggacaacagtagatgactcggaccgtgctggaatgcatcctaggcgatctagctggggaagaaagagtggaagctgggaaatgtcccctgaagttctggctttggcagccagggtgggggaaccaaaccgtgtcggtggaggtggcagcagtagtagtttggcacacgagaaccgtcatcaaaattatgtgcaatatgggggttgtaggcatttgcaaggtgtttcctttgcacccgtggaagttgctgcagctctctctggctga

SEQ ID NO: 74907 - DNA, 339 bp, Glycine max
  Peptide Sequence Number=SeqID_191685
atgtcacactcagtgagctggctcgcttatacctattccattaaatgcaatttcagagaggtttttggacttagcgcaattgtctcgcttagcgagaccccttcagccaatgggtgggggttggagcgaaaaagctgggttgctgatgaggacatgaccaaaagcaagggcaaggatccacttgaaggacttggaaggcctataacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 74908 - DNA, 762 bp, Glycine max
  Peptide Sequence Number=SeqID_191686
atggcgtgtttatatggcggaatttcggccttccgccatgttccaccatctgccattgatgaactgattaggacctatcctcctagatccatcaatgccacccactctattatccatgcaccaagctcaatagtgttgggcatgagggggtgcattgtggaagtctcaagtcttacatcgactaaagatagtgccaaaatagagtatagaagcatatcaccaatttaccatgctatgcacccaaaagatattctttccaaccctatgctgatgctacaatcttttcaggtcttagttcttcttttgttaacatctggccgagatccaggcataattccacgcaatgcacatcctccagagccagaaggtttggatagtaatctagatgttggtgctggtcagactcctcaattgcggttgcctcgctttaaggaggttgaggtcaatggcatccctgttaaggtcaagtattgtgatacttgcatgctctacaggcctcctcgatgctcgcactgctcaatctgtaataactgtgtggaacggtttgatcatcactgtccttgggttgggcagtgtattgggctggtattcaagagaccaggttcttccatagagttcccaaatccaaagacttaccctcgttatcaaccctacttatttataggcaactcctccctaactattactctctcaaactccattctcctaacttattctaactctcttggctacaaacttatcagtatacttactgtcctataa

SEQ ID NO: 74909 - DNA, 252 bp, Glycine max
  Peptide Sequence Number=SeqID_191687
atggaaatagtgtaccccattgcccagagactcttcgctatgcgaaggggccatgctaatcttctctgtatcgttccaattttatcggatgtccccgaagggacaatccatgtggtggcacatttcattataaacaagaataccgtgttagggctcctcagctatttcagggttgcagctcagctttttcagggttgcagcaaggtggcagcaggagcagcagttgaatcgcaggctccactagcgatttga

SEQ ID NO: 74910 - DNA, 336 bp, Glycine max
  Peptide Sequence Number=SeqID_191688
atggttcccaagataccaaatctagaaatagtttctcctctctccatctgtagagaaaacgaatgtcccataagaaagaaggtgatttggttgaggaagatcatcaaactaattattcgtgaccgcggtaagattccgctgcgtgttgatcaagctctatggatcaagggaagggaggttttgttttggttcagtacttacatcgatgtttgtaatacactatacataaccatagttcttatccatgaaatcaatagaacattgcataaggctggaaacatggaaatgctcgaggaagaaatggagagtccaaacctcaaggtcgtggaggaatga

SEQ ID NO: 74911 - DNA, 117 bp, Glycine max
  Peptide Sequence Number=SeqID_191689
atggagaggcattgctgtgtagctgcaggggaatttaccttcttctgcctaggttcacatgctgattgggaaattggtattgttatggtgttaatcactgaaatggggaaagcgtga

SEQ ID NO: 74912 - DNA, 147 bp, Glycine max
  Peptide Sequence Number=SeqID_191690
atggcggtgatgaaaggtggtgtagttagaggtggtgcgggtgatggtgtatggaaaggctgggttgggtttggcactgggattagttggtataaggctaaaatgttattgccattggaccccgaggacgatatcggcaccacatag

SEQ ID NO: 74913 - DNA, 838 bp, Glycine max
  Peptide Sequence Number=SeqID_191691
atggagagatctcactctcagactcagtacaggatgtatgtgaagagagaacagcactcacaccttggagattactcatcgtgggaagaaagggcttttgctgaagacgcagcaaggatacttggtgggaacatgtggcctcaaagatcttactcttgcaccttttgcacaagagacttcaaatctgctcaagcccttgggggtcacatgaatatccaccaaagggacagggctaggctcaaacaacaaaatcatcttagccctcatcacaaaaatcatcatttcatcatcaaatccttattaggtaataataaacttcatttctcatctgcaccagaaatctccacccagttagattgtggtcttactcatcatgcttgttattcttctagccctgcaactacaatcacaacaaccagactcttctcttgtatatcatccacacaagatcaaaattgtggccaccataatttttcaccttcttcttctaattcttgttcttcttcaattatcttgggacacgtagggtctcctaattcagaacaagaaggggtagtcaaagcaagggactataaatttaatggcttgggttgtagtaattatgttgaaacaagtttgtctgttggactgacttcaatgtttggccaaaattcatcatcaccaacaaccgttccttgtggggacagatccaacaacagttgcaagagactaaggagtagcattgtttcttctctgcctctctttcccaagccatgttcaaatgataaaagctcggcttttcaacctgtggtacatggaacggttgaagacttggatcttgaactcaggctagggaaac

SEQ ID NO: 74914 - DNA, 534 bp, Glycine max
  Peptide Sequence Number=SeqID_191692
atggcatcctcaataaattcagcaagttgtgagagttctgaagcactgttgagtgttcaagagctgataaagaaacccctcacttcggttcctcaacgctatattacacgactacacaatcatgaaccttcatctgttcaagatgaaaccctctctcatgcaatcccaaccatcagcctgaaaaaattgattcatggaggagctacaaaaactgaacaagagaaattgaactcagcttgtaaggactggggtttctttcagttggtggaacatggaataagcccacaagtgctgaaaacgctcaaagatgagattgaaggattcttcgggcttcccttggaagaaaagatgaaatacaagataaggccagatgatgttgaaggctatggagctgtgattagatcagaggatcaaaaacttgattggggtgataggttatatatgataaccaaccctcttggtagaagaaaaccatatcttctcccagaactcccttcatcccttaggttcgtatgtattctctctaaattctaa

SEQ ID NO: 74915 - DNA, 300 bp, Glycine max
  Peptide Sequence Number=SeqID_191693
atggtgtggtgtctccaatcatctttcttccttctccattccgccgccattgatcttcaagaagcaaaggactccattgatgaagaagatccaaggcctacaagctccacaaggagttacatcactatctaccttagaaaacaacatgttaaaaagaaaggaaagcaagatagaaaatcgaaaaaggcctacatagcttgggaagacaatgtgtcaacatcctttgattcttatagtgaaaaagaagttgaaaatgtgtgcttaatggcttattcaaggtatgactccttaactatttaa

SEQ ID NO: 74916 - DNA, 3612 bp, Glycine max
  Peptide Sequence Number=SeqID_191694
atgatggtcgaccctttatccacaggcattgcttctagtactgtgagtgatgtggcagcaactttagtggatgaagacactgctattgctagcattggcaaagagactgatctgaatgaattgcagcttatgaatgaaccatatgggattccctgcatggtggaaatatttcactttttgtgttctttgctcaatgttgttgaacatatgggaatgagtcctcaatcaaacacaatagcgtttgatgaagatgtgcctctttttgccttaactttgattaattcagccatagaattgggagggccttcctttcaccgacaccctagattgctgagcttaattcaggatgaattattccgtaatcttatgcaatttggtttgtcaatgagtcctcttgtactttcaatggtctgtagcattgttctaaatttgtatcaccatcttcgtacagaactcaaattacagctagaagcatttttttcttgtgtaattttgaggcttgcacaaagcaaacatggggcttcatatcagcaacaagaagttgcaatggaggcccttgtagacttctgcagacaaaaaacattcatggtggagatgtatgctaacttcgactgtgacataacttgcagtaatgtctttgaagacattgctaatttgttgtccaaaagtgcttttcctgtgaacagtctgttgtcttccatgcatattcttgctttggatggtcttattgctgtcatgcaaggaatggctgcaaggataggcaatggatctttgggttcagaacaatttcctatgaatcttgaagaatatactccattctggcaggaaaaatgtgaaaatttcagtgatccaaataattgggttccttttgtatgccggagaaagtacttcaagaaaagattgatgattggagccgatcattttaatcgtgatactaagaaaggtcttgagtttcttcaaggagcacatcttttgcctgacaaacttgatccccaaagtgttgcctgctttttcagatacactgctgggttggataagaatctcattggtgattttctaggaaatcatgatgaattctgtgttcaggttcttcatgaatttgctagaacatttgatttcaaagacatgatgttagacactgccctgcgtctatttttggaggctttcagactgcctggagaatcacagaagatacagagggtgctcgaagctttttctgagagatattatgatcaggctcaaaatatcctagccaataaggatgctgctcttttgttatcatactcaattataatgcttaatacagatcagcacaattcacaggtcaaaaagaagatgacagaagaggattttatccgaaataataggcgaataaatggtggcaatgatctacctcgacagttcctgtcagaactttaccattcaatttgtaagaatgagatccggacaactcctaagcaaggttctggtttccctgaaatgaccccaagtcggtggatttatctcatgcacaagtcagaaaaatctgctccattcattgtctctgattccaaagcataccttgattatgatatgttttctatattgtctggtccaacaattgctgccatttctgtggtatttgataatgctgagaatgcagaggtataccagacatgtatggatggattcttggctgttgcaaagatatcggcttactatcatcttgaaaatatactggatgatttggtggtgtcactttgtaagtttgttactgtttttgatccattatctgttgaggagtcaatcctagcctttggagatgacacaaaagcaagaatggcaactgagacagttttcactattgcaaataggtatggtgattacatccgcacagggtggaggaatattcttgattgcatcttaaaatttcacaaattaggtcttcttcctgctcgtatggccagtgatgcagctgaagagtcagagctttctacagaaactgaggatggtgggaagcggaatactaattctttatctttatctcgtcttccatctgctaatactccgaagagatcctcaggattgatgagtaggtttagtcaactgttatatcttggcgctgaagagccaagatcagaacctactgaagaacaacttgctgctcagcagtgcacccttcaaacaattcagaagtgtcacattgacagcatattcaccgagagtaaatttttgcaagctaaatctctattggagcttgcaaaagcactcactagtgcaggagtgcggcctaaaaaagggaacagcacatctgaggatgaagatacttcggttttctgcctggagttactggtagcaatcactctgaataatagggatagaattgaacttctttggcagggtgtttatgagcatatctccaatattgttcagtcaactgtgatgccttgtgcattggtagagaaggctgtttttggcctcctacgaatttgccatcgcttacttccctacaaagagaacattactgatgaactactgaggtctttgcaacttgtcctgaagcttgatgcacgtgttgctgatgcatactatgagcagatcacacaggaagttagtcacctcatgaaggcaaatgcttctcatattagatctcatttaggatggcggacgattacatcactgctttccatcactgctagacacctggaagcagctgaggctgggtttgatgcattgttgttcattatgtcagaccaagcccacctgcttccagctaattatgttctctgtgtagatgctgcaaagcagtttgctgaatctcgtgttggacaggtagaacgatctgtaatggccctcgatcttatgacagggtctgtcggttgtttagagaagtggactaatgatgctaagcaagcagcggaagaagaggaagtggcaaagatgttgcacaatattggggacatgtggttgaggctcatacatggactaaaaaaactatgtctggaccagagagaggaagttagaaaccatgcgttgttatctttgcaaaattgtttgacaggatcagttgggattaatctcccacatagcttgtggttacaatgttttgatcaagtgatcttctccgtgcttgatgacctgcttgaaatttctcagacacactctcaaaaggacttccgcaacatagaaggaacgcttgttcttgctatgaagctcttatgtaaagttttcctccaattaatccaagacctatcaccattgccaggcttcaacaaattatggttggctgtactaagtcggttagaaatttatatgaaggtgaaagttaggggaaggagaagtgagaagcttcaggagcttgtgcctgagcttcttaagaacactttgcttgttatgaaagcaggccgtgtactagtccgtagcagtagtgtagatggaagtagtttatgggaactgacatggctgcatatagataattttgctccgttgttgcaatctgaggtatttcccgagcaagactcggagcatttgcagcacaaacagactgaaaaagttgaaggtttgggggctgatgaaagcaattctgtgtcttcaaatgtaacagcaggtaaagatgatcctggtatcggttaa

SEQ ID NO: 74917 - DNA, 376 bp, Glycine max
  Peptide Sequence Number=SeqID_191695
gaggatcttagaagtgtacattgtggagttgcaaaatcttgccatgacatttctagggctgttgggaaaagccctgaagatagaaaagagagagtgggaggtgtttgaggatgggatgcaatcggtgaggatgacatactatcctccatgcccacaaccagagcgggtaatgggcctcactgctcattcagatgcaacaggaatcacaattctcaaccaagtcaatggagtgcatggcctccagattaagaaacatggcatttggattccagtcaacgtcgcctcagatgctcttattctcaatattggagacattttagaggtttcttaccttcctataattcatatttcgttctatatccacatccatgcatag

SEQ ID NO: 74918 - DNA, 171 bp, Glycine max
  Peptide Sequence Number=SeqID_191696
atgcatgatgcgatcaaggaacaagccagaggactgttagcgacaatgcatcaccaaaagaggaaaactctagatgaggtttccctgttatcaagcgagtcggagacccagcatgaccatagattgacctccactccttatggctcacatagactcgggtataaggcctaa

SEQ ID NO: 74919 - DNA, 741 bp, Glycine max
  Peptide Sequence Number=SeqID_191697
atgggacatgtaaagttgcaaacacaaactggtattaatgcaatagaagagggatctgggcagtgcaaggctgaatatcctaacaaaactactgtggcatgcatgatcaatgcagaaattggcgctgttttggctgtcatgagaagaaatgttagatggggagttcattatatgtcggatgatgatcaattggagcattcccttgttcagtctctgaaggcattaaggaggcaaatattttcatggcagaatcagtggcatgtcataagccctgccttgtatttccagccttttctggatgtcattcaatcggatgaaactggtgcaccaattactggtgtcgctctatcatctgtttacaagatcttaacattggatgtaattgatcaaaacactgttaatgttggggatgccatgcacttggtagttgatgctgtcacgagttgcaggtttgaggtgactgatcctggatcagaagaagtggtattaatgaagatattacaagttcttctagcatgtgtcaaaagtaaagcatctatgatgctgagtaaccaacatatttgcaccatagtgaatacttgtttccgtatagttcatcaagcaggaaccaaaagtgagttgttgcagcggatagcacgttacacaatgcatgaacttgttcggtgtattttttctcaccttcaagatattgacaacacagaacttgcattggtaaatgggagcactgctttaaaagaagag

SEQ ID NO: 74920 - DNA, 920 bp, Glycine max
  Peptide Sequence Number=SeqID_191698
gggctgggaaatcctgcgtgaagccggcgtgcgggtaaacgtctgcccgcgctcagattcgcactacggtattgaaagcgggatgtttgctattgaggctgcgcagcgtcatggcattacaccgggtctgagcgtggataacgaaacgtcttacagcaccgacatgtttatggaaatgcgcgtggcgttttatctgcagcgtgtaatgggtatgcataagcagcactgctgtgattcagatcattctttgacaacgatcccggcagcgcagctgcttaaatcggcaacggtcgatggtgcattttgtgccggtctgcaggataaagtaggcagcctgacgccgggcaaacaggccgatctgatcctgattaacgcggctgacctcaacctttacccgaacggaaatgcattcggaacggtggtacatgcagctgaacgcagcaacatcgataccgtgatgatcggcgggcgcatcgtcaagcagaacggcaaagtgctgggtgtggacagtgagcgccttcgcgccgccattgatgagtcacgcgagcatctatttgcggcagcagggtatgagccagacatctttgcggaaaaattcctgccgctgacgacactgaacagtcagctcgcaaaagggctcggcggagatccggtcaccgccgcgttgttttcctttacggccggggcgttcggccttggaatttactcgctgctgcgtggagggttattcacctcccttgctgccattccttcgcagcctgtgtggagtctggcgggcggactgattggtgcctgtgcgttattcagctacgttgtacttgctcccaaaatcgctactctcatcacaggtgatcgacaattttggcctgctgggcgcgataaggcggccagtctcgttgctgaagctgggaggaatgctg

SEQ ID NO: 74921 - DNA, 579 bp, Glycine max
  Peptide Sequence Number=SeqID_191699
atggaagaaggttactctaccaacaagccatcattgttaagaggaatcaagtatgattattgtaaggaaagggtgacaactcactttgagtctatacacatcgacttgtgggaggttgtagagaatgacaactatatctcatatgatgttgagttgaatgaaatcctcagaaaggaatacaccaaagtccatagctttagaagcgccaaacaaatgtggaacaccttagccataacatacaaagggtcctcacaggtccatgaacaagaacttcaacaggatgaagaaatcaagaaaggaaagtcactagctctaaatgctcagaaagccaaaaaatcttcatcgcccaaagagtccacctctagaccatcaatcaaaggctcaatcaaagctttaaatgtagatgactcttctcagggtgaatatgaagatgataaattagaaaaatatgatcaactagccttcatatccaaaaagataagaaggatgtggaagaagaaaggaggatccaactggaaaggctcatttaagaagaaatccagagatatgaaagatagggagaatagttcaatgatttag

SEQ ID NO: 74922 - DNA, 219 bp, Glycine max
  Peptide Sequence Number=SeqID_191700
atggtgaagggttcaatcgaaggcttcaatcgaaggtcacaaggctgtctactgggttcaatgcttgaaactgaaacagcaaatacgttgagggcaagcgagaatggtgaagggttcaatcgaaggtcacaaggctgtctacagggttcaatgctcaagggtacaatgctaggtctcagtgctgtctactggggttcaaaggaaaagacaatacgttga

SEQ ID NO: 74923 - DNA, 2379 bp, Glycine max
  Peptide Sequence Number=SeqID_191701
atggtggtgagagaactggaacgtaaaattgttcaacttgaacaagataataaggaattgggagatttacttaaagaactcagggaagctcagatcaataatggtgaaacaggaaatagccaacagaagacttctggtgctgagggggagcgattaaaagaagcagctaacatcaataaatcattatctaccttgggtcatgttattatgatactagtggatgtggcaaatgggaagcagaggcatatcccttacagagactctagactaacttttcttcttcaggactctcttggcggaaactcgaaaacaatgatcattgccaatgtcagcccttctatctgctgcgctgctgaaacattgaatacacttaaatttgctcagagagcaaaacttattcaaaataatgctgtggtgaacgaagattctactggggatgtaattgctttacaacatcaaattcgacttttgaagtctacactgaccaacaaagaacaagaaataagggagcttcagatggaattggaaaattgttattatgccattgaagagaatcacttgggactcttgatctttaaatctgaacttgctgaggcttactccaaatcattcaggggcagggcagaccctgataaagcatttgatatcaaagagaatgaagacatggttctaatttctgcagagcaattgagagtgaaagacaagtctctaaaaactatggcacaagctgcacaacaacactctctgttggaggaagagcttaaacaacaaaagaaaaacctcgaggaatcatctgagggtcaactaatcttggaagagcaactgctgcagatggaatacaccctacaatatgaaagaagtgcggcatttgaggctctagaagtgctggaacatgaaatagccagtaaaaatgatgaaatatgtcgattaaattgtgaagtacaggattggaagtctactgctgaaacccttaaagtatcctatgaagaaattcagggaacaagtaaaaagatgaaagcttcccttctatcacatattaagaatgagcaagcccttaagcaggccaatgaaaaccttgtctgtattgtgaaggatcaggaaagaaaaaccgaagatcttctactgcagattggtttattggaaaggtgcaatgcagagaaaatgaaggaagcagaaagatgtaagcaagagaaagagggtcttattcaaatagtagaggagagggaatgctgcataaaggatcttcataaagatatagccatcagctgcttgaagcaagaatccaaggaaaaagaattagaagatgcaattcatgcccagctggatgcagagaaagccctcaagcaggagaaagaaattcttttgaagattaaagatgtgaaagatcgaactattgagcactttcagtggctagctatagcatcagagcaagatttgttaggtgcgcggtgtttttctttctcaaaacaagtggaaaagtggattgaggtcagtgtgcttagggacgcgttgaaaaatgcacaatacctggcaaagctagaaattgaagaaaagaacacgagaatagtgaaatcagaagaatcaatcttccatttaaaacaagaagcagagcagcttcaagcgtcactggaagccttgaagtttgaaaatgaaaaattgatggataaacagcaggccatggaattcatgataacaaagctcaagtttgagaacggaaatttactgcaagacatcatgaacttatcgacagaaagggaagatatgctggtacattttgaagtcatctttggtagaattggagaattgtctagtggggatatgcaattgatggagatgttggggaatgtgttgaatacttctgaagatgaaaatgaaatagcaatgggttcagtagtttgtgacaagccacatgagtctgctagagatagtgcaaatgatcttctttttcctcccacaactaaaaaaactgaagaaaatattgatggacgatccccattgagagaggttgaatccaatttaagtgaaagaaaaacagttttagaggtttgtgagacaattgtaaagcgaggtgggagcttagctggtgcaggaatagtggggattgtacaaaaaatggaagaggatcagagaggtctcgtctttgggaatgggaagagaagtgttgttgccatcgatgggggaatatatgaaaattatcctcaatacagggcttatttgcaagattcagtcatagagctgctaggaacagaaaagtcaaacaatgtggtgatagagcatactaaagatggatctggaataggagctgctgtattggctgcttcaaactccataggaaaaggtgacttgatggaggtccaagattattttttttcctcataa

SEQ ID NO: 74924 - DNA, 963 bp, Glycine max
  Peptide Sequence Number=SeqID_191702
atggcttccaacaatgttccattactagcacctcctgtattcacaggaaagaacgacgaaatctgggttgtgaagatgagaaggcagttgaaagcttttgatctttgggaagcaatggaaacaactgaaccaccagctttggaagagaatccaactgttgctcagatcagatttctcagtaagcaagttgccaaaagagcaaaggctcttaccatcttgcactcagttgtggatgatgatgtttttatgagaatttccaacttggatacagcaagggagatttgggagaaacttcaagaggagttctttggaaatgagaggaccaagaaaatggagtttgaagccttaaagatgaatgaggctaaaagcataaaagatttcatgaccataatgatgaaggttgtgaatcaaatcaagttgttagcggagaaatttctatacagtaggatagttgagaaagtcttcgttctcttagccgaaaaatttgaacctaccagctttgaaaaagctagtaagtttgaacaatggaaccattctatgaaggagatgaccaccattgaagacaacaatacatggcagctggttgacaaactggaagacaaaaattctattggagttaaatgggtctataaggtaaagctgaatcttaatgggtccattaacaaatacaagaccaaacttgttgttaaaggttatgctcagcaacctggaattgattatgtagagacgttttctccgaaacaagctcctagagcttggtacaacaacattgatgcttactttagcagtcaaggttttaggagtgaaaatgaggcaactctttatgtgaaaaggttgttggatggtggctctttaattgtctatgtgtatgttgatgattttctaatgactagcaataatcaacaagaagtgcaacaactgatagtggagatgcaaaatcagtttcagatatccaacttatga

SEQ ID NO: 74925 - DNA, 429 bp, Glycine max
  Peptide Sequence Number=SeqID_191703
atgaggttcaaagttctcggctcgaactgccagttcgtgaagaacaacattgatctcacttcgaagaaaccagggaagacgcgtgcagctcatcgagttgttgttgaagaagttggaaccttgtttactgggctgcaaacggacaacataccttatccaaactatctcacaaataaaaagggaaatttatctcttaaactgtcagttagtaagaaattccatgagttgacagctcaagtttctgctgagactgaccctgtatcactttttccaaaagttgtgtctttactttatatccaggtttaccacaaagcacttcaagctcctggaagggccatttctattggtatttcccatttaaagcctgctggtgtttcccatccagacttcttatccattatgattgcatatcatactgatagaacctag

SEQ ID NO: 74926 - DNA, 963 bp, Glycine max
  Peptide Sequence Number=SeqID_191704
atggagttaaaaaatttatctccttgtctgtcatctagggaattggtagaggcagggaaggacatagaaagtgcttattgggaattggttgtgaaggacatacaggatacttgcaaacttctggagctaatttacaatgaaacagatggggaagatggacatgtatctcttgcagtttccccaaagctagcaaatgacaccaaggggacaattgaggcagcaaaatggcttcataatatggttggaagtccgtgtgtttacatgaaaattcctgccactgatgaatccatctcttccatgaaggaggtcatttctctggggataagtgtaaatgccactctcatattctgcctccctaaatatgaagcagtgattgatgcttacttggatggccttgagtcttgtggcatgactgatctctctaaggtttcaagtgcagcagcattctacatcagtagagtggatgttacacttgacaagaaacttgagcaaattggtactactgaggctcttgatctcaaaggaaagggtgcggttgctcaagcagtcttagcataccaactttaccagaaaaaattttctggtccaagatgggaacgcttggagaatagaggtgccaagaagcagaggttgatgtgggcttcaacaaatgtgaaaaatccatcttaccctgacacattttatgttaattctcttattggaccagatacaatttcaaccttaccagtacaagttcttcaagcattcatggaccatggtattctttcaagaacgcttgatgcaaaagtatcagaggctcaagacatttacaatgcaattgagaagttggggattgattggagttctgttggatcagaactggaacatgaggtgctggattctttcacaaaaagctttgacaatgtgcttgaatgcatgcaaaagaaggctatgaacatatattcatttcaaaagcacgtttaa

SEQ ID NO: 74927 - DNA, 267 bp, Glycine max
  Peptide Sequence Number=SeqID_191705
atgatgcattgttatttgagtatgattgatccagctgtcgttgtcattggcactgagcatctttcgagtgattgttcacacattcaccgctttcatcttgtgtacttgaagaccaatgcgaaatgctgccgaaatttcatcaaatcactcgaaagagattttacttggccacaccttcaatgcaaaaaagtgagttttgcatgcatcacagataacttattgattgtcatgaatagcaaagacgaaacatggatcgaagttggatga

SEQ ID NO: 74928 - DNA, 393 bp, Glycine max
  Peptide Sequence Number=SeqID_191706
atggtggtgagcttgttcttgactcatctccttgaagtggcatctccaatcacctttcctgcttctctatctgctgccattgatcttcaagaagcaaatgactccattgatgaagaagatccaaggcctacaagctccacaatggagccacattaccagggcacttcaagtccaaatggtctaatcagtacttgggaaggcctgaaagacatatcatcttttgaggaaaatgaagaagccaacttctatccaatggctgatagagtatcagaagagtctgagtcagatcaagatgacgaggaaaaccttgaagatcctaagtctcctaaaaaagcttatcatgaacttctttggaacttatccattctttcaaaagcttacaaaaacttatga

SEQ ID NO: 74929 - DNA, 438 bp, Glycine max
  Peptide Sequence Number=SeqID_191707
atgaaaggaactttctacccaaagctggtgaaagtcttctatacttgtgcccgcgccgatatggaagtttggaaggcagtagccaaactggacatggttggagtccagaagtttgaagaatctgctaatggttacagcaagatgcagacttacaaaggtatgctcattgacccaacaacgactctgaggaaccacctaggtgtaggtggtttaactgttgaagacagaatgcatatagtagatttcaccaaagggtctaatgagataaccgaaaggaatctcaagaagcttaggatgagatttattgaacacaaatggatcatgactggagagtcaccagcagcagcaaacatagaccagatggaagaagaagcgaaagatgaagctcagcaagagcctgcgcaccaatggagtccttttgaatctcttatgatttag

SEQ ID NO: 74930 - DNA, 370 bp, Glycine max
  Peptide Sequence Number=SeqID_191708
gggccattggcaactggtagtactgtgtcctgcgaccaatgttgttgcatggttttgttcgttacatgttgatcatgctattattataagcagtgcaatgaagtcaacaaacacaactgcggatggtacaaataatccagcaactcctaagtggattgaagtcaagagccatgttcaaagcggagggtatgagtgtggctactacgtgatgcattggatgtggaacatcgtcagtgggggtttaaagaatgattggagcatgtggtttcttgatggaacggtgttagacaacgaaacaattacaacgattcaccagaaatgggcagcatattttcttaaagttcaaagcaatcaatgtacaaagtcttag

SEQ ID NO: 74931 - DNA, 249 bp, Glycine max
  Peptide Sequence Number=SeqID_191709
gaattattgtggctataacctgcagtagtgcagtggtgaaattgggcgcttggcgcatctgctgccccttacttgtattgtctcttgaagatattttggtcaagctcatggatttctcactcaatcttgcacctgtggacaagttacaccggttagcaactgaggcgggatttgaactgaatttcttgtcccattttggtgggaatgtctttcccaatgagaaaactgaggacctagagtttttgattg

SEQ ID NO: 74932 - DNA, 381 bp, Glycine max
  Peptide Sequence Number=SeqID_191710
atgtctgagggtttgtcagaattggtgacagtgcagaagctatggagcactgcagttctgtgcctatatgaagctggaaagtattgcagagtgcgactattggatttgttttgtgaagctctcagtcaacatttatacctttcaagggtttctgattgtgatgtgggggatgaaaaagattgtgatttgtcctcaacaaatgatcccagacaacaatattccatcatgaaaagcggtggtattattggcaaaatagtatgcaaagtgagggatctccctacagggatgctatatcagttgattgagagttgggaaaaacttactgctgatgtttcagagtggcttccaacagaaggtcagcaagctaagtgtactcattga

SEQ ID NO: 74933 - DNA, 951 bp, Glycine max
  Peptide Sequence Number=SeqID_191711
atggcaaagcaaaggatcttaaaccacgtcgaaacgagaacaagattgggaagtggtcaaattgcgatcttgttaaggtacaacaagagatgggctaaagatagaaatggacagatgctggaaagaatgtgcccccgatcaacgacaactaagataacgacaaagtcattggaaggaggtaagcatgtgacgaaatccagggaaaggtcttcccagactgatgaaggccggaatgaactgggaatccaagggaagccagattttgcctttgtgaaagatgagatcgcgttggagtgtataatccgagtgggagttggcattatggcgaagctgttgagtttggatagatacacttgctactctaagtgtttgaattacttgagtcatcaaatccttcaagcttctatgatccgtaaggatgatgaatggactgcccagaaggtagtgactccattttcgaactacggcggtgatggcgtggagacgacactcatggctgtgccgcaagcatcagtctccaaagtgaacaagatagagaagttaggtgtggctaagacagaggtcgttgtcatgaaatgttttaacttgtcaaaagcctgttgcgcagctgaattccatctcgccgatattgggcatgggaaagcgatccttcaccataatggcgttaagggccctgtaatctatgcagcacctccaacttccatctttctttttgacgagaaggacaagggagaaaaatatgctaaagagatggatatggtgggaaattgttcgataagggggaagggaatcgggttcacgaaagatgtttgtgaagtggttaaggatagaggtgatgggggagaagaagtggggtgggccgatattggtgctatatggaatagggatgatatactctatgtttgggcaaaacgtttgagctgttgggtgttggtcgtcatttacgactaa

SEQ ID NO: 74934 - DNA, 663 bp, Glycine max
  Peptide Sequence Number=SeqID_191712
atggtttcagggattatgacatataatggccttgataattgcattccggataatcgatcctacggagatgaaagcagaactagcagaggagatggatgtataactgattcattcaatgatgatgatgactccagctcttcatccagcaaagatgcttttggatcattctcatcaaaatgttttgcaatgaaaagagatgaacaagaattggaagagtgggaaatcgcagaaagtcctcaacatttctatgttaaagataagtccgcttttgacgtggccaattgttcagatgtagaagccatgaaagaaaagtttgcaaagctgcttctaggaggtgatgttacaggaggagctaaaggcctcaacacagctttggcactgtctactgccatcacaaaccttgcagtcacagtttttggtgagttgtggaagttggaacctctatctgaagagaggaagagcaaatggcgacgagaaatgggctggttgttgtctcctaccaattatatggttcagttagttcccgctaagcaaaatggtgccaacggtggaatctttgagataatgaccccaaaagctcgtgcagacatccaaatgaatcttccagcacttcagaagttggactctatgcttattgtaggtcacctcttcgttctaatttaa

SEQ ID NO: 74935 - DNA, 576 bp, Glycine max
  Peptide Sequence Number=SeqID_191713
atgcgtgctaccactatctaccaagataacaacgcggtggtggcaaagggttctgaaaacgcgaaaggtttccggtgcaggcgtccccgtcaaagcattgagactgatctgaggaaaagcgttagaggaaggttcaatggtagggaagatgtcggcatcagtgttaggaacaagaggcctttgtctctgtgcaccgtcatttcttctgaagtcaatcgcttaaaaggaattttggggtgtgggtttccgcccaaaggtggggaaggcagagtgagaatggaacgtcagggcaaggccgaaaatccgattagccaagcgttcaaagtccgtaagatggacgaagcgaaccaagactccagagcttggagcatcatgggccatgaggtgaagaaaccgttgcggtacatctattggtaccattataagggatctcgtccgccgaaacaaggtacatccaacctcatgggtgggcgtgaaggtaacggggatggtggcagtttgggagaggtgggggttggtgtcatggtagtgaggcgctctagaatggaatcaatttttgacttcagcactgtctag

SEQ ID NO: 74936 - DNA, 657 bp, Glycine max
  Peptide Sequence Number=SeqID_191714
atggtaattgattaccagaggctaatttccagataccacccaagatacatagttggccagccgccacacaagcctccttgcttcgtggactttgttcttttattggttgactgccaggagctcgcctgtttaggtacgtcacaggttctcactgactggctatgcccaagttgggtcgggattagccaagcttggttttgggcaatagtaccccacctgacgtccccaaggtctcctgacccccgcgacatatctccaggtaccactctgtggtcaacaaacaaaagtaggaagaccgactctaccatgctttctcacatcaagcttattggattatgggcacccatcatatgtggcactaggtggcgatcgggcgatggcacaaatcaactatcccacttctacaagccaggcataagcacaccatccccagttgcccacctttacattgagctcacgcactcctacgtagctcttatcctcgttcctctcagcaccgggtccccatcaacccctccaagctttcacaatatccaaaaaattcaattccatttgtcacgaaactaccctaaaccaagaaaaacagagtggaggcagaaaactctgcacaaagctcattcaaattccatagtttttcctactcacatgccccagtaa

SEQ ID NO: 74937 - DNA, 264 bp, Glycine max
  Peptide Sequence Number=SeqID_191715
atggtggttgatgaatctgaagatgatgatgattctaatgatgatggtcctgtggagtgggcttcatattggaaaccaaatataacaataaacttggttgctgacttcactcacatactagcttttggcatgcttctgtttttcttgttcaccctgttcgagtttttaaccatgtccttatttaatagggttgtatatgaagaattggggaaatatggagatctggataaccaagttttgtgtgtgagcgagttgaggaactag

SEQ ID NO: 74938 - DNA, 699 bp, Glycine max
  Peptide Sequence Number=SeqID_191716
atgcccatgccaacaataattaaggatgcacttctgaagtctgggaaggcaagccttggagaggaactgcacaaggtcttgatggctgaatcgagttctggagaagaaatgcttaaagctctcaatttgagttctgaacatactgccctagagaccattaatagattggaagctgctacattttcatggaaagagagaattatacaagaaaatagtggaaaatcccccgttcgaacctcgtggtctttcatgaaggaccctatggcagaaacgcttctaagtatgcttaaagcaagatatccaaaccttccccaaacatttctggatgctgcgaaagttcaatttggcaaggatattgggcattccattttagaagcatactcaagagttcttggaagtttagccttcagcatactgtctagaatagcagatatattgcaagaggattctttaagcaatcccaatacaccaatttcagcaagttgctctcctgggataaatctttatgaagcttgggtggttggttcgcgtgtcaggcactcgttaatcgataagatgaacgaggtagatggacaatattgtgcttctagttgtggcagtacttctgacatagaattctcatctactcatgccaatgctagtaactctgtacccgccatgccaagccgtggtcgattgtggtgcattggtagaggctag

SEQ ID NO: 74939 - DNA, 516 bp, Glycine max
  Peptide Sequence Number=SeqID_191717
atggagcagaagaagaggcacgatggaggagtggatggcttcgacggggtggaaggattggagggagggggagaggagaatgacctagaatctcatcagccacattttctttcacgcggcggaaaccaaactagaagagggtcgggtgtccatgctcctattccaaggctgatgtggcgggttgacacgtgtctcggagtgccattgtcgaaggagattgtcccgtgtcaagggaaattatctgatgttcgggctgcttctgtcaagttgtctgtgatggacatgcctttgatcttgcaagctaagtgtgacatgtcagctcaaaagtcaagaacacttcatgttaacaaagatgatgacttcaagaatcaaggaatgagttcaagaatgaatcaagaacacttcaaggttcaaaaggaaattcgatttcaagaatcaagtttcaagattcaagttccaagaatcaagattcaagactcaagattcaagaatcaagagaagactcaatcaagataa

SEQ ID NO: 74940 - DNA, 2279 bp, Glycine max
  Peptide Sequence Number=SeqID_191718
atggaaagtgcaagaatcagccaatggttaaatcttctagtttgtgtactgctattacttaaggcagaaggatcttcagttccattgactttggtcgagaatgccgaatcaaaaggagctgtatgtttggatggaagtccaccagcttaccactttgataagggatttggagaagggattgacaactggattgttcacattgagggaggaggatggtgcaacaatgtcgagagttgccttgaacgtaagaacactagattaggttcatctaagcaaatgaaggatatttacttttcggcaattttaagcaatgagcaacagtttaatccagatttctacaattggaatagagtcaaggttaggtactgtgatggttcatcgtttactggtgatgtggaagaagttgatccaacaaccaatttgcacttcagaggagcaaggattttttcagctgtaatggaagaattactagcaaaaggaatgaagaacgctattctctctggctgttcagcgggaggattgactactatattacactgtgatagctttaaagctttgttgccttctggagctaatgtgaaatgtgttccagatgctggtgccgatgcaagtgtagttttgcttcggtgtagatctgacccatgtggggataccaggaaaagaaaggattttgatttctgggttttgttttttggtgcattgggtcattggaaaagtggagagattgttgttggtgtcatgggttccaatggtagcaaagccacttcttcgtatttaagtagttcttcatcgtcttcttcggggagtttaaggaagggtcgatctaagggccttaaagtttttcaatcttgttgtcttggaacaacttctggttctcacgacagtgataatgaagaccaggtttgtgatcagaataaagtaaatggaagtgatgctacatatgctgatggcaatggcacagactcggatgaggtgaaagcggagtcatttagaaaggttaaacctggggcaatgacttgtatgccttctaacataggccttgatggatggggagaaacaagcatccccaacacttcatccagaactggaagcagctctatccatacttcttcaactcattccttgaaccctacaagtcattgcctttctcggtttagtctcattcctggtaatgtaagcttcagacttagcagaaccactagtttggggtcatcaagtcctcgtcctgtttcttctgccaatctctcaatatttgacaatgaagatgagcataatctccatcctggatctcctggatgtttgattaacagaagtgtaacacaacaacgtagtaatttgcttcctgcatcttttttcaatcaaatacatgcacaatgtcatgaagatgcttctaataattcaaggtcaaatgtcccgacatcaggcatacttggaaacttgcagagcaattccacagatggagtatgtacaagagaagggccagatgtgaacttactttctccaagaagtcagaccgcgacagaaaatgttgacaatgacactacacatattgatcaacgaaatggtgctcgagaaccagttgaacggaattttcattttagccgaactttaagtgtcggaaggcttcgtgacagagttctccgtcgatcaacattatctgacctcacctttttccctttgcaacaagagacagagctgagagatgctagcctgcctagccaggatatggacaggcaagcagtggagggaaattcaagagtgtcaccatctgatcatagtaccattaattcttcaacaaatagatatcctccatctagtatgtctaactccatgtttagcatccaagattatgagggtgagacttcaggattgagagaaggtaggtatcaggatctactggagcataggtccaatttccttgaacggagaagaagaatacggtcccagcgattgggcagccggtttgaaaatctttctggacatgatagatcgtgcatcttgtctggtcaacatagaaatggtcattgtacatgccgaatcaataatcgtaacactaattcaaatgatgacactggtgctagagctagcatatcaagaattgttatgcttgctgaagccctatttgaggttctagatgaaattcaccaccaatctgttgttttatcttcccgcccatctgtatcttctattggatctgttcctgcacctaatgatgttgtcgattccttgcctgtcaagttatatgagaagttgcataagcatcaagaggatgctgcgca

SEQ ID NO: 74941 - DNA, 774 bp, Glycine max
  Peptide Sequence Number=SeqID_191719
atgtcttcatttttgtctgactctgccatcgccatgggtgatagtgattccgggggtttgattcagcaacccttgatggactgggaggtcattccattgaccgttcttcctcagaagatacttgttgtggtctctccgacaatgagtcctcctcatcggatagacacagccttccactgcttccagggagtgtgtcctagttactgtgatcctcccccttctacttccgagggagtagggagagatagtggcaggggagatgtcaaggtgagggatgatgttctgaagtacaagtcttctctcacctttgcagtgagcatcattggtctacaacaccaagtgaagctagcaagacttgaggactcctgcaagatatttgttcaggcctgcgggagtgatgacttccctttcttgagggcgacgccgagcagtccacccttcttctttatgtataggtgtttgtttgaggtattatgggtgacttctcttggaggccacttgcaaatcaggatggacttgctggtggtgttgtgccaccatctactactgcttctgttgttggagaagggggtcaatttgctgaggtcatccctgttgaaggcccctttgagcctccgtgttgtgaggcaagctgtagggttaacgcccgatgtaggtcatcgttcatgtgtgcaagatatgcctcaagctccagtggccatcaaggctcctgctaccaatgttgttgttactgttactgctactcctccacctcctcctgctgtaccttgttag

SEQ ID NO: 74942 - DNA, 2187 bp, Glycine max
  Peptide Sequence Number=SeqID_191720
atgactcccagattcgatcacatagtagtggcaattgaggagtcaaaagatgtagagcccatgatgattgaggagttacatggatctcttaaggctaatgaactaagactagatgaaatgagtaatgaaaaaagtgttgatcaagcattatggtctcaagcaacaaagaaagggagtgcaaaatttagtgcttcaattgtgaaaaatggggacactttgctaatgactgttggtatggaaaaggcaagcagaaaagaacaaatgataatgaaagcacatgtggtccaagaagatttagactcagatattgttctattgatggtaaccaacaatgatgatgttgtgcaaaatgagtcatggtatcttgatacaggttgcttgaatcacatgaccaatcacaaggagtggttaactgatcttgatacatccagaaagagcaagtccatcaaaatattaagaactgatagaggaggagaatacaactctaatgagtttgatgaattctacacgaggaatgtaattttgcatgagagaaggccttaccacaatcattgtaggggtaaagctatctcaatagttgcctatttgttgaacaagtgcccaactaagaaattgaaggagaaagttcctaaggacatttggacaggaaggaagccaattgtgagtcatcttagaatatttggctcacttttcttcaaacatggccctggtcaaagaagaagaaacttggaagacaagaatcaacctataaagcacaaagaaagattggttgtaaagggctttctacaaagggctagtcttgaccactcaaaatttgtattcctcaatggacctttgaaggaagaggtttatgtcattcaaccacctggatttgagataaaaggaagagaagatatggtgtacaagcttaaaaaggcactctatgggttgaagcaagcccctagagcttggaataaaaggattgatgcctttttggttcagcaatactttagcaagtgctatattgggcatggagtatatgtaagattgcaaaatggaggattggatcaagtaataatatgcctctatgttgatgatctattggttattgggaacaatcttaaggagattgatgatttcaaatttgacatgatgtttgaatttgaaatgatagacttgggaagactcagttatttcttaggtatagagtttacaaatgcttcaaccagaactatcttgcaccaaaagaagtatgcattagaaatattgaaaagattcaatatgactaattgcaacttagttgtgacaccaatggatgcaaatgcaaaactcatgaaaggaaatgatgatgagagtgttaacaatactctattcaaacagattgtgggatccttgaggatttatatatgggttgaagcagggaaaggaaaaagtacatctttaatgggcggcaacaatatacaaagttcagcagatcataacttgtggaacatgctcattgcattaggaaacattgcacttgctagttgttattctcaaattgccgtagatattcaggacactttgagatcatcaccaccagaaaataaagtgatgaagaaggcaaatatgataggtatatccacaatgacggttttcttccagctatgtgcatgctctggctatgctgcatttggctcagaaacacctggcaacatcctattgagctctggctttaaagaacctttttggctaattgacatagccaatgtcttcattgtggtgcacctggttggagcatatcaggttattgtccaacctatttttggtgcagttgaaacatgggctagagaaaggtggccaagctcaagttttattaatagggaataccctttgatcatcgggagaatgaagttctgccttagcttctttaggctagtttggaggaccatatttgtggcagcagtgactattctagccatggcaatgccttttttcaatgagatgcttgcccttttgggggccattgggttctggccaataacagtatattttccagtggagatgtacattgcaagaaagaagataaagaaaggagcaatgagatggcttggacttaaaacattgagcttggttttcatgttactatcactggctatagcaattgctgccattcatgggatgaatcaagctcttcgcaagtacaagcccttcaagtataaagcgtag

SEQ ID NO: 74943 - DNA, 1740 bp, Glycine max
  Peptide Sequence Number=SeqID_191721
atggcggggcagtcgcggaaatggatgatcctggtggccacgatttggattcaggccttcacgggaaccaatttcgatttctcgcagtactcgtcgtcgctcaaatccgcgcttaacgtgtcgcaggtgcaactgaactatctcgcgacggcgaacgatatggggaaggttttcgggtggtcctcggggattgccctaatgcacctgccggtttctgttgttatgtttgtcgcggctttcatgggcttcttcggctacggcctccagtggctcctcatcaccggcgtcgtcgatttgccttattttctggtttttcttctgtgccttttaggaggctgtagcatctgttggttcaacactgtatgttttgttctctgcattaggaattttccggttaaccgagcacttgcattatcactcactgtgagtttcaatggcatcagtgcagcactctacacccttgttgccaattcaattgatccatcatccgatgcactgtatcttctattgaatgctcttgttccccttctcatatgtattgcagtacttgttcctattcttcgccagccggctttagaccctctccctcctgatgcagtaaatcaggactcaatgatatttctaatattgaacttcatagcccttttaactggtctttatcttctcctgtttggctcatctgcttctggtgtgacttctgctcagctctattttggtggagctactctcctcctcatcttcccattatgtattcctggcattgtatatgctcgggcttggtttcggcgtaccatccattccagctttcagatgggaagctctagcttcattcttgttcatgatgatgatcttgagatgcatagagagctccatagctgtcacaatagtattgttagaaatggagatacttacagtctgcttagtgataacggatacatgtttgggagccagagggaaaaagatagtgatatgtgttgtgagacgatgattgtccaggatcacttaacagtgctaggagaagagcacccagtagcagtagttgtccgcagattggatttttggctatactatgctacatacttgtgtggaggtacacttggtctagtctatagcaataatctgggacagattgcccaatctctgggccagcgttcaaatacttctacacttgtcacgctctatgcaaccttttccttttttggtcgcttgctttcagctggaccagactatattcggaataagatctactttgcaaggactggttggttatcgatttcacttataccaaccccagttgcattcttcctccttgctgcatcagacagtcttctgacactgcagacaggcaccgcactgattggattgagctctggttttatattcgcagctgctgtgtcagttacatctgagctgtttggaccaaacagtgtgggcatcaatcacaacattctcatatcaaatatccctattggatctcttctctatggctttcttgctgcactagtttatgatgctaatgcacactcaatacccggaaacttgataacgtctgactcagtagtgtgcatgggaaggcagtgttacttctggacatttgtctgttcagctgtagaagcaggagctatgctttgcccaggtgttggttccaaagatgctgctaccatatacttttcagtagctttcggaaaaagctcttttaacaaagtcagacatgacattttgaaagctttagttatttaa

SEQ ID NO: 74944 - DNA, 1473 bp, Glycine max
  Peptide Sequence Number=SeqID_191722
atggccctcaataccaccaagtctaaaaactcaacttcaccttcaaatttctacttgtgcaccactcttttcttcattgtcctcttcaccatacccgttcttttcctcctccatgccccaaccaccaccatctccatatgcaccaacccagccaaaacatggtctggtgatcttcagttagttgaatttgcgtggaaccgcctctcgttttttgaacacaagccaccaccctttgctctcaaagttgctgtcttctccaggaaatggcctattggcacaacccctggtggcatggagcgccatgctcacacccttcacacggctttggcacgccgtggccatcaaattcatgtcttcacatctccacctgatcaagatgagagcatttcaatctcatcattctctgaggtgaacaaaaacaaccatcaatcttccccttacatccatttccatgaaggtgagcctggcaggtggcactataacaaggcgtgggaacagtttgtagaagaaaacaagccagaaccattcgatgttgtgcactcagaaagtgtggcactccctcactggctagcgcgcaacatgtcaaatcttgcagtgtcttggcatggcatagcccttgagagcttgcaatcaagtattttccaggacttgactcgccggcctgacgagcctatgtcccctctcttcaacaaaagcatacagggcgttgtgccaaaggtgctgaatgagataaggttcttcaggaattatgcccatcatgttgctattagtgatagttgtggtgagatgctgagggatgtgtaccaaattcctaacacaagagtccatgtaatactaaatggtgttgatgaggatgactttggagaagatgttgaattgggaagggaattcagaaccaaaattggcattccagggaatgcaagtttggtaattggtgtagctggaagattagtgaaggacaaaggccatcctctgcttcatgaagcatactcaaggcttatagccaagcaccctaatgtgtacttgattgttgctggttctggaccatgggagaacaggtacagggatttagggagccaggttcttgttctgggatcaatgagcccttccatgttaagagctttctataatgctattgacatttttgtcaatcccactctcagaccacaagggcttgaccttactttgatggaggcaatgatgagtgggaagcctcttttggcatcaagatttccaagcattaaaggaactattgtggttgatgatgaatatggttacatgttttcgccgaatgtggagtcgttgttggaggcgctggaagcagtggtaaaggaaggaccgcagaggctagcaatgcagggcaaggcatcccgggaatatgctgccaaaatgtttacagcaagaaagatggcattagcatatgagaggttattcctatgtataaaagatcgtacattctgcacctatccttga

SEQ ID NO: 74945 - DNA, 1215 bp, Glycine max
  Peptide Sequence Number=SeqID_191723
atggagagtgcaagaatcagccactggttaaatcttctagtttgtgtactgctattgctcaaggcagaaggatcttcagttccattgactttggtcaagaattcagaaacaaaaggagctgtttgtttggatggaagtccaccagcttaccactttgataagggatttggaaaagggattaacaactggattgttcacattgagggaggaggatggtgcaacaatgtcacgagttgccttgaccgtaagaacactaccttaggttcatctaaccacatgtcggatatttccttttatgcaattttaagcaatcagcaacagtttaatccagatttctacaattggaatagagtcaaggttaggtactgtgatggttcatcgtttaccggtgatgtggaagaagttgatccaacaaccaatttgcacttcagaggagcaaggattttttcagctgtaatggaagaattactagcaaaaggaatgaagaacgctaaaaatgctattctctctggctgttcagctggaggattgactactatattacactgtgatagctttaaagctttgttgccttctagagctaatgtgaaatgtgttccagatgctggttattttgtcaatgtagaggatatttcaggagcacattcctttcaagagttctacagtgaagttgtttcaatacatggttcagcaaagaatttacccacatcttgcacttcaaaacacaacccagcactgtgtttttttccacaatatgtggcatcacatatcagtaccccaatcttcgttgttaattcagcctatgactggtggcagatattgcttttgattcagattggaaacatctttgtacctagctctgcggatcccagtaatagttggcatagttgcaagcttaatttaagcaactgttcacctgatcaactaagtaaattgcaaggcttcaaaagtgaattccaaagggcattgagtgaggtaggagattctccatctaaaggaatgtttattgactcttgctatgcccactgccaaacagaaacacaagagacatggtttaaaagcggttctcaactgcttgccaataaaactattgccaaggcagtgggagactggttttatggtcgaagtccttttcaccatatagattgtaattttccttgcaaccctacttgccacaatcgtgtatttcaagtaaaagactaccctggaatataa

SEQ ID NO: 74946 - DNA, 402 bp, Glycine max
  Peptide Sequence Number=SeqID_191724
atgctcgagcaggaagacaaggggctgaagcctcaccaagaggaaacaaaagttgtaaacttaggtattggcgaagaaagaaagaaggtcaaggttggcatgggcatgtccacaaacattcgagatgaattggtggctttgttgcgagactaccaagacatctttgcttggtcctaccaagatatgcctggtctgagttccgacatcgtacaacatagattacctctaaatcccgagtgtcccccgataaagcaaaagctgaggaggatgaagcccgagatgtccctgaagataaaagaagaggtgaaaaagcaatttgaagctagcttcttggtcgttgctcaatacccagaatgggtcgccaatattgtaccagtccctaaaaaggatgggaaggtgtga

SEQ ID NO: 74947 - DNA, 474 bp, Glycine max
  Peptide Sequence Number=SeqID_191725
atgttcactgtcattgggttctcggagcatttgggaatgaagatcttggtggttttgaagaggtctactgggaggcataaaaagactccaatgcccatggttattgttgttatgagtgtttggaagtggccattgatgtggaaggaaatgaaggctagaattggaacagctagggttagacctccaccccatgcaattgatgtccactccaaagaggaaaagcttgaacttctaactgatatggttggtgtggagaggcaaattgacgagccgacattgcaatcaattatcatggcaacaattatgagtcatggtggcaagtgcgatgaaccagttgcagctaaggcgtcatattttgaatacgaccatcattggatcgtgaagaagtccagcatgcaatgggaatcctctttaaagggatgccttttgaaaccaaagaagaaattcaacatgctttgcattggtatcatgtga

SEQ ID NO: 74948 - DNA, 132 bp, Glycine max
  Peptide Sequence Number=SeqID_191726
atggagagctcaactacaaatggaaaagacaaggaaagggtttgtagctgcgctgggcgagctgttttggcgttgagcggattccctcacttagtaagcgttgcgcgcgagccatcagattgcacttcctaa

SEQ ID NO: 74949 - DNA, 495 bp, Glycine max
  Peptide Sequence Number=SeqID_191727
atggctcgtgccttcttagggccaacaagacaaaccctaaagaaaaaaataaccctattttcttccacaaagcaaggagtctctagttggctatctctttatgccactattgttggttgcttaggttcatccattgtttcatccttcacttaccaaatgctccgagaacccaatgacattctgggtttgggttctacttctgtaacaatcattggaagtgatggcacttgctggtggttagggccattcaaggcacatcaagtgggttggtgcacacttttggaaggggttcatgtggctttagtggtgccaaggaaagtcaagacttcttttggagctgttttttgtagtggcattgttggaattgttgttttgctttttggaaaggttggtgactttggtggtgttgtcagaaagggtagtgaaacacgttcccatgaccaccttgtcggtgccttggattaccacgaacatatcagcgtttggaagtcttag

SEQ ID NO: 74950 - DNA, 171 bp, Glycine max
  Peptide Sequence Number=SeqID_191728
atgtctgaaacacttgttcaccctggatggcaacaagccttgatttatgaaatgcatactattaaacatagtgaaaaagagatttacatggagcaacctcctaggtttgttgctcaggggcaatctggtctagtttgcagacttaaacgttctttctatggacttaaatag

SEQ ID NO: 74951 - DNA, 237 bp, Glycine max
  Peptide Sequence Number=SeqID_191729
atgacggcagcggcacgaccctgcgaagcagcgaccaacagcgtcgcagcgaccaacagcaccacaaacgacggtgacgaacaacagcgacacacgacagcgcgaacggcagtgacgcacagcgcgaacgttgtggacgatgatatgtcagagatcttcagggttcttgtagaagaacccattctccaccttggagatctctggtgcctctttattgggagatccacacaaggctag

SEQ ID NO: 74952 - DNA, 423 bp, Glycine max
  Peptide Sequence Number=SeqID_191730
atgggtgtcaaacaacaaaaaaaaacaaatagaaaaaacgcaccatcgtccacaacgttcgcgctgtgcgtcactgccgttcgcgctgtcgtgtgtcgctgttgttcgtcaccgtcgtttgtggtgctgttggtcgctgcgacgctgttggtcgctgcttcgcagggtcgtgccgctgccgtcatcgctgctggtagtggtggctgctggtgctgggttgggtcgggtcagcccaacacctaccgcaaaaaaacaaaaaggccactattccgcctttcccgctattcagccatgacctgccatggctatggtggccgccatggcaccgccattagcaacccaccacgccactgctatttggtgacgttttttcaaaatttcatcacacttttccgtcatggcgccgccatggccgccatttga

SEQ ID NO: 74953 - DNA, 897 bp, Glycine max
  Peptide Sequence Number=SeqID_191731
atggtacacgctctaacaaagttccaggtatacctacgcaggaactgtgagggagaaatagatcctaaaggtgatatatgggcttctccatatcgatggggctgcatggtaatagcatacaagacaaataaatttcaaaagcataagttggctcctgtagaggactgggcagatctgtggcgtcctgatcttgcagggaggatcttgatggttgattctccaagagaagttgttggtgcagttttgaaatatatgggagcttcctacaatacaaatgacatcaacgcagaagttaatggtgggagagatgttgttaaacataatttggctttgctagcaaaacaggttcgactctttgatagttcaaactatttaaaagcttttggggttggagatgcgtgggtagctgttggatggagtagtgatattattcctgctgctaaacgcatgtctaatgtcgccgttgttgttccaaagtccggagtgagtttatgggcagatctttgggcaattcctgctgcctctaggattcaaacaaatcggattggtggacgcatcaggggaccatcaccattgatccatcagtggatagagttttgtctgcaatctgcaagagcactcccctttaagcaggaggtgatcccaggtgcctctccctctcatcttcaaggtcattcagccaatgtgcctgtggagttaaccaagggtgggccgaggataaatggcaacctagttgatggagcacctccaccagacatcttagaaaggaaattattagtacaaatcaacattaagaggctgtttggttcaaaggagggaagggaagggaaggaagggattttgattaaacatattgtttggttgagaggagggctggagaagggaggtagtccttaa

SEQ ID NO: 74954 - DNA, 684 bp, Glycine max
  Peptide Sequence Number=SeqID_191732
atgccgcagttgcattatccggtcaccggactctgtcgccacccccagccttcgcttccgaccgccacgcgcttccggaaccagccccttcccctcaaggtttttacgcgcgtcgccgtctccaccgtgctgtttctctgcttcggcgttcgcatgtgcttggcctcttcgccgccggcggcggcggctctacccacggttcaggatgagcaaactgttcaagatgatcaggatggaagaaaacaagacaacaaagaaactgtagtagataaggaattagaggaagcttttaatgcctggaaatctaaaacatttgcattgactgttcctctgaaagttgttgctctgcgtggttccatacctccttcatggatcaaggacttcataaattctcaagggaggagaatgaagtttaacgtcaagtattatgcaagtcttgagaacatgttttctgatccatctattccttttactaaaggaaaaattggcccagcatctgctttggcagctgatattgttggtattggcgattcatggctcaaatttgctattaacaaaggtataattgagccaataagagatgtagaagatcaggagtggtttaaaagcttagatgacaaatggaaggaaactgtaccaaaaaaggatgcacaatactaccacatagaagcgttgttgggatga

SEQ ID NO: 74955 - DNA, 243 bp, Glycine max
  Peptide Sequence Number=SeqID_191733
atgccttggattcaaggtcaaggtggattcgggttgctatcagttggtgagagccgccgccgccggcggcgaagaggccaagcacatgcgaacgccgaagcagagaaacagcacggtggagacggcgacgcgcgtaaaaaccttgaggggaaggggctggttccggaagcgcgtggcggtcggaagcgaaggctgggggtggcgacagagtccggtgaccggataatgcaactgcggcattga

SEQ ID NO: 74956 - DNA, 399 bp, Glycine max
  Peptide Sequence Number=SeqID_191734
atggcaatctggaaacgtacggtggatctcgccacgctgaatcagctgggcgataactcgctggtggcgcatctgggcatcgtgtttaccgccatcggtgccgattatctggaggccaccatgccggtagacagccgcacgcagcagccgtttggtctgctgcacggcggcgcgtcggtggtgctggcggagtcgatgggctccattgccggttacctgagcgtggaagaaggtaaaagcgtggtgggcattgaggtgagcgccagccatcatcgggcggtgagcagcggcgagttcgcggctgacggtggcggtgctggggtaggtttgggtcctctgcggcctgatgccctcaccctgccctctcccacggggagagggaatgcttgtgcggcctga

SEQ ID NO: 74957 - DNA, 291 bp, Glycine max
  Peptide Sequence Number=SeqID_191735
tttctctccgggttccttgttgaaccaattaccctgacttatcttccttcattggaagtggcgtctatcctgacttatcttccttcaccggaagtggcgtctaacctaacttatcttcctttattggaagtggcgtctacccagacttatcttccttcaccggaagtggcgtctaccctgacttatcttccttcaccggaagtggcgtcatccaaaacctccgtagcctgtatcaaacgatccgctcctactcaggttcacatcatctggtatcagagctttggctcttga

SEQ ID NO: 74958 - DNA, 246 bp, Glycine max
  Peptide Sequence Number=SeqID_191736
atggtgagggctgggtccactaaacataaacatccacaagatgggcctaaaactctagtgcatccaccgacactagacggtagcgaatgtagtcgtagaaacaatcaacataatgcacatcattgtgctcccattacgagttatctcctcaatcaaaagctagagagtcagcctcacacatggcataagattcctaaaatgcatacaccactctcgatatcgtacttcacatttctatcacgatag

SEQ ID NO: 74959 - DNA, 510 bp, Glycine max
  Peptide Sequence Number=SeqID_191737
ttcttgaggccacttgatcaacaagcccaacaagtggtatcagagccagggttatcactattcgaaaacctgaatgcagatctttatgtcatagatttaaatatatgggaagccattgaatttgatctctttattcctacaatggtagagaaaaatgcaactatagaaaaacatagagaagaagatgataatgatttcagattttttgtgaagaggttcaataagtttctgagaaacaaaagaaatcaaaggaaatcaaacatcaatccaaagaagaaagaagaagattcctccttagccccaaaatgctatgaatacgatcaacctgggcacatgagattcgagtgtcttgtctttaaaagaagaatggaaaaatccgataagaggaatttcaaagaaaagaaagcatgcatcacttgggaagataataacataaattcttcaagtgattcagaaaataaaatcataaatctgggtctcatggggaaagagtatgaaagcggagaagag

SEQ ID NO: 74960 - DNA, 315 bp, Glycine max
  Peptide Sequence Number=SeqID_191738
atggcctttatggataactggttggtgggtaaggaggaggtttgttattggctgagtaatgacattgttggacccacatcgatcctttcactggcaaagaccaaatccacaaagcgattgtcataccctaatttcgtccggggacctttgcttgatgacatgcgacctttgtttggtccttgtaagggtgaggataaagtagaagcccatgctgtgactgccattcctatatggccaagtttccaaccaatccaacaatgtcattactcaaccgataacaacccatctccttacccaccacgcagttatccataa

SEQ ID NO: 74961 - DNA, 414 bp, Glycine max
  Peptide Sequence Number=SeqID_191739
atgtctccttatcgggttgtctttggaaaggcatgtcatcttctagtggagattgagcacaaagcatactcggcagtgaagacctgcaacttctttatggatcaagctagtgaggaaagaaagttgcaactgagtgagttagatgagatctgcctagaagcgtatgagaatgccaagttctataaagaaaagaccaagaagtcccatgatagcatgataattaagaaggacttcatggttgggcaaaaagtgttattgtctaagtggattggtccttttattgttactaatgttttcccttatggtacagttgagatcaaaagcgactccacaaacaagagcttcaaggtcaatggacaccgacttaagtcattcctcacaaaccctcctttagtggacgtagtggtggaatag

SEQ ID NO: 74962 - DNA, 423 bp, Glycine max
  Peptide Sequence Number=SeqID_191740
atgcataaggcattgcgattaaatgctccactaccatatccacagcttgtcactctctttttccgccattttcaaattcctcttgattctgaaccttatgttccaatcaagcgatcttttttaattggtgctgctatgattgcttcttttggttaccacaaagagcgtgatggctcttgggtcaaaaagggtgttccacctgctgatgatgaaggccacataccagttgaagataattccactcttcttcaaaggcttatggacaagtttgatgccatggaattgcaagttgacatgcggttcgatgctatggaatcaaggatcactagggttgaagaagatgtctccttcatccgaacttgctttgatccaccaccaccgcctcctcatcctcttagattatatgttattattctaacttag

SEQ ID NO: 74963 - DNA, 147 bp, Glycine max
  Peptide Sequence Number=SeqID_191741
atggcttccccaaaaagtgacaagtgcaagtgtacgtgtagacagcagacaacttgggtacttcctcaggttacattgataactactcagcctttaatcaatgttggcataatttttttagagcttctattgttcgttctaacttga

SEQ ID NO: 74964 - DNA, 282 bp, Glycine max
  Peptide Sequence Number=SeqID_191742
atggatgaatatgagtggatatatgagaacattatatttgaagaaattaatatgaaagaagacatgatagaggaacctattgtgggtgaaaatattgattgttttaatgccttcaatacttctcatgtgtcatgtgttgatatgattttgtatttggttaaagtgtttgctatccttgaggatgtattgcaatgggcttgtactattgcatatgatattggttttgtgactgtgacaatgaggtctgatacatcaagtagaaagagaggaatgactttgtaa

SEQ ID NO: 74965 - DNA, 168 bp, Glycine max
  Peptide Sequence Number=SeqID_191743
atgggtttcctcaggcaggtgttaactgaagagaattttcacgggcttctctttaatgagatgacaagatctaagaggttattggaaattcaacaattgagggagcataacaaagagtatgacttgaagaataatgctgctaaacaacaaggagtgaaaaaggcctag

SEQ ID NO: 74966 - DNA, 177 bp, Glycine max
  Peptide Sequence Number=SeqID_191744
atggaaatagttgagggaaaagccagcggttttgaggaagctggagaggaactagagatgtatcacgaggggtccaccgaaggtgccgatagtgacttgttgccaatggaccttctaatacttcaacaaaaacgtaggaaacttattgtttatcgatgtcttttacgctatttatag

SEQ ID NO: 74967 - DNA, 240 bp, Glycine max
  Peptide Sequence Number=SeqID_191745
atgagcggagcgaaggggaagaagaaaggagcgagcttgttatcgattgcgagaagggaaagagacactttccaaaaaattgctcaactacgcaacccggcctactcctgctcaccgcaacctcactttctccacaccgaaacctctcgcaaccccttgcgtttactcgcactcacaacctctctcttaggtgttggactttcaactaagaaatataactttgtggcatatccaaactga

SEQ ID NO: 74968 - DNA, 129 bp, Glycine max
  Peptide Sequence Number=SeqID_191746
atggctgaagaagtgcacggcaaagctagagagattgacactatgtgttcaattaagtaccctcttttttggaaagatctcgagcaacatggtcagattttacttactagtgttttgtacttggtgtaa

SEQ ID NO: 74969 - DNA, 189 bp, Glycine max
  Peptide Sequence Number=SeqID_191747
atgcaatttgggtacatgacagctcaagaggcatatcaacacaatacaagccaccgagtcatatcatgtgaattggccctactcctctctatgacctatcccgggcttgccttcaaatggaaatgggcaacatgccaaagaggttatgtaaacactaggtggaatcaaaactgtatctcaatagcataa

SEQ ID NO: 74970 - DNA, 390 bp, Glycine max
  Peptide Sequence Number=SeqID_191748
atggagaaccctaaagaaaataacaaggtagagaaccatcatacggtgaatgcaattttgagtcctacttttgtcttttctgctacaaaactagcagaccaattcggatatgcagaaggtaatcctactccagaacaacaaatattggatcctaaattaagaagaatattttctaaccgatttgctgcccaaagatcaagggagaagaagaaaaatcatttagccaatttagagattcaaaagaaaacttttgagaatgaaatagcccaaaaacaacaactacaagatttgtacgaaaataagaggcagactcagatagtagaagaagaaacaatgtaccaggaaattgatattcttaagaattattcaatgttcaaagatggtaattaa

SEQ ID NO: 74971 - DNA, 1572 bp, Glycine max
  Peptide Sequence Number=SeqID_191749
atggccccgatgggcatggcggttacgccacatcaccttgccagcgaaagcgcactggcagttctgcgtgaaggcggcaacgcgctggaagccatggtggccgcggcggcgaccattgcggtggtctacccacacatgaatggcctcggcggcgacggcttctggctggtggtgccacccagcggtgatccggttgccatcgatgccagcggtgctgccggctcgctggcgcaccccgacttctaccacggcgaaagccatatcccgcatcgcggccctaaagcggcattgacggtcgccggcaccgtcagcggctggcaggaagcgctgacgcttgcgcaggagctgggcgcaacgccgctgccgctgagccgtttgctgcgcgatgcgattcgctatgcggccgatggcattccggtcaccgcctcgcaggcggcagcgacggcggcaaaacagcatgagctgcaacatcagcccggttttgccgccacctttctgcctgatggcgcaccgcccaccgccggcagtcgttttacccagccggcgctggcgcagacgctgagcgtgctgagcgagcaagggctggagagcttttatcgcggtgagctggcgcaccatctggcgcgcgaaatgggcgcgctcggcatgccgattacgctggacgatttacaccggcagcgtgcccggcgctgcacgccgctgcacctcgcgcacagcgaaggcgatatctggaacatgacgccgccaacgcaggggctggtatcgctggcgatcctcgggatcaccgatcgtctggcgatggccgacgccagtgaagcacagacggtgcaccgcatcgttgaagccaccaaacaggcctttgccctgcgtgatcaacacatcaccgatccgcgtcacatggcgattgatgtgcagtcgctgctgaatgccgatcatctcggcacgctggccgcgcaggtgcaggacgatcgcgccgcgccctggggcaccggacgcggaccgggcgataccgtgtggatgggggtgatggacagcagcggcctggcggtctcctttatccagagcatttaccacgaatttggcagcggcgtcgtgctgcccggcaccggtattacctggcaaaaccgtggcgcggcgttcagcctgcagccggatcacctgctgacgctggcaccgggcaaacagccgttccatacgctcaatccagcggcggcacgcctgaaagatggccgcacgctggtgtacggctcgatgggcggtgatggccagccgcaaacccaggcggcgatctttacccgctatgtcattcagggccagccgctgcagcaggcggtcagcgcaccgcgctggctgcttggccgcacctggggccaatcctcggactccctcaagctggaggcgcgcatcgcgcctgaaaccgtgcagcagctgcgcgcgctcggtcatgaggtcgaactgctggctgaatacagtgaagtagtgggccacgccggcgccatcgtcagacacaacaatggcatgctggaaggcgcgtttgatccgcgcagcaacggcagcgctgccggtttttaa

SEQ ID NO: 74972 - DNA, 705 bp, Glycine max
  Peptide Sequence Number=SeqID_191750
atggtaaagcaagagccgttccagttttggtgttacgccagcctggatcgatttatgctagcttgtgatgaaacgaaagttacaggaccgatgatgaaacagctcgatgaacgccttcgcagtcactatccgcaactgtcgccgcaggagcagcgcattgctgactttgtgtttgaccattttgatgatctgattagctataacagcgctgagctggcgcggctcagcggcgtatcaaaggccacggtaagccggctgttcaaacgcctcggctatgaaaaatacaaagacatgcgtgacgagctgcgcaccctgcgccagagcggaatgccgctgaccgataaccgcgatgcggtgcagggcaacacgctgctgtcgcgtcattacaagcaggagatggcgaacctgacgcagtgggtcaacagcattgacgcccggcagtttagcgaggtgattgctgcgctgggcaccgcgcggcgggtgtttatcattgggatgcgcaacgcgtatccggtggcgctgcacctgcgtcagcagctgttgcaggcgcgcgcccaggtgcaggtgttgccgcagccaggccagacgctgggcgaagagttggtggacatgacgccggaagatgtggtggtggtgatggcgtctcgccgccggccacgcatcatccgtccattgatgcagcagctgcagcagagcggcatcccg

SEQ ID NO: 74973 - DNA, 315 bp, Glycine max
  Peptide Sequence Number=SeqID_191751
atgcatgcttgtttgtacaagaccaatgaagtacaaagaccttacatctgttctacccttcacaaccgtctgatttctctggttgttggtcaggctcagattgggtttgagttaatgaatcctcaagtgtttcagatgatatcaagaaaggatgggctggaatccattttattgaacatggtttatgatacgtggtttaaaattacacgagccagctcatggcatggcaatgaaattattgagactgaaaacattgcagtgcttatgttggcagaaggagttaactcgggccatatattgggattgttattgtaa

SEQ ID NO: 74974 - DNA, 591 bp, Glycine max
  Peptide Sequence Number=SeqID_191752
atggcgcgctgtgacgcgctggcagcaatcagtgaaagcgaagagggtctgacccgcgtctatctgtcgccggagcaggtgcgcgccaacgcgcgcgttgctgagtggatgcaggcggcaggtatgcacacctggcaggatgcggtcggcaatatctgcggtcgctatgaagcgacggagccgggcgcaccggcgctgctgctcggctcgcaccttgataccgtgcgcaacgccggacgttacgacggcatgctgggcgtgctcagcgccatcgaaaccgtgcagtggctgcacgaccatcagcagcgcctgccgctggcgattgaaattgtcggcttcggcgatgaagagggcacgcgctttggcatcacgctgcttggcagccgcggcctcaccggcagctggccggagagctgggtgtcacatccggacggtaacggtattacggtggcgcaggcgatgcaggacctcggcctggacgcggcgctgatcccgcaggcggcacgtgaggtgagcgacattgtggcttatctcgaactgcacattgagcagggaccgtgtctggaacaggacgatttggcgcttggtgtg

SEQ ID NO: 74975 - DNA, 1734 bp, Glycine max
  Peptide Sequence Number=SeqID_191753
atgattgggcaacttaactttgcagatctctggccgcactggccagagctgctggccggactgtgggtcacggtgcagcttacggtgctggcaacggtgggcggtgtcggactgggtattctcggcgcggcgctgcgcagcggcaaaccgggctgggccagccgcctgtggggcatctacgtcgagctgattcgcaacacgccgtttgtggtacagctgttttttatcgtgtttggtctgcctaatctcgggctgaaactgacggccggtgaagcggcgctgctggcgatgctgattaaccttggcgcctatagcactgaaatcatccgtgccggtatccaggtcacgccgcgcgggcagtgggaagcggggcgcgtgctcgggctgagccgcacgcaaaccttcatccgcgtggtgctgccgccctcgctgcagcgcatttatccggcgctggtcagccagtgcatcattgtgatgctcggctcgtcggtggtgtcgcaggtctcgtatgaagagctgactctatctggtgaccacgctgatctatctggcgttgtcgattgccatgcgacagctgctgctggcgctgggtcgcaaatggtttggagcgcagccggcatgacaacgtttactgactgggacatcctgcgcaacctgctgctggcggcgcgctggacgattttgctgtcgctggtggcctttttcggcggcacgctggtgacactgccgctgctgtttctgcgtctgctgcagcggcacgccgctgctgatgcagctgtttcttgccttcttcggcgtcggcctgttcggcatcgatgtcgcgccctggacggcagcgtcgctggcgctgacgctgtataccagcgcgtttttactggatatctggcgatccgcatcgccatcgcgccgaccgttggctttgccgtgcaggtgatcaagggcaccgcgctggcgtcgattatcggctttgtcgagctgaccaaagccggcactattctcaacaatgtgacgtatcagcccttcaaggtccagaagtactacggtgataaccacgtactgaaaggggtcgatctggatatcgacaacggcgaagtgatttccatcattggccgcagcggatctggcaaaagtaccctgctgcgctgcatgaacgggctggaaggctatcaggaaggcagcattaaactgggcggcatgacgattaccgatcgtgaatcgcaggcgcgtgaaatcagccgctcggtgggcatggtgtttcagaactttaacctgtttccgcacatgaccgcgctggaaaacgtgatgctggcaccgcgccgcgtgctgaaaaagagcgaggcggagtgccgcacgctggctacgcagatgctggaaaaagtcgggctcggcgaacgcctccattactacccggccaacctgtcgggcggtcagcagcagcgcgtggcgattgcccgcgcgctggcgatgcagccaaaagttttactctgtgacgaaatcacctcggcgctcgatccggagctggtgggtgaagtactgaaagtgctggagcagctggccgccgaaggcatgacgctgattctcgtcacccatgaaatgaacttcgcccgcgacgtgggcgaccgcgtggtgtttatgcatcagggacgcgtgtgggagcagggcgacagcaaaacgctgtttgcgaatccacaaaccgccgagctgaagcagtttatttccaccgtgcgtctgtaa

SEQ ID NO: 74976 - DNA, 681 bp, Glycine max
  Peptide Sequence Number=SeqID_191754
atgatgcacattatctcaaggaaagtgtttaacgaagcgacacagagatttcctaatgatgccgcagcactggatgccacttaccgactattaagcggccatgattttgccgatccacaggcgttaaaagcctggtttcccagcctggatcgcatgaagtatcgggcaaaatggtgggtaattaatgtcggcggcaacaatctccggctgatgttctttgcggattttgtggcaaaaagagtcttcgtaaagcatatcgtgacgcatgctgagtatgacaagctggcctccaacaatctgattaaagccgtgccgctgctgggcgggagtcagtccagagccgattatgaacaggcgcttgaactggtggaatacctggttgagcatcagccggggcatccgctgatcgagatgctggccgttaaagtcgcgaagtatgaagaaaccgcagcggaatttgccgcgtttaatgcacgcactcaggcgctgccgggtggcgtggcgctgctgcgggtactgatggaccagcacggtctgaatcaatcctctttcgtggcagaaatcggtcagcgttcgtatgtgaatcgcattctgaaaggcgagcgcagattaacggacaagcataaggcggcgctggcgcgacgctttaatctgccgtttgaggcatttcgtgaggcataa

SEQ ID NO: 74977 - DNA, 183 bp, Glycine max
  Peptide Sequence Number=SeqID_191755
atgcgatccaggctgggaaaccaggcttttaacgcctgtggatcggcaaaatcatggccgcttaatagtcggaaacaacagggcaggaggagatgtggaagccgcatcgcagggatgcggctaaaagattacttcagcgtatattcatcggcgtcgcgccaggccgggaagcgctcgcgatag

SEQ ID NO: 74978 - DNA, 447 bp, Glycine max
  Peptide Sequence Number=SeqID_191756
atggagaaccctaaagaaaataacaaggtagagaaccatcatacggtgaatgcagttttgagtcttgcttttgtcttttctgctacaaaacttgcagacgaattcggagatgcagaagctgaaattgagaagaacaaaggtgaagtgattagggagagggaactccaagtgatagagcaacaagaagaattgcaagcacatttggttaacttgaatattggtccacaggagcctgtgtccaattatccaacctcaaattattatgcaaactcatatccagcaaatgaagtggttccacttgagtcatacataccaccggagccaagcgagatgcagtttcttgctgtgccaaatttgcacgaaatgaactttagtctacccaacaacatgggattgatggatctgacaaatcttacaaggggaactgctccaaaccacaaaccttaa

SEQ ID NO: 74979 - DNA, 709 bp, Glycine max
  Peptide Sequence Number=SeqID_191757
atgaagaacgcgttcgagaagaaacaagtacgagttcagctagaggaggaacaaggccgaagggatttcgcccggaccgctgcagggaggcgggtgcggatcatgcgcaccagcatgaccactttgacccagacgtggatgacattgcagctcggcaatgtcttgcctagagatcataactccgatctccctctaccgaagtgccagttggtgtatgccatcctgacacggatgagcgcccacgtggcccaggtgattgctaacgccatctatttgtccgcaggtatgccacccaccaggcaccctctagacccgaataagtctaacagggccctgggatttccggcattgatcacgggcctctgccagtcgttcggggttcccgtcacccccactaaggaacaaggtgatgcacctcaggctacagacgcaccaccaccacctcatcaggctgatgctgctggatcactatgcatggagcgttatctacaacacttggttcgccagcaggcagccaaccaccgggggcaggtgcagatacatgagtgtctctaccggttcagcctcagtcagcaggggcagggttttgctccttttgcatgccctactccagagcagtttggggctgaggtcgcatggcccggagattggcccgaggcccaggcaggggaggagcccgcaggatcccccggtgaggcagaggaggccc

SEQ ID NO: 74980 - DNA, 240 bp, Glycine max
  Peptide Sequence Number=SeqID_191758
atgaaaggtactaaggtagtcatcggagcatcctcagacttttcccatattaaggctttactactaagttattataaagtaaagaacaaaagtaatgacttagataaaagtaaagcggaaataaaaagtacacagcggaaattaaagagtgtagggaagaagaagacaaacacaagatttctactggttcggcaacaacccgtgcctacatccagtccccaagcaaccaccggttcttga

SEQ ID NO: 74981 - DNA, 582 bp, Glycine max
  Peptide Sequence Number=SeqID_191759
atgagaacggaagcaacgataaagtcacataaacagccgtctgccaccaagcagtctcgtccggtgaaacatgatgccatcgtcttgctgaagcaagatcatgacgaagtgaagaagatgtttaaacagtatcagaagcttgcccaaaaaggagatacagatggcaaggtacttatcgcaaataagatctgtgcagaattgattgcacataccattgccgaagaagaaattttttatcccgctgcccgtcaagctattcatgaggatggcatgtttaacgaggccaaggttgagcatgatagtgctaaagacctgattgcgcagattcaaagcatgacgcctgaggatcctatgtacgatgccaaagtgaccgtgttaggcgagtacatcgaacaccatgtagaagaggaagagagtgaaatgtttcctatggtgcgcaaatccaaaaaagtcgacctccggcagatgggctctttgttggcctctcgcaaagaagaggtgatgcaagagctttgtgatatgcaaggtgaaattgatacgcagcaattacaggccaagcttggtatgaaagccaagcactaa

SEQ ID NO: 74982 - DNA, 553 bp, Glycine max
  Peptide Sequence Number=SeqID_191760
gtcgactctagaggatcccactcatcaacaacagtactgcaaatacacaataggcccaaaaagaggcgcccaaacggatttcaccgatttcggtcagcttcaccaggctgaccagggcggcaatcataaacacatcggccatcatccagggatgcaagcgcgaaaacaggcgggcgatcacgatggccgtgcaactgacaatcagcgcgacaattggctggtgaacgtccaccagggtgatggccgtctgcggcagttcaatctgcgtgtccagcccattggtatccatgctgataaacggaaaggccaccgcaatcagcaagcacagcaatgcactggtcgccaacgcaatactgcgctgtaccggatgcaaatgccgcctggccagcacgtgaccacagcgcggacagcaggcatgttcgccagggcgcagcacgggaatcgcactgaccatgtcgcaagcactgcaggcacgcaagaaaaattccattcgctgccgacttcagaagctgatcaatccaagcacctgaaacttgctttcacccgcctttaa

SEQ ID NO: 74983 - DNA, 702 bp, Glycine max
  Peptide Sequence Number=SeqID_191761
atgaatcagcgcgaatttatccgtagtttgctggagtggattgaaaaaaacttagggcacgatctgcatctggatgaagtagcacgccgctcgggatattcccgctggcatctgcaacgtctgttccgtcagcacaccggtttttcactggcagaatacattcgccagcgccggctgactgagtcagcgctcacgctgatcaacagtgatgaggcgattttgcaggtggcgatgagctacggcttcgatacccaacaggcttacacccgcacctttaaaaattatttccgcgtcacgccaggccagttgcggcgtcagcgtcgcgtcgagccggatcgcctgctgtttccgctagcggtggcgccagagaacatggacaacagcgataatctcaccgccatgatgctgtttgcgcgcgtcgttgagcggcaaagcttcagcgaagcggcccgtatgctgggggtatcaaaatcgcacgtcagccgcgaaatcgcccggctggaggtgcggctgggtatcaaactgttgcagcgcaccacgcgcaaagtggtgctgaccgagctgggccaggcttactatccgttctgcacccgcatgctggaagagatgcatcgcgccgacgcgtttgtgcagcaggtgcatcaacagcctgccggcaacgtgcggctgcaggcgccgatcaccttcggctgccagtgcgtg

SEQ ID NO: 74984 - DNA, 660 bp, Glycine max
  Peptide Sequence Number=SeqID_191762
atgcgtgtgctgctggtagaagatgatgaaatgatcggcgccaacctgcagcaggcgctggaggccgccggctggtcggtggactgggtgcgtgacggcgtatttgccagcaacgcctggcaggaaggcggttacacctgcgtcctgctcgatctcggtttaccgcgtgaagatggcatcaatgtgctgcgccgtgcgcgcacgcgcggtgacatgacgccagtgctggtgctgaccgcgcgtgataccgtgcagcagcgcatccagggcctggacagtggcgccgatgactacttactcaaaccctttgatctgcaagaggttctggcgcgtatgcgagccatcacccgacgccgccacggtgcggcggactccctgctgggcaacggcgacgtgcagctcgatatgatgacgcgtgaagtgctgtacaaaggccagcgcgagcagctgaccgcacgtgaatacgccctgctctatgcgctgctggaacgcccgggcgcgatcctgtcgcgtgagcagttagaaaaccgcatctacggctggggcgaagaggtcaccagcaacgccgtggacgtgctgattcatggcatgcggcgcaaactcgataacgaagtgattcgcaacgtacgcggtctgggctggcgggtaccggcaatatga

SEQ ID NO: 74985 - DNA, 207 bp, Glycine max
  Peptide Sequence Number=SeqID_191763
atggtggctgtattatctccatcacacaaagtgggtccacaacatattatgaagtggttgttgggtttggacatgttggtagctcgcaagggggacaaccttcacattgtgactcttggtgatgacatgaaagtgatgacaaggaaaaatatggatgaccctagtgagcctcctggattgtgctcaatgctgcaacgtctgttttga

SEQ ID NO: 74986 - DNA, 294 bp, Glycine max
  Peptide Sequence Number=SeqID_191764
atggctttgcctctgctctcggctgtaatgcactatcctttcctttatgttttggtttggttccacgtcattgacctcattgttgttgccgccaaagttgccctctctcggaacaagggcgctgattgggcctctacttctggcttcgttcgggcttgctacatccacgccatcgctgccaagaaaaagcttgaactagcgaaactcaaagttattgactgtggaaaaccggttgatgaagccgcctgggacattgtaacctctcacatccctaaattgctgactaagccttaa

SEQ ID NO: 74987 - DNA, 147 bp, Glycine max
  Peptide Sequence Number=SeqID_191765
atgtcaactgttcagaggcaaatgatgcacaagctgttcattaaagaaattgccacttggcggagagagggtgacacctttggatcagacccattggggatgacacttggggaaatagaagattacaaattattcatgattgattga

SEQ ID NO: 74988 - DNA, 180 bp, Glycine max
  Peptide Sequence Number=SeqID_191766
atgactttgagcttagctcatcagtgggctaagcacgtatccatcgctaagcgcagatttagcgcaacagaagatctggtagagcatcaatatcaaggtcgtgcactaagcacagtagttgtcttcagtcaggctcagcgcacgactggcgctaagctcaaatccacttactcgtgctaa

SEQ ID NO: 74989 - DNA, 230 bp, Glycine max
  Peptide Sequence Number=SeqID_191767
aagcaaatagaataagttgtgcaagaaagaaaagaaggagacactctagtgattatgcaaccaacactattgaagagaatgatgacaatgatgttgagtatcactctaaagaattggaaagtgagcctgagtcagatgaggagggtaatgtaattgagaaagagaagttcccaccatttgttcctcaatctagcatggctataaaaatgggatgttggtttattatttga

SEQ ID NO: 74990 - DNA, 596 bp, Glycine max
  Peptide Sequence Number=SeqID_191768
cagaactagtcaacaatccaaaggtgttgaagaaagctcaagaggaggtagagaaagtcaccggaaacaagcgattagtgtgtgaagcagacatttcaaacctcccttatattcatgccatcattaaagaaacaatgagacttcacccgccaataccaatgattacgaggaaaggaatcgaagactgcgtggttaatggaaacatgattccaaaaggttcaatagtttgcgtaaacatttgggctatggggagggacccaaatatctggaagaaccctttagaattcatgccagagaggtttctagaaggtgaaggaagtgctatagataccaaagggcatcattttgagttgttgccatttggtagtggaaggagagggtgtcctggaatgcctttggccatgcgtgaattgcccactttcattggagcactcatactgtgttttgagtggaagatgtttggttcacaaggtgaaatcttagaccacggaaaaagtttaatcaacatggatgaacgaccaggattgactgctccaagggccaatgatcttattggcattcctgttgcacgattgaatcccacctcttttcctcaa

SEQ ID NO: 74991 - DNA, 228 bp, Glycine max
  Peptide Sequence Number=SeqID_191769
atgagggagatgaaggtgcagaagctcgttctcaatatctctgttggagagagtggagatcgtctcaccagagccgccaaggtgttggaacagcttagtggccaaaccccagtgttttccaaagtagtggtgggcttaatgaatgcatttaaatgtcaaattttcttcagaaacttgatgcagaggttcatggaagaactgaaaatgaggattctgataagtgtatga

SEQ ID NO: 74992 - DNA, 321 bp, Glycine max
  Peptide Sequence Number=SeqID_191770
atgaacttctcagaaggaacttcagtgatactggttgcttcggctttggtattcaggagcatatcgatttgggaatcaaatttcaatttacacatattggtccttgagcgtttactctgcttcaggtatgatccttcaactggtatttatggaatggatttctttgttgttctggagcgtcctggctatcgtgtgggacgtcgccgaaggtgcaagtcccgtgttggaattcagcaccgggtcacaaaggaggatgctatgaagtggttccaggtgaaatatgagggagtgatccttaacaagtctcaggcaattttttag

SEQ ID NO: 74993 - DNA, 327 bp, Glycine max
  Peptide Sequence Number=SeqID_191771
atgtttaaggaggattgtaaggaggtaagtgtctcctccaagaggttagctaagaaggaaagtcattttgaaataaagacaaatattaaagaaacttcccctcttagacaacctccacatcttctcctttgtaaaaagacacttgttagcactgccacatctcttgggcttgaggttattcctcaagtaaaggagttgttggatgagggtttggttcgtaagagcttaaatccttgtgctttgttggtgcccaaaataggtattattaggagaattataagcaattgggcttggatccggaattgggctgaactggcttggacttga

SEQ ID NO: 74994 - DNA, 255 bp, Glycine max
  Peptide Sequence Number=SeqID_191772
atggctaagttcgtgaggcctgctctagagattgaatgtcttgtagctaccaacggactaagactaatgtctgcttttgtggaacgctggcataaggaaactagtagtttccatttgcctgtaggaggggtgactatcaccttggatgatgtggcattgttgttacatttgcctaacgtaggggcattctgtagaagcaagcttcatgatgatgaaccaaacaattttgatgatgccaaaagcccaagtaattga

SEQ ID NO: 74995 - DNA, 222 bp, Glycine max
  Peptide Sequence Number=SeqID_191773
atggaaaagtgtcttgtgaagttgcaaaccaaatttcgaaaagatccaacggttaatgaagtctgggcagcgtttctaccgaggcagcttcataccaaatttcgagaagatccaacggttaatgaaggctgggcagcgtttttaccgaggcagcttcatgtagctttctctagaagcttcattaagaggcttcctctagaagcttcctcgtggcttctttga

SEQ ID NO: 74996 - DNA, 159 bp, Glycine max
  Peptide Sequence Number=SeqID_191774
atgaacaaaggagtcagggttattcacctctttattgtcaagcaggtgctttgggcttgttttgatcggctagaactcggtccatcttctttcaagaatgtcctcttactcggctattccaatggatttcaagttcttgatgtggaagatgcctctaat

SEQ ID NO: 74997 - DNA, 273 bp, Glycine max
  Peptide Sequence Number=SeqID_191775
atgaagtcagcaaacacaactgcgaaaggtacaaataatccagcaactcctaagtggattgaagtcaagagccatgttcaaagcggagggtatgagtgtggctactacgtgatgcattggatgtggaacatcgtcagtgggggtttaaagaatgattggagcatgtggtttcttgatggaacggcgttagacaacgaaacaattacaacgattcgccagaaatgggtagcatattttcttaaagttcaaagcaatcaatgtacaaagtcttag

SEQ ID NO: 74998 - DNA, 415 bp, Glycine max
  Peptide Sequence Number=SeqID_191776
cattccgaagctggttggttatacaggaccactcaacggcgaaggttataacgctattgttgaagtgcagcttatttcaccaaatgagagtggtaaaggagactggacttatgagctaaccctcaaggctccagtaaatcatccagtgaaaggagttgaacattcactgttggtacagctcgatgttattgtttctgatggtaaaacaacgacagagactaaactcaatgtcacgatcgaagacgatgccccaattgccgttgatatggagccagtaaattcaattttaccaattacagcggtaacaaatcttctattgatggaggtaagtttaccatcaccgcaaaaggttttgaatctgcgaactcttctaaactggttgatgcatatgtcaatggtggctctgaggggctag

SEQ ID NO: 74999 - DNA, 753 bp, Glycine max
  Peptide Sequence Number=SeqID_191777
aatcagtcggggcctgagaggcggtggtttaaccctgtggcggatgtcagcggttcgagtccgcttatctccaagcgcgtgaacttagtcgatacaaagctatatgatagcacttccatttttccgattcggcagtttgatctatgctatgatttatcattcatggacgttgataagatccttccatctagcagcaccttaggatggcatagccttaaagttaatggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctggttctccccgaaatgcgttgaggcgcagcagttga

SEQ ID NO: 75000 - DNA, 186 bp, Glycine max
  Peptide Sequence Number=SeqID_191778
gaaaatgagggaggagcttgccacctagctcgcccaggcgagctaggttgcttcctccagaagcaaccgccttctggaggaacatcctggaaggcccaaaacctcacggattgtgtaacaatgcttccttttgatttccgacatgttatggaacttcacagatcgtgcaacaatgctctcgtttga

SEQ ID NO: 75001 - DNA, 708 bp, Glycine max
  Peptide Sequence Number=SeqID_191779
atggcgacgattgagaaaaatagcacctgggaattaattgattggccaaagggagctaaagtagttggagtaaagtgggttacaagactaaactcaatgaaaagggagaagttgacaaggctaaagcaaggctgctcgtatggagactgtacggttggtaattgcgttcgcagcacaaagagggctccacatgcttggtacaaccgcattgaagcatattttgttaaggaaggaaatgacgagtcaatgtttactgagtttaagaactcgataatgcttgagtttgacatgactgatcttggtaaaatgaagtattttttgggtcttgaagtcttgcagaaatcaggtggaatctttatctgtcaaaagaagtatgttgaggagatgttacaacggtttgggatgaagcagaacaactcagttcaaactccaattgttcctggttttaagatttgtaaggatgagggaggaaaacaggttgataaaatgtgcttcatgcaaatggtgggttgtcttatgtatctcgcttcaacttgtccagatttgatgtttgctataagtcttttgagtaggtatctggagcattccactcagctccatctacacctagcaaatagggtactgaggtatatacaaggaactactgagtttggaattttttacaagggaggaagtgataaactcatagcatatactgatagtgactaa

SEQ ID NO: 75002 - DNA, 457 bp, Glycine max
  Peptide Sequence Number=SeqID_191780
gcttgcagagttgggcattgaggcccggtcaggttttaaatcccatggtgaagggagtacacagcttttaggttctatccaattatcatcaaaagaatcattctttggcaacgctgaggcaaagactattgttgagattaacaccatctctgaagaaattgtttgtgtcactgttgacacaattactaggattcaactggacaatcattcatggtgttatacagcttgcattcagtgccataaaaaaagtgatgcagagatggcgccctttacatgtgcatgcggcaaatacaataaggaagttgtgcttaggtataggcttgaggtgatgatcaaccagggaaatgaaagcacaaaattcctgctttgggaccgtgaatgcagtgaattaattggccaatcagctgatgcagttaataagcttaaaattgaagtgtgtttttggattcaaccgtaa

SEQ ID NO: 75003 - DNA, 829 bp, Glycine max
  Peptide Sequence Number=SeqID_191781
cacggcgcgtacattccagcgtcagcagctggcgcatcctgccggtgccgctcagatcagcgccagcagcaccttcgcgctgcacgccctgcccgcagatggcggctggcacgcccttacctcacgctgcgccctgctgctgccgcttaaagccggagaacgcctgccggcgctgacggtgcggctgcgggcgtcatccgcgcagacgctgcaggtttcactgctgaccagcgacaatccggccaacacctgcggcgatcggctgctggccacacacagcctgcagattgacgctgaagaggcgtattcgctgccgtttgactaccgtgcggagtgcgatcgctacctgtttatcgcctttgaagaaaatccggcggttgaagtggcgctcacccgccagcgcctgccgggcattatgatggtatttaacagtctcaatccgcgcgtcgcgaaacgcacccggcagataaacgacggcgattacggcgtggaagagtttgatttctggctaccgcgccgcgcgcccaatcagatcctgatcgcgtttagtctgacaacaccgctgcggctgtggcactgcgactatttgctcaacggtaaactgcggccggaaagccacaccaacggctggctgccggcggcggacgatcgccagccgtgggtgtgctggcagtggccggacgcgcagcgcgccagccagattacgttgctgttcgataatgatttcgatcatgcgatggaaacggtgcagatgggccatgcgcaggcggtaacgccgcactgcactacccactatcgcctgtggctggatgacacgctgctggccgag

SEQ ID NO: 75004 - DNA, 363 bp, Glycine max
  Peptide Sequence Number=SeqID_191782
atggtaagcatttgggacctagctagggttgaagtctccatggaaccaattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaaaagtccaaatcttggcgcaggaattagaccgccaaaggcaagtcgaaaatggggtggtcggaataccgagaaaatatttggagcgatcgacgtttttctggcctatcataaccacaaggaaagtccggttgtcgcaatgctag

SEQ ID NO: 75005 - DNA, 366 bp, Glycine max
  Peptide Sequence Number=SeqID_191783
atggccgacggcaacacggacaccaaatcctccaaccagatgtggggcggacgtttcgcttctggccccgatgcgatcatggaggagataaatgcctcgatcggtttcgacaagaagctattcgctcaggatatccgcgggtcgatcgcccacgcgacgatgcttgcccatcagggcatcatttccggcgacgataaggacaagatcgttcacgggctaaacacgatcctgtcagaaatcgaaagcggcaatttcgaattttcacgccagctcgaagacattcacatgaatgtcgaagcgcgcctcgcaacgctgatcggctccgccgccggccgcctgcacaccgcccgttcgcgcaacgaccag

SEQ ID NO: 75006 - DNA, 552 bp, Glycine max
  Peptide Sequence Number=SeqID_191784
atgacgacaagaaagccgcttgggctgccatccctgaaactgatctcgatagccgccgttgcaggcataattgccggtgcggcagcggtttacattaaggagacggggtctggcaatggcggcggcgaaacggcgtctggccaatgcgctgctgcgaaggatctggcgcagaagatcacccccctcgccaaggggcaggttgccgccatggttgccgccaacgagccgcgcaagctgaccacggttgccttcaacgacgccgacaacaagccggtgacgctcgacagttttgccggcaagaccgtgcttctcaatctctgggccacatggtgcgtgccctgccgcgaagagatgccggcgctgaatgcgctggagaaggatatgggcagcgacaagttccaggtcgtcgccgtcaatatcgatacgggcgatgacgagaagccgaaggcgtttctcagcgaaaccggcgtcgattccctgaagctctatcgcgacaacacgatcggcgtgttcaacaatctgaagaaggaaggcctggccttcggtctgccg

SEQ ID NO: 75007 - DNA, 565 bp, Glycine max
  Peptide Sequence Number=SeqID_191785
ggcgaaagcaaaatctggcagggcatcagcatcaaggccacacgctaagcaagagatcaatgtgctaagtgcagcaggcaggaaaagcaacttttgcagagatacctactcgaatggacactacttcattttggtcaccattgactacttcaccaaatgggttgaagcggcatcgtatgccagtgtgactaaaagtgtggtggttaggttcatcaagaaagagataatctgccggaatgggttgcccaagaagattatcactaataatgccaccaatctgaacaataaaatgatgaaggaaatgtgtgaggatttcaagatccaacaccataattctacgccttacaggcccaacatgaatggagcagttgaggctgctaataagaatatcaagaaaatagtccagaagataactgtgtcatacaaggattggcatgagatacttccttttgcatcagacctcgatacgcatatcaactggggcaacctcgttctctttggtatacaggatggaggttgtgcttccattagaagtagaggttccttcattgaggattctagctaa

SEQ ID NO: 75008 - DNA, 612 bp, Glycine max
  Peptide Sequence Number=SeqID_191786
atgtcatgcccacatcttagtggcatagctgctttgctcaaaagctctcatcctcattggtcaccagctgccataaaatctgccataatgacttctgcagacataatcaattttgaacgcaaactcattgttgatgaaacacttcaccctgcagatgtttttgccacaggttctggtcatgtgaatccatcaagagcaaatgaccctgggttagtttatgatattcaacctgatgattatataccttatctgtgtggtctagggtacagcgatacccaagttgggatcattgcacacaaaacaattaagtgctctgagacttcaagcattcccgaaggagagcttaactatccttcattttctgttgtgcttggttccccgcagacattcacaaggactgtgacaaatgtgggtgaggccaactcatcttatgttgtcatggttatggcaccagaaggggttgaagtgaggatccaaccaaataaacttaccttttcaggagaaaaccagaaagagatatattcagtgtcattcagccgtatagaatcgggtaatgaaactgcagaatatgctcaagggtttttacaatggtctcagccaaacacagtgtaa

SEQ ID NO: 75009 - DNA, 524 bp, Glycine max
  Peptide Sequence Number=SeqID_191787
gtgtagctgagggtgatactgagggccctccaaagggttttgtaggggtataccaccaactgcttgcccttcagtggcatattcgaggcaaggctcaaagtcggctagattgtggtggggaatttcatgcgtctcccccacggagtggagttattgacattcttattgggagtgtatgccacattggatggcgtatagttgagaggcaagccatatggcgggaaggcgtgctcgttttgaatttgcacatcatgggggccgcccgtacttcccaaatctttgcctaccatatcttaggttggatgattcatttggttgatgccggatggggacatcaggttcaccttagcaacaacactggttgcggcaattgcaaccgcattggcttccattatcttcttcacgctcatcatggcctccatcattgcggccatttgctctttcatggcctccatgtcagcctccatctactctttcatacccattactctagctctagcacgggttcggtaagggcaccgtaa

SEQ ID NO: 75010 - DNA, 318 bp, Glycine max
  Peptide Sequence Number=SeqID_191788
atggggggggagtattttcgaagcagggttgcttctggaggaagtaatccagatcgcctgggcgagctgggcggcaacctcctctccctttttcttataaataggcgaaagggggatgttctaaacatccattatccttttggctatgcatttcagccattttgggtgaaaaaaaattgtttccgtgaagaaaatccaagtcgaggtgcttccgtaacgcttctgagatgttttcgtgagcgaatccgtgaaggtttttcgttgttcttcaccgttcttcatccgttcttcgttcgttctttgttcttcagcgggtaa

SEQ ID NO: 75011 - DNA, 513 bp, Glycine max
  Peptide Sequence Number=SeqID_191789
atgcgtgagataccaggttttgttggctactgggccacagaggatggtcagatactgtccagacgcgatggtgtgagagagctgcagcagcgatctgtggatggctacatgcatgtgactctgggagttcgcgtgcgcggaaagaaggctaggcgtcggtatccggtgcatcggctggtgtgtctggcattccacggccatcccgaggatggagccaacgtgacccgccatctcaatggtgtcagccgggacaaccgcgcagccaacctgaagtggggcactcacgctgacaacgcccaggacgccatcaggcatggaaccttgggcgaagggatgagggcgcatcgccgcaagctgtcggaggtgcaggtgcgcgagatatgcgcccggtacacagccggcgagtcgggaaggacgttggcggccgagtttggtgtgcacatctactacccgagccagctggtgaggggaaagacttggaagcacctgaaccgctcgacagggtgcgtgtag

SEQ ID NO: 75012 - DNA, 1065 bp, Glycine max
  Peptide Sequence Number=SeqID_191790
atggcatatgacaaagaaatgctagtagaacaatacaacacggcataccaattgctcacagttaacactcaatcagctgcagtttactttatggatatggtggaactggcaaaacatttgtttggacaaccttatcatctggtatacgctccaatggtggaattgtttgtacaattgcttcaagtggaattgcttcattgctcttgcctggtggtcggaccgcacattccaaattttctagtccctgcaacacaaaattcaacatgcaatattcatcaaggcagtgaattagatgaattgttaaaggcactagataaaagccttaaagacatcatgcaaaacaatctgccttttggagggaaaattatcatttttggtggagatttccgacagatcttgccaattgttccaaaaggtaatcgctcagacatcgtccatgcaactataaatgcatcatacatttgggaccattgccaaattcttaaacttacaaaaaacatgagattgctatcaaatgctccccaacaacccaacaatgaagaactcaaacaattttcacattggctacttgacataggagatggaaaaattggacaatataatgacggattttcagaaatcactattccagatgagtttctcataaaaaattatgatgatcctatccatgctattgttgaagccacctatcccagcttgatagataactacagtgacacagattacttgcaaaaaagagctgttcttgcctctaaaaaagaaattgttgaaaaaataaatgattatgtcctatcacttatacccaatcacgaaaaagagtattgcagcgcagatagtattgataaatcagatgaattgctcaatcctgcttttgcattattgccacctgaattcctatattcattgcaaacatcaggtatacctaatcataaattaaaacttaaggttggaactccaatcatgctattacgaaatctcgaccagactgatggccgatgcaatggaactaggctcattatcaccaaactcggatctaatgaaataggacatacatacccagaataa

SEQ ID NO: 75013 - DNA, 414 bp, Glycine max
  Peptide Sequence Number=SeqID_191791
atgaggagcacaggtcgcttgagcaaatggaccaatggcttgcactcaattctggtgaaagttgaaaatcctgatgagtcattagagacatctaacaacagctttcaaaatttgccccatgtgtggcatctcttgttaatgtcagtatttacatgcgattctcctcaaatttcagccagcccgcaacaattagaccttgcaccttacgcttcaggcccctacaatgctcaatggaatgccccggggcttctccatgacaagcacacgttgcgttcgagtcgtattctcggagaaatagaggttgacgaaccttggttggggttacggctaccattgaattatcaagtagatatgggagtgatcgaggccgtacccgaatcaaataaacatgaaaatgcagtaactaagaagtga

SEQ ID NO: 75014 - DNA, 222 bp, Glycine max
  Peptide Sequence Number=SeqID_191792
atgttcaacgacataaaggaggagaggtgcttacggcgacgacgaacacgcaaaggcggtggcggcaactggctaaacaacacaaacgaatgcaaatggcagtggcgacacatcaggaagcagaaaactaaggtggaagaaaggaggcgcaacacgatgttattatatgttgtcccacaaactgatccaatcttactgttggatcgagtgacctcaaaataa

SEQ ID NO: 75015 - DNA, 150 bp, Glycine max
  Peptide Sequence Number=SeqID_191793
atggctataagaagaaccctagtaagagaagttagtcatgatttgaataaagccccccagcggcaactgcccacaacatctgcacgtaggcaacaggaagttgcatttgttgttgaggatattcaacatgtggatcatgcagctgacaag

SEQ ID NO: 75016 - DNA, 909 bp, Glycine max
  Peptide Sequence Number=SeqID_191794
atgaatatcttgacggcacacgatcaagagtgggaacaagaattaagttcttacgatcaatatgaagaagaaagaactcctaatcttgaaactgtgtttgaggaattcatggcataccatgccagctcaaaagctaatcaaagctcaatgaaaaatcatgaaattcattttggtaagagctactcaatagaaaactttcacgcgggaccaaagttacaaccttactatcaaaatgaagcagaaagaggatccaatatggataaattgttgatgaaattcatggaaacaactaaatcaactcaacaagcactccaaagtgtagaaatccaggttggtgagctggcagaagcagtaactcaatttatgtccagacgagaaaaatcctttgtagaggctgaagctcaagagaaaagccctataaaagagcatgaatcaagagaaaaagatgaggagaaagatgaggaacaaacacaacaacaatgggagaagtactcaacagtagaaaaccaacaaggaaatattctccaaagcaataaccttcctcatcaactgattgacaagaaaggaaggcaaggagagcatgaggaaaccttaagtgccataatttctttaataactaacacctttcttgaaatgaattggaatgtccttccagattatatgaagttcatggaatttctagctaaaaggcgaaacttcaaggaagatggtttcaattacttggaaaaaggactgaaaaataacttagaaaaatattttctgaaaaatagtcctttcgctaagcgcaagcctcgtgctaagcgcatctctgttcatatgctaagctgcgagtctcaagcgcttagcacccaacccttgcatctgaggctgatttggtcccctaagctggccaaggttgagctaagctaa

SEQ ID NO: 75017 - DNA, 183 bp, Glycine max
  Peptide Sequence Number=SeqID_191795
atggagatattcttggaagtcatgaatctagacttttggagatcaaccttcaagcctaaaaactctaacaaagcaactggaggaggagctctagaaagcaccaaaaatgccactgttgctaacaaagaacatttgaacgactatcttgaggtaagggatgagttactcacgcttggatattag

SEQ ID NO: 75018 - DNA, 819 bp, Glycine max
  Peptide Sequence Number=SeqID_191796
atgtgggaagcactttctcaggttttgtatttaaacctctctcgtaatcatatccatggtgagattgggactacattaaagaatccaatatctatcccaactattgatctaagctcaaatcacttgtgtggtaaattaccctatctttcaagtgatgtgtttcagttagatctttcaagcaattcattctctgaatccatgaatgactttttatgtaacgatcaggacaagccaatgctattagaatttctgaatcttgcatcaaataatttgtcaggagagatacctgattgctggatgaattggacatctcttgtggatgtaaatttacaaagcaaccattttgttgggaacttaccccaatccatgggttccttggcagacctgcagtctttacaaattcgtaacaacacactctcaggaatatttccaaccagtttgaagaagaataaccaattgatatccttggaccttggggaaaataatctttcaggaactattccaacatgggttggagaaaacctcttaaatgtgaaaatcctccgccttcgatcaaacagttttgccggccacattccaagtgaaatatgtcagatgagtcatcttcaggttttagaccttgcacaaaacaatctgtctggcaatatacggagctgtttcagtaacttgagtgccatgacactaatgaaccaaagtacagatcctcgtatctattctcaagcacaatctagtatgccttactcttcgatgcaaagtatagttagtgctctactatggctgaaaggaagaggagatgagtacagaaactttctgggtttg

SEQ ID NO: 75019 - DNA, 213 bp, Glycine max
  Peptide Sequence Number=SeqID_191797
atgaagaggaaccatgaagacatgaagcttaccttgacaccaacagcgacagtggcagcgagactgaccgcaagtggtagtgagaacgaagagtcgcgacatggagagtttgtgacagagaggaacacatacatggaggcgagctgcgatgaagaggatgacatgggcgacaaccagagctgcggcagagacgaagatatgcaacagacgtga

SEQ ID NO: 75020 - DNA, 906 bp, Glycine max
  Peptide Sequence Number=SeqID_191798
atgggagatgtcacaaaatcacatgatgtgggagaagatagtttatatacagaagatgggacagttgatatttacaaaaagcctgccatcaagaaaaaaactggaaattggaaagcatgccgcttcatacttggaaatgaatgctgtgaaagattggcatattatggcatgagtacaaacctagtgaactatctgcagacccgtttccatcaaggaaatgcaactgctgcaactaatgtctcaacctggtcagggacatgctacatcaccccattacttggagcctttttagctgattcatacatgggaagatactggacaattgctagtttctcaactatctatgtcataggaatgtcacttttaaccttttctgctattgcccctggattaaagccttcatgtggtgctaatggttgctatccgacatcaggacaaactacagcttgctttatagcactctacttgattgctcttggaactggtggtatcaaaccatgtgtctcatcttttggtgctgaccaatttgatgaaaatgatgactttgagaggaaaaagaagagctcttttttcaattggttttatttctcaattaatatcggttcgctcattgcttcctcagtgttagtttggatacagatgaatgtgggttggggttggggatttggagtacctactgtagcaatggtcattgcagttacatttttctttattggaagtaaatggtacagacttcaactgcccggtggtagtccccttacaaggatttgtcaggttatagtggcagcatccaggaaagctaggctacaagtgccagataataagtctcttctttatgagactgcagatgtagagtctaatatcaaagggagccgcaaacttggacacacaaatgagttaaagtga

SEQ ID NO: 75021 - DNA, 342 bp, Glycine max
  Peptide Sequence Number=SeqID_191799
atggttcttataaaaccgcctttgttacaaatgttacgaagaaaccgcctttgtttaactcatactgcctttccatctcccctctcccttcacgctgctgtcgtgacctccgcttcaccctgtcgtgacctccgcaagctcgtcattgaaaggggaaggaaggaaggcaaggaaggagagtggatctccagaaggatccttctacctcttgcaacgccggttaacaatgatctaagcttccactctcttcttcagcgattccatttccatggcttcctccctcgacgacaacttcaaccttctttctcctcaacagcaactgctgcttcttctgcattctaa

SEQ ID NO: 75022 - DNA, 836 bp, Glycine max
  Peptide Sequence Number=SeqID_191800
attctaggtgtttggacaaggcagcaatagagacagaatctgaccacactaattggccaaattcatggaggctgtgcacagtgacacaagttgaggagctcaaatccataattcatttgctcccagtttgggcaaccatgattgcctttgcaaccgtgtacagtcaaatgagcaccatgtttgtgttacaaggcaacaaaatggaccaacacattggtcaacacttcacaattccctcagcatccctctccctctttgacacccttagtgtcatcttctgggccccagtgtatgatcgcatgattgtcccatttgcaagaaagttcattggccatgaacaaggattcacacagcttcaacgcataggcatcggccttgtcatctccatcatctccatgattgttgctggcattttagaggttgttcgccttgatattatcagaaaaaacaactactatgatcttgaaaccgttcccttgtcaatcttctggcaagtgcctcagtacttccttataggagctgcagaggttttcacaaacattggtcaaatggagttcttttatggagaggctcctgatgctatgagaagcttgtgttcggctttgcaactcactacaaatgcattgggaaattatgtgagtactttgcttgttttaattgtgacaaaagtcaccacaagccatggaagaattggttggatcgcagacaatctaaacaagggtcatcttgattacttctactggcttttgacagttcttagcttgcttaacttccttgtgtatctgtggattgcaaagaggtataaatacaaaaaggttacaacaaatactcattga

SEQ ID NO: 75023 - DNA, 381 bp, Glycine max
  Peptide Sequence Number=SeqID_191801
atggtttcaaataatgaagttggttcacaatttccaatattttctacccaaattgggctagaagggtcttctacaaaaaggaggcctcgagtcgcctttgcaatagaagaagacacacacctcattagttcatggctcaacatctcaaccaatccaattgttggtgttggtgtgcaaaaattcaaggatcactacaagcaaatgatattgtcgcaacgtgcccttcgcgggcgagcgagggcgaggctcacggatgcactttccaaaggaggaaaggtgcgcgtagtcgccaccaacgtttatttgtggaaaacgtcgggaaaaccgaaggaaaccggtcaaaatgagaattctaagttcgggagttgtatttacgcttga

SEQ ID NO: 75024 - DNA, 444 bp, Glycine max
  Peptide Sequence Number=SeqID_191802
atgcttcatgcatatgccatttggaaggaagacgaaggaaatcaatcgagatggttagaacaatttactgaaaactactctaaaaggacgaagattttttcatttggggaatattcattgtcatctaatctaaaaacacggatcaaagattctaaagccgaagcatcatctccaattgttcgtccagtggagcaaaaggcaatcaaaaggaagagcaaggggaaaggagtaggaacatctaccaatcttgtgaacttgactggtgtggaggaagcaatgatggaaagaaatgttctcaacgccaaactagcagccttaagggagaaagaattggaaaaggagtattacgacattctaatgaaggacacatgtacaatgtccaaaactcaactcgaagaccatcatgccttttgtaaaataattaggcgtaaactaggattctag

SEQ ID NO: 75025 - DNA, 378 bp, Glycine max
  Peptide Sequence Number=SeqID_191803
atgcattctacgcgacgccgcgaagctcagaactcaaggacctcgaagctgacattccctgtgtcgcatcaacgttgttgcaataccgccgtgcctgagaagcagagggtaacgggaaaggtgaagtggttcgatgaccagaagggagggggccacgtctacgatgtcagcatcgaaaaatccttttacagcctcggcggcccctacgccatgttcgccggcaaagacgctagcagagccctggcgaagatgagcaagaatgacgacgacatctccccctccctcgatgacctctctgacaaggagatcgacattctcaacgactgggagaacaaattccaagctaagtaccctgtggttgctcgtgttctcaattaa

SEQ ID NO: 75026 - DNA, 186 bp, Glycine max
  Peptide Sequence Number=SeqID_191804
atgaacaaaggcggttttctattcacacccgctgtagaaataagtcctacaaagacgggtctcgaagaccgtcgtaattatcttgccgctatttacaaaaatgccttgagagacattctaaggtggttcttgggaaccaccttagaatgtatctatatggaggtatatgttggtagctatgcttaa

SEQ ID NO: 75027 - DNA, 192 bp, Glycine max
  Peptide Sequence Number=SeqID_191805
atggtcatgtcttataaactttacatagcaagtggacattatagaaacatgctgaaagccttcagcatccagagctgcacgcagtgctcctacccagggtattttgccaataagaaaaataactcatcaatatcacctaatcatcaacacaagatatatcccaagtctaaacagacacaacatttgacctaa

SEQ ID NO: 75028 - DNA, 788 bp, Glycine max
  Peptide Sequence Number=SeqID_191806
gatcccaccgctggtgctgggcttcctggtgatggctgccggcatgggtatcctcggtaccatgctgcacattggcattaactctgccggtgagcagtactttgccatcgccatgctgctgatgttcattgttggcttcgcgatgtcagccggtccgctgatttgggtactgtgttctgaaattcagccgctgaaagggcgtgattttggtatcaccgtctctaccgcgactaactggattgccaacatgatcgttggtgccaccttcctgaccatgctgaactcgctgggcaacgcgccgactttctgggtctacgccgcgctgaacgtgttctttattctgctgacggtcgcgctgattccggagaccaaaaacgtctcgctggagcacatcgagcgcaacctgatgtcgggcaaaaaactgcgcgatatcggccagcaggcggccctttttttatctgccgcctgtgcgcatgcagttgcgtaccccgctgcaacgccttatgctgccgcacatgaaaacgccacagccaacgctggtttatcagcagcgcggcacggccgcaggcaccgcgtggctggagcagtggcaaattcgcctcaacccgctggcgcatctgctggtgtggaaaaccttcggccgcgtaccgccgcacggcaaagagtggaagtggatgatggaggacgtgctgggcgtgcccgcccgccgcacccaccagttcgccatcacttcggtgcgcagcaataccttcccctatcgctgtcgctgccagcaacatcagctgacg

SEQ ID NO: 75029 - DNA, 375 bp, Glycine max
  Peptide Sequence Number=SeqID_191807
atgatgaacaaagaacaccgaacgaagaatgatgtagaagttgattacagtcgcgatttggtagcgcctcggcctcattttctcttctttcttcttattctttccctctcctctcaatatccttcaatgctgaaccttggaaccctttactcagcctccctcacgcctatttatggcaaagaaaagggacttggtggacttgcagctcaatcaggcaagctaatgcttcactctaaagtaaccttgctcgcccagggaaaatacttgtacatgggggcatgtcactcggtttggaactctcttgtgactcagactgatcaccatgagagggagttgcctgtgcacgacagggtgacctcgacacttgctgcctag

SEQ ID NO: 75030 - DNA, 177 bp, Glycine max
  Peptide Sequence Number=SeqID_191808
atgaagaatgcgttcgacaagaaggtgcgctcgcgcaagttccttgagggggaccttgtgctgaaaaaggtgtcccacgccgttaaagataatcgagggaagtgggccccgaactacgaaggcctttcgttgagcagaattgtcttaggcagtggtcaaatgccgggacgggtctaa

SEQ ID NO: 75031 - DNA, 768 bp, Glycine max
  Peptide Sequence Number=SeqID_191809
atgaaggaagaatcatcatacgcattgggtccaccaccagttttttatggtcaggagtacaagttatgggcctctagaatgaccactcatcttgaagtgttggatctttggaagaaaacgatggctcagatgaagaatcacaaagaaaggaagacaagaaaggctaaggctaaaaattatcttttctctgatgcacatgagcagcgaagaatgatgagacaagaggaggtagtacaaggtgtttatcatatgaaagcacaaaatttaagaggtggcaaagacaacaagaacaacaaatggatgaacaaaaaaccaaaaccctctaacaagcagcaatgcgagacctttcctccatgtccgcattgcaaaaagacaaaccatcctcaatctaaaccagaggagacaaaggtgactacagaggaacaagaagatgaaaattggtgcttgatcaaaaatgcaaaaggaaaaggcatattcagggtcaagatgagagctaaaagctatgctctaaatctgatagaggatgagcaaatagctttttcaagcacaaccgtcaacgctgaactatggcacaaaaaactcagacatttcctccttgttggacttttacacatgcaaaatcatgccttggtgaaagatgtcttgatgcttgaagacaagttggttgattgtgtggcttgccaatatggtaaacaagtcaaaaaaaccatttcctctaacagcttggagaataactcaaaagctgcaactagtacatacagatgttag

SEQ ID NO: 75032 - DNA, 300 bp, Glycine max
  Peptide Sequence Number=SeqID_191810
atgaggggtggaggttgcacaacagcttgcccaggcaagctggttacttcagccctaagctttccagtggcccaggcgagccaaaggctagcttggtcaagccaggggctgcaaaagtcaccaaatgtccattttgccctcctttttgggtactttccgcattcttttccgaaatgtcaaaaaaccttacagattgcacgacaattggtgttaagcagcacaattcggctggcaagaatccagatgtttgcaaatgattgtgcccggacgaaattagggtatgacagtcaggttggatag

SEQ ID NO: 75033 - DNA, 627 bp, Glycine max
  misc_feature (373)..(373): n is a, c, g, or t
  Peptide Sequence Number=SeqID_191811
atggaggaatcctttgtttgggaaatttgggggccaatgggttttgatttcaagtggcaattgaagcctttcgtgggggtttttctagtgattctccatccaaggggatgtctttctgcagtaatgtttagaatggaggatgacatcaactcggtcacctacaagggtgaaaggaaaaggagagcgatttcctttaacaacatcaaatctgaggagtttagctttttcattcacaatatggaactgttggatgtcctaacctctggtaaaaagttcacatggataagtgttgatggcttgtcaatgagtagattagactgtttcctcatctttaaagaccttttccttgggtcgaatatctcattgcaatggnttggtagtgtggaagcaaagcttcatgatgaatcaacaatgattcaaaggtgttttgatgataacaatgatgacaacaaaagtaatgaacaaaaagctcaagtgaatcaaagaacatccatctcaagaatcaagattcaagattcaagttcaagaatcaagaagaattcaagactcaagaagaaagcctacaaacaaagattcaagatctcaagaatcaagatcaagattcaagatctcaagaatcaagactaa

SEQ ID NO: 75034 - DNA, 975 bp, Glycine max
  Peptide Sequence Number=SeqID_191812
atgccgagttctaggaggcaatggactcagctcgcgacacccatggctaaatacgatcctgagatagtcatggagttttatgccaatgcatggcctacagaaaaggggatcagagacaagcgctcctgggtgaaaggccaatggattccctttgatgaggatgtcattaatcagtttttggggcatccattggtcttggaggagggccaacgctctgagtttagccagaggaagagtcaggtcacagggtttgacgaggaggccatcagccagttgttatgcattccagggcaggactttgcccgaagcatggcagggagtcaggtgtggattatgcgcaccagcatgaccaccttcacgcagatttggatgacattggagctaagcaacattctccccagtgaccataattcgaacctcctcctgccaaagtgtcagcttgtctatgctatcctgactcagatgagtatccatgtagcccagctgatctcagacactatatatcaatttgcagggatcacacctcctagacacctagtggactcagagaagtccaatagggctctaggcagtagggctttcatagagaaatattgcaccataacagccagaggaggacccgcagcagtcggccacaggtgcactgctgtcgcctctataggaatcaccatccttggggtccatctccactcacctgcggaggttagagctccagatacacaggtgcagctaaatgagaccttctaccgatacactatgcaccagcagagccagaacaccagtcctttcccgtggcctaccctagagcaattcggggccacagttgccaggcctggagatgcgcccgattttgagacagggatagggcccttgggaacgacgagggagcttaggaggataatgatatggctaacgtgctggatttcttcacttgaggaggcagagttgcacggccggggtcgccaaaaattgtga

SEQ ID NO: 75035 - DNA, 180 bp, Glycine max
  Peptide Sequence Number=SeqID_191813
atgtcttgcaagagtgaagtgataataagcgaccaaatgactgtacaagttgcctggctaggagtccagcttccttctgtaggggggactagagctgatggtgattacattgcagacatcattgttgcacaggaagcttgggatctagggccacacaggattgaggcccattttgattag

SEQ ID NO: 75036 - DNA, 342 bp, Glycine max
  Peptide Sequence Number=SeqID_191814
atggagaatgcggaggagatgatgcagcaaaacgacgaggtcgctttagtcatcacgcgtaccaaagcctatcccaccagctccaatggcggaactgcccacgtagacatgtcccgccagcaccaatggcggtaccctcgcctcaccccctgtcccgctgctgccaatagcggcaccccctgtcccgccattgcctctggtggttccaagcttcacgccattgttaatggcggcacccacttacagaagagaccccccttggaatttcttttaaaagagaccctgttacgtaaaatgtttttaaaagaagcccccttgtgtaaatttgccaacttctgttga

SEQ ID NO: 75037 - DNA, 714 bp, Glycine max
  Peptide Sequence Number=SeqID_191815
atggatggtccccggacgaaattagggtatgacaataacctcaacacattcttggagattcctatgatattagctgagggcgagactttaccaacatattccagatactgcaggttgcccacagattctaaagagattgaggcttctttatgtatactaggccgagggtttgttttgaactctgagggccatcctgggatgattctcaagaaagatttgacgactcttgctcaggtgtggagtgttctcacatattccaacctggatcctacttcacacacctcagacctgacagtagatagagctaggctaatctttggcctagtctctcaaatggacatgaatgtgggagcccttatctttggccaaatcacatttatagcccagtctaactcttctagacttgggttccctgctctgatcaccatcctgtgtaaagccaaaggggttaattctgacagcttggttttcgagcgcctgagcccggtcatcaacttggcctatatcaagaaaaactgttggaatcctgatgatctaacagtttctatcagaggggccaggcatgcaaggatgaggccagctgagcctccttccacatctacaactcctattatagcacgtacctcaacagctccttctatcctagctgtagaagcaaagcttcatggtgaatcaagaatgattcaaagatgttttgatgataacaaaggatga

SEQ ID NO: 75038 - DNA, 687 bp, Glycine max
  Peptide Sequence Number=SeqID_191816
atggcgcgtgataaggtggatgacacgtacgagaactggaaggaggcggaatttgaaatcccagaggcttctgacagtaagacgaaaaagaagttacttcagactatcgatgagagattgatgcagtttaaatcagacctcacgagaaaaggggcccttgtagccaatcaagacagtgtggacgacactgtctgtgagaaatacggcataagcaaggaaaaatgggcccagatgtgtgggaaaaaggcacaggccatccagacacagaatactgcccctcacgttttgtctcgtgggggttatgaatatttggagcagaagctcttgggtgagaagaccaagaagaagctggaggaagctgaacagtcaggaagtgttgatggcgtcattgaccctctatcccccgtcagacgtctagtgaggtggaagatggcccgcaccaagaaaataggggagataatgattgaggccgcaaaggagatcgctgagaagatcgattcctttgaggagcaggcacgacacagggatccttcgtcccccatggacgtcaggatgttctcactgctactattagacgtccagagcaccctggacatgtccgtgctgctgggagccggtgtcaccatcaagcagtacttcagatcagctccacggacgtcctgcaactcttcctcgctgccctcctga

SEQ ID NO: 75039 - DNA, 471 bp, Glycine max
  Peptide Sequence Number=SeqID_191817
atggcgctgacaggcaagaagcggctgttcgccgaggccttgttggcgggcaagtcgaacaagatggcggcgctggccgctggatacagcgcggcatccgcttcggcggctggatcgcggctggcgaaagacaaggatgtgctggcgcacctgcagcgcaaggccaaggccgtcagcgcggcgcctccggcagcggctgacgccgccgcgccaccagctggcagtttcgacttgagccaggcgctttcccaccgggacccccgggccttcctgttggcggccatgaacgacgccttgttggagccgaagctgcgtattgacgccgccaaggcgctgatgccgtttgagttcgccaagaagggggagggcggcaagaaggagcagcaggcggacgcggccaagaaggtggccagcaggtttgcaccggccgcgccacccaagctggcggcatctaacggaagaaaggtatag

SEQ ID NO: 75040 - DNA, 2535 bp, Glycine max
  Peptide Sequence Number=SeqID_191818
atgtcttcctcccgttatgactccgatctccatgatgactttttccgtgaatggtaccaggacgacaatagaaagtatgatgtgtttatgagtttcagaggaaaagacacgcgtgcttctttcacttcacatctctatgccgctcttaagaatgcaggaatcactgttttcaaggatgatgagacactttcaaggggaaaacacatctcacactcgctgcggctgggaatagaacagtctcgaatttctgttgttgttttctcgagaaattacgcagagtcgcggtggtgtttgcaagagttggagaaaataatggagtgtcacagaacaacagggcaggtagtactacctgtgttctatgatgttgatccctctcaggtacgtcatcaaaaaagccactttgggaaagcatttgaaaagcttctgaatacgattttaaaagagataggagataagtggccgcaagttgtgggatggagggaggcacttcacaaagcgactcataaccaaaggtgttggaaaaactcgcacgttaacctttggaggaagggactttgtgaggctggtggcgtcccagtggttgttgtcttcagctccagtggagaaacggagattgctaatgagataagcctcatccttaagcattggagggaggcactatgtaaggctgctggcatcgttttaaattgcagtccgcaaccgcaactacggtcccaacataacggttatttgactgtttgcaactgcatcaagacagcagttacagtcgcatccgctgcattttcctgcaattgctcaccacaatataaagattgtttgactcgccgcaaccaccattcaccgccagaaatgtctgcaaccatctcaggcagtgcagtcttaaattccagtgttgaaatggagatggctaataatgagatagacgacctcatccagagttggaaggatgcacttcataaggctgctggcatctcaggggttgcagtcttaaatcaccgaggagaaatggacacttctaatgagataaaccaattcgtgaagcgttggacggaggcccttcgtgaggctgctagcatctcaggggttgtagtccaaaatttcaagaatgaaagtgaggctatcaaacatattgttgaaaatgttacccatttgttagacaagacagagttgtttgttgccaataatccagtgggggtagaacatcgagtgcaagaaatgattcagttgctagaccaaaaacaatcaaatgatgttttactactagggatgtgggggatgggaggcattggtaaaacaacaattgcaaaagccatttacaataggattggccgcaattttgatggaaggagtttccttgcacatattagggaagattgggggcaagactctggtcaagtgtatttacaagaacaacttctttttgatattgacaaagaaacaaatgcaaagatacgtaacgttgaatcaggaaaaattatattaaaggaaagacttcgtcataagagggtattgcttatacttgatgatgtgaatgaactagaccaaatgaatattttgtgcggaagccatgaatggtttggtccagggagtagaataatcatcacaaccagagatattagtatacttagaaggggaggagttgacaaagtgtacaaaatgaaaggaatgaatgaagttgaatcaattgagcttttttgttggcatgcattcaagcaagccagtcctagagaagattttatcgacctttctagaaatgtagttgtatattctgggggattgccactagctcttgaagtccttgggtcctatttgtttgatatgaaagtaacagaatgggaaagtgtattagagaaactcaagagaattcctaatgatcaagtacaaaaaaagttaaaaataagctattatggtttaagtgatgatacagagagggaaatattccttgatatagcttgtttctttattggaatggatcgatttgatgttatacgcatattaaatggttgtggacttttcgcagaaattggaatatttgtccttgtagagagaagcctcgtatctgttgatgataagaacaagcttggaatgcatgatttattacgagacatgggaagagaaattattcgtgaaaagtcgccaaaggagcttgaggagcgtagcaggttatggtttcgtgacgatgtgcttgatgtattatcaaaagaaactggaacaaaagctattgagggactagctttgaagttaccaaaagctaatacagaaaaagttcgcaccaaagcttttaagaagatgaagaaactcaggctgcttcaacttgctggtgttgaacttgttggagattttgaatacatttccaaagatcttagatggctttgttggcatggatttcctttgacatgcataccaagaaacttttatcaaggaagtctagtttccattcagttagaaaacagtaacattacaattttgtggaaagaggcacaggtgcctttcatgggaatcatgcataaattggctgccacaataacaacataa

SEQ ID NO: 75041 - DNA, 192 bp, Glycine max
  Peptide Sequence Number=SeqID_191819
atggcatacttgttgctacatatgttgttgcaaggggtcttgatattcctagtgtttatgtccatagaagtggaagaacaaccagagcttctgctgaaggttgaagtattgcttaaatatcatcaagagatacatcaaagtttgcttcattgtgcaagtcattttccaaggggtgggaataggccaggctag

SEQ ID NO: 75042 - DNA, 363 bp, Glycine max
  Peptide Sequence Number=SeqID_191820
atggctaacaatgcctcagcatcgttgacacgttcttctcccacccccactagcatctctaattttttcatcaacgacccattgttcaaatcccttaaagatgtccaaaaccaaatccactgcatccaaggaaggatctaccttcatgagggacgcaaggctaagcttgggtggtgtcgatggggtgactctactcaacgttggaaactgaacttggatagagacaacgagacgattctgctcgacactagagatggtggtaagggagaagcctttgtagatgaggctggttccagagagagaaaagagagagacaagtttttttgtttatatgaatctcgaggaaagaaaatgacaggataa

SEQ ID NO: 75043 - DNA, 2493 bp, Glycine max
  Peptide Sequence Number=SeqID_191821
atggagtgccacagaaccatagggcatgtggtagtgcctgtgttctatgatgttgatccctctgaagtacgtcatcaaactagccactttggaaatgcatttcaaaaccttttaaacagaatgtccatagacttaaattccagtggagaaatggagatgatgcttaataatgagacaaacctccacggaaagagttggagggaggcacttcgtgaggctgctagcatctcaggggttgtagtcctcgattccaggaatgaaagtgaggctattaaaaatattgttgaaaatgttacacgtttgttagacaagacagagttattcattgctgataatccagtgggagtagaatctcgagtacaagatatgattcaactgctagaccaaaaactttcaaacgatgttgaactattagggatatggggaatgggaggcattggtaaaacaaccattgcaaaagccattttcaataagattggccgcaactttgagggaaggagcttccttgcacagattagggaagcttgggagcaagatgctggccaagtccatttacaagaacaactcctatttgatattgacaaagaatcgaaaacaaagatacctaacattgaattaggaaaaaacatattgaaggaaagacttcgccataagaaggtacttcttatacttgatgatgtcaataaattgcaccagttgaatgctttgtgtggaaatcgtgaatggtttggttcagggagtagaataatcatcacaaccagagatatgcatatacttagagggagaagagttgacaaagtgtacactatgaaagaaatgaatgaagatgaatctattgagctttttagctggcatgcattcaagcaaccaagtcctagagaagattttaccgaactttctagaaatgtaattgcttattctgggggattgccactagctcttgaagtccttggttcctatttgtttgatatggaggtaacagagtggaagtgtgttttggagaaacttaagaaaattcctaatgatgaagtacaggagaagttaaaaataagctttgatggtttaaatgatgatactgagcgggaaatatttctcgatatagcttgtttctttattgggatggaccgaaatgatgttatccatatactaaatggaagtgaactttatgctgaaaatggaatacgtgtccttgtagagcgaagtcttgttactgttgataaaaagaacaagcttggaatgcatgatttgctacgagacatgggaagagaaatcatccgtgtgaaatcaccaaaggaacctgaggagcgtagcaggttatggtttcatgaggatgtgcttgatgtattattaaaagaaagtggaacaaaagctgttgagggattgactttgatgcttccacggagtaatacaaaatgtttgagtactacatctttcaagaagatgaagaaactcaggttacttcaatttgctggtgttgaacttgctggagattttaagaatctttcaagagatttgagatggctatattgggatggatttcctttcaaatgcataccagcagacctttatcaaggaagtttagtttccattgagttagaaaatagcaatatcagccatatgtggaaagaggccctgttgatggaaaagctgaaaattctgaatctcagtcattctcattatttgacacagaccccagacttttcaaacttaccatatcttgaaaagctaatactcatagattgtccaagactatttgaggtttctcataccattggacatctcagggatatcgtgctgataaatttggaagactgtgttagccttcgtaaccttccaagaagcatttataatttgaaatctctgaaaactcttattctttctggatgtttaatgattgacaagttggaagaagacttggaacagatgaaatctttgacaacactgattgcggataggacagcaataacaagagtgcctttttcagtagtacggtcaaatagcattggatatatttctctatgtggctatgaaggattctcacgtgatgtatttccttctatcatttggtcttggatgtcaccaacaaataatcctttatgcctagtcgagtcttacgcgggtatgtcatctcttgtttcttttaatgtgccaaatagtagtagttcccacgatcttctaactatttccaaagaactgccaaagcttagaagtctttgggtggaatgcaactccaaacttcaactatctcaagatacaagaataattttggatgctttacatgctgacacaaattttgaggaaaaagaatcaagtaccacaactacatcacatggcccaaacacaaaaacttctgcattaattgaatgtagcaatcaagagcacatttctggatcaaaaagttctttgaaatctcttctaattcaaatgggaacgaattgccaaggctccaatattctaaaagaaaacattttacagggaccgaaagcaaaataa

SEQ ID NO: 75044 - DNA, 324 bp, Glycine max
  Peptide Sequence Number=SeqID_191822
atgagtgaaatgcccaaatgctctacttttagtagcccttccaagcgctatagaggttcctacagcactggcatttcaaataaaatcatcgatctccatacctattggtgctccacctctaaaatttatattgagattgcatctcctttaacacaaggtttagggagttggctccgaggaatgtcacacgaattggataaagctatgggaaaggatttacgtgtgataacggaacgttctggtggggcaatgggccctggagattctaaagttagacagaggaatgatccaggacaaatagcggcagaggttgccatggtttag

SEQ ID NO: 75045 - DNA, 594 bp, Glycine max
  Peptide Sequence Number=SeqID_191823
atggcatccgggtttgttacaaattggaggagaaaaaagaacttgttgaggggactgagaatgaatggtgagtgggtggaggagccaaaggaagtgaaggaaaaggttgatgtaaaaatgaccttggatgagtttcacatacatagtattatcctaggaggatccaactcatcctttatttgtcttgtccctaaggtagaggatcctattcatttggggaagtatagaccaatttccttggtaggttctatgtacaaaatcttagctaagatcttggctagaatcctaccaaaggtgattgatgaaagacaaagtgcgctcttgagtggtaggtccttgcttcatagtgctcttgtatctaatgaagcggttgacaaagcaaaaaagaaaaagaagctgctttcttttcaaggccttaggaaaggagatcccctaacccatttcctctttactattgtggtagaggcatctttgagtaatgtgaaggttatcaagtgcttgataaggagttttgaattggtttctgagcttaaggactttgaacctaccttttgtctatttgggaataccgattggtgccaatccaacacgtga

SEQ ID NO: 75046 - DNA, 255 bp, Glycine max
  Peptide Sequence Number=SeqID_191824
atgcacgagtggcatgaagtgggcaatgcatgggtggcgagatatacgtttagacagggtgaggtggtcaacgcggtgtggggcgtggcacacaatagtgatagaggagggatggtgcacgatggtgggatgaaggttaagggtgagattctgaaggaaagggaaatagggtgcgagaaagggaaggaggttcatcatttcacaaaattttgtagtgaaaataccaattttgatagtgagaatagaatcttttag

SEQ ID NO: 75047 - DNA, 462 bp, Glycine max
  Peptide Sequence Number=SeqID_191825
atgacttgtgttgcaaatagttttatgaataattgtggtagaagcaaagttgatcagtcactgtatggtctgttggagcctcaatctatacacaatgctaaggacagacgtgaacaatgccaagaatacattcaaacatgggtcaaggaatcacaaaggcagttgtacttaggggcttacttgcatcaggcacattggcaactatttgttttgtgtccaagggaaaacaccgttgtttggttttgttctctgaggaagaagccagatattaacatcaaagccacaattaacagtgcaatgaagacaataaccagttctttccaaggcatgtctaatcaagctgcacctcggtgggttgaaccaaagagtcatgtccaaactggagcgtacgagtgcggatattatgtcatgcattggatgtggtgcatagtgactggtggattgaaggatgactggaacaag

SEQ ID NO: 75048 - DNA, 171 bp, Glycine max
  Peptide Sequence Number=SeqID_191826
atggcagcctcctcctccaactcatccaatcttgttgggtcaattactttgctacaaatagcattaaaaacaaaacacagccgtgttatggcaacccgaactttgacaggcaagattccccgaatcgctacagattatccttgtggaactttaagcatatgcaaacaatga

SEQ ID NO: 75049 - DNA, 476 bp, Glycine max
  Peptide Sequence Number=SeqID_191827
gcaggcaaaacgagagagagccgacgaacggtagcctcttttggccaaacatagtagaagaagaaagggataccggattgattgggggaggggacgaaatcaaaagcgacaaggggctgaatctcaagtgggattcgtgggcagcaaggcccacttctgccacttaccaataccccgtcgcgtatttaaagtcgtctgcaaaaggattctacccccccgctcgatgggaattgcgcttcaaggcgtctcgtagagctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 75050 - DNA, 240 bp, Glycine max
  Peptide Sequence Number=SeqID_191828
atgacgaatcagaaagatcagcaattcctccaactggggaagcaggggggaggggcggcagcttcatctgatgatgcatcagagatgataatcagaggtggagatgggggaactacttcaagctcaggagaaggaggtagattcaccactagagttcatggctcggctggcattggttcaacccgtgccggtgtgggctctgaaggagcagcctcattggttctcaccaatggaagttaa

SEQ ID NO: 75051 - DNA, 525 bp, Glycine max
  Peptide Sequence Number=SeqID_191829
atgtcttctagaaaaagaaagagcattggtgcaaggccgacaactcaatatgacacaagaagattccactccttcgaggcctggaccagatacacagacaatgtgctaggaagacatatactagctgagagaaaggtagaaatataccatatggagttggatgagttcaaggatgaattggagaggtgtaacttccataagcgcctctccaatttagttgacagcagcatcgacctagccttggtgaaggagttctatgccaacctctacaatcccgaggggccttgcccaaaacaagtcaaaatccgaggccacttgataaaaattgatgaagacagcctaaacaccttcctagagatacctgtggtattggctgagggagaatccttacccgcctactccagctactgcaggatgcccactgatataagagagattgaggctgctttgtgtatacccggccgagggtttggagtgttctctcatactccatcctggctccgacttcccacacctcggatttga

SEQ ID NO: 75052 - DNA, 336 bp, Glycine max
  Peptide Sequence Number=SeqID_191830
atgttggaaaacccatattgtcgtcactggaaccccacagaacccacattgtcctggctcgaagaaaagcctacatacactgttgctactacggtgctgaaacactcgtcgctactcaaaggtcaaagttttctccgcgaggctccgctcacgtgcgtgtgttgctgggttctcttgatcaagagaatcaaccatgatttttgtagatggatccacaggggtcttgaaattgcctgcaattgctttaacattttattgtccaacagagggggcttgactgttgttgttttaacatattttttgtttcttgagcaagtaatgcttaagtatagataa

SEQ ID NO: 75053 - DNA, 165 bp, Glycine max
  Peptide Sequence Number=SeqID_191831
atggctggtacattcttccttttgaaacagcaaaataatttagagaattatgagcggttgaggttgagtacaacatgttggattctatatccagatgatgcaaaggcccaagctgttcactcaacagaggcaatggagcctgataggggggcacatcaggattga

SEQ ID NO: 75054 - DNA, 348 bp, Glycine max
  Peptide Sequence Number=SeqID_191832
atggcacaactactatgcataccagggcaagatttcacccagccgctgcaaggagaccaggattgcgctggcaagacacccagtggacccaaagaagttcaacgaggtcttggggttctagctctgattacgggcctctgtcggttctacggagtgcccgtcgcccccaacaaggtcaccaggccccctattaaccaggctttcatcaagaagtactgcgcccccaggcaggtgcagggcgaggcaccacgacagcctggggacgaccagctgttggcggcagacgcactaccaccacctccagaatccacctcagctcatctacaaaggctagagcattgcctatga

SEQ ID NO: 75055 - DNA, 649 bp, Glycine max
  Peptide Sequence Number=SeqID_191833
agggctatacatcctcgcctctagagggctgcacgtccttgcctctagagggctgcatgtccttgccttcagagggctacacgccctcgtcttcaaagggcaacacgttctcgcctttagagggctacatgtcctcgccttcagaggactacacaccctcgccatcagagggctatgcgtccttgactttagagggttgtacgtccttgccttcagagggatgtacgtccttgcctccaaagggttgtacgccctcgcctccagagggctgcacgccctcacctccagagagctgcatgccctcaccttcagagggttgtgcgtcctcgcctttagagggctacacgtcctcgcctttagaggactacacgtcctcgccttcagagggctacatgtcctcgcctttagagggctacacgccctcgacttcagaggactacacgtccttgccttcagaggactacacgtcctcaccttcagaggactacacgtccttgccttcagaggactacacgtccttgccttcagaggactacacgtcctcaccttcagagggctgcacaccctcgctttcatagggctgcacgtcctcgctttcagatggctccacatctgggcttttagagaactcaaggtcctccgcccttaa

SEQ ID NO: 75056 - DNA, 354 bp, Glycine max
  Peptide Sequence Number=SeqID_191834
atggcccgcacaaagaaaactgggcaaatgacgtctcaggcagcaaaggaaattgctgagaagattgaatcgttggaggagcagtcgtcatacggtttcttcgttgccattgggcgaccagaacaccgtagtcgtgtaggtgttgttggagttggtgtcacgatcaagaaatactttggactggctccaaggacctcccgtatgtcttcctccatggctcccgaagacctggagcagctgatgcaacaaattagggaccagttggaggagtcgatcactgaaaaagtgactcaacggctaatgttatcctttcaagccacagtccatccagagatccgagcaattgaaatttga

SEQ ID NO: 75057 - DNA, 522 bp, Glycine max
  Peptide Sequence Number=SeqID_191835
atgtccatccctgaagtcgccctgcgtccctttattctgcaggatgctgaagcgtttacgcatgccgttaatcagtctctgaacagcctgctgccgtggatggtatgggcacacacagattacagcgtcgatgaagccgtgagctggatcaatttcacccatctgcagcgtcaaaagggtgaagctgaagagttcgcgattgtcgatggcaacgatcgattgctgggcggtgctggcttacgttatgcgcgccagcccggcgagttcagcgcgctgggctactgggttcgcagcgaggcgcagcaacagggcgttgcccgccgggcggtggcacagctggtgaatctggcgttcgcccagccacacataactgtgctggagattcttgctgcagaagagaatcacgccagccgcgccgtggccctgcgcagcggcttctcgtttgtggattaccgctacgggttgattgtgctggagagcggtccggtcaacacggcgatctatcacctcagacgcccataa

SEQ ID NO: 75058 - DNA, 150 bp, Glycine max
  Peptide Sequence Number=SeqID_191836
atgtgggattggcacaaacttaaaggagcactcaaactgggtgtatttacccccaaggcttacactctgaagagtccatcagggtcattccctcttgattcagcgcttgtgattaaactcgtcgggttcccacaatggatcccatcatga

SEQ ID NO: 75059 - DNA, 303 bp, Glycine max
  Peptide Sequence Number=SeqID_191837
acatcattgtggaacaaccttcatccacatcaagtcgtaggaactgctggtataataaaggaaattgattgtttaactgccacggtggctgacatagagaaagtcagatcagatttttcaatgtcaataaccgtggataacacaaagttatgtggatttggagggtggtttgatgtacattttcggggaagaagtgaggatccagctgaacaagagattgagttaaccacagctcccagtgtaaattatggtacacactggggccaacaggtttgtgctgcatcacaacttcttggtggttga

SEQ ID NO: 75060 - DNA, 222 bp, Glycine max
  Peptide Sequence Number=SeqID_191838
atgaacactggaacaggaacctatactgatcgctggaaatccatcggaacagttctttaccaacaaattttgccatgcgacatcgcagcgacttcgcaacgggatggcatagtggcgagcaacgagacaacgcagcagcgtcgagcaggggatagcgcaacgacggtgcaacgggatggtgcatcgacggtgcagcggaatggcgctatagtgagcagatga

SEQ ID NO: 75061 - DNA, 1455 bp, Glycine max
  Peptide Sequence Number=SeqID_191839
atgtcagagaagatcatggttcactcaaggtttatattttgtgtgatgataatttctatgttccttttgagcctgtcttccattttcctactccagtttagtagtcattctttgatacctagatcagcgttagaacttattcttgtcaataatgcgtcgctttacttcatgcccaatttgaagagagaacaaattttactccctccctctggggattcaaattttcaatcacaaaaacccagagaatctgactgtcatgcttccgatttgagccagaaaacaacttctgtaggacagcagatgaatatggcatcgcacccaactcggccattattgaaagtattcatgtatgacttgcctccagaatttcactttgggttattgggttggaagggaagtgtgaatcagacatggcccgaggtggataaccccgagcgtatcccccgctatccaggtggtctgaacttgcagcacagcatggaatactggctcacccttgatcttctgtcatcaaaagttggccagccttgcactgcaattagagtgcaggattcaagtcaagcagatgttatttttgtgccatttttctcatcactgagttacaataggcattccaagcttaatggacaggagaaagttagccttaacaaaaggttgcaagacagattggtacagttcttaatgggccggaaagaatggaaacgttcaggagggaaggatcatctaattgtagcccaccatcctaacagcttgttggatgcaagaagaaggttgggtgctgctatgcttgtacttgctgattttggaaggtatcctgttgaattagcaaatatcaagaaagatataatagctccctacaggcatctagtaggcaccataccaagagccgaatcagcttcatttgaaaaacgtaccacactggtgtatttccagggagcaatatacaggaaagatggaggagccattcgccaagaactgtactacctcctcaaagatgagaatgatgttcatttcacatttgggagcataggaggaaatgggattaatcaggctagccagggcatggccttgtcgaaattctgcctcaacattgcaggggataccccatcctcaaatcgcctttttgatgccatagtaagccactgtgttcctgtgatcatcagtgatgaaattgagctaccctttgaagatgacttggactactctgacttttccataattgtccatgcctctgatgccatgaagaaaggctacctgctgaatctccttcgttcaatcaagcgtgacgagtggaacaagatgtgggaaagattgaagcagattacacaccactttgagtatcagtatccatcccaacctggggatgcagtgaatatgatatggcagcaagttgaacataagatatcttcgataaggttcaatttgcacaggaagaacagataccagagatcttag

SEQ ID NO: 75062 - DNA, 534 bp, Glycine max
  Peptide Sequence Number=SeqID_191840
atgggggagcacgtggttttatctgtccttgaccctcttatagcacctggaactttgctaccacaacatggtggtgatggtaatgctttaggttcactcattgagggtgctactcatgttaatgatgttaaggaatgcgatacacttgaagaagaaaaagaagaccttatccaaatggtggaatgtcgcatttgccaggaggatgatacccttcaaaatttggacataccttgtgcttgcagtggaaccttgaagccattcaaacctggttatactgcaaattcacctgtctgccagcctggagatacttcaattggtatcagtgatgactgggcaatctctagtagtcctttagatttgcacaatgctcgacttttggctattgcggcattggagcaccaagttccggagactgagcatgaagattatgtcaatgctggcactggtggaacttcattgtggcactctgttggtctaatccaatcagctgaagaacttgcatttatgctacaagcagaggaacagcaaggttag

SEQ ID NO: 75063 - DNA, 330 bp, Glycine max
  Peptide Sequence Number=SeqID_191841
atggataccaacattgttgttaccaagcttgagtcttgtgaacagaaaaaaaaaagaaaaaggtcaacatatccgttgcggaaagacaagagcacaagtgtcactagagcaaaagatcaaatgtcattgaaggtgcaggtgccaactccagctgtgattgcaaatcctccattgcaacaccctttacgacacgagctattcgagcaagtggtgattgtttgtgatcccatctcagagcaagatctttgcttctctggccagaaaccatgcatggttgagaagctaaaatcccaacacaaactaaaacaaagaaccctcgcaaagtcatga

SEQ ID NO: 75064 - DNA, 3531 bp, Glycine max
  Peptide Sequence Number=SeqID_191842
atggccgatgctactcgatccaaagccaacgtcgatcgttgggaagatgccttcgcgaagctttcctcttccatgacttcgaagattgacgagcttctccatcgcatgaatcaattggagacctcgcacgccaatcctcacgttccatctgcattttctggtccttcgtccacaacgaccgcggactttgcttaccagttgaagctggaggttcctcgcttcaatggttccgatccaaaggggtggatattcaatatcacacaattctttgaatatcatgctacacgagaccatgatcgtctcaccatcgcttcattctacatggaaggacctgcacataattctcatcttcagcttatgaggatcctattggtgattaagcccaccattcgaagggaggtgcaagtcatgcagcctcactccttggctcaagcagtttccttcgtgaggctccatgaagagaagctgttagatggtcgtcaaccttccgttcggcccccacctactactactatgacttccctaccttcacggccctcgcctcctccagccaccaactctcctgaatcacctctgcttccctccgtgaccaaaccacactcatccaccattcctttcaaacaattgtctccgactgagttggctcgtcgtcgggaaaagggcctatgctttaattgtgaagagaaatactctcgcgacaaattatcggcgcagatcattcttcatgcactctcgggccatggagctccgaaaactttacgcgtcaccggcttaatcgcaaatcaccaggtccaaattttcattgatggcaaaagtacacataacttccagcaagaggagttggtctcctccctgaacttgtgccctcagaatacttcaacactgcaagtgatggtgggcaatggtgaggaattgcattgtcatcaggtgtgcccaggagtctcagtgcatattcagaagcatgatttcagggttgatttccatgtgctgccaattcgcggtgcagacgtagtcttaggaatgcagtggctcaaatcactgggacctgtcctaacggactacacaactcttactatgaaattcatttatgatggcaagttgatcgaactcattggggatcgcgatatgactctcgatcaaatttccccatcacagttacattgtcttgtggatacaggtaacactagcagttattttcacattcaaatggatccacacaccactacatcattacccttgtttcatcctataccaacaattcagactctcctcactaaatgtccctccctgtttcaaccactcacgaccttacccccatcccgacccacagaccacaccatcaacctccttcctaacacaactcctgttaacgttcagccctaccgctatccttactctcaaaagcaagagattgagaatcaagttgcatccatgctccatcatggtcacatacagcatagctcgagccctttctcctctcccgttttactagagaagaaacttcgggatcgtttccctataccaactgtggacgagttattggatgaactcggaggcgtaacctggttttccaagctagatttgatgcaaggttatcatcagattctgatgaaggactccgatacgagcaaaaccgccttccgcacacaccatggtcactatgagtttcgtgtgatgccttttggacttcgtaatgctctttcttttcaggcaacgatgaatcacttgttccagccatatttgcgcaaatatatcatcgtcttcttcaatgatatattgatatacagtcgaactctcgttgagcacttaaagcatttggagactgcatttctggtattaatggatggcaaatttactcttaagttatccaaatttactctttctggcaagggggtacaacccataccagacaaggtacaatccattcaacagtggtcgcaattgcgcattgcacgagccctgcgtgggtttcttggtgtcgcgggattttatcgcaggttcataagaggttacactaccatggttgcacccgtttcacgactgctgaccaaggaaaactttgtgtggtcaccggaagctgatgctacctttcaaactcttaatgatgcagtcactaagtccccggtgctagcacttctcgatttcactaaacctttcatggtggaaaccgatgcttcgggcgccgatatgggtgcgtatagggcgggcaaaaccaatgtggttgcagacacgttatcacgatcatcggagccacccattgcttcgttcctcattctttcgatgccacgttttgttttccttgaagacctgcataaggagctacagtcacatgctgaatttgtgactctaagggaaaagatttgcgccaatcctgtagcatatcctgattatttgttgactccacatttcattttacatcgtggttgcatttggctaccctcatatttttctttcatcaataccttgctcatcgaatttcatcaatcaccaattggaggacacatgggcttttggaaaaccttgaatcgcgtcgccgaaaacttcacttggcacacaatgactatcgatactcccataggaagacctttcaatggacttcatagtggggttgccggcgtaccgcggcaacacttgcatcctcgttgtcgtagaccatttttccaagggcattcatttcggcatgcttccttcccaccacacatcgcaaagtgtggtgctgctgcattattctccttaagtggcactaaacttaggatgagttctgcttatcatcctcaaacgaatggacagaccgaatggtcatataatacatccactcatttggccactgagttgacaccattcgaggtaacctttggtcgcaaaccatcgaactttcctcagtacctaacgggcacttcaaagattgatgcaatagatgatttgctcagtcaatgggaatccatatttgccttactccgtcagaagttgcttaaaacccaggcccgtatgaaagctatcgccgacgggcatcgccgtgatcatgagttccagattggagaatggttcctggtcaaactctggccatatcatcagaccacagcctggggtgggacacaatccaagcttgcgaagcgtttttatgggccatttcggatcattgaacggatgggtccagttgcttataagctggcattaccagagaactctcgcattcatctggtattccattgttctattttaaagcctttcgtgggacctcttgatgctgaaaggactgttgaccttccaccagtggcagtggataatcaaccagttccaaccccactagctatcctggctcacaagaccattccatcggatacaggtccaagacagctcgtattggttcagtggaagggccttcaccctgacgaaacatcttgggaggattggacgaaccttaaaaatattcatcaccttgaggacaagtcatttgaaggattacgtattaactgcatagtcgttcctgggtgcatgcaagtacgtaggagcagcgctagtatcttctag

SEQ ID NO: 75065 - DNA, 240 bp, Glycine max
  Peptide Sequence Number=SeqID_191843
atggaggccgatcacatgggtagggtggttaagagtggggtcccaaagagggagggatgtataattgaaagggaaagaaggataggccaaaaaaaaggacaacagtgggacccctcaatttccgatgtcaatcacttggaagttggaggaacctgcggaaggaagaacttgaggcattcacattcacctcatctttctattctcttttgggcttttcaaatacacactcgtcctatgtag

SEQ ID NO: 75066 - DNA, 496 bp, Glycine max
  Peptide Sequence Number=SeqID_191844
atggaatgctctgagttcaaatctatgggtggtgcgatggtcgatgttagaaacaaattcttcatcactgcactagctggcaatctcttgctaggccagcagattgaacactatgagcataatagaactatagaagctaagttgttgcacatctatgatcctctagtggggaagaagcccgaagctctttacaaagtagacaatacggaggttaggcagtttgtagagaaatgcttagaaattgtgtccctcaaactttcagctagggaactcttggatcacccttttctccaaatttatgattatggatttgactcaaaagttgtgcagtatcaaagacatttctatgaagtaaacccattaattagacaacctttgaatggaatttacaacattaacaacaagttaataagtggggacactgataatgttggtggttatggacctgtatctgaattggattatcatcgagatgatttcgaagcaagtgaaattg

SEQ ID NO: 75067 - DNA, 249 bp, Glycine max
  Peptide Sequence Number=SeqID_191845
atggtggaagagaatgttggggaatgcttgtgcaatggcttgaagcaaattgagggagaaaagcaaaagaaggtaaagcttgattatatgaagctttcaaaattagggttggggcagcagggacatgaaggaggggagaagaagtgtctgaattctgagctatggcatgcatgcgcgggtatagatgcattatcttatatctgcatgcgatacatgatttctctcagcaaccaccaacacaggaactaa

SEQ ID NO: 75068 - DNA, 990 bp, Glycine max
  Peptide Sequence Number=SeqID_191846
atgggggtgcaaatagcaaccaggcccacttgggccctccagaatattcctccagaaggttgttgcttctggaggaagcaaccctgctcgcctgggcgagctggaaaatctaagccgaggcgcttccgaaacgtttccgtaacgttttccgtgaggaatttcgcaaaggttttcgaccgttcttcgacgttcttcattcgttcttcgatcttcaacgggctgtcgtcccttgggacgggcgtgtggggtgctaataccttccccgtgcgtaaatacaactcccgaacctttcacttaaaagttcgtagatcgcgtcttttccggtttttccgacgttttcctcaaataaacattggtggcgactccgcgcgtgttcctttcgtggaacacgcatcctgcgagtctcgcgtcgccctcccgccgaagggtaggttgcgacaggatgccaccgtgttcgaggtctttaatccagacttcccgctctacataaagcacgaaaacctctcggaaatcacacacggtggtcaatgtctcagcatatcagtgttacagttgtggattttattcctcaagccacagttaattcagaggtctgggcaatcgcagtttgagtcagaaagttacattaagagttggatgcagagatcaaaatgcgatgtctatcttagagcctacctgaatggcggacactggcagatggtggtcattgaccccaacgaacacctagttgtctggttttgtcttgatgatgctccacaacctaaatcaaaggctcctgctaggtggattgtcgtcaagtgtaatagacaaaaaggaagtactgagtgcggctattatgtcatgcactggatgtccaccatcattttaggaagttttaggaataactgggaagtgtattttaacgatcctagaccattggagccagagagattaaaggtgttgcgaatccaatgggcacagtattatctccgagttagagatcaaacctag

SEQ ID NO: 75069 - DNA, 345 bp, Glycine max
  Peptide Sequence Number=SeqID_191847
atggattatcatcgagatgatttcgaagcaagtgaaattggtctatttggttgtgaagaggatgacaatttggccgaagttgacaccacaatcaaaggtagaagagaagatgatggcatctttttgacactcagaatagcagataaggaagattttaatattttaataaggagaggaacaagaaaggaggttaaagacaacataagtactaatgtgagaggaccatttaaggggacaaggcatctctcttatcatataagcttatggagagacacagcaagagactctgttaaatgtagacaaaataacagcccaacacaccaaatcttggacaaagcatcttag

SEQ ID NO: 75070 - DNA, 210 bp, Glycine max
  Peptide Sequence Number=SeqID_191848
atgaaaaccgtgcccgcggtgaggagcctcccgtcgacgatccccccctgtcgtccggaaagggacatggtgaaggtgttcggtatcaccaccgaagaaccgtggtggaggaaggtggtgggcatggagaggatatcgaagcaaccatggaaagtgacaatggtaacagtggcatcggctctgtcgcctctgggagtgaaagaaggttga

SEQ ID NO: 75071 - DNA, 384 bp, Glycine max
  Peptide Sequence Number=SeqID_191849
atgttgtgcggtgccaaaagcagcaaaaccctattgcgaaaggaaggacgctttgaatatggagattcattgaggaaaccctcctcagagttgttggatgaccatgaatggtgtactcccaacagtcatccaaaaccaagttgtgtaagaccatcgagttctgagagttctaatgatagttggccagatcatataaagggcaaagagtcgacgcttcatctagataatgagtgcacttgggggcggcggatacccaacgtgaccagaggtgtggatcacttccttggttgtactgaggttgtgctcgttactatactcaaggaaaacacttatgtgcacgcatacacacgcatacacacaaacacacatgcacacacattatga

SEQ ID NO: 75072 - DNA, 1533 bp, Glycine max
  Peptide Sequence Number=SeqID_191850
atggtagaaaatgagttaaagatcaaaaagcttagatttgacaatggtgatgaatacctagacactagatttaagaagttttgctatgagcatgggatcagaatggaaaggactgtgccaaatatgcttcaacataatggtgttgctgagcatatgaatcaaacattgattgaaagagccagaagtgtgtgtctacagtcaggcttgccaaagcaattatgggcaaaagcagtcaacataacaacttacttaatcaatcaaggtccatcagtaggaatatgcttgatcccaaatcaaagaagtgcactttcatcagttatggtgaagatgagtttgactaccgcttatgggataatgaaaaataaaaagatgattcatagtagagatgtgatcttcaatgaaagattaatgtacaaggataaggacaacacaaacactagcaactcagaacagagtgggccagtgtatgcagaggtggatgatgtcccagaaacccctatgattgagacccctcaattagaggaatcaatcaaaaataacaatgagcaacaagttgacacaccggagccttctactttagctcctgtattaagaagcaagttagagcttgctatgaaagatgagatgaagtctttaatctctaatcagatatgggaactagctgagttacccatggggaagaaagcacttcacaataaatgggaaagagttgactacactgaaatctttgctccagttgtgaaattcaatactatcaagtttgtcttaagcattgttgccaatgaagtgctctaccttgagcaattggatgtgaagactgcatttcttcatggagacttagatgaagagattttcgtgcaccaacttgaaggtttctcaaaagaagggaaaaagaatatggtgtgcagattgaagaagagcttgtatggtttgaaacaagccctaagacagtggtacaagaagtttgaaagctttgcgcacaaggaaactggatcaaatatggatgaaattaaaaacttaaagttgcagttgcagttgttaaaagaatttgacatggaggacttaggtctagcaaagaagatccttggtatgcaaatcatgagagataatcaaagagaggttttgcagttatctcaagtagagtacatcaaccgtgttttgcaaagattcaacatgggcaacaccaagccaatgagcacacctttggctagtcattttcgcctatccaaggatcaatcacctcaaatagaggaagaaaaagaattcatggctaaggttttgtatgcttcaaccattggaagtttgatgtacacaatggtttgtacgaggccatatattggccttggagtgggagttgttaacaggtttatgtcaactccaggagaattgaaagtacaaggctatatagatgcaaactttacaagtgaagtcgatgaccgaagaagtactaccagctgcattttcactgttggtactatagctgttagttggatatcgcgagtacaaaagatagttgctttatcgactacagag

SEQ ID NO: 75073 - DNA, 258 bp, Glycine max
  Peptide Sequence Number=SeqID_191851
atgaacaaggaagagtcttgggtattagactctggagcatcttttcacgccacttctcagaaagaattatttgagaattatgtccccgaaaatcttggtaaaatttatcttgataacgaacaatcttgtgagattgtggctaaaggcaaagtggagattaagttaaacgggtttgtatgggaattgaaaaatgttagacatattcttaacttgacaaagaacttgatctctataggccaattagccaatgatgactaa

SEQ ID NO: 75074 - DNA, 1056 bp, Glycine max
  Peptide Sequence Number=SeqID_191852
atggaaacacctacaataggggtgctgaaacaggaagaggagaattcactccttgcaaaacttacaacaaggatgactcaagcattgaatctcaaccaaacacaaagtcaaagttcaagttctgaagtagcaatacaaattggaatcaaattagatggtaccaattatgcactatggtcccaaattgttgagatgtatatctcaggcaaagacaaattgagatatataaatggagatcttcctgaacccccacaaacaaaccctgcattcaaaaaatggagaacaaaaaatgcagtggtgaagggatggctcatcaattctatggatctaaagttggtgagcaactttattagatttctgatggctaaggctgtttgggatagtattgctacaacatactttaatggcggtgatacatcacaagtatatgatctcaaaagaagagtgaccagactcaaacaaggcgacaaatctattgaaacatattataacaacctacaaggactatggagagagatcgatttttgtcgaccaaatcctatgctatgtgatgccgatattcagagatataatttaattttgcaagaagacaaagtctataccttcttagatgggcttgatgatcgtcttgacaagattcgagtggatgtacttcagatgcaaccattcccaacggtggaacaagcttatgcattgggcatatctcttcagatgactttaaatggcaagccaactaccaaatctcaatcacaaggagaagaagaaggatgcaaacattgtggaaatatgaaacatgccaaagaaacatgttttaaactacatggttatccagattggtggcatgaactcaaggaaaagaaaaaacatgaatcaagtggaggaaacaattctggtcatgcaacccttataagcggaaaccatgataattggatcatcgactctggagcaattgaccacatgacatttgatccacatgaattttctaaaatctctcaaccaaagcggatatgcactgccaatgccaatggagtaacttatctagtgataggggcttga

SEQ ID NO: 75075 - DNA, 291 bp, Glycine max
  Peptide Sequence Number=SeqID_191853
atgggtatactagtggcgaatgcactgatgtggaaactagtgcaacttttggggaatcaagtgacttgtggaactaacaaaggtgaggaccagatgaagtttcttaaaggattcagtggagatgtcaaggaaaactatgaagaggcaagtaaagtggcaaacgatgttgttggtatcatcaaaaccattgcatcattttgtgccgaatcaaaggtaatggatatatacaggaagaaatgtttagagtcggaaaaacaaggtgttaagttggggcttgtcagtggtacatga

SEQ ID NO: 75076 - DNA, 393 bp, Glycine max
  Peptide Sequence Number=SeqID_191854
atgtctctttttcagggggttttcaaaggaagtgtaaaaacatccaataatggttcccaagtcagaagagatgcaaaaataggctcaaatcgacaaggagaaggcttagaatcacggttacctcgaagaaaccgtgaaggaaggattggaggctttattctctaccgaatcctcatgttgagttttgaagattctgctccgattaaactgttcttctccgtgcggaggagcttggggatgttgggggagggtttaggggaaaacaaggaggaagaagatgactcttttaagctgttggacgtatttgaagcttgcaacactcgctcaagcgagtttggcttgcctgggcgagcagatccagcttcaattttactgcttcggttgaaacaataa

SEQ ID NO: 75077 - DNA, 1821 bp, Glycine max
  Peptide Sequence Number=SeqID_191855
atggatgtcacctttattgaatcggagaatttctttactttccaatcttcccactcctctcgtcagtgggagatgatgagtgaagagcagaattgggaagattggtcaggttttaaagcttcaaaggatgtaggggtggaggttatagcaaaaattgaagaatctgcagaaactgaaagtgaacaacctttgcttgttgaagcaaaaactgaaagtgaacaacccttccatgacttaacagtgacacaatcagaatctcctgagaatatctctgaggtacaagttctaaacactcctcaaaacatttttgttggttataaattacctttcaggcataatcgagggcaacctcctaatcggtattcatcggatcatggaactagcaagtcaaagcacccaattgccaattatgtctcaactcataaattatctgaaccccttaaggcattagtttataacttatcggcagacgatgtcccttatacagtaaatgaagctatgaaaaatccaaagtggatccaagcaatagaggaagagatgaaagcatggatcgttgaaagatataaagtgaggcttgtcgcaaagggattcactcaaacgtatggaattgattatcaagaaactttctctccagtagcaaaattgaacaccataagagtattaatatcacttgctacaaacatggactggctgctgtaccaatttgatgtaaaaaatgcttttctccatggggaccttgaagaggaagtgtacatggacattccacctgattgggcagggagtattactgatagaaaatccacatcaggttacctcacatttgtgggaggaaatcttgtctcttggaggagtaaaaaacagaaggtggttgctctatctagtgcagaagcggagtttagagcagccatagcaatagcacacaatccagttcaacatgatcgcactaaacatgttgaagtggatagacattttatcaaggagaagcttgaagacaagataatccagtttccttttgtgaagtcagaagatcaactagctgatatacttgcaaaggttgtctctagcaaaatatttcacaactcacttgacaaacataggcatttccagactattgtcgtagcaccaaacactaacaaggccaaagattccgcaacttcaatatttaaaattcttgacagtaagcctaccattaactccagcaccaatgaggctttaccattggcttctgtttcctccagtgaattgaagacactggttgtgccttctgcttatgcatacatgcatgcagttgcaaaacagatgcagtcgaccacaagtggtgctgtcaaagatgtcaactattacatatgcctggttaaagaacatgcaagaaaccttgcatatacttcggaactccaaaggattgccgtaatggttctcattgccctttttcgacatgatatgccaaatcagtgggaagctgagcctatatttttcaatgaaagcatttgtgccaacatagcttatgccaaagagggaggtgccacagaggaagagataattgcagcagctgaagcaaccaatgcacaagagtttataggttctcttccaaatggtcttgatcttcttgctacaactggagttccaatttggctcacagaaccaagtgtggatccggcacaatacttgaaaaagatactaagagagacatactcttatcctactgttgaagggattataatgttttttggtccagctcaagttggtttcaacggcacgactctaactgatgagactttcaaaaacactccagctggagatgttgtggacaagctgatttag

SEQ ID NO: 75078 - DNA, 434 bp, Glycine max
  Peptide Sequence Number=SeqID_191856
atgttattggtgttgtggaggaggttgtctttcgccaagtttcaggaaaagccagcaattgctatcttgcactttgtgggatgattattgcttgcagtttttttaagttcttagatgattatgaaggtgatggcccaattacagttctattgagccattgtaggatcaaggaagcgcagggatcttatcccgcatccatcagcaattctttcaaggcttcaaagttaattattaaccagcccgtgatagagattcaagaattcaatgaacggtattttttgtatagttgggcattgaggcccggtcaagttttaaatcccatggtgaagggagtacacagctttcaggttctatccaattatcatcaaaagaatcattctttggcaaggctgaggcaaagactattgctgacattaacaccatctctgaagtga

SEQ ID NO: 75079 - DNA, 732 bp, Glycine max
  Peptide Sequence Number=SeqID_191857
atggtgagaaaagaacaatctaaagaaggtgctctccaagctttgataaaagatttaggaggaagaacaacaatgagtagaagagtgacaagactgacaacaacaacaaaaatagggattggatttatccatcatgtccatactacaaaaagaggaatcacccacaaagaaatgcttgacattgaccaaaacctacttagtgttggaaagttgattgaaaaaggttttgcggtcatatttgaaaacatgagatatattcaaagtgcaaatgagggcaaaaagctttgctctaattctaatggtggaagaacaaagagcattctaagcacttgcaacttatattttgtctacttgggattatcagcaatggtggccttcatgggtaatccaatttcaaacccaattttgctttacttttttacgacaaaggcattactcaacagtgcacctcaaggttatcaaaatcgagagtctatgcagactcgtgagagctctgtagactcgactcataaactcaaagaagaattagagcactacgctaacaccatgaaatttctaaaattctcacctagactcgcggcttctctcaagctcgtcgtggacctcgtgggtcgtggctcatggtactcgcagcttccaacagaaccaggcaaccaccgcaccgcattgtctggtctcgcatcatcttgtctcgcactctcgcgtcgtctgaatagctccaactcatcgtga

SEQ ID NO: 75080 - DNA, 1068 bp, Glycine max
  Peptide Sequence Number=SeqID_191858
atgttatgcttcctgtcaatcactttggtggaaaaaatccctgatgaattattgagttatgaaaacttgaccaaggttgattttagggaaaatcttctctcagggtccattcctagcaatattgggaagctatctaacttggaaagtttggttctttcctctactaacctcactggtgaaattccagcttcccttttgaacctcacaaagctttcaagatttgcggcaaatcagaacaatttcataggtcttgtacctcctgggattacaaatcatctcacgagtttggatgttagtattaataaattgtctggacccattccagaagaccttttatccccatcacagttgcaggttgtagatttgtcaaataatatgtttaatgggtcagtgcctacaaatttttctccaaagttgttcaggttaaggtttaggagtaatcatcttagtggaaatattccttcaggttcttttgcagcaattcctaatttgaaatacttggagttggataacaatgacttgaccagattaataccggttgaattggaatcttgcaggaaaatgacaatgttgaatttagctcagaatcacttgactggtgtgttgccaccactgcttggtaatattaccaatcttcaagtcttgaggcttcaaatgaacaagcttaatggtgcaatcccaatcgaaattggccaacttcataagttgtcaatactgaatttgagctggaattctctgggtggatcaattccatttgagattacaaagttgagcaatattactttcctgaacttgcaaaccaacaatctaagtggttccataccaacatccattgacaacttgaaatttctctttgaactccaactcagggaaaacaaactaagtggtgtgataccaagcatgccggggagtttgcaggtgtcactgaatcttagtagcaaccactttagtggtaatactcccaacaattttggtaatttggatagcctgcaagtcttggatctctcaaataacaaatttcctggtccaattcccaaccaactaactggaatgtcagctttgacatag

SEQ ID NO: 75081 - DNA, 111 bp, Glycine max
  Peptide Sequence Number=SeqID_191859
atgacgccgatgcaccacgaaggctgtacgcgacgtcgacccaccacggatttcgtaaaatgcacttacctggatgacgtgcatacaaacggagcaaccaacagaggataa

SEQ ID NO: 75082 - DNA, 207 bp, Glycine max
  Peptide Sequence Number=SeqID_191860
atgtgtcccttttattggatttttgatcattttgggtgcccagttgagagtgttttggttgtgacatgctacagtaacaacgacgactttggcaaagaagttgtcggagaagttaaaaggaagatagagtggccgaaagaggcatggattctgggtcaagatgtttctcctgggtgttgcagattattttggtatcgcaaggaatga

SEQ ID NO: 75083 - DNA, 264 bp, Glycine max
  Peptide Sequence Number=SeqID_191861
atggctggagattttatagaatttaacttaaagattgacacactattcctcatacttgtcttttattgcccatcgataaaaggaaagactcttggtgaggcaatgagctcaaatcaagctagagaaattcctgaaccagattgtgtgacggtggaacttattgctatctatgaattctcagagtttagttcagagcctcgaaggccgagaatgccatcaagaagccttttcctctcggtgtcggtgtcagccaagttagcatag

SEQ ID NO: 75084 - DNA, 336 bp, Glycine max
  Peptide Sequence Number=SeqID_191862
atgtatgtagttgagttcaaaaatcaggttggtagcagattcctcgaccctaggagcgtcattcctcctttggtacttgagctacacgagggctgtgtggatgaggcactacaacgtgtagccagagatccgtcgacggatcgacgtgttggggttctccttgacggtgcaggcgagcatcaccaccgagaccaccatgaatgctatgttccacatcatgtcgagcactgccaccggcttcgagtaggtccagacggtgcaacgctcttccagctcacgcgcaaccatctcttagaccataatggagtggccgtggaggccaaggaggagctctag

SEQ ID NO: 75085 - DNA, 339 bp, Glycine max
  Peptide Sequence Number=SeqID_191863
atgtctaccagtttgtggtggggacatcacaaaatcatctgcagaatccttggaagcagcatctttgtacgagcaggcagcaattatttccttgtttattgtgccatgcacaatgtcaacaactttaacataaaagagatgaagaggtgccctcttacgaacaaagaggataggcttacaggcataagtgtccctcacctgagaagtgcttcacaggcaaatgctcttccagtcattggagtcaatcttgtagaaagcataatactcctcctttgtgatctcctaaggctctgtcatccaaatggccttatgcttgttcaccaacgagcattcatgtga

SEQ ID NO: 75086 - DNA, 561 bp, Glycine max
  Peptide Sequence Number=SeqID_191864
atgcgggagcacagccgaataactcccctcatgccggcacgcttgttgtcttttgctaccttttgcttcgctcaacaagttaaaaagcggatggaagaggtggcggcaaatgcagatcttcagctaccttctgtcacggttgaagtcacctttgtggacactgcgcctgtcgaagactacgagtttaaataccagaaatcataccgtgaagtccctgataatcttgatatgcgcatggtagattacaaacgggtccttgatctcctatctgagtggtctgatatcaatttcaaaatcgtctatcagtcgaaattcttgggggcagatggtgaaggttggatttctgtttacttggtacgacacctcgagctcccatgctctttctctcttctttcttctccaactttcttccttactttaactcttctttccttctcaattatattccacaaaatggcgccctcacatcccccgctgataggcaatgcgtctttcatgcagaccaccctgaactactccgttgttcaaggcgtctccaacgcctctaaccttaaaacctga

SEQ ID NO: 75087 - DNA, 321 bp, Glycine max
  Peptide Sequence Number=SeqID_191865
atacacaggtttgtgctgatgatgaaagtgaaaggtgaagcatgtgaggttgtgaatgttggagatgagcttttgaagctaataaacaacatagtgatgagaatggcaataggagaaagttgtttcaacaatgatgatgaggctcacaagttgacagaaaggatcaaggagtcttccaaggaaattgggaagaacactattagaaaatacactttcaacatcggttatttatggcattctacattggttttaaaaccaatgttgaaagtaccgatgttgaatgttttacaattaacatcagttttacaaaaccaatgttaa

SEQ ID NO: 75088 - DNA, 216 bp, Glycine max
  Peptide Sequence Number=SeqID_191866
atggaaagcacaaccaaaacttaccttgtgattgcgagtacaaggatgagcaaagactgctttcgtgccaatggaatgcctgcaaggaaaccaacgaagcttgttcaaagacaatgtgacgatggtaggctgagggtggctatgcgagactcagcgtcgggggtcaggaacaatggcagcggcgacggtggcctgagggtgcctttgcgagagtga

SEQ ID NO: 75089 - DNA, 180 bp, Glycine max
  Peptide Sequence Number=SeqID_191867
atggtagtgctgaaggtcatggtgctttggcgatgcaaggattgcaataataggattcacaggacagtattgaagaataaaggctacagttataatggcggtgctgaaggtgaaaatgcaacacgcacaacagaatgcccactacttctgaaaccctcccacgctgtgtcgataatgtaa

SEQ ID NO: 75090 - DNA, 560 bp, Glycine max
  Peptide Sequence Number=SeqID_191868
atggctgaagcaactcgacccaaaaccagaatggaacacatagaagaagccatagccaagctagactccaaccaactccgtgtcaccaccaaactagatgaactcattcaacatattactgcgttggaagcccttgactccgtcacccatgcttactccgtcgtccatgccaactctgccgccacaccccgcacccttacgattctgtttctcatgcttgttcctcatctagacaccaacagcaagcaccaagtgccccacgtgttgtcctccatcttcaaccagctcggccacgcccatgccattgtttcccttgacaacctcttaagtattgttgttcattatagtcgtgaagcggcttcacatgacaagcttttggaacatagagacatggcactgtttgagaggggagttgtgccctatgggtctgccatggttgcacgcaagcgccaaccagttgcttttgcattagggacggctgctgacccaaaggagtctcgtcggtacaaaccttgggatcctggaggaccttggtggactcgtaacaccttgaggacaag

SEQ ID NO: 75091 - DNA, 678 bp, Glycine max
  Peptide Sequence Number=SeqID_191869
atgcagaagcttctcaacattcttgcaatctcctgtttgagtgtttttctcgaagaaccattagcttctgaccatcccaaagatgagcataacataatcaacaacgtcaagcaggatgaggaattcgagtatgaggcagccttgcatgttacaatttattgctgcattccacaacgacaagcctcataccagatacgactcaggaaacatcgaggaaaattgttctttggcgatggcctcaaacacttgagaaaacacttagacatctacgagtcagtaaccatcaattttatggcttgtgaacacaaatggattttcaacctccatttcagtcctccactagaacaacaagcatgcggccgacccctactagcatctagaatgcatgtctggactcttgaactcacacaagcgctgcttggtgatcctgaaccactgaagcttccacctcttgcagcaatacatcttccttcttgcggttttcatatgacgattttaagaaggttcgaccctccattgcaatggcctgtcgtcttggtttgccctggctttcatggcaagtatgttgcccaaccatggtaccggtttcttgctgaaggtgattttgttcatggagacgagctttcattctactacaggcctcgtgacaatatttgggaaatagttattagaaaatag

SEQ ID NO: 75092 - DNA, 1290 bp, Glycine max
  Peptide Sequence Number=SeqID_191870
atggttcaaaccttcgacccagaggacctcttcacaaggcgctgcatatgggtgaacggacccgtgatagtaggtgctggcccttcaggtcttgcagtggcagcatgcctcaaagaccaaggtgttcccttcataatcctcgagagagcaaactgcattgcctctctctggcaaaaccgcacctacgatcgcctcaagcttcatctcccaaaacagttttgccagctaccaaacgtccctttccctgaggacttccctgaataccccacaaagtttcagttcataagctaccttgaaagctatgccaagcacttcagcatagccccacagttcaatgaaacagtgcagtctgcaaagtacgatgagacctttggcctgtggaggatcaagaccatcaggaagatcaagaaattaggaggactctcttcaggtggttgtgctgagtgtgaggttgagtacatttgcaggtcgcttgtggtcgccaccggggaaaactcggagaaagtggtgcctgagtttgaagggttgggagagtttggtggccatgttatgcatgcctgtgattataaatctggggaaggttatggtggacaaaaagtgcttgttgttgggtgtggaaattcaggcatggaggtctcacttgatctttgtaaccacaatgctaacccatcattggttgttagaagctcagttcatgtgttgccaagagaagtttttgggaaatctacctttgagcttgctgtgacgttgatgaaacggtttcctctttggatagttgataagatattgctgattctggcacgtttgattttggggaatgttgaaaagtatggtctcaaaaggccctcagtgggtcctttggaactcaagcacactgcagggaagacccctgtgttggacattggggcccttgagaaaattagatctggcaaaatcaaagtggttcctggaatcagaaggttcttgccagggaaagttgaacttgttgatggccaagttcttcagattgattctgtagttcttgccactgggtatcacagcaatgtaccatcatggttgaaggaggatgatttttttaccaatgatggaactccaagaaacccatttccaaatgggtggagaggcaaaggtggtctttatgctgttgggttcacaaggagaggcctctccggtgcatctttggatgcaattaatgtggctcatgacattgtcaagagttggaaagaggaaaccaaacagaagaggaaaacagtggctgcacgccacaggagatgcatatcacacttctaa

SEQ ID NO: 75093 - DNA, 207 bp, Glycine max
  Peptide Sequence Number=SeqID_191871
atgttctctactggtttctttgctgatggggaaaatgcatattcctttgggacctcgggttactactctctgatcttcgatgatgacaacattctccgacttctttacgatggtcttgaagtttctgccattactggccacatccatggctggcatcttggaaagctcattaggatgcagtgcatgctcgacgttgtagtgaagtga

SEQ ID NO: 75094 - DNA, 267 bp, Glycine max
  Peptide Sequence Number=SeqID_191872
atgtcagttttagaattatacatagaaaaggatgttgttggtggttctgcgtttcattctgcaaattctgttagatcatgtgaaaataatttatctaataatgagtcggaaccgccaagaaatgtaagcaatttacatgaggatgaagatgaagataataatgattatcttgtgtctaattcatacgttgaagactctttagatgaagatgatagtgttgatggtatatctgatacagatgatgaagtcgccgacatggttcaacca

SEQ ID NO: 75095 - DNA, 240 bp, Glycine max
  Peptide Sequence Number=SeqID_191873
atgcttggtttcgccagtcagactggcgagatgaccttacgctggttcagccagtcgcatttgcgggatccttggtccattggtttcgccattcgaggttgtgggatggccttcgtccattggttcgcgagatacaaccgatgcagtgcaacatgcatgaggggttcaggtatagggtttgcaggaataatgaagaaaaaattgaacatgtttcagggttttagaaagaataggctttaa

SEQ ID NO: 75096 - DNA, 696 bp, Glycine max
  Peptide Sequence Number=SeqID_191874
atgtttgcacattcgattaaaggctgccgtcccttgggacggacgtgtggggtgctaataccttccccatcacgtcttttccggtttttccgacgttttcctcaaataaacgttggtggcgactccgcgcgtattcctttcgtggaacacgcatcccgtgagtcacgcgtcgccctcccgccgaagggtaggttgcgacaggtctatcctgaaggaactcacttcataatttcatggtttaagaggctggttatctatgatgtctgtgcacgaccccatctagttgaaagtacatctgggagtcgtgatatgttgctaggatttgcatgtagtcatagagaaatggttttgtgttgtctcaaggaagcaataatatatcaagtcaatctttatcatagtggcctacttctaaccatgacacctaaactaactgttaaaagcaagaatctaaaactgcaccataacaagagcaaccttcatctgagaaaaaatctcaagatgaatgtcaccaagcaccaattgtacaagtttccctccacaattctcgagctatcggaattcagatttctagaaaagatccagtccttaataacctatatgattaaacaagtaaataacacaagagaattgttaacccagttcggtgcaacctcacctacatctgggggctaccaagccagggaggaaatccactaa

SEQ ID NO: 75097 - DNA, 492 bp, Glycine max
  Peptide Sequence Number=SeqID_191875
atgattcgtgatcatggacaaaagtcttttcagcaagcacatgcccctatgtatgatacattacaaactaattcaaagaagcctttgtatccagggtgcaagcattccttaaagttgttgtcagcggtgttacaacttgttaatgtgaaggccagatatgggtggagtgacaaaagctttagttcactacttcaagtagtgcatgatatgcttctagaggaaaacacgtcaccaaaaagttactatcaggccaagaagatattgtgtccaataggtatggagtatcagaagattcatgcttaccttaatgattgcatactgtacagacatgagtttcaagacatgcacaaatgccctaggtgtggggtatcacggtacaaactgagtgtagtagtgacgcaaactcaaagaaaagccccccagcaaaggtgttttggtatcttcccatcattccaaggtttaagcttctatttgctaatggagacaacgtaa

SEQ ID NO: 75098 - DNA, 261 bp, Glycine max
  Peptide Sequence Number=SeqID_191876
atggaagctctcgagactttaaatggtcataacttttcctacggatgtccaattcgggcgcataatatgtcgagatgctcgaaattgaacaacggaagttctcgagaaattcaaatggttataacttttcacacggaggcgtatcacatatacagacacgcgaggttgaacaacggaagctctcgagaaattcaaatggtcataacttttcacacggatgtccgattcaggcgcataataggtcaagatgctcgacattga

SEQ ID NO: 75099 - DNA, 297 bp, Glycine max
  Peptide Sequence Number=SeqID_191877
atggactgccccctatggatgctctggagcatggagtgcaacatctgtggtgtaaaagtaaaatctaatggtcctggagagaatggagctggaaatggtatctgtgtgggtgtaggaggaataactagagtcagaatgggaggtaatggagttgtggacgaagaaggagctggtgtctctggtgctgaagtggaaggggcctcagatctcttacccttggccttcctgggtcctttgaaagttattgttggatcatcaagattccaacagttcttcttaatatatgcaaaattaatg

SEQ ID NO: 75100 - DNA, 381 bp, Glycine max
  Peptide Sequence Number=SeqID_191878
atgcagagccttcagggcttgggcttgccctccattatgagcatagaggagtttgaggctcaggtggcctggcgaggagaccagccctcttcttctaggaggggtggggcctctgcagcccaggagcctgatattgaggagccaccagcaccaacaccagcaccagcagaggaggaaactactccagatcagactccacagccatctccagcccctgcacatatacctgaggatgttgcaccagttgcagagcctgagcagcttatacaggattcatcaacaactccaacactggatcttaatgaagaccagccacaggaggagcaggattttaaatttttgcattctaaacactttagtttattttcagttattttatga

SEQ ID NO: 75101 - DNA, 714 bp, Glycine max
  Peptide Sequence Number=SeqID_191879
atgggggcacttcagatcttgaatgtggcctctttccaacttcatttgaatgattatgctgctattcaagtgtttcgagccctttgtttatatatgcatgtgaaggctactcctgtggacactcttccccctccagctaaggaagctaaacaaaaagacaagggcaaacataagaggaagcatcgtgaccagaggcatggttcggctagaccttctagtcatgggggctcaaagaagataaagcaacaaatgttggagtttccaagcactcaccccttaaccaacatctcaatcttcacaaatggtggtttcttcaccaacgaatttgtctcgagtcgcttggccgatctgatccatatctcagatcatagtcatcatgttctaaataagagtgaagatgccaccaacttggaaaactttgggcaaacgacagccatcacccaacatcttcaaggctccttgagggttgttgcccttgagttagagacaaaacggttagaggttcgtgccatgaaagctgaagactctgccaagttaaatgcagaggaggtggaaaggctgaaaactttgcttgctttgataaagaaggagagggatgttgaaaagcaggagaaggctcggattgagaaaaaggcatatgatgatgaggacaaggatgacggtggtgatggcggcaaggtgcaaaagaatgttaagcattacaaggattcttag

SEQ ID NO: 75102 - DNA, 1296 bp, Glycine max
  Peptide Sequence Number=SeqID_191880
atggctgtttccaagaaaccccggcttaggcttagagatgtggctctgtgccgtctgttatctgtggtgtttgttactttatgtggggttttgcttctgatatttctccttgcatcaaattcaacaccaattgggactcatgatatgatagacaatgctgatgcataccatcatgacatgaagtttgaaaagttgcatgatctcccacagcagaatgacttatcacttagattggaaaggctaaatgggttgccacctaggaacttggatttgtatccaactctcgcgaaggatcgtattgttgtagttttgtatgttcacaaccggcctcagtatctgaaagtggttgttgagagcctttcgcaggtggtggggattagtgagaccttgctaattgttagtcatgatgggtacattgaggagatgaacaagatcattgatggtatcaagttttgccaagttaaacagatctatgctacttattcgccccatctgttttctgatagttttcccggggtctcagctaatgactgcaaggagaaagatgatgctggagaaaaacattgtgagggaaatcctgatcagtatggaaaccaccgcttgccaaagattgtatcactgaagcatcattggtggtggatgatgaacacggtatggaatgggttgagagagacaagggatcattctggtcatattcttttcattgaagaagaccactttatatttcccaatgcgtatcgcaatctacaggttctaatttcactgaagcctaaaaagtgtcctgattgttatgctgctaatttagcaccttctgatgtgaactcaagaggcgaaggttgggcaactttgattgctgagagaatggggaatgttggttactctttcaatcgaactgtttggaagaaaatacacaataaggcgagagagttttgtttctttgatgactataattgggatatcacaatgtgggcaactgtttatccttcatttggcagtcccgtttacacgttacgaggtcctaggaccagcgccgttcattttgggagatgtggtttgcatcaaggtcaggaggagaataaggcttgcattgataatggcatggtgaacattaatgttgaagagcctgatacagtttctaacattgaattaaattgggaagttcacacctataagaatcagcctggttataaagcagggtttaaaggttggggaggttggggggataatagagatcgtctcttatgcttgagttttgccaaaatgtaccactccactggcacagcgtctccattgtaa

SEQ ID NO: 75103 - DNA, 468 bp, Glycine max
  Peptide Sequence Number=SeqID_191881
atgaggagtctcaggaacattaaagaagcacaaaggttggttggaagaatagcctccttgtccagattcttgccaaggatcgtcgagaaggtcaaactgatcataaatctcctaaaaaagaccaagaattttcaatggaatgaggaatgcaaagaagcctttcggcaattggagattacacttgcaacccccaatgggttatccaaccagcatggtaatggagctggaataatcttagaagggttgaacaatgctacatgcaaccagatcggctatgaggcgctactagttggcctcaggttagctaaagaagtaggagcccgaaaagtaacacttatcagccaagacaccaacgaccggatcaatgagttagcaaggctggcaacctcaccccagcccagaaaattaataactttcatccagcaaaccctacctgttcctagaatattggctaaagaatacttatag

SEQ ID NO: 75104 - DNA, 234 bp, Glycine max
  Peptide Sequence Number=SeqID_191882
atggatcaaaaatggaggggggaaagaaggggcgtggaattggggtgcagaagagatcgaaaaggtgaagacgtggaagagcaaaagaagggttgttttggaatcagacgcattgacatgatgagtgaggcgttggaaaaaccaaagatttgtgtccgtcggatcgggtcggatcgggtcgggtatggtggctgttggatgctattagaagcaaagtcagtcaagggaagatga

SEQ ID NO: 75105 - DNA, 801 bp, Glycine max
  Peptide Sequence Number=SeqID_191883
atggaagccaccctctcttcccattggaagaaccttaccattaagaagtatgatgacaccactgaccctgatgagcaccttgatgtttatatcacccaagtcagcctggcagccaaatacatgcaaatggaggaattggttgagtataggaaccaagtacgagctgaggctacttcaaccaagaaggaagccgacaaaccaaactttggtaagacgagggacgaagggatcaaccaccttgagaacctcgttatgctcattacacccccctcaatgactgagatcgggcccccaaaattgaaaggtgtaggagtcgaagttgatccaaagaaaaggaggaagactctcttgaccaaccaagacatagagggccagaaccaagggatgcatatggttgtacacgaagttcgaccattacgggctgtaacagaaacacttgaaaagtcgatacagattgtagccggggccgaagactcacaagaattagatctagatccgagaaccaatgaggataacagggttaggccaattgaggaaacatgcacctttcagatagacatcaaggaagaacagggtacatcctttgtggtacaagtagatggtacatctacttgggttgctgtaactaagaacaagagagggtacatctcttgtggatcagttcaagtggagggtacatccacttggttgttcaaagagaacaagggagggtacatcccttgtggatctttgcttgtaaaggtttttacaaggttgaaaagaaatctcaaggaccgcaggttgcttggggactggatgtag

SEQ ID NO: 75106 - DNA, 453 bp, Glycine max
  Peptide Sequence Number=SeqID_191884
atggcaacacaagtgataagagttgggtattactggccaaacttgaagacaaactgcacaaattttgtaaaaaaatgcaatccatgtcaaaaacacggaaacttgatccatcggccgaccgaagagttacatccctttacttcttcgtggccctttgctatttggggaatgagtatcctcagacctttccccatggcccctgggcaaagaaaatctttactactagctgttgactacttcaccaagtgggtagaggccgaacctttggcaacaattactgctcagaatgttcaaaagaacaaccaaaggaagataggccaaagagctctcagaggtcttatcgatgcaattgcaatccattactcaagagacccccttttggttagtgtatggaacaaatgctatggtcccaatggaagtgggagagatatccctcaaggaaaaatttcgtag

SEQ ID NO: 75107 - DNA, 177 bp, Glycine max
  Peptide Sequence Number=SeqID_191885
atgccacgtcaaactgtctttgctattgtcatagaagagctaccattcaaacaacaaggacggcaaggaataatgggagactgttttatgcttgtccattaccacaacaagatgcagatcgatgtaatttcttttcgtgggttgatgaagacattgatgttggtgcaactgaaatag

SEQ ID NO: 75108 - DNA, 351 bp, Glycine max
  Peptide Sequence Number=SeqID_191886
atgaaaaatgttgttgttaatgaacaagatgaacctgcacctgcacttgctgttgttaatcagcatgttgttcatgaagaaatcaacttatctcaacccccaagttcacaggacatagacttagacctcttcttgagaccacctggtgttgcaggacagccaccaagttcacaacaaccaatgcctaatgttccattcaacatggctggatcttcttcaaggtatagaccacctccaatttggccaaactacaatatttcgattcttaatccatcaacatcccaacaacaaccatccatgtgcttcattcccacgccaagatttcctcatcaaggaccaataaacaattga

SEQ ID NO: 75109 - DNA, 363 bp, Glycine max
  Peptide Sequence Number=SeqID_191887
atggaaggggggtacccatggtgcatgcatggtatgcatgcatgtatggaaatggaaggagtgtgttttgtcaatggtactggcgaaacacactggacacgtgaacttgatacagttacagctgtgttgctggtggtgctgacgaaacccctcagtactgctgttggacttggcgaaataggatgtttcgctagtgccaatgacaaaacacccttaaaaacagaccccccaagaatttctttacaaacagactcatttaggaaaaaattttgtgctgtgaaactcactattctcaccctccattttcttggacacagaatacggaatgggaaagcatgcttcaacagagaaaaaatgagatag

SEQ ID NO: 75110 - DNA, 324 bp, Glycine max
  Peptide Sequence Number=SeqID_191888
atgtcaaactcagaaattggagtaaaaattgtgtgttctcctttggagaattctcatttaaataggaaacatagttctgatgctatgagaatcgagcctgcgtgtttggacaacaatggtcaggtgttttggaagttgaaaagttataatagtgaatgtgctgttctgttgcaagatatcaaaattaaggatgaaactgctactgcacctgctgaaaaatggtttgtttatggtcctgaaaagaaggatgaggttgataagtacatttcctcgagggctaaaagacttaaaggtcacaaggttgcttacatgctttcgcagtga

SEQ ID NO: 75111 - DNA, 372 bp, Glycine max
  Peptide Sequence Number=SeqID_191889
atgatagtactcactaacaccactatagttaatgccacgaatttcgcggtgcttttaatgcaaagaaatttaagtgaagagagaatgatgatgaagtctgctatgtgtgcattggtgcttgtggcactggttgtggttgaagtggggcccatggctgaggctgcggtgacttgcaacccaacacagttgactccttgtcttccggcaattaattcaggttctgcaccttcgagtgcttgttgccagaagctgaaggagcaaaagccatgcttctgtggctacctcaaaaaccctagcttgaagcagtatgttaactctcctaatgccaaaaaaaccgttagttcttgtggtattgcctatccaacttgttaa

SEQ ID NO: 75112 - DNA, 1029 bp, Glycine max
  Peptide Sequence Number=SeqID_191890
atggcttccctgcttattcacctccctcctatccctattcttcaacactttatcctcctcctcatactgattcagacacctccatatttaagctcctacaatgatgataggggttgtactaatcagctgataagttgtgggaatataaaaaacattggttttccattctggggagaaaaacgaccaagagattgtggccaccctcggatgcaactcagctgcgaacaggagatcacctacataaacattaatgatttcaggtacaaggttttggaggtaaacccagataaccatactttgagaatcactagagaggactacttggaaggcatatgccaaccaaagtttgtcaccaccagccttgacactgagctctatgtccatgactcagcctataagaatcttacccttttctattgtgctaatgatttgccttccaccactggatttctgcctagttgtgtcccaaatggcaattatgtttatcctcgatttgagcctctgcctcctcctaattattatgcctcttgcaaaacagtggttgttccagttcctccgtccttagttgatactagtgatgctgacaaaatacacaatgcaatcatagacggatttgtggtgagatggatagtgggcattggagaatgtgagaagtgtatgatatcagcaggtagagtatgcggcggtattgaatggtatccaaatcaaacatgttactgcagagatggaccttgttctaatttcttaccagatgacaaagcaccgcagtccccacctacagttattgtattaatatgtgggagactggatcatgtctcccatcgtggaaataactattgtgttgttggatcatattttaaggcaaattctaccaatatcaattatcccttcccttcccaaacccttatcttccttgaccgtatccgctacagcaaaaacaacaccaacatcaaggacaactgcaaaacaacaaaatcaactaccaagcgtgagaacgagaacgtcaaggaggccatgcaaaagtcgtga

SEQ ID NO: 75113 - DNA, 1053 bp, Glycine max
  Peptide Sequence Number=SeqID_191891
gtgcatcacatagatgatcatgctagatcaaaaactggactggaatctcttgatgagtatcttggcaaactaaatcgtggagcaaaccaagaacctcatgtgccatcgtatgtcgagaatcgtagtgaagaaaatttagcaccaaaacgatctcttaccaaagacattgaaagatcaaactttaggaaacgaaatgcttatgtggatataggaagactaaaaggtgtgcatggtccaaggtctgctatagattcacagcagcatgttgaaacctccagtctctacctaattggcatattggcttctgtaaacattgcagtgtttctatttgaaatagcaagtcctataaggaactctgatttagagctgttttctattccactactatatggagcaaagataaatcatttgatcatggttggagaatggtggaggcttgtaacaccaatgtttctgcatgcaggaatatttcacatggctgtcagttgttgggcccttttaacatttgggcctcaagtttgcaaaggctatggttcatttacatttttcttgatctacatactgggtggagttgcttgcaacttcataagttttctacatacaccagatcccactgttggtggaactggacctgtatttgcaataattggtgcttggctcatgtatcaaattcaaaacaaagacgttattgcaagtgatgcttcagagaacctgttccacaaggcagttattatgacagctcttattttcatattaagccactttggtccaattgacgaatggtcacactttggagcagccttctcaggcatggcatatggctttttaactagtccaatacttcagttgaatgattcatcatcaggaactggtcaagaaggacttaaacttgttagaaaatatggtgattcttgcaaatcagtattcatattcaccatattcatcattgttttaagctcattccttttcttcatggagcccccaccaaatgcactggcatcggtcaatgcagcagctgttgatgccttggagtatatattgatatttggctga

SEQ ID NO: 75114 - DNA, 1875 bp, Glycine max
  Peptide Sequence Number=SeqID_191892
atggctattacagcaatctccaactcgagtcagaatatgaacgaggttgctgccggaggcgtgaaaccgaagcgctccaattctcgcggagttcgaatagtgggaagcagaatctacgattctgcaaatgggaaaacttgtcaccaggtgcttttcttttttgagattttgagaatacccgtttctttttttcttgtgtttttgcgttgtggggtgtgctggtttgtggagagtgctaaatctgaatgtggggtggaatctggatgtgggaattgtgtgaaaaagggaaactgtggtggatggggttattttgaggtttgtttggatgataacatttttgtttgcttggttttcacgttgaagtgtcggcaaaaaaccagggattttgctgtttcttgtatggggagaaggcagaaaaggtggagcagttgggtaattggatgtgtccaaaatgtagaaacttttgcaactgcagtttttgccgccaaggcatctggtttcaagtcagtgtctgaaatgcttgtttcaaaaactgctgaatctaatgatttggaatcgaacaaggtgaatagggtttttccttcaaaggaagctactgaggtaaagaagcaaaaacgtgttaataaatcaagttccgacaaggttccggtgagcaaagctgtttcacctatgaagcaaattgcatcagataaggagcttgtagtacttctctcaggagaaattggaaaggaaaattcttcagatggaaaacttgaccctgtgatcagtcagaaggcatcaaccaaaaaatctaagaaaacaaagcgtgaagaattaaaggaaatatctaatgagaacaatgttgagagtgcaggcaaaaagaagagcctgaaaaggcctaaaatttgcaaagttccaagtgaggaagcaaaaggaaaagcaaatgatgaaactaaagtttgcaacggagtctctaaaaaggaaacaaaagtagatagaaaacatgatactgctcatatattgatggacagtccagaggctcaggctgcaaatgatcttttactgtttggaaaatatgccaaaggcaaccctttctctgaggtgcaaccacaaatgcataaaaatcctgacactatttttgaagatccagcaaatgatcccattgtccctgtgactgtggctccaaaacattatttattcaattctaaacatccagatatgaaacatatgcatggtgaaaattggaacaacactgtacttgtagatggtaatgctggtgccaagttccaagtaggaatagcaacgttcccaagtattggtatgaatttagtggtggaaaaaattgaagaggaaattcctttgccccctggaactgagttaacagaaatattggacactgagctcccacctgaagatgttggaaatgcgttgcagcttttagagttttgcagagtgtttggaaaggctcttgatctcaagaagggagaagctgaagccatcttaagagaattagtgcgtaaacaaaatttgcgtcgaggacaaaacactttagtggttcagtttcaaattagagtgttgaccttgatactaactgattcaggaaatgagtctccatccttgactactagcaatggaaataattcatggttgaaaccattggaggatttaattgctggatctgatcatatattaaaagattttcctttggattggcttcaagaaggcgttggtggatattacaatttggatttatctaaaaagctcacactgctgaattttctttgtgatgaagctttaattactgacaaactgaggagttgtattgaagatcaaaattcaaggcatgcagaagaagtgaaggaagcaaaaaacaagattgctgcagctaaggaaaag

SEQ ID NO: 75115 - DNA, 114 bp, Glycine max
  Peptide Sequence Number=SeqID_191893
atgaatcttatgtgtatgcaatgtatgcttggtgtgcctatgacagggtttgagcaactgggcaccttaagggagaaaatcttggagcatggagttgcttgcataagattttag

SEQ ID NO: 75116 - DNA, 177 bp, Glycine max
  Peptide Sequence Number=SeqID_191894
atgaagttggagtttgaaaatgagaataggttgttaccaaaattcaccattgaaccgttgattcatgagaacttgtgccacccttggaagaaatgtctattggagatagacaaggagaaagtcattaacgtcattatctcacttttcgttcttggtctccagagtttgtggcggtaa

SEQ ID NO: 75117 - DNA, 1989 bp, Glycine max
  Peptide Sequence Number=SeqID_191895
atggatggtgtaaagcttggtagcaaaagagttggatcagttaatgctgctgttaacttctatgatgataagaagccctcttcaagaacaaaggaactccacagagcaagaagggatattggaaggtacaaggagagcaaatggactgcagaatctgcaaaagctcaagcagaatctgagctttcgaatgcgaagaagacagcaaaccatctttcttctatgcttgaggagtcaaattacaaggcaaaaacacaaatgagagatgtagaaagactagagaagtgggggaagggccaacatgggacaattgttgttgcaaagaggaatgaaaattttgagtatgcacaagtcatgagagagttggaatatctcaaaaaggaactgttcaagcttaagcttgatgtggcttatgtgatggaacagaaatcgcgggcagagaaggaaattgaagcatcaaactcgaagatgctatcatgtttaacaactgcagaagaacttagaagggagattgaggaggccaacgaggagcaagtacttgctgaactggccaggattgaggcttcgaaagaactgacagatattgagacccagagaaaacaggaagcaaatgaattttcattcaaattggaaagcacgaggagaaagttgaaggaggccattgaagagattgatgagtcaaaggagcttgaaatgaaattggctgtgacaatatcagatgttgatttcttgcagaatgagttaaagtcagttaaggaaatggataaaagggttcaaggagatgggagtgcaaagcaattggaaggaagattcaaaaaaggggaggaatcagaagactctatagtgttacaaactataacagaagaattggaggcagctaggaaagaattagctttggttagagaagaaggtttccagtttatggcctctttggatgtcataagaaatgagttgaagcatgtcactgctgagacagataggttgaagaagaaggaagggaaagtagactcaacagttcaaaatctcaatttcaagattttgagagcaaagtctaaattagaagctgtgtctgctgctgaggaaaaggccagatccatagtcatgagtctgtctcatactcttgaaaagctgaagacagaaacagaagaagcaaaaaaggaaaatgaggatgtaagccaggaggttgcagccaccaaggaagaaattcaaaaagttgagttggatatagacacgaccgaggaaagattgcaaggcgtcatgcaagagctagaagtagccaaagcatctgaagctctagccttagagaagctgaaaactcttactgagaggaccatgagagaaagagctttaacagcacagcatagttccatgatcactatctcaaaatttgagtatgagtatctaacaaatcatgcagcctcagcagaagaaattgctgataaaaaagtagcagcagctgaggcatggattgaagctctcaaggccagcgagaaggaaatactgatggaaacaaaaatagctcaaagagaactcaaagaatcaaaattggagcaagagctggaggtttacaccaaagagaagatgctttcaagaagagttagtagtagtgaggagcttgacaattggccaagaaaacgcgagaagacttcatccaagaacttccagagagccttgtctagaaagagcatcaaacttaatggcactataactcctgcaaggggagcaaagtttcagaagactgcttcacctgcagctcggcatatcagtccttttactattaagaagagaaagaagaatagcacaggaggttccttgtcctcggattcaaggggttcttcatcctatgttcttaacaacatccaactagctagtcgtaagaagttaataccatatgacccatcatctcaatgttttgaagacaaaaagcagttccattgttcagcttggaatgctaaaaagtataggattttcttacttttacatcaaaagtga

SEQ ID NO: 75118 - DNA, 279 bp, Glycine max
  Peptide Sequence Number=SeqID_191896
atggaaggatgtgacataaagactaaagctgaacccaagaaagcaattccgccagcattctcaacagaatatctatattccagcgctctctttcacccaagacacggagagttgactcaacggatcgttcaaccccagaaagaggtggacaatgctgcagaatggtgcaagaatttccacttagaaaaagaaatatttgtcaagaatgaaattctcaatcacaagggagcagtgacagtacaaagacaaacaaataccagggcagagtttacagtatga

SEQ ID NO: 75119 - DNA, 309 bp, Glycine max
  Peptide Sequence Number=SeqID_191897
atggctgctattgaaactgtgtatccagttatcttaaagcttatagcaagaaaggatttcgtggatgttctgtttagcttcttaacattgtctttaggaaccattgcaagacttgtggctaaagagaaatcaaatatgcagccaattgaagttcgatcactgagctcactctatcgaagtgtgaaaaatttggacaaagagtatctctgcacagttatgtgcaaagaaatgctactgcaacccaggaactcattggaagcttattgcaagaagctgaggctaaacattgacaacacaccacccacataa

SEQ ID NO: 75120 - DNA, 504 bp, Glycine max
  Peptide Sequence Number=SeqID_191898
atgtcaatcattagggacaaaaatggggagaaaaagtgggaaaaagttgaagttaagctggaggaccatatcaaagttcctacatttcccaatggcaagtcatccaacttcttatatgatgaataccttgatgagtacctgtccacaatagctgtggaacatttgccacataataggccactatgggaacttcacattattaaatacccaacaaacaatgctaagggtaccttggtgttcaaactccaccatgcccttggggatggcttctctctcatgggtgcccttctttcatgcatgcaaagagctgacaacacctctcttcccttcacactcccatcaagcctaagacccaaagcatcaatttccaacaccaaaggggttttcaagaaattgccctccattttcttccaaaccatatccgaatttggatggagtttcttgaaaagtaacatgattgaagatgatcaaacaccaataaggtcttgtgcggaagtcgtctag

SEQ ID NO: 75121 - DNA, 333 bp, Glycine max
  Peptide Sequence Number=SeqID_191899
atggaaaccaaagctgatgctgctgactctttctggacctggaatgccaacaacgaccaaaaacaattctcggttaccaagttcctgggaaacaacaaaccccccaaacctcaaacatcagtgttgggtcctggcttcggagctggcatcggttgcggcgccggaataggtttaggtttggttggtggcttcggctacggaggctggcccttcaaccacatgcacttcgtttttggtctcggaattggttgtggtgtcggtgttggcttcggcttcggccaaggcattggatacgattttaatttccggaccctttctgcattgggtttttga

SEQ ID NO: 75122 - DNA, 1542 bp, Glycine max
  Peptide Sequence Number=SeqID_191900
atggctgatattgtaagtaagcatcaggttaccttgaagctttgggtaaacaaagaacgcaacaaagttttctttgccaaggcagaaaaggacttcgtggacgttctgattagcttcttaacattgccgttgggcaccattgtaagacttgcgaacaaggagtctaatatggatctagttgaatttggctcactgagctcactatataaaagtgtggaaaatcttgataatgagtgtctatgcacagatacgtgcaaagaaatgctgctgcgaccgaggaactcattggaagcttactgcaggaatatgaagctaaacattgacgacacagaacccaccaagtacttggtatgtaacgacttggtcaattgtcgacactactacccggtcttgttgagcaccttcagaaataaaaggtgcagttgtgggaacacattgggaaaaccgatttctcctgaaagtcaatgctcaaatgtttttgatggttttgtcaagagtaatgctacttttatgatcacggacgatctgaaagttttgtcagactcattgaatactatcctttctgtacttatgagctctggattagagaacgcgtctttgctgactgaaatgacagtgtctataacgaagacccaggtaatacatctgctgaagagttgtttgctctcgaaaacaactttgacagatacgttcttggtagagaaaccgtatcttgaaagatttaataagataaaacttgctcccttagatttaaatacaaatggtagtgggaaaatcaatataaagataatgcagagaaaatcaaatggcaaaatactctttgcccaaggaaaagaagattttgcaaactttttatttagtttcctcacttttcctttgggagcagtggtgcagttgatggaatgctgttcttctattggcagtgtggatgcattgtataagagtattgttgatttagacgaagattattggacaacaaaggaaacaaagcacaaagtcgttcatcctgtgatcgctccacaattcaaattaaccaatcagctactcccaatttgtgatgcacccatccccgaatatttttgtttcaccaaagacgtttatgatgaaagagattgtcaaagaaagcttatttcttggtttctaacttctgaacgtacgagaagaaagaggcgcacggaaacatgcgaaggtatgaaattcgttgatcccatatctgagtcaggaaaaggtgagggatttgcgaaagggccgacaatgtacatggcaactgatgatttggttgtgacacctatgtcgtccgatagtttgttatctttgctaaaccgtacgaacattctcgttagggacttggaagagaaagaagttagcattggcgtcaaggagggtataagcatactacaagcatctttgtcctcaacatcagctctaacagccgctttggcaatcattgttttccacatcctggaggtcacagaagcaaaaatcccgtctcaagttccaccccaaatccctgaaatagtaaaatccaatggtatggactag

SEQ ID NO: 75123 - DNA, 219 bp, Glycine max
  Peptide Sequence Number=SeqID_191901
gcacaacaaagcattgatggtgcaaggcgttctcagttagagaagcatgaagaggagtcgaggttatccaaggtgaaaccaatcaatagtcatgacagaggagtacagggtaacagacaaagccaagtaggatacaaagaggtggcagtatctcacgctcaaaagaggaagaaatttagacagaaggctcacctgctagctggtaccaaatcagaacag

SEQ ID NO: 75124 - DNA, 447 bp, Glycine max
  Peptide Sequence Number=SeqID_191902
atggcacatttcttcacatcagagcacaggcattgtaatgtacaggcaagtaacagaagcctaaacaagaaaagaaaacaggaaacacaactgaaattcaaactcgcaccttttaacttctggaaccacatcgttaacaaatgcctgcatttttttatgaaccgtaaggttattaaagacccaacctcttacaatgtcaatatcagaggaatcaaatcagctgatacagcaacagatatcaagaaggcataccacaaggcaactctccgacatcatgcagacaagttgttggctagaagtgaagttggagatgaaggccaactttggaaggaaatttcacaggaggtgtacaaggatgctgataagcttttcaaaatgattggagaagcatatactgtgctttcagatccagcccaaggttatacatatgatttttctactagttaa

SEQ ID NO: 75125 - DNA, 1119 bp, Glycine max
  Peptide Sequence Number=SeqID_191903
atgggatcaaggaatgatgaagacatttatacactatttgaatgtgtatttcctattctaaaggctgagtgggaaacatcaatgacagctggtgatgcctcattggatgagttcaagcctgaagtgttagactgggattgcagtgcattctttaataagcttttgtatgtcaagctgagacatctaaatgtgaagattctcaccttcaacatttgttggatattaaccttttacaaaatgcagcatgatgatgataagtgggtcaacaagataagggatctgtttgtattttttgcttcctctaaattgaagcatacattcctcgaacacctccattacttagcagcacagtgcaaaatatcacctccccgcctcttatctaagtttttcacaaatgaaggtgttactgctgcagttcaggttgaaagtcttcaatgttatgcatttctttgtagcctgtcgcaagataaatggcaaattgaacttttagctgaatttccttctgttcttgttccatttgcgagtgataatcagtctataagggttgctgccatgagctgtattgattcattgcgtacattgtggtgtcatgttgagcattctggcaagaaaaatggtaacaatgcaacgtggatccattttttgggtgatgttttggcattgatggatcaacaaaaaacattcatattgtccgacaagaaatttcttccttcattgtttgcatctgcttttagctcaccctgtccaaacatcttggagcctcgaaacatcttggtacctcaagatatagaaaaaaggaatttatcttcgagtggattgtcaagaaagatagacccttcaattttaaatctcaccatgctggagaatttggatttatcaaataatagcttaaaggatgaagttcccgattttctgtctcaattacaacacttgaagatcctagacaagcttgatgttattaaaggctttgcacctacctctggcactaacagtgacaaagatgatcataatggggagcaattgatggaatatgaatctcaaattgctctaaggagaaggaagaaacttgttcttgatggtgatttggaaagacaaatcaaagatctccatgagaagtag

SEQ ID NO: 75126 - DNA, 222 bp, Glycine max
  Peptide Sequence Number=SeqID_191904
atgcagcaaaatcacagtattatagatgtttgcctcttgcatatcagatcatacacagctgctgcaatcccacctgctataagtcctacagcagttgcagcaatgcctaggccaatgacaccatctacaatgaaagaaaagaagcagtcagtgctttatcctcttgctcttggcaagaaaaaaggagcagagaaaaatgttaaatggaaaatcaagaattga

SEQ ID NO: 75127 - DNA, 261 bp, Glycine max
  Peptide Sequence Number=SeqID_191905
atggcctctcatcagcgggagattcgccacttgagtgaatcccccaccgagggtcaggaggccagacaagaaagattcgcgcgcctcaagacggttcttgactcagtcgacagccggttggatcaagcccgagaaatagatcgggttcgtgacaacgaacgtgctcggctacgggcagaaatggatcacgactgtgatcggtggagggctctcgagagaaagaacgcccaaatgcgattgaaagttaatgaactaaattaa

SEQ ID NO: 75128 - DNA, 516 bp, Glycine max
  Peptide Sequence Number=SeqID_191906
ggaggtgaatgcaagcaaccttgtgctcctataatgaaagtggatattaaagaaggcaaccttgtgctctgcaaacaagtagggttaagggcttggggcttggggcttagggattgggatatgctaggtgcacccagcaatattgttggtgcacccagcaattcattgaaagtctcttccgcaaaagcttcttctcttctctcttccccgacgagcttcttctccgcgaggcttctccggcagcccttggacccatttgcattcgaggtaggtggccttcttcttagctttggttttgttatgcactacattagggtagacccgttaggggttcttccgaaacttctggaagaaggtcttccgaaagattttcggaagaatagttattccggaaccactgaaacgtcttccggaagtactggtctttcgaaaagctcccggaacacctattctggaaagtttccggaagaaatggttgttccggaaacattccggaagaagggttcttccggatga

SEQ ID NO: 75129 - DNA, 159 bp, Glycine max
  Peptide Sequence Number=SeqID_191907
atgccacatagtctcaccatgacgatcatgagctacatgggaaagataagaattgcatttggagtagagaaggacttcatcgacaagcaattattcaagtcgtgtttggagaattctcttgagatgataaaggaagcagcaaaaaagatttcgacataa

SEQ ID NO: 75130 - DNA, 993 bp, Glycine max
  Peptide Sequence Number=SeqID_191908
atgactgcccccacgtactgtctcgtgggggttaggatttgcttgagaaagaaactaatagaggagaaaagaaagaaaagacaagagaaggcaatgttgactgagaatacaccattgcttgaggaccttccatctcccattgaaagacatgtgaagtgggaaatggctcgcacaaagcgatatgggcagatgacatctgaggactcgttacaagagcagacgacacaaggtagttttgttccccatggtcaggacgacatacttaatactgttattgggcgaccgaagcatccaggtcatgttcgtgtagcggggtctagtatgatgatcagtcaatattatggcaattcctctacatcaataacccaacaacaattggctgacataattggcagccttaaggaagagtggaggaatgaaattatcaaaaacctcaaggaagaacatgagttgaaggatgccttaaaaattgagtttttccaaatgggatcacagtactcaccccttattgaggtagatatacatgcattaggtgcacgtgttagcatcaaaggaagcaatgttgaagctgctgagaacccatcaggtgaggaacatgatggtcgtgtcataccgactatgggggttagtgttgaaaaagttttagatggtgacgcccaagtcccgtttccgacatcagaaatacaatatgttagggcgaataatgtctttgaagatgatcccttgcgtcagttgataaaaagcctatatgacatttacgagaagcccgttgagttgatgtgggatgccactaaatttgggattccaaatgtagatgcatccttcttcttaacatattttgatgtaaatgaaataaaagcaggggacaaatgtttgaacttagctatactacaattatggatgatgtttatggatgagtggagctcaagtttgggtcatgtttccttgtatggattccttgagcctcagtcgatacatggtgcaaaggactga

SEQ ID NO: 75131 - DNA, 1217 bp, Glycine max
  Peptide Sequence Number=SeqID_191909
aaccaaggttgtgcctaacagacaccgaaatgattaaggagtttctgtcaaagtacagtaccacatctgggaaatcgtggcagcaacaacaagggaccaaacatttcattgggagaggcttattgatggcaaatggtgaagagtggcgccaccaacgtcacatggttgcccctgcattcatgggagacagacttaagagctatgctgggcacatggtggaatgcacaaaggatatgcttcaatcactacaaaatgcattagaggttggccaatctgaggtggagattggagagtgctttactgaactaactgcagatattatatcaagaactgagtttggcacaagctatcagaagggaaagcaaatattctatctcctcacacagctgcagagtagagttgctcaagcaactcgccatcttttctttcctggaagccgcaagtataacagagagataaagtctatgaagatggaggtggagagactcttgatggagatcatagagagtagaaaagattgtgtggaaatggggaggagcaattcttatgggaatgatttgttgggtatactcttggatgagataaagaaggagggtggtaccttgaatctacaactagttatggatgaatgcaaaacatttttctttgctggacatgaaaccactgcactcttgctcacttggacagctatgttgctagctagcaatccacattggcaagacaaagtccgagctgaagtcaaagaggtcttcaagggggaaattccatcagttgatcaactctctaagctcactctgctacacatggtaattaacgagtcaatgaggctctatcctcctgcaactttgcttcctagaatggctttcaaagacattgagttgggtgaccttcacattcccaaaggcttatcaatttggattccagtgctagccattcatcatagtgaagaactatggggcaaagatgcaaatgagttcaaccctgagaggtttgcttcaaggtcattcatgcctggccgtttcataccatttgcttctggccctagaaattgtgttggccaaacatttgctattatggaagctaagattatattagccatgttgatctcaaggtttagcttcaccatttcggagaattataggcatgcaccagtggttgtcctcacaattaagcccaaatatggtgttcaagtttgcttgaagcctttagatccatga

SEQ ID NO: 75132 - DNA, 282 bp, Glycine max
  Peptide Sequence Number=SeqID_191910
atggctatgttcgatccggagatagtcatggagttttatgctaacacctggcctatagaagaaggagtaacagacatgcgctcctgggtgaggggccagtggattccctttgatgagcatgtcattaatcagtttctggggcatccattggttttggaagaaggccagcattgcgagttctcccagaggaggagtcagggctccaacttcgatgaggaggccatcagtcagttggcatgcgttccggggcaagactttgcctggagcgtagcatggagacag

SEQ ID NO: 75133 - DNA, 1342 bp, Glycine max
  Peptide Sequence Number=SeqID_191911
gttgatacaagagaagaatctaaagcagccatggagaacaatgagcctccaaggcgtcttgagggaaaatatgctgcaatggtagtttgctggcttcttggcaacggatgccttttcgcgtggaacagtatgctgactatagaagattactatgttcacttgtttccgaaataccacccctcaagggtgcttactcttgtatatcagccatttgcagttggaacactagcaatactggcttacaaagaggacaggatcaatacaaggataagaaacctatttggatatacccttttcttcataagcactttgtcgatcttaattggtaaggctgcgtacaacatccctcccccataccttcgcatagcgaagagcctctgggcaatgggtggtgcatttggaatagcagatgctcatacgcaaggtggaatggtgggagacctgtcctacatgcttccagaattcattcagtctttccttgctggtttggctgcatcaggtgtactaacgtctgctttgaggttaattacaaaagcagcatttgagaaaactaagaacggtcttcgcaaaggagccattatgttctttgccatatcaacattctttgagcttctttgtgttcttctctattcgtttgtgttccctaaattagcaattgtgaagtactaccgctcaaaagcagcatctgaaggatccaaaactgtttcagctgaccttgctgcaggtggcatccagatcccatctggaggagccaatcaatatgaaaaagaaatagatcgcaaaggaaataagaaactgttgttggaaaacattgattatgcacttgatttgttcctaatatatgcacttacactttcaattttccctggattcttatcagaagatactggatcacacagtttgggcacctggtatgcacttgttttaattgcaatgtacaatgtgtgtgatctgattggaagatacattccactcttgaaattcctgaaggtggagtcccggaaaaagctcacaacagcaattgttagtcgcttgttatttgtgccagcattttattttactgcaaagtatggcacacagggctggatgataatgttgacttgttttttggggttatccaatggttacttcactgtttgtgttctcacttcagcacccaaaggttataagggaccagaacaaaatgccttgggaaatttgttggtgttgtttcttcttggaggaatctttgcagggggtgttttgcaagtgccaatgacgaaacatcctatttcgccaggactagcaacgacactgaggagtttcgccagcaccactagtgacacagctgtagttgtgtcag

SEQ ID NO: 75134 - DNA, 867 bp, Glycine max
  Peptide Sequence Number=SeqID_191912
atgcgaatgagttgtaacggatgtcgtgttttgcgcaaagggtgtagcgaagattgtagcataagaccgtgtttgcaatggatcaagaacccggagtcgcaagctaatgccactgtgtttcttgctaagttctatggccgtgctggcctcatgaacctcatcaacgctggtcctgaaaaccttcgtcctgctatttttcgatccttgttatacgaggcatgcggtcgaattgttaacccaatttacgggtcagtgggtttgttatggtccgggagctggcagctctgtcaagccgctgtggaagccgttttgaaaggtgagccgatcacgccgataacatccgaagccgcggctaatgggcgggccccacctctcaaggcctacgacatacgccacgtgtcaaaagaccagaactcggcaaatgaaactccaaagaccaagacccggtcccggttcaagcgaaccagcggcacgcttattaaaccgaaggccagcaaaggaaccgggttcgttccggttgagccggagatggcgaaccggactgcgagtcatgagtcggggctgagccacttgtcggaagccacggcgatggtggagggggaaagcaaagagagcgaaagcgtggtgtcgatggatacctcaaacctaattcacgaagaaccggagtgggttgcgaagacgagtgatggaaccggtgagagcggcaacgaaattggtttggaattaacgctcgggttcgaaccggtttcacgtttgcatcacgtggttccgatgaagaagagaaagataattgagttgaagagttgtggtgactcggctgagaaagactcgtgtaagatggagctggggcttgagtacccggcttga

SEQ ID NO: 75135 - DNA, 931 bp, Glycine max
  Peptide Sequence Number=SeqID_191913
atggcgcgtggccgctctcgaactgaagcgaatcaacggccagcggcatgttctcctggtcgggactacacttggactcgtgagggtgcgcactgtacatcatcgcacgcagcaccgccgaaacggtggggcaccgaggcatttagtgcaaccagcgtaagaggagttacgacaattattctccaggttgcgaaccgcggcggttggagtggcgtttctgtgagaaagcgagacgttaaacgcagcgttgcaagtcagcgacgtgatttggtggagcctgatgccgcagaagcagagaatggcgtcgcacgtggcgttggactgagggattcgtcgccggaggatggaggcggggcggcggagacgtcgagggcggtgcgggcgtgggcggcgaagagccaggcggcgaggacggggcagcagcggctccggtcgaggtctttgccgcaggcgtccttgactccgccgaatagctcgtcggagaggtcgaggcggcaggtgagggcctgggtctggacggggaaggcagggaccgtgttggagcccggttcgagtggctggttggggtcgcttaccggttcggagagtaaaccggcccgagaaaaaggtagtagaaataagagtagtactagtactagtgacgttgaaaaaaaaggggtttgggtttgggtttggttgaaaatgattatagcaagagagaagaaaggtgaagagattcatgggacattggtagtattatatggtggtatttggtttgagattcgtagaggtttggattttctggcgtttgctttggaccctgccgctgctgctggtgtttctctcactgctttgtgctctttgacaaactggattagtttaagggctatttataataataataccacagacacagtcaataaagctttgcagataattgtgactacttcaa

SEQ ID NO: 75136 - DNA, 153 bp, Glycine max
  Peptide Sequence Number=SeqID_191914
atggagcatgcacaggctaggactcgtgtcgccactctactttctcggggtgagacagtgagcgacggtgaggatgtcttggcaatgaccactacggggttgttgcgggaaacacaaattgatggtttgggtaaaggcatcacgactccatga

SEQ ID NO: 75137 - DNA, 504 bp, Glycine max
  Peptide Sequence Number=SeqID_191915
atgtgtaccgtacggcccacgaaactcgacacatactccggtcatgaaaccccacgtggtgatccccaactgccactcatgaactcatccatgatgcatagaggagcattaccaacgtggcttcgaacattgtgtaactccctcaacacctatatagacccagaggggagatcgtcatcaaaagatgtgagctcaaaatgtggcgagggtggcacactaaccaaagctgttagcgagtggaaagatggttgtgagcatgtcactttggaagtcgtcggcgcattcgctctagtgacaaaactcataccatgctttggttgtgttgtgcgagaaggagcaagtggtgtgagtcgggcatgtgacgagtatgacacattgactgaacctgtattagaggttgaccacatcttcatatccttaccaattgagagttctcgtctaagctttcggtgcattctgagcctcaggtttgatgatcttgggaaatatcgccctactccttaa

SEQ ID NO: 75138 - DNA, 243 bp, Glycine max
  Peptide Sequence Number=SeqID_191916
atgtcattggaaagcaatgttaaggcagctcaagaagatattcaaggaccatctgctcaactagatattgaaaaagatatccaaccattttctcagccaactaaggggccatccacctcatcctcgctactaatattgcagcatggtctaaatctctcaagaagttgggtagtgcaattttcaagatggatgagtcatgcacttaagcatagcatgttcttaaatgttgttagtattaattag

SEQ ID NO: 75139 - DNA, 687 bp, Glycine max
  Peptide Sequence Number=SeqID_191917
atgagtttttgtgcaaaatggatacactggattgctggatgcctaaaatcagcatcggtatcgatcttggttaatggaagcccttcatccgagcttataccccaaagagggctcaggcagggagatccactatcacccatgctttttaacattgtagccgaaggtcttaatggtttaatgaccaatgctttagagaaaagggtccctaaaaaggtggagaacaagatagtgcgactacagagaaaattcttatgggggagcgcatctgagcaaaacaaaattgcttggatcagatgggaaaaggtgtgcttgccaaaagtagatggaggattgggggttaaagacatacggtctttcagttcaactttgttgggcaaatggaaatggaagttgtttcaaaatcagggggaattgtgggctagggtaattgaatcaaagtatggtggttggaggagtttaaacgaagcaccgagagctaataaagagtctatttggtggaaggacttgaagaatgtatctcaacatccacaacaggggcagctgttgaatgctccgatatcatggaaggtgggacgcggggataaattcaaattttgggaggataattggacagggggagacaattgtttattagagaaatatcaaaggttatacaatatatcggttcagcaaaaccaaataatttag

SEQ ID NO: 75140 - DNA, 828 bp, Glycine max
  Peptide Sequence Number=SeqID_191918
atggccaaaaaacataaggaattttccgtaggaattgaccttgctgctaagaggttaattggtaggaaatacagtgatcctgttgttcaaaaagacaaaaagttgtggccattcaacgttgttgttggtgtcaatgacaaacctatgattgtggttaagtataagggtgagaaaaaacgcctttgtgctgaggaagtatcatctatgatcctcgttaaaatgcgggaggttgcagaggcatatttgaaatcccatgtgaagaatgctgttgtcactgttcctgcctattttaactactctcagcgaaaacccaccaaagatgctggtgctattgctggccttaatttcatgcgaataatcaatgaaaccatagctactgctatagcatatggccttgaaaagagaactaattgtgtcgaaaagcgaaacattttcatattttatcttggtggtggaacttttgatgtgtctctccttaccattaaggacaaagacttcaaagttaaggccactgctggagacactcatcttggaggagaagactttgacaacagaatggtgaactacatggtacatgaattcaagaggaagaataaagtggacattagtggcaacccaaaagcccggaggaggttgagaactgcatgcgagagggcaaaaaggagagatgtgcatgatgttgtccttgttggtgggtcttctaggattcccaaagtgcaacatttattgcagaatttcttcgagggaaagcatctatgcaagagcatcaaccttgatgaggcagatgcttatggtgaagctgtgcaggctattttgttgggggagtaa

SEQ ID NO: 75141 - DNA, 1221 bp, Glycine max
  Peptide Sequence Number=SeqID_191919
atgtctctctgtgcttcactctcctccacagcttcacacctcacttcccttgcctccgtctcttcttccacctctccactttcccgcaaattttctctcactttccgggaaaaaaacagaaccccaattgcaccacctcacaagctccccttcttctcagcaaggcctgcccccaccagagtagtgttggtgaagtctcaggccacagcacctgcttcttctgaggctgtgaaggtgacaccggtgccttctgagatgaaggcatgggtgtatggagaatatgggggtgtggatgttctgaagctggactccaatgttgctgtgcctgatgtgaaggaggatcaggtgttaatcaaagttgttgctgctgctcttaaccctgttgatgccaagaggaggcagggaaagtttaaagccactgattctcctcttccgactgttccgggctatgatgttgcgggtgtggtggtgaaagttggtagtcaagtgaaggactttaaagtgggtgatgaagtgtatggagatgtaaatgagaaagcacttgaaggtcctaagcagttcggatctttggctgagtacacagctgttgaggagaaattgttggcaccaaaaccgaagaatttggactttgctcaagctgcttctcttcctctagcaattgagactgcttatgagggtttggagaggactggattttctcctggtaaatctattcttgttctaaatggttctggaggagttggaagcctagtgattcaggtttgtcttcagttttacgacagagatgcagggattctagctaagcaagtttatggagcttcaagagttgctgccacttcaagcactagaaatttggacctactgaaaagcttgggagctgatttggccattgactacacaaaagagaactttgaagatttgcccgaaaaatttgatgtagtttatgatgccattgggcaatgtgacagggcagtgaaggctgtgaaagaagatggcagtgtggtggcactcacaggtgctgttacaccacctggcttcagatttgtagttacttccaatggagaagttctgaggaaactaaacccttacttagaaagtgggaaggtgaagccaattgttgaccccaaaggtccattcccctttgataagcttgctgaagccttctcttaccttgaaacaaaccgagcaactggaaaggttgttatacatcccatcccttga

SEQ ID NO: 75142 - DNA, 309 bp, Glycine max
  Peptide Sequence Number=SeqID_191920
atggataggttgacgaccatgatgagtgcactcctgtcagcccagaactctcaagctgccgccgctgctgtagagcagcctttggtgagcacaaccccgctatctacggtgacttctccacccctctttttgcctccaggttgtacatggggaatgccacctccagtctgtggaagctcccagcccgctgtatctgaagctccacctccttttgctcagcagtcagcaccggttccgcaacccagtacctctttccctcaagctgcaatgacttattcagctccactgattcacactattcaacaagag

SEQ ID NO: 75143 - DNA, 411 bp, Glycine max
  Peptide Sequence Number=SeqID_191921
atgcttaactctctagcttacccagtggagtcgccaactgtcacaaccttccctctggcgggggtgcaaaaaggcctctcggtcgaccaaagggatgcgtcttccgtcaaaggaaaacgcgtggactcgccaccaacgtttattcgaggaaaatgtcagaaaaaccaaaatagaaaaggtcaaaggtctgcgcattttgaaaatgagggttcaggagttgtttatgcacggggaagggtcaacaagggtgtttccctcactcctacgtattccgcaattgcgatgaggaaatcagacctacgtagttcattgagaaatgaatgttggaaagaatcgttaaggcattggaccttgaacgttctcttgatttttgaaaggagagaatcgttaaggtgttggaccttgaaatga

SEQ ID NO: 75144 - DNA, 213 bp, Glycine max
  Peptide Sequence Number=SeqID_191922
atggaggatgaggtaaagctgaaaattaatggaggtttaaggagaacctacttgaagctcttgtgctctgattaccacttgatggaagcttgcttgcgtcatccactagggaataagccatggaagaaggagcttcaccgccgagagagtgccttggatgagaagcttagagaggaagcttcaatggaggaaaagaaagagagagagaaatag

SEQ ID NO: 75145 - DNA, 279 bp, Glycine max
  Peptide Sequence Number=SeqID_191923
atgggtgccaagcacctcacgaggaccgaagaatggtcgcacgtcatcgagcaaaggtccccggacgaaattagggagtcatttgacttaatccatcgaaaaatccttcaactatttctcgtccttgaaaaaattctttttgcaagaatcaactccttctttcattcttcctcactacgaggctatgaaaacaagacaacgattggtacctcaaagccttacactggggcaatgaggggcatcgtgcatgagcctctagtgaacctaggggcagattag

SEQ ID NO: 75146 - DNA, 594 bp, Glycine max
  Peptide Sequence Number=SeqID_191924
atggtgtgggcggccggtattaaagcgccagacttcatgaaagagattggcgggctggagaccaaccgcattaatcagctggtggtcaaagagacgctgcagactacgctggacgacgatatttacgccatcggcgactgcgcctcctgcgcgctgccaggcggcggattcgtgccgccgcgcgcgcagtcggcgcaccagatggcgtcgcgagcactggaaaacatcctcgcccagcgcaaaggcaagccgctcaaagcctacgtgtataaagatcacggctcgctggtgtcgctgtcccgcttcagtaccgtcggcagcctgatggggaacctgatgcgcggttcgatgatggtggaagggcgtattgcgcgttttgtctacatctccttgtacccctcaaccgcgtgctgcgtccgcgtctcaaactgcattgatggctggcgggcggtcatccccgcccgctgcgcgcccggctgccgtaacctgctgattgccgttcaatcagcgccagattacggcgcaatgacactgccgctcagaactctcctaaaagctggtcctgctggctttccgctgcgtttcctccattaa

SEQ ID NO: 75147 - DNA, 324 bp, Glycine max
  Peptide Sequence Number=SeqID_191925
atggggctccgaaaaaaggtagagaatggagaattgcacaaaccaatcactacgcatggctccaaactcgtgggtggaggatgcatgaacgaaaacgcaattcatggggctccgaaaagaggggttgagaatggagaattgcactatgcaataactacgcatggctcaagacttgtgggtggtggatgcatgaacgaaaacgcaattcatggggctccgaaacagggtagtgaatggagaattgcactaagcaatcactacgcaaggctccaaaagatgggtggaggatgcatgaacgaaaacgcaattcatggggctccgtaa

SEQ ID NO: 75148 - DNA, 937 bp, Glycine max
  Peptide Sequence Number=SeqID_191926
agggctacacgccctcgccatcagaggactgcatgtcctcaccttcagagggctacacgccctcgccttcagaggactgcatgtcctcagcttcagagggctacacgccctcgccatcagaggactgcatgtcctcaccttgagagggccacacgccctcgccatcagaggaccacacgtcctcaccttcagagggctacaccccctcgccatcagaggaccacacgtcctcaccttcagagggctacacgccctcgccatcagaggactgcatgtcctcacctttagagggccacacgccatcgccatcagaggaccacacgtcctcaccttcgtagggctacacgccctcacctttagaggaccacacgtcctcaccttcagagggctacacgccctcgccatcaaaggactgcaggtcctcaccttcagagggctacacgccctcgccatcagaggactgcatgttctcaccttcagagggctacaggccctcgccatcagaggaccacacgtcctcaccttcgtagggctacacgccctcacctttagaggaccacacgtcctcaccttcagagggctacacgccctcgccatcagaggactacacgtcctcaccttcgtagggctacacgccctcgccttcagagggctgcacgccctcacctttagaggactacacgtcctcgccaacagagggttgcacgccctcaccttgagaggactacacgtcctcgccagcagagggctgcacgacctcaccttgagaggactacacgtcctcgccaatagagggctgcacgccctcacctccagaggactacacatcctcgccttgagagggctgcacgccctcacctttagagggctacgtgtcctcattttcagtgtgctccacatctgcaccttaagagcatttaaggtcctctgtccttaa

SEQ ID NO: 75149 - DNA, 1852 bp, Glycine max
  Peptide Sequence Number=SeqID_191927
gcatatacctgatcaattgagaaggaagctagatgacaaggctcaagcagttgtcatggttggttatcactcaacaggttcatacaaattgtatgatcctatagagaagaaaataatgttcagcaaagatgtaaagtttgatgaagcaagtagctggaattgggaaggtagctcatcaaggaagaatagtatggtgtatctcaatgatactgaatcaccagtacaagaggtgaacacaaatcaaggaggtgcatctgaaagaccaactagaaatgtacaagctccacaaaggctgaatgattgtgtgaggtttccagatactgcagtggctgatgatggtgaactaattcaactagctatgctagctgaatctgagccagtcagtcttgaacaagcaatgaaggaagagcattggaggaatgctatgttagatgagttacagtccatagaaaagaatgaaacatggtctttggttaagttacctacgagcaagaagtgtattgatgtgaagtgggtatacaagactaaattgaagccagatggtcaagttgcaaaatataaggctaggcttgtggcaagaggttttctgcagagacaaggcctagattataatgaggtttttgcccctgtagctagaatggagacaataagattgattattgcaatagctagctggaagagttggaagatgtttcaactagatgtcaaatcagcatttttgaatggtgagctagaagaagaagtttatgtgagtcagccacctggatttgagataaagggcaaggaggattatgtgtacagactgaggaaagctctatatggccttaagcaggcacccagagcttggaataagaaaattgaccaatttcttatcagtcaaggctttgagaaatgcatcacagaacatggaatttactttagaaattctgatgacaaccagaagttgatagtatgtttgtatgtggatgatatgattgtaactggaagtgatacaatggaaattgaatggtttaaggaagccatgatgagaaagtttgaaatgtcagatttgggtgtgttatcatattttctaggaatagaaattgtgatgtccacagaaggagtgcttattcatcagaagaagtatgcaagagacatattgaagaggttcaatatgaataatagcaagcctgtcaccactccaattgatactggtacaaagctaatcaaggaaggcgtagaagaactcagtggatgctactttgttcaagcagattgtagattcatggaaaagcccatgacttcacacttggtagcagctaagaggatactaagatatgtgaagggtacagagggacttggtattctatatagaactggaattgacacaccagatgctgaactatatggatactcagactctgactggagtagagatgttaatgacagaaagagtactgcagcttatgtgtttatgtatggtaatgcaccattctcatggtgttcaaagaagcaggcagtggttgcattatcatcgtgtgaagctgagtacatagctgcttcaatggcagcttgtcaagctcaatggttatgcatgcttatgcaggaattgggtttgaagtctgatgataaggttagaattatgttagatagcaagtctgctatcgatttggctaagcatcctgtagctcatggtaggagcaagcatatagagaccagatatcatttcttgagagatcaagtgaacaatgataagctggagcttctgcactgcaagactgaagatcaacttgcagacattctgactaaggctctgaagacgagcacacttgaaaacctgaagatgaagttagagatgaattcgacaagctaa

SEQ ID NO: 75150 - DNA, 555 bp, Glycine max
  Peptide Sequence Number=SeqID_191928
atgtataaaggttacactattccatggccgtggaggcagtattggtcgtggtggtggcccaacatatctggctattcagtcccaaccccctggggaacgcttgggtctacagagcagggagagatggtagaggccaagattgggttggcacagatagctgttagacaactagagatatacacaacagcagtgctgcttgcgacccttggtccagctatcccacccagagaagaaaaatggcgtaatgtcatggaagagatctcaaacatcagttggcagtgtagtgagaggcaagagcttggccatgaactaagaagtgagctcatgacagctgaaaagtttgtcatggttattagtgggcacgagaaacttcagcagaataataggagcttgaggaggctgattgagaatagacttctcttcctcaatcccttgaacatgttgcaggtggagagactcaagaggttaagacgtgacgatgacaactgtaagatcagagatgctttgcttatcaccataaatgggattcctgcagggatgaagaatacaggttga

SEQ ID NO: 75151 - DNA, 266 bp, Glycine max
  Peptide Sequence Number=SeqID_191929
atgattggtacctcaaagccctacactggggcaaagaggggcatcgtgcatgggcctcaagtgaacataggggcagatcaaaagttctcacccgtcgatgtttttaaacacaaaaagaaagggggggacaaaccctggaatttcaatggattgattaaacgtcaaacagctccatcgccgtcactccaaaatggtcaagtgactaaatcaaacagaacatacactctaagggagttctcggagagatttgcaaaagataggataag

SEQ ID NO: 75152 - DNA, 239 bp, Glycine max
  Peptide Sequence Number=SeqID_191930
tgccaacggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaag

SEQ ID NO: 75153 - DNA, 315 bp, Glycine max
  Peptide Sequence Number=SeqID_191931
atgttgagacacaaccttaagctactttggacctcggcccatgaaaagaatcctcatcctttcccccgaagaagaggacagcagaatctcctcatggaagagcgaataacgaatgctaaaacccgaattcccaatcaaagatcgaaagaaaaagaaaaaagaaaagaaagaaatgaaaagaaagaaaaggaaaaaaatgaaaaggaagaaatgaaaagaaagaaaagaaaaggaaaagaaggattcccgattgaagatcggaagaaagcaaaaagggaaggatcggaggaaaacagaataattcccgatcaataa

SEQ ID NO: 75154 - DNA, 381 bp, Glycine max
  Peptide Sequence Number=SeqID_191932
atggtggtgatacttatagtggtggctagtgatgattgtgctggtagtagtagtagtagtgatcgtggtagcggtgttaatggtgattgcaataacaatagtgtgacaacaatagtgtcaacagtgatggtagcaatagtgatgatggtgacaatgtttcaagacaataatagtgctcgtggtggtgacaatggtgatgacaacaacaatagtatcggcagaggtggtgatcgtgctaatggtggttacggcgacgatgttggtgatgattgtagggaaggtgcagtgtcggtggtggtggtggttgtgacagaagtgctggtgctagcgatggtggtgagaagtgttattatcaaatgtaaagtgcctgtacttttttaa

SEQ ID NO: 75155 - DNA, 361 bp, Glycine max
  Peptide Sequence Number=SeqID_191933
cagcgtcgaggagagcgcgagtcatctattttttcactgcagcaaagtacttccgctttggtgggaatccttgtcttgggtgaatatggtggttgtcttcccacaacacccaagacagcactttatccagcacatgcatcaatcgtatgaaggcttgatggcgaaaagatggaaatggtggtggttagttctttgcttttatccctctccaacttgcgtatttggcttgagggctattgagtcgaaggagcaaggtgttagggaggaaaaagaaatggctatagcagatatggagtatatgatagagaagagggcaaagaagaaagtatatgctcgtttcaaggaaattgcacgtctttaa

SEQ ID NO: 75156 - DNA, 375 bp, Glycine max
  Peptide Sequence Number=SeqID_191934
atggtgatttccatgaatttaacttgccacttaaatccatgtcaacaaaagataattgaattcatagagcactgggtccaaatttgcactccagcaaagtccaaggttaaaacagaagcaaacacattagaattctctgagcaatgtaccagctgcgagaaggcaattatgctatatcgtattgaaaatttcttgctcacttcaatgcaggaagctgtgaatgtatcacttgggaacctattgacatatcgatttgtgagagatgcagttgtgaagaaaactcttgccttgaaaggtgcacattacaatttcgttaagggcacatttgagctgtgggatctggacttgaaaatctctaactctgtatccgtttaa

SEQ ID NO: 75157 - DNA, 132 bp, Glycine max
  Peptide Sequence Number=SeqID_191935
atgtatggggttgcatttccatgttggactgagaagatttgtgaagaagttattctttctcctcaattggaagttgttgcccgtctgcacccacacaaaatggttctttctaccaacaagtcattggcctaa

SEQ ID NO: 75158 - DNA, 483 bp, Glycine max
  Peptide Sequence Number=SeqID_191936
atggctggaggatcatacgaggaagccattgcagcgttgacgaagcttctcagcgagaaagccgacctgggtggtgtcgccgccgcaaagataaaacagctgacggcggagctggataccgccaccgcaaacgggtcgacgccgtttaacccggacgagaggatccgaaccgggttcgcccacttcaagaacgagaaataccagaagaacccggaattatatggcgaacttgccaaaggccagagtccaaagtttatggtttttgcttgctcagactctcgagtttgcccatcccacattctggatttcaatccgggtgaagcctttgtggtccgaaatatcgccaacatggttccaccatatgacaagaccaagtattcaggaaccggggcggccattgaatatgcagtcttacatttaaagggaatgtcttataggtggagaatattgtggtcattgggcacagctgctgtggaggtataa

SEQ ID NO: 75159 - DNA, 405 bp, Glycine max
  Peptide Sequence Number=SeqID_191937
atgggaataattgaggagacacaaaatacgaaacttaagagagtattggatgccatcaaactcgaaggaatcatagtgtctcttccttccttttccttttctcgaaaccctaacgggttggccaagagacttgtcctctgcaggttgagtgccttgtcttcatcgtcgcttgttgccaaccttcgtgaccagatctatgactgctggacaagatctgtgaccattgttgctcttgcttttcttcacggcttcagtcttcgttttcttcttggtgactttgtggagctcgagagtgactttggcgttgaagtgatacttctgcatctggatgacaggggtccagttgagccgacagggatggatggtggtgaaggtgacgtcgtagtcgaaggatgcggcaattga

SEQ ID NO: 75160 - DNA, 225 bp, Glycine max
  Peptide Sequence Number=SeqID_191938
atgcaacagggacagacatacatctctatagttaggttccctgaccccaactatgcaaaggtggctcatggcggtcaccagtggtcagtggtggtggaggaggagcttagggtgttgggggagggtttaggggaagtgaaggaggaagaagatggttgttttacacttctggacacatttgaagcctgcaacactcgcccaggcgagtttggctcgcctgggtga

SEQ ID NO: 75161 - DNA, 852 bp, Glycine max
  Peptide Sequence Number=SeqID_191939
atggaagagtcatatgagaagagctcaaagggcctagaaatcttctgcaaaagttggcttcctagtgcatctaagccaaaagcagcagtgttttactgtcatggaattgctagaaagctggcatcatctggatatgcagtttttgccatggattatccaggatttggtctctcagaaggactccattgctatattcccagttttgatggacttgttgatgatgtcattgagcattactcaaaaatcaaagaaaatccagagttccattctcttcccagcttcctatttggacagtccatgggtggagctgttgcattaaagatacacctgaaacagcctaaggcatgggatggtgcaattcttgttgcgcctatgtgtaaaattgcagatgacatggttcctccaaaattcctcactcatatcctgattggtttagccaatgttttaccgaagcataagttagttccaaacaaggatttagcagaggcagcattcagagatttgaagaagagggaactgactgcttacaatgttattgcttacaaggataaaccacgtttgcagagtgctgtagaaatgcttaaaactactgaagaaatagaacggcgactgaaagaagtttctctaccattattcatccttcacggggaggctgacactgtgacagatccatcagtgagcaaagccttgtatgagaatgcaagctgttcagacaagaagcttcagctttacaaggatgcctaccatggtcttcttgagggtgagcctgatgaaataataactcaagtttttggtgacatcatatcttggctggatgagcacagcttgaaacacaatcaatcttcctcttaa

SEQ ID NO: 75162 - DNA, 390 bp, Glycine max
  Peptide Sequence Number=SeqID_191940
atgcgtgtagcgtcgaatcatgatagcgaaggttccaacaaaaatcgacctttctttttcttcttctgcttccatgtccctctcggcgtgatggagaacaagtttccatgcggcgtcgaactcccttgccttctcgagagcgttgactacagcgagaaagagcatgtggccgggcttgaagcgggttgcgtctgggcccagaggaagagcgaatgcaaaaacttgggtgacgagctgaagcaatcgaacatggcgagcaggagggccaggtccggcccagtcaaacttggcgtggagaggttgggcaacatggaggggtcgctgaagaggttggagatgacagagaaagcgtttgagttgggggaaggagggacgggtgtgcggttttga

SEQ ID NO: 75163 - DNA, 136 bp, Glycine max
  Peptide Sequence Number=SeqID_191941
gccttttatccacatttatagcaagaaaagaggagttaagggtatcaagccaattacaaatggaccaccgggttcaatggagactcggtcagaagagagaaagaggggagtagcacactggagagaagtagggtaa

SEQ ID NO: 75164 - DNA, 1464 bp, Glycine max
  Peptide Sequence Number=SeqID_191942
atgagtggtttgggtgttgtagagtgtcttagaccccttgttaagaccaatgcttgggattatgtagttgtttggaaatatggggatgacccaacaagagggagttgtagtgtgaacattgatgtggtgaagcctgaagaggaaaagggtgaagtgtgcaacttggctcaaagttgcagggatgatcattttcattttcagcatctagttagaacaaaggcttgtgaagctcttgctcagcttccttttgcattgtctctctattctggtgtgcatggagaggttgccatatcacaacaagcaagatggcttacccaggtggattcaattggaacccaagttttgatccctattgttggtggtcttattgagctcttcactgaaaacctgattccaatggatatgaatatcatagagttcataacagcacatggttgtgtctctttagagcaagaagccatatctgcacagagctacaccagtctgaacatcaatgaacatctgccattaagggaacaatactcacattggtcaccacacatgccaactttaactcctagtgtccatcagcctgcaacgagacagtgcagctcccatcctagcattgaaggaccatccagtgggtctaatccttcaactgaagaaccatcatttgattcaaagtttgcttccttgattccacatgaatatctgaaaccaccagttaaaaaatctcccatccccaaaactgaaacgcctaagtacaacaaaacttcagggaaatggcagagaggtttaagttcccattgtagcaatgaggaagacgatgaatcaaaatcagtcaaggagtctcagaaggaagtttaccaggctaagaatcttgtcacagagaggaataggaggaacaagataaaaaaagggctttttacactgcggtctctagtcccaaggataaccaagatggatagagctgcaattcttgccgacgcggttgaccatataaaggaattgcaaacacaagtaagagaacttaaagatgaggtcagggatttggaagaacaggaatgtgagaagaacacgccacaattgatgataacaaaaggcaaaaaaccagaaggaaccagaagtaaccctcctcttaatcaaagttcttctggttgcactaaaaagatgcaaatggaggtgcaagtagaagtgcatcacattagcaagacagatttcttaattaagttatgcagtgagcagacgcaaggtgggttctcaaagttgatggaagctatacattcaattggactaaaggtggatagtgccaatatgaccacacttgatggcaaagtccttaacattctgacggctaaggcaaacaaacaggatattcacccaactaaacttaaagagtatttaatacagaagacaagcgatgataggcaaagtagcaaacaagttcgagaaaatggtggtgatatgaagagttcaagaaagtaa

SEQ ID NO: 75165 - DNA, 813 bp, Glycine max
  Peptide Sequence Number=SeqID_191943
atgaacaacatgcagaataaaacctcaagcattaagaaattgaaaatgcatgctttatctattcttcgaatgtcccatttgtttcacaaatctaatgacgttgctcccattccttcgatgctcaaccaaaatttcataagtgaaaatcaaatccaaattgacaaggaagaaaattttgaagagcaacaagagtttagttttccaaacttttgtgctcaaggaacatttacatttgccgatgacatctttgacaatggcaagatccgtccaaaatctactacttttgaccaatctcttatttttaccatcgtacaagacaacgacaccttgcatcttcaaccaccattgaagaagctctttgttgataaggaactcaatggtttttcctcacaatcaaaaggtacatcaaaaggatcttgcaacgagacttcacaaaaaatgacaatggttgaagttttgacattgaacaaccaatgcaagaagagcaaatccacaggtttctcaaacacatggagactacgggaagacataaagcttcgaagcatcagtgatggcaaggacgcttttgttctcttgaatccttcggggtcaatgcctatgaagtccaacgaggcaaaggaagaaattgttgtttcaaagagaaaaaagggtgagaaacgcaaaacaactttctcacctcatgaaaagatttacgtgatgaataaaaagaggaaggaaaccaataaacgaaagtcattcttgccttataggcaaaacttgattggggtctttgccaacgtgaatggatttagtaggatccttagtcctttttga

SEQ ID NO: 75166 - DNA, 174 bp, Glycine max
  Peptide Sequence Number=SeqID_191944
atggtgtgcacgaggttggtggtagcgggcagtgtgatggttgttgtgacaggttgcccggtgctcatcaaaccaagacaggatataaagttgtccagtaacttgattattttactgtcctgttctccttgtccagaacaattagaacagaacagtacaaataatgaatattaa

SEQ ID NO: 75167 - DNA, 2157 bp, Glycine max
  Peptide Sequence Number=SeqID_191945
atgagtacaaaacataccgaagaggacaatgattcttcttatctaactatacctaacaaagataaaaggaaacaaaagagttctcatgataatgacaaggaatcggctccatctccaaagcctcctgatttagatactcaggagagtgctccgtccaactccccaccgccatcaccaccgccaccaccgcctcagttgaaactgccaatattatcaccacctcggttgaaaccttcctcaatatcattgttgtcaccaccatctaaagatttaagtggatcaccatcatggtcaccgccacctccaccatcacggtcaccatcacctccatcatccttgtcattgctttcatcgtcatcacccccaccatcaccttcatcacccccaccaccaccttcatcgcccccaccaccaccaccaccttcatcacccccaccaccaccttcatcgcccgcaccaccacaatcagtgccattgcgcaataacggcaatccttctcctcctcctccttattatccacgtaaacagtcaccgccacaattccatgctccacctcctccttcttcgcttcctcgtaatgcaccctccaatgattcaactccgcgaacctctgacaagccacgatcaggccaccatggcaagcatggtggtgctacttcttcccatacaaactcaacgggttcttctcccaatcaaacctcttctgatgataattcagaaaaatatattggctacacactcattgggatttttgctgttgccttggttgccctagctgtatctcttgttttcgtgtttaagaagaaaaaatcaagaggggatgcccatgttacaccctatatgccaccccttaatattcatgtaaaatcaggtgttaatgggcattactatgtacagcagcctatcccatcacctccccttgcaaacaactatggaaatgggaatgcgagcatgcaccatttaggagcttctttcgactcagctcagttcaaaagtgctcagatagtttttacctatgaaatggttatggaaatgaccaatgccttttctactcaaaatgttattggggaaggagggtttgggtgtgtttacaaaggttggctgccagatggaaaagcagttgcagtaaagcagcttaaggccggcggtaggcagggagaaagggaattcaaggctgaagtggagatcatcagccgagttcatcatcggcatttggtgtcattagttggttattgcatatgcgagcagcaaagaattcttatctatgagtatgttcctaatggaacactccatcatcacttgcatgcaagtggaatgccagtattgaattgggacaagaggctaaagattgcaataggcgctgcaaagggcctggcatatctgcatgaggactgctgccaaaagattattcacagagatataaagtccgcaaacatacttttggataatgcttatgaggcacaggttgctgactttggacttgcgaggttagccgatgcttccaatacccatgtatcaactagggttatggggacctttgggtacatggctccagaatatgcaacaagtggaaaattaacggatagatcagatgttttctcatttggggttgtcctccttgagcttgtaactggaaggaaacccgttgatcaaactcagcctttgggagatgagagtttggttgagtgggctcgtccacttctccttcgtgcaattgagacacgtgattttagtgatctaatagatccaagactcaaaaaacactttgtggagaatgaaatgctcagaatggttgaggtggccgccgcttgtgttcgccactcagctcctagacggcctcgtatggttcaggtggtaagatccttggattgtggagacgaaagttctgatctatctaatggggtgaaatatggtcatagcacggtttatgattctggtcaatatgataaagaaattatgctattcagaaggttggccaatggaacctttgtcgattctgattttgagatatatagtagagaatacagtttgtcaagagacacctcaatgacctcaagaggatcccaccaagaattgatacgacatagttctagtgggagtttgaatctagagctatcaacatgcataggaccagtattgaatgaaaacagggattga

SEQ ID NO: 75168 - DNA, 195 bp, Glycine max
  Peptide Sequence Number=SeqID_191946
atgtcaatggagtttactctacttgaccaaccaacatgtaggagtcccttatacatgctacatatggatgttttttcctatggccttctccttctccaacaaattaacatggttggagcgatgacgaaggtggaggaagttgtggcggtggtgaaaggagtgggagataagaggaagaggaggaggatgagatag

SEQ ID NO: 75169 - DNA, 243 bp, Glycine max
  Peptide Sequence Number=SeqID_191947
atggaagctttgcgttactatcagattcagatgatgatccctgaaggacatgagaagagaggggacaagaggtcagtgagctatagtgcagtagcagagcatagcaaccctgggctagtatgggattcaaatagtggagcgattttcaataccagtcattgcaaccgtaacagcagcaattcacatgctatagcggcgctaccatggtataggcttcaaaaacccttttttactcctgaataa

SEQ ID NO: 75170 - DNA, 237 bp, Glycine max
  Peptide Sequence Number=SeqID_191948
atgatagatctcacttcttgtttgcatctccttcctctcgcacttcattcttttctttctttttctcaatcatctttttgtttccctctatgtgcagccctcaatgaagagaatcacgccgatctagtcaatgctctcaaggttgcatttaagactggtgatttgaagcggcaaactatatatgccatagatgcgtataggagtagcaatgaatttttcaagcctatgagctcttag

SEQ ID NO: 75171 - DNA, 258 bp, Glycine max
  Peptide Sequence Number=SeqID_191949
atgaagaacaaaaatagcgtcgatctagcgcaagaggcgtttctcctctgcctgccatgcatttcggtgcgaggcgaagatctccactacgtgtgcattggcctaggagtcctcttgccgccgagacttcatctgcaggagctcctcgaccacagcggtgatgatgaacgattggggtttcgaggggggagggaggaattaattctttgcatctctttacccctttgcaacctatgtgctgaagggttaaggccgtga

SEQ ID NO: 75172 - DNA, 552 bp, Glycine max
  Peptide Sequence Number=SeqID_191950
atgtctcttcaagctcaaccacaacaacaaccacaacaaccagtccaagtttacccaacaaatcagccaccttcatcttctcatcactcaaatgggtcatttggggcagttttcattgtccttgccataatactagtcatttctgtagttgcatgctttctagggcgcctttgcaacaagcgctataataatagccacagcaaccgccagaaaccctctaagcagcataataggccacagatccacaatttgcatccaagagatcatcatcatcatgaaggggacattgaatttggtgacaaaggaatgccaccaccgattataagaacccaacaagaacatggtcatggtcatggtcatgaaggggacattgaatttgagggtgacataagaatgccaccaccaattataagaaccaaagaacgtggtcatggtcatcatggtcatggagcagctggcacaggaggaccccagttacatcatgttaatgataccatgaaagattttaatttgagacctggccatggagaagtgcttagagcaggtgcatga

SEQ ID NO: 75173 - DNA, 513 bp, Glycine max
  Peptide Sequence Number=SeqID_191951
atgaagtcaagaatcttcatggatttgcataaagttatcacaatcattaaaagtcagagagaaaggagaaagtacaatatttatcagcatcaacacaacaagcaaatgagttgccctgcgatggctcagttgctctcaaacactctttattacaaacggttctttccttattatgctttcaatgttttgggtggccttgacaatgaaggaaagggatgtgtcttcacatatgatgctgttggttcttatgagagggttggatatagctctcagggttctggatccacacttattatgccatttcttgataaccagctgaagtctcctagcccactcctgttacctgcccaggatgctgttactccattgtctgaagcagaagcagttgatctggtcaaaactgtttttgcatctgcaactgagagagatatatacaccggagataaggttgaaatcgtcatcctaaatgccagtggtattcatcgtgaatacatggacctaaggaaagactaa

SEQ ID NO: 75174 - DNA, 333 bp, Glycine max
  Peptide Sequence Number=SeqID_191952
atggcttcttcgttctccttctgcaccctcaagtttcgcaccaaacccaacgatagtagaagcagtgcttcctctcttccccgtattctattctgtcacaacctccacgatgacattcacacacccactgaccaaatcaaccgaagacaactcatattgagaagcagcgaaatagcgaccatcggtgccatcttcgacttcagtgggaaaaaacctgattatcttggagtgcagaaaaacccaccagctttagctctgtgtccggtaactaggaactgcgtatcaacctctgagaatatcagtgatcgcactcattatgctcctctttggtaa

SEQ ID NO: 75175 - DNA, 420 bp, Glycine max
  Peptide Sequence Number=SeqID_191953
atgagcattattagctttaccaagtatcacaagtttcccaagagttcgatactcgattcttaccattttatactacttgtgcgatctgttattcgaagaaagcagtggttatcaaaccaatcctttggaaatcccccatctttatggatcaaaattaacacggacaaggcagttagagggaatctgggtagagcgagtagtggtgctagcattggcattgagagtgctttcattgcaaagattattgcatccatcctcgcaattgaaaaggtcatacttggtggaattcaccaccttctttcatttcttaggagcttagtagatacacagatgagcttccttttcaaaggttcatttagtcttgcttcattgggtatggtttggccctcccaagtgttttgttcatcttttcatcaataa

SEQ ID NO: 75176 - DNA, 417 bp, Glycine max
  Peptide Sequence Number=SeqID_191954
atgacggttttggtcaaaaccgtcatagataggtcgcccttaaagatgggtttggattatcattgttgtattcaatttaaattaattaaaaacctcaagtgtcacgtccactcgagcatgctcctcctagggtttttcaattccaaatcttccttcctctgcaaccaaatcgtgtcgctcaagccaaatgctagaattgaggttcaccgatgtcgtctccaactccgatgcaaatgtgtcaacaactatgactatgccatcaatcgcaaggtcgatgatgactttgacgccttcataacttcaaaggtttggacctacataatggtgtttctttcaaagctgaagatggaatcgttagagtcagagacgagtttggagaaggaacgactttgggaatctgaggcgacggtagtgtga

SEQ ID NO: 75177 - DNA, 240 bp, Glycine max
  Peptide Sequence Number=SeqID_191955
atgagtgggtgttcacactcaagaaatgaagagaacaacccaaacccaagagcaattctcggtctagctgcaaaacaagacttggaggttgagcagcttgatgtcaaaacaccattcttacatggagacttagaggaagaaatttatatggagcaaccaaaaagattttgtagaactagggaaagaacacttagtgtgccgcctgaagaaaatttgggatctgacaaattagtccaatga

SEQ ID NO: 75178 - DNA, 792 bp, Glycine max
  Peptide Sequence Number=SeqID_191956
atgaaacacatgagcgacgcaagggttacctctgttagggtattccctaacctctctgtccccgtggcagtcatcgcgtgtctgggcattgggttcttgcaatctatatcctggaatccttcacctatcaaaattccagaagatgagtatcagcaaggactcattagttgcaaacatagccctcatggaaggatgattttagtgaaaggaggattagcgaagtgtttgagcactgggttcttgcaatctgcaacctggaatcctttgcctatcacaaggaccctagattttagtccgaataatctgcagataccaacgattatcctctttgttgctggtggtgtgggcattcttataaccatagatgagaagattagagacaaggagtttggtcactatgcctgcatcctagttgtcattaacttggaggatgcgctcccaaacttgattctaatgcaaagtgaggaggctagggaaaacaaggagcagattgatccaaagcttacagggaaaggccaaagatacgccctggtgatttttcaaaaccaacccgctattgatgttgtccacgttgggacaaactctgggaaggataatgaatttccaagaatagatggaggcctcttagattttttagagaacacagaagaccaagttgatgatttacttttgcaacaacatcatgtagatccctatggaggatactactttcagaatatgcaagtggctcttgtggagatggactctccttttaggcaagtcatgctaaaagcaaagaagaagaagcaataa

SEQ ID NO: 75179 - DNA, 924 bp, Glycine max
  Peptide Sequence Number=SeqID_191957
atgggagattctgatcaactctccaaatctgccaaaaaccagaaaactgaacaagataatgaggaggactcaaacaaggagagctctctgttgcatattcagaaaaagaccttgaagcctgacaataagttgtacttttccactgggtcttcaaaaagctctgcatctgctgaaccaattgaagaatctgggaaaccagtgtttcagtttgagtcttcaaaagagattcaagttcaacatggtagcaaagcaacagcaactctagagaccgagactgagttttccaaagatgcccgtgccatccgtgaaagagctcttaagcaagcagcagggagtttgaaagggaaaagtgcaagttctgaggatgaaaaattatataagggaatcaacaattacaaagattacaaggctggctttcgtagggagcaagcaattgctagtgaaaaagctggtgggtcacatggtcctctttgggcttcagctcatataagagtttcagcaaggtttgattatcagcctgacatatgtaaggattataaggaaactggttgctgtggataccatgattcatgcaagtttatgcatgatcaaggggattacaagtctgggtggcagatggagaaggaatgggaagaagttgagaaagcaaggaagatgaaattggctgcaggtgaggatgcggatgaggaggagggtgctaatttgactgatgaagatgaagatggttcattaccatttgcatgtttcatttgtagaaatccttttgtggatcctgttgtaaccaaatgcaagcgctacttctgcgagcattgtgcattgaagcatcatgctaagaataagaagtgttttgtctgcaaccagccaacacttggaatttttaatgttgctcatgagatacgcaggaagatggccgaggataaataa

SEQ ID NO: 75180 - DNA, 324 bp, Glycine max
  Peptide Sequence Number=SeqID_191958
atgcaccactctagtaagaactacaatcctgaaggtaggaaaaaccctgtgagcagagaagaggcaatggaggaactgatagacgtgatagaatcaacaacaccagacaaatttacaccacgaatagttgaaaggaaggaagactatattcatgtggagtaccaaagctcaatcttggggtttgtgcatgatgttgagttctggtttccactgggtaagggttctactgtggagtatcgatctgcatctcggttggggaactttgattttgatgtgaataagaaaagaataaagatttacttacatgcaaattatgcaacttga

SEQ ID NO: 75181 - DNA, 309 bp, Glycine max
  Peptide Sequence Number=SeqID_191959
atgatgtccccgaaccgcgtctcagaggatcggggcaccccaccacaacatttcaggtgcattgacgtgtgccaatgcttttgctctttccttgaagctgtgtctcaatgtgttagttgttttaggaactgggttggagctaatgggtcatctttttcgatagttattgcaagcattgtttactttgattcagtgcttatttgtgtggagggaaaatttgaagttaacacgagagcaaaatgcaatgccctcagtggttgcaatttaatctataacttattaggtgtgtgtttggttcagcttatttaa

SEQ ID NO: 75182 - DNA, 282 bp, Glycine max
  Peptide Sequence Number=SeqID_191960
atggataggagaaatgttggagcgaagtgtaagggatacctgttattaggttacaacgtagggttgggctccacgactgaatttgtcaatattgatgaggaagaaggtattgttacaagcattgcttgggctcccgatggatgtcatttagccattgctttgaacaacacgcatgtccagctctgggatactcatgtttctaggctagatatgggacgtggttatgccttttttctatggaaggatatggtagaaatgtatgatagcaatgatgttgagtag

SEQ ID NO: 75183 - DNA, 432 bp, Glycine max
  Peptide Sequence Number=SeqID_191961
atgggtgactcagaggtggcaaagttcggcttaaaagtcgggaagaatgagaaaaatgggttcccaaggggactagatcctgcaatatccaagttttttgtgcagctccaaagtgttgttaagtctcgacttagtagattagcaaaacaggatggaatgagtttgatgagttctgtccaaagaaaaggggataagtctttcagttactctgaagctgaactaaatgagcaactgcaagcatggagagaaaatccatcttgggttgacaagcctccactaataaaggtcactgctcccaaaggttctctttgcaaccttgatgtagaagttgatgttggcctaccccctgatgcagtatataatatagtgatagatcctgacaataggagagttttcaaaaatatcaaagtaggtgactttaatcatccataa

SEQ ID NO: 75184 - DNA, 1314 bp, Glycine max
  Peptide Sequence Number=SeqID_191962
atggaattagcaccctcaaactccaaccaacaacatgagaacaacaacagcaacaaggttcaggggctccattgctctgtgaagaactatgagtggggcaaaccgtgccgtgactccctcgttgccaagctattttccatgaattctgggtcgttacaatcatcacagcttgatgaggatcagccatatgcggagctttggatgggcagccacgtgtctggaccctctttcattgtttttgatggctcacaacaaagagtgaccctcaagtcttggctcttggagaatcctaacgtgcttggaccaaaggttgtggagaagtggggtggtgacctccctttcttgttcaaggtgctgtccgtggacaaggccttgtctatacaggctcatcctgataaggagctggccagaaccttgcataagttgcatcctgatgtttataaggatgggaatcacaaaccagaaatggctctggctgtgacagagtttgaggctctatgcggctttgtcactctaaaggagcttaaggctgtgcttactgtccctgaggttgtggaactggttgttgctgaaaatgttaactcggtgttacaaatcactgatgaggatggtgaagagaaggttaagcctattttgaagtctcttttcactgacatcatgtcagcaggtaaagagagagtagctggtgcagttgacaggttgagaagtcgtctgcataaggaaagtcaggtgaggcagttgacagaaaaggagcaactggtgctgcggttggaaaagcaatacccatctgatgttggtgtcatagcagccttctttcttaaccatgtgaaactcgctcctggtgaagccttatttcttggggcaaatgaaccacatgcatatatttgtggtgagtgcattgaatgcatggcaacttcagacaatgttgtaagagctggcctcactcccaagcacagagatgtacagactctttgttccatgctcacatacaaacagggttctccagagatcctgcgtggagttcctataaatcaatatgtaaacaaatacatcccaccatttgaggaatttgagattgattgttgtattcttcctcaaggggaaaaggtagtgttcccagcagttccaggtccttccatctttttggtcacagttggggaaggaatgatgactacagaatcaccaaaagggtatccaatcactgaagggcatgttctttttgtagcggccaacactgagataactgtttctagtgcacctcagttgcatctgttcaggactggggttaacagtagattctttcaagattcctaa

SEQ ID NO: 75185 - DNA, 246 bp, Glycine max
  Peptide Sequence Number=SeqID_191963
atggaagacatatccaagcgatttaaagagcttaatgtatgtggcaaagtgactctaaagtgtaaacttcgggaattttcctaccttgatctaaattctatgtgtgcttctccagaaaaggtgaaaacaaaaggtattggtgaagattcatggtctttggttcataaccatttgctgaaagaacttgcaaaatggtctgacgagtatatgaacctacttggtggcatagacagatttgaggagtaa

SEQ ID NO: 75186 - DNA, 1265 bp, Glycine max
  Peptide Sequence Number=SeqID_191964
atggtgcattataggggacttcaacagcatcagagatctttcgcaaaggttgggagtttgtcaaagggggatggaggagaaaaattcacgtggttcaaacccaatggagctacaaggagcaagctggacaaatttctagtatctccagaatggcttgccaaatggcccggaagtacacaacacccactggataggaacttttctgaccatttcccggttttgcttaggtccaagtttgtagactggggcccaaagccgttccggatccttgactgctggttcctggacaaatctttcaattcaattgtgcagacatggaatagagaccagtatggtgatactcttaagaaatataagaagattgaggtagagttaaatcagttggaagtgagcacaattgacagacagctttctcctcaagatcgaggtgctaataagaaaacagctccaagaaaatttgtgggtagctgcacaatctcctcaagatcgaggggttgtaatgcctcattcatagttttaatccctaaggtggaaaatccacaagctctggatgaatacagacctgtatcactcattgaatgtatgtacaagatagtggccaagctgctggccaacagactgaagaagattatgccacttataataaatgaaagacaattcgcattcatagagggcaaacatctgttacaaagtgcattgatagcaaatgaggtggctgaagaggctaaaagaagacaaaagctgtgtattgttttcaaagtggtttatgagaaggcatatgattcggtctcctgggaatttctagtctacatgctcaaaagtccctcatctgagttcttcccacaaagagggcttaagcaaggggatccattagcacccttcctcttcaatattgtggcggaggcattgaatggactggtgagagaggatgttaagaaaaacatatttcggggattcccagtgggctcaaacaatgtcgatattagcatcctccaatatgcggatgacacaatattttttggagaggcatcaatggagaatgtcaaggcaattaaagcaattttgaggacctttgcacttgtatcaggcctcaaaattaactttgcaaaaagcagttttggtgcaattggtatgtcgaataggtggaagcttgatgcagccagttgtttgaattgtagtttgctgtccatcccatttgtctacctaggaatacctataggtgcaaatccgaggcggggtcagctgtgggatcctattctcaaaaa

SEQ ID NO: 75187 - DNA, 375 bp, Glycine max
  Peptide Sequence Number=SeqID_191965
atgcttcatatcactacttgttccaaccgtacctcttactgtgatattgcccgtatcattgtctactacgcttattttggacttgcacaaccgcctaacccgttgcggttcgtgcagcagttcttcaggcacaatgtcaacgggaggcctagtataactaccttatgccaggacacggccgttgaagttgacgagtatgtggaagatttcagtgatgatgaggatctcacatcatccgaggttgctactactgaggcgttatcggtgaagagatacttgagggcgagccctggtgcagcggtaaagttgtgccttggtgacttgttggtcatgggttcgaatccggaaacagtctctttgcatatgcaagggtaa

SEQ ID NO: 75188 - DNA, 885 bp, Glycine max
  Peptide Sequence Number=SeqID_191966
atggagtttctaaaagattatgatttcgagttatcataccatcccggcaaggcaaacgttgtggcggatgctttgagaaggaagtcattgcatatgtccgttatgatggtgaaggaattgcaattgatcaaggagtttagagacttgaacttagcagtggaacgtggtgccagtggacttatcaagttcaaagagagggtgtgcatacctcaagtagacgagttgaagcaagcgattctagatgaggcatacaagagtagattgagttttcatcttggatcaacaaagatgtatcaataccttaagaagaatttctggtggaacggaatgaagaaagatgtggccagatacgtagcaaaatgtttgacttgtcgcaagatgaaggttgaacatcaacaagctcctggagaaatacaaccattagagatccctgagtggaaatggaataacatttcaatggattttgtttctggcttaccaaggatgaggcataattatggtgtaatatgggtgattgtggatcaattaacgaagtcgtcctattttattcccatcaacatgaagtacaagttggagaagctcatcgaattgtacatcaaggaagttttcaagttgcatggagtacctttaagcattgtatttgacagaggtccacattttacttcaagattttgggatcttttaagggcatgcatgatggagcaacaaggcggttgggataagtgtttgcctctactggaattcacacacaataactttcatgctaatatcagaatgacaccatttaaagcattgtacggtagaaaaatcaagcaagtgcatggtaagacgattttgttggtgaaggttatatggagcacaaccgatgaaggtaatgcaacttag

SEQ ID NO: 75189 - DNA, 211 bp, Glycine max
  Peptide Sequence Number=SeqID_191967
ggtggtgagacttcaagttcaactgagagcaatggtggcagtcaaaatgtccgtttgtcaataccaattttaccaaattccagttcttcattagtttcaatgacatactctccttctttcaactctagtcaacttgttgctcagaggaaactgtttgcagaatcccaaataggaaggaccagttttcagaggcttttggagccaaactcag

SEQ ID NO: 75190 - DNA, 243 bp, Glycine max
  Peptide Sequence Number=SeqID_191968
atgggtgccaagtacttcgaagtggtcaaaagagggtcgcatcccaacaacagatggtccccggacaaaattagggatattgtcatgctgtgtacatccccctgttgcactattgcgcatctacatcatgtcgtcacgcatgtgtcgtatgttggtctcatcttttgtcacaggaagccggaatgtccatatcaccttcttaactgcatacatggggcactgtgcccccaaatgttcaagtaa

SEQ ID NO: 75191 - DNA, 165 bp, Glycine max
  Peptide Sequence Number=SeqID_191969
atggggtgctatgaagagcacaagtttgcacctaagaggaacgacaaccatggaagtggagccaaggttggctacaagaacaacaatggggtgaagccaaaggtacaaggaaaggtgtttgcaatgagcgagtctggagcaacaacatctaatgatctcatctaa

SEQ ID NO: 75192 - DNA, 834 bp, Glycine max
  Peptide Sequence Number=SeqID_191970
atggagttccaaatgggaaatattagtgggttcccaaaggaacaatcatggttactaaccaaaaaggagccaaaatctattgggcatgtgatgggagacaagaccaaatttgtctcattgaaagcaaaggagggaggctatgtaacctacggggacaacaacaaagacaagattcttggtatagcatacccacatccattcttcttccctaaccctctcaacatctctttctaccttcaccttcaacctacatcaatagcgaataacaagaacaagatgatgaagagcattgggcacaaaccattagccccaaaagcaaaattgaagaaggagaaggagcctacaaagggtggcccctcaaatagagctaaatgttcagcatgttcaccctcaccaccaccctctccaaagcctactctatggtttgtagaggagcactatgaggtgtcctacaagtttagctttacaaagaaggagctaattcaacccaagtttttctacactaccgctcatgttgatggtgagtcaagttatctatgtgttgaagtgaaggggaagcaaattgtgatcacccccgaactatgggaagacattgttggtttgtattcagaggggatgatggccaatgagaaaggcctcaacgatgttggagtgaaattcaacaaggtcactaggcaagggaaaggaaagatttggcattggccccttgtagatggaacaccgacttttgtcatatttgattgtttggaccattactcccaaggggagcaatcatgcataactgaccgaggaagatctacttctcatttattcgattacaaaagccaattttag

SEQ ID NO: 75193 - DNA, 246 bp, Glycine max
  Peptide Sequence Number=SeqID_191971
atggattggttatcgttcaaccatgttcttctcaactgtaaaaacaagaccttgatctttggtgcttgtgcccaagatatcccaagatcttcaagtttagagatctccaacgagtctcttggtattggagggatgcctgtagtatgtgaatttcctaaagttttccctaaggatgtgactaagttaccacctgagagggaacttgaattcgccatagacctactgcttgggtctagtcctatatga

SEQ ID NO: 75194 - DNA, 333 bp, Glycine max
  Peptide Sequence Number=SeqID_191972
ggcatcaactgcttaattgaatttataagttcatacccgatagcagtagccaatgtcggaagaggagccgttggtgctttagttccgcagctcttgcctgagacggaaagttggcaaaggcttcagacgcggtctccggctcaaggtcaatttatttttgagttcccggcccaagtcaaggcgatgcaatactcgggcgataaggaagaagcagtcccaggccttaggtccagaccagatctgagaactttcgagatggctagtcctggttctgttaagggcctagttctggacttgctcgaccaagtcttaaaggttggaagtagattgtga

SEQ ID NO: 75195 - DNA, 216 bp, Glycine max
  Peptide Sequence Number=SeqID_191973
atgctttatgacactttgaatgacccccttggaagccaatttgaacgtgccaagccataccacaaatggttttgggtggatgaggatgttggtggtttggagggaatgaaggctcgtggtgaaagggtgcctaaaggaagaggcgtgtgggtggaaaggagaagggggatcagcatagaagagaaaaggaaagagaaagtgaaagagaaagaatga

SEQ ID NO: 75196 - DNA, 345 bp, Glycine max
  Peptide Sequence Number=SeqID_191974
atggaggaagagggatgcctccatgcacattttggatacatttggtgccatgtttcgcagttagatgagccccatgttccactgatcaccataaaggcaaatttctttgggcacgatgtcaacgagaggcctagtagaactaccgtcctccaggacacggccgttgaagtttacgaggatgtgagagatttcaacgatgatgaggatctcacgttgtctgagattgcctactaccgggatgttattggtgaagagatacctgagggagagatgtttttatccgacgaggaacgtgattccttgggagacgagagtgaccatttcaaagatatgacttcaccctag

SEQ ID NO: 75197 - DNA, 378 bp, Glycine max
  Peptide Sequence Number=SeqID_191975
atggggtatggaggcacctgtttggagcatttggaagaacagaaattttttggtgctcacagcaaagaaaggcctagaagagatgatggaactggtgatggtccagtagttgcagtgcaattctgcatcggcagggacaaggggtatgatggtatgcacaaagtcccacatcacttaggagtcaaaaccaaggacctctccactcacatcgaggtgccttttaaggacaaaaccaatgaggccactcttgtccttagcctcgatcaggaggctagttccggtagccatagagtctcacatcgcttagaagtcaaggtcaaggatagcaccctctctcctcaaacccaccgaggcatcttacaagggaaaaaccatgag

SEQ ID NO: 75198 - DNA, 330 bp, Glycine max
  Peptide Sequence Number=SeqID_191976
atgattcaaaaagctattgatgaaggaagattgaagtttgaagaaaagcctatgcgagccagttatgttgagcccgtccaaattcttatggttgagacaaccttatatgaagaggaggttaaccaagcatttgaggacttcgagaaggaggaagaatttgtgtttccacctactgaagagaaattactcaaatttctggtgaagaagcaaaaggtagaaaaggaggtgatgctttgccctcgatatagtgctatctttgacaagtttactacaaaatcttttgaagcttctgatattcaaaaaaacattatcagaagattcaagaagtga

SEQ ID NO: 75199 - DNA, 396 bp, Glycine max
  Peptide Sequence Number=SeqID_191977
atggaagataaggagcttgaaggaacaaaagacgtgtgtatgatattgattacaaatatcgacaaagagttatgtccactgacaattacagagttcttaaggagacatacttctgtatcagccagggtcgttatttttccaagtttttcaatggaggtatataccaaaggagccattatggtgaattctacaagagagttccaagagctgtgtgactttttgaataatcccaaccgcatcataacatcttcaactggcaggccttgggtgatacttgaaaaggtagtgggattcaaaaatattaaagcatcgataggagcattggtgcatacatccgaggtagatttcataccccatttccttccctcctttttaccaacaaaaagaatattttag

SEQ ID NO: 75200 - DNA, 201 bp, Glycine max
  Peptide Sequence Number=SeqID_191978
atgtcttttcatagcccttcccaagcccgggttaaggaggagggttatattaggctctcggcagccaaatctaatgctaggtcgttgctagaaaataacgtgctatatcgcccatgtatagtgtccagtgttgttaatggcggatggcggttcatggcggaaagccaaaaatccaccataaaaatatggcggatggcgtag

SEQ ID NO: 75201 - DNA, 819 bp, Glycine max
  Peptide Sequence Number=SeqID_191979
atggcgccaccatccacaacccgcaacgccaccgctatttggtggcggtttttcaaattcccgcaacgctattccgccatggcgccaccatggtcgctatttgataacactgatagtgtcaaaagagcaagggccgtagcatcagtgcaaaaatgtagtgttaaatgtgcaaggactctcacattttcttggacgaatctgggttttaagctatggtacaccgggaaagttagaggaaagaatggagtaggtactatggtagacaagggattgatattccatgagaaatttttcttaggtggggatttaaatggacatgttggtattcaaaaaaggcaatttacaggtgcacatggtggttttggttttagagatctaaataaagaaggccaaacaattattgacttctctatggcttatgatgttaagattatgaacacttgtttccagaaaagggaagaacatcttataacttataaaagtggaagctcaaggtctcatattgatttctttttggtgaaaagtgttgacaaaagggtttgtaaggattgtaaggtagttgggaaacaaggcaatgctaacctcatttgggatggtatggcaaagaagataagaaaatttgtcaaagcagtcatgggtgaatcaaaaggttttgggttaagagataaggaatcttggtggcaggatgaaaaggttaaagaaaacgtcaaaaacaaaagacagagcttggaaatcttgctggggtgcaacaatgctgaaaattggtcaaggtatcaatatgctgggaatgagacaagaaaagtgataagtgaagcatga

SEQ ID NO: 75202 - DNA, 219 bp, Glycine max
  Peptide Sequence Number=SeqID_191980
atgaagaagactgtgactgagataactgagtatttggaactgggtgaaggaggtataataggtacgatggaagtgggtaaatttgtagaagtggacaggggattggtggaaaccgcagtgtatgctggattcactacaccagcagtgcaatgtcctcactcacaaacagcagaggaatcttcaaagcaacaaggaaatgctgaagttgatgagccttaa

SEQ ID NO: 75203 - DNA, 225 bp, Glycine max
  Peptide Sequence Number=SeqID_191981
atggatctcagagagggtcaaactcaaccaatcttggatcctaaccaaccatctcatgtgtatcatctggctttggatattggagtgatgaaactgggcactgaaagtgttccgtctgaaaacttcaaaattttactttgcctccctgaagcaattggttgggccaacgtctataatcctgctgaaaatatctgttcttctgatgggtgtgcctgttcaggttag

SEQ ID NO: 75204 - DNA, 543 bp, Glycine max
  Peptide Sequence Number=SeqID_191982
atggcttccgcaaacaacaattcttctctgcctcctcctctgctgcctgttccaatgctggcgccgcgctcccttgtctttttctcgcacgttgtaatggcgaaactcacggatttcaattgccttctatggcgttctcagaagcagttcttcctcgcatcatcaattgtgcaacctcgtggcatctgtgggatcgattgcacgagcactttcaatccattgcgcggtaacacacactcctcctcaaactatgattctgtgtatggtaatcaagggaggggtgatggtggctgttcgtacggtcaaggtggtcgtggtggagctcgtgggagagggtgtggcagatttgctgatgttcagtgtcagatttgttgcaaatttgggcacgaagcctttcattgctggtacagaaatgatacaagctactcctccaatccctctcaaccaaattcccaacccaattcccaaaccaattaccaatccaattaccctaaacagaatcccaattcaccctatccttactcaccttatcccttttactga

SEQ ID NO: 75205 - DNA, 591 bp, Glycine max
  Peptide Sequence Number=SeqID_191983
atggggttgacattcaccaagcttttcagccggcttttcgccaagaaggaaatgcgaattctgatggtgggtctcgatgcagctggtaagaccaccatcctgtacaagctcaaacttggagagatcgttaccacaattcccaccattgggttcaatgtggagactgtggaatacaagaacattagtttcactgtctgggatgttggtggccaggacaagattcgtcccttgtggaggcactacttccaaaacacacagggtctcatttttgtggttgacagcaacgacagggacagagttgttgaggccagagatgagttgcacaggatgttgaatgaggatgaactgagagatgcagtattgctcgtatttgctaacaaacaagatcttcccaatgcaatgaatgctgctgaaattaccgacaagctgggtctccactctctcagacagcgccactggtacatccagagcacctgcgcaacctctggggagggtctttatgagggtttggactggctttccaacaacatagccaacaagttgattggagatggtagtaaaattgatctgtgcattatacaagctgcttga

SEQ ID NO: 75206 - DNA, 520 bp, Glycine max
  Peptide Sequence Number=SeqID_191984
gcttctaaagaggtgcttctacatggcaaagttggtgaaaattggcctctaccatttttcaaatttgctccagcctttgcagaagcctgctgcttgtgtttccaagtcttctgttaatactgttgtttctaattctgtcaatgtagcttccacatctagtgattcctactttgtttggcactctagtactgatgcagagtacaggagtttagccttggcaacagctgaagtaacatgtattcagtccctgctgactgaactcaaagttcctcatgctccaccagttattttctgtgataatatgagtactgtttcccttgctcataaccctgttctacactctcgcaccaaacatattgagctggattacagaaacactttcctctctctctctctcctccctaaatctctttatgttggagttagtgaaattgagcttggatcttcttctcttttgagggtctggtgttcagtgcaagataatggttttatgaacttgtggtttacccttgtgcaatga

SEQ ID NO: 75207 - DNA, 201 bp, Glycine max
  Peptide Sequence Number=SeqID_191985
atgacggtgttttctttcaaccatcccattttgatgatgggtgtggggacatatgcgtctatggacaataccttgatcagcaaggaatcactagatgtggaagctacattgacagaattagaaacaacagtattaacagaagacttggaaacacaagcagcaggcttctgcaaaggctggagcaaatttgaaaaatggtag

SEQ ID NO: 75208 - DNA, 1971 bp, Glycine max
  Peptide Sequence Number=SeqID_191986
atgggaaaattttctcagaatgcatggagctgggagttcaagtggagagggagattatttgattatgagtacgcgatggctgttgatttcatggatgaaatttctgatatctctatccagaatcaggtccaggataatatgatttggaaagctgatcctagtggtgtctattccactaagtcagcctataggctcctgatgccctccatcagtcctgctcctaccaggaggaattttcagatcctttggcatttgaaaatccccccaagagctgtggttttctcttggagatggatccgggctataggagctcttccagctgatccggctagccattttatccaattctgcgatggatttgctgcaaggagtaatcacagtaggaggggcatgtggtggattgctttatctattacaatatggcagcataggaactctctcctgtttcaaggcactccttttgaaccgcaaaaagttttggaggatgctttattcttagtttggtcttggataaaagttggagacaaaggtttcaatacatcatttaaccactggtctaccaatcttgtggaggctcttggtggcaccttcgtgccttgtaattgttaccttcagtacctctggcgcaaccttgaccaagctaagagcttgttggaagcattgatcaagagggaagagaaaaaaagagaagtaatggatagtgaagttacgttgcagaggatgcaaatgaagtacaagcatgaaactgagtttttggaagacaacattgcactctctggatttactcccttcacttccaagtttgtttccagtgaagaggaatatttcgattcagatgatgtcatgacaaaccgtcttctccgcacacgttctactgctttacagtctttcccttctcatgaaaccaacattcccatggttcctgccgctagcacaaagcaagagtttaggaggagatatgtcccacatggatggcctcataaactggatccacttgagccagttttattgttcaccaaacctctacttccagataagttggccatggcaggcattatgccacctgattcaatcacaccaaatggaagggtgtcaccaccgccgtatagatatcgtggaagaatgggtagaggtggccgtataatatttgaccgatggaatccacttatgcaaacaccaattgattgtgttgaagcatgcttgattgtgtatgatgatgggaatggtgacattgaaccagtgacttgtcccaaagaccctgtattggcacactccatacttcaaaactatgagtttcaaaagaatcagagacctcccaagaagtttggtattcaggactttgttgaggataggaagaacatcattgaagctgagatttccaaagtgcataaagagatcaccaacatcaagtatccaacttcggatccaagtttcataaacatggaagaggatcaattgagggccttcattgctctggtggatgctaagattaggacctgtgatcattctttgaaaaacatgcatcaaagtgaagccaacttcatgcaaaacatggcttggggaagtgcttcctcctcccatcctactcctatggagccacttaataataatgggagggtggatgttacaaactcaatagatcaggtttatgaagctatgcaactagttgatgctccctttagttacattccagacatggttcagaaaagttttaattgcttgcaaaacatctctcaaagccaacccatacttgatgttgaggatgagatggtaggttttagtaatagagttgatgtgtcactggatacaactaatcaaattgctgacttgttggactggtttgatggacctattattggttggtctgatcttgtggattggactagtcaacctgatgaatctcagaatgagcaacaaggtggaggagatttggatggatttcaaacagaatgctataatctgaatttctga

SEQ ID NO: 75209 - DNA, 579 bp, Glycine max
  Peptide Sequence Number=SeqID_191987
atgggtggagctcagttgacaacacaagttgagtttgtttgtgggacaggatcagtttttaaaaaccttggttcaaagtgtcaccaagttctgaacagagaattattacctcaaggtcccatccaagacccaaaggtttcaattacgatgagaaaaaaaaaaagaattgagaaagtgaaccttggctattccttccccgacggccttctcgtagacaatgtcggtgaagtccttgccggagttgtcgtggtcggaggcgacgatcctccaaacgacgtcgtgggatggaacttctccgtggacgcggcggaagctgttgttcccaccggaagtgaggcacggggcgagttcgccgggtgcgttgtgataagaagaaggagtgaggtggttggtcacagaggcaagccttctggtggcggtttcaaggtggtggttgttgttgttctccgccataggattgtgagagctatcggaagtgatcaccaatggcgtgcaagaaagattgtgaagctattggttggttttatacattccattcgttcattgacattcccaggtggtcgtggcgggtggggataa

SEQ ID NO: 75210 - DNA, 273 bp, Glycine max
  Peptide Sequence Number=SeqID_191988
atggaggatgaggagaagagagccttgatggtagaaatcgatgaggagtgtgtgagccctaacaagagcgagcaggagaaggaggatatccttgagaagcacaacatgaagtcggtcttcgcgttcaatcccaccttcgacaaccgcgacgttctgttccggttcaatcctagaaatggtaggtcagttttgacgtatagggatgttgttgttgtttacctcgatggagaacttaaggtttttgttgttgtttttggtattgggagtgagtga

SEQ ID NO: 75211 - DNA, 430 bp, Glycine max
  Peptide Sequence Number=SeqID_191989
atggtcagatttgattctaacatattgctcaggcgagagtgtgacaagaagaatcaatcagtttataatgcaacatatacgattaaatatttacatgaagctggagcaaatgtcatcttggtcagtgattggaatatgaatactccagaatttcacatagagtcagtcgcagatttcgtatcagaagttcttcaaatacaagttgttccacttcatggaagttcttttaacaagctatcaaagactaatggccttgagaaagagaatatccttcttcttgagaatctttctaatatcaaagaggaagttgctaatagtttggagtttgctagagtattatcgtcaggagttgatatttttgtcaatgactccttctccaactctcataaagttctagcatctactgttggtgtcaccccgtttctgctat

SEQ ID NO: 75212 - DNA, 526 bp, Glycine max
  Peptide Sequence Number=SeqID_191990
aaagagaactgggaagagatgcctggattgcaaggagatcatggatctcatcaaggctgctggactgctgaaaacagtcaccaacatcaaattgcccaaaggaaatcactgccaagcaagtccagcattggccaaagaaaagggaaagctttctgcagggaagctaagtgtgaatcaacatcccaatatcttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcctgatcaaaagactctcagacaatggcattgatgatggagaagcagctgaggaagaagaagatgcagcagaggatacagaatcagatgatgatgattctgatgccaccccatga

SEQ ID NO: 75213 - DNA, 2592 bp, Glycine max
  Peptide Sequence Number=SeqID_191991
atgaatcctgccaattgtaaaggttggctaaatggagtgggaacgtccactggggctggtggatggaatgctggaggggcatcatccactgggggtagtggatggaatgctggaggggcatcagccactgggggtggtggatggaatgttggaggggcatcatcaactgggggtggtggatggaatgctggaggggcgtcatccactgggggtggtggatggaatgctggagggccgtcatctaaaagggatgcagggtctaatcattctgctccaagcttattgaatacagaatctacctcaaatccattcagttccaagggtgcagaagattctgcttgggaaactaaaagtaattctaataagacctcctcatggggtgctgcagtggataagactggaattgcttctaatgcagatcagtctggtggctggggaagtggtggagggagctggggtcaggcagagcataaaactggaagtgtgggtgatggcaatcagaatagcaattggaatacaaccaaggcttctgaaggggagtcttctggttggaacagtatccaaaagtcaaatgaaacttcatcagctggatggggtggtggcaatgggtttaaaagtggatcagatgaaggaaacttgaattctacttggagtggctggaagtctggatcaagtggagtcaaacaagctgggaaccctgctggtacttcagatattgatgctaatcaggatgctgggtggaaaaacaaaccaaataaggatgggagtgagtcatctggttgggaaacaaaaaacaattggaatgctccagtctcttcatcaaatgataaagtggaaaaaggtaatgatcaaggtgggtggaatgcaggaaaagcttcaggtggttcggctgtagatttcagtcaagcttctggttggaaaggggggctgagtgagcacacccaagaaggttctaattggggcgacaagaaatttggttcatgcgatgcatgtggtgattccagtggaaatcagggtagtaatggttggggtcagaaaagcaattggaactctggatctaggagtgggaatgagacccaaaattctcactggagttctgggcgtaatgagcctggaaatcaagattccaacttggacaagaaaagcaattggaactctggaaacagtggaaacctggcttccgatccaaaaagtagcaattggaattctggatatgaaaattccaactggggaaccaatgtcaataacaaatcttcatggggtactggaaatgaaaacaagaattccagctggagttctgggcatagtgatcctggaaatcaagatgccaatcagggcaagaaaagcaatgggaactctgggaacagtggtaaccagccttctgatcctaatagcaattggaactctaacaaatcctcttggagtgctgggaatgaaaataagaaatctaattggagttctggggatcctggaaataaagattctaactggggcaacaaaaataattgcatttctggatctggtgatgctaatcaaaacaccacttggagaagcaatagcagctggaacaccgcaaatgcctcaagcgatgatggcaatgaaggttcaaatgaaaattctgatggagtaggtggtgggaactggagaggtggttaccggggtagaggtggctctgacagagggggttttagaggtagaggttttcggggtaaaggagagcgtggcggtttcagtggacgaggggagcttggaggctttggtggccgaggggaacaaggaggctttggtggtagaggtggggatcagaaggaggacgtggaggccgaggcaggggaaggaacgatcaatctggtggttggaacaacagaagggattctggtgaggatgggccctctgactggaagaagggggcagataatggtggatggaagaatagtaatggatctcaggcttggaaccaggatactggtgacaaggataggcagagctggagccagggaaatgcagataaggagcatcctagctggaaccaaggaagtggaagaaatcagagctggagttcagcaagtggagctaatgataatggatctcaggcttggaaccagggaaatgcagataaggagcatccaagctgaaaccaagctggaaataagcagagctggagttcagcaagtggtggagactgcagaggctagctggaaaaaatctacaactgaagggaccaatatccagggtggtgggtggaacaagggatctagttcaaacactacttctaaggatgagaccattcagacacttggttgccagtgcttatcaaagttcatctactgtcaggtggatgctacttatactcataacattgaaaagttggtgccgaaagtgtgcatgctatcacgggaacatggtgaagcatgtgaaaagcgctgcttgagtgcatcaagcttgcaatgcctttcagcaatggtttggtttatggccgaattttcacatatttttgtagattttgatgagggagatggagagaaaatattgatggtagggttgaagggtttgaatatccctgtagtcaatacagatcctgagaaatgttaa

SEQ ID NO: 75214 - DNA, 282 bp, Glycine max
  Peptide Sequence Number=SeqID_191992
atggtgtcggtcgaaggttcgtcattgagggactcgattggaggcgagtttgaggttcgagggtatgatgacgtagtttttgatgtgtcatctaattcctactccttaggatcgattttttctagctcgagtgacctctcggcatttgaggggtctaatgaccttttggcctttttgatccagcttccgatgaatacgaccaaaaacatggttgaaagcgttgctactctagtggtgaccaccgttgccgaagtgaggacttcccagagggctacttcttag

SEQ ID NO: 75215 - DNA, 396 bp, Glycine max
  Peptide Sequence Number=SeqID_191993
atgtcatcttcctgtagagatagagcacagagcctactaggctgtaaagaccctgcaacttctctattgatcaagctggagaggaaaaggaagttgcaactaagtgagctagatgagattcgtttagaagcctatgagaattccaatttctacaaggagaagaccaagaagttccatgacaacttgatagctaagaagaacttcgtggttggacagaaaattttattgtataactctaggctcggactcatgagtgttgagatcaaaagtgaatccacagataagagcttcaaggtcaatgggcaccggctaaaaccattcctcacaaatccttccttggtggatgtagtggtggaagagacctccttacttcaccctacttttcttccgccatga

SEQ ID NO: 75216 - DNA, 372 bp, Glycine max
  Peptide Sequence Number=SeqID_191994
atgaagagcttcaacggagccccaatcactgccagaataaacccagacgacataaatccactgctgccccttctttttttgaagacaaattctccaagaaacgcagaaatcaagcctcaagcttttatctgctctctcacctcttcactcgcccaagcaggagagaaaagagcatcaacaggaggaggctactctgtctctcttggtttctctctcctctgtctcagagtgtcttctatgcgtggcagtgtttttctctcacaggctagctccgttacgaggatccaacgcgaggtgaaccacacgcgcgtgaagagagattgggagaacgaaagtctcgggggttgcagctttttgcgccgccaacggtga

SEQ ID NO: 75217 - DNA, 462 bp, Glycine max
  Peptide Sequence Number=SeqID_191995
atggcaggcaacagtggtgttccaggaaaccttccaattcttgatggcaagaatttggatcgatgggacatccttgcaaagtgttacacgggtggagataaggtgagaaaggtgaaacttcaatctcttagaagacaatatgaattactgcaaatggaagccagtgaaagaattgaaaattacttcgctacagtattgaatcttaccaatcagatgaagagttatgagtccaaagatgttgaaagcatgaaaattgaagaattgcaaggttcattggaagcccaagaactgaagttaatcgaaagagaaagtgtgaaacctacagaacaagctctacaggcccaaaccttccaggaagtcagaaacagtgaagaagaagccaatgaggctcaagatggagattctgtctctgatccagtaactgctactggtgactaccagtggtggagatcttcattttga

SEQ ID NO: 75218 - DNA, 225 bp, Glycine max
  Peptide Sequence Number=SeqID_191996
atggatgtcatctttcatgaaactgagtcattctttgtcaatcctcgacttcaggggaagagaaatctagaagtcatagaagctgaagacgagtctactttagagtcattacccttgtctttacaaggtgcccaaggagccaatggtgaaatcacaaatgagataaaggaggaagctcataataaagctgaaaaggaaaaacgtttctttggcacgatatattga

SEQ ID NO: 75219 - DNA, 252 bp, Glycine max
  Peptide Sequence Number=SeqID_191997
atggataagagcttgaaggtaggagaaaatgagtggagggataaggagagaaggagcatgaaattttgtgcctcaaataaggctcatgagaatcctagggcattgtcttgtatctctggcccaatcttcttggagtcttctatccaatgcccttggtgggtagaattgcatcattccctccctcttgaaaaggatttgacctcaaatccagaggttcttgaagctctgagcttcttccctcaacacctgtaa

SEQ ID NO: 75220 - DNA, 369 bp, Glycine max
  Peptide Sequence Number=SeqID_191998
atgacgaacgaagaataccgaacgaagaacgatgtagaagttgattacggtcacaattcggaaatgacgggacttggtggacttgcagctcgcctaggcgagctgatgcttcaatctgaagtaaccttgctcaccctggcgagctggtcaaatccttttcaaggcggagggaatgatgaaatcctaccccctagggcattggataaaagactccaagaagattgggccagagatgcaagacaaggccatagggttctcatgagtcttaggggaagaagctcagagcttcaagaacctctggatttgaggtcaaatccttttcaagagggagggaatgatgcaattctacccaccaagggcattggatag

SEQ ID NO: 75221 - DNA, 696 bp, Glycine max
  Peptide Sequence Number=SeqID_191999
atgctggcaacagtgaaggagggaaggacgacgacgagtgtggtggcggctgaggaatacacgacggagttccgagcctacaatgacgacgcctggtacacggtgcgcgttttgctcgaaggagagagactcatagtgaagtaccagaacttctccgacgaaaacgacgaggcgtttgagccctcgcggtttggggattgtgaggacctcgaggacttcaaggagcgcttcaggccgctctccagacagctccaggacgccgagtgtcgtcggttcggtcccggcgctagggtctgcgcttgccactccttcgcccccgacgacgttcgcttctacgacgccgtcatcgacggggtgcaagaaaacgagcattcttgggaaataggagaggaagaatgcttgtgcacctttctactttactggttgcatgggccaaatgcaagaaacttgactgctgaaccaattgataatatctgtgaagttcagtctgcatgggagctagatcctgcagtgacttcatttctggatatggcagggaagaaaatacatttgttttcttctcgttatgttttagcatcatcaggagtttctggcctagaaatggggccgtactgcaacggaagctcaaacactactcatagaatgagctattttgaacgaatggaaaaggcaagtagtatatgcatctttttgtaa

SEQ ID NO: 75222 - DNA, 285 bp, Glycine max
  Peptide Sequence Number=SeqID_192000
atgacgaaagacaacgattggtacctcaaagccttacactggggcaatgaaaggcaccttttgtcaatcgcggccaacaagaccgttgacacgcggagatttacgtcatcttccgcgcagacaaattctgtcatactgacactggagtcacgtgacatgcgaagatacccgagtgagacagactctgcgccctttatcattctggaacaacaagctgagtgggtaaatgcgcagagacagactctgcgccctttatcattcaagcacaacaagctgagtgggtaa

SEQ ID NO: 75223 - DNA, 270 bp, Glycine max
  Peptide Sequence Number=SeqID_192001
atggtaggtcttgataaatttcgcacttctttttcatcgcaagtttttcactcacttggaacccagagaaaaatcactctttatctctctcccacttccggagttgttcaacttgggaaagtggcgcatgaatcccaacctaggtctgaaattttcagatctcttactttaacagggggatcaaattcgaaattggagataaattggtggaccaaaagtgcaattttgcctattttattcataaagctcaaactcgttaaccagagttga

SEQ ID NO: 75224 - DNA, 444 bp, Glycine max
  Peptide Sequence Number=SeqID_192002
atggaggttgccaagcaaactctcaactcttggagtagcaatgagcagttgcttgctcgaaaggcttatgactacatcagaggggccaagcctgctatcaattggaattctgttgtttggaatcctgtcattcctcctgagatgtcttttatcttatggcttgctaccaagaaccgtctgctcactttagaccgagctgctttcttgaacaagggtctactctgtcctttgtgcagaactaaagcagaatcccatgctcatttgttcttttcttgcagaatctcccttcgagtctgggccaatatccgtgattggattcctctccataggcaaacgatttcattacagcgcactatcaattccctcattcgtggtagagccacctctggtacttggggcaaattttggtgcttggcttctgcaactacagtttactacacatga

SEQ ID NO: 75225 - DNA, 1968 bp, Glycine max
  Peptide Sequence Number=SeqID_192003
atgggtacgacttctgggtcaggtgaaactcaggagtcttcctcaactagtttgtctggtggaattgttggaggccaagacactccatctgcttgtttggcttcacagaaaaatactgcaccccaggtgttcgataaaaagcctgggtcattttctgcatcaactagagttccagcacaccaggtgtttgttaaaatgtatggttgtctcgcaggcccctacttcatcttccaaaggccccttttactgaaagtcatgcctcctttcttcgattttgaccacctcactgcctctaagggatctatttcctttgctagagaattggtggaagttgatgcctccttagatcttatcaaagaggtccgctttaaacttcccaccgcaaagtacaaagttgtttctgtagttaagcaagataatagaataaccacatcagaagggcctacagcaggttcaccctctgttcaatctcaagatgctaaggtggtagcttttacggagaccaatcttactaatccctctgggaaacccaaggaagaccagacttccaaaagttctttgcatcaggactcaactgaagatcctggtgatgggtttgttcgggacaccatgaaaagagagtttggagattggaatttctctcacaactttgcttctcacaatgctggatatttcaacaatatcctctctcccaatgaccggttcaatggcgttgacatcagtgcttatgagatgcaggattttgctgattgttgttttgagcttgggctggggaaccttaacagtcacgggtccatgtatacctggactaatggtagagtttggagcaacttggaccgggccttctgcaatcagctatggcttaactcctttgaaaactcttcttgcaaagtggtggggtttgaatcaatttctgaccacgctcctttagtggtgaccacaaaggtgttggtgcctagagatggttggagtcatcaagtttctggatgttgcatgtttgaagtttgcaagagactgaaaactcataaagctcctttgaagcttctctttaaacaagaattcagtcacattggtaaccgagtggaacaagctgaagctgaatataatagactgctcaatttcctccagtcaggttatcctactcaggaaagcagagtcaaggatgtagctcagctcattagaaacagcacatcctctcaatccgaaattgctaatgcctttgtcaatcatttcaaggctttatttagtgctcaggagctgcatcattctgcctctttagcagtctacaactcggggatggacaataataaagtgtcgggtcctgatggctacaatgccttattctttaagaaggcttggaacatcatagcggatgacatttttgctgcggtcaataagttctttatgtcaggcaaactactaaaacaaatcaatcatgctcttattgctctcattccaaagtctgaccaagcatcccaagtgaaccattttagactgatctcttatagcaatttgctttacaagattatttctaagattttggccaaccaaatagccccagtgctggagcatattattggtgcatcccaatctgcgttcctaaagaataggaatatgatggacaacattttccttgttcaagagctccttcgcaaatatgctcgcaagagaatttctcctagatgcctcttgaagattgatttacataaggcatacgattccatttcttgggagttcctggattggatgcttaagtctatgggtttcctagctcagttttgttcctggattatggaatgtatcactaccacttcctttagtctggtggtcaatggatccatctatggtcatttcaaaggtcaatgtggattaaggcaaggggatcctctttccccttacctctttgttctctgtctagaatatttttcttgtgatcttcaaagcctcaaggataacatcaacttctag

SEQ ID NO: 75226 - DNA, 624 bp, Glycine max
  Peptide Sequence Number=SeqID_192004
atggttctttttggtttgcttttgttgtccagggttttgaaagaccggtctttttctgggactttcgttttactgcgttacccagccatgtctcgaaaggaaaatctcatatctgagttacatatgagaaaaggaacatggaagatagttgtccgtatcactgatctttgggaagttagaaagcaaaatagtaaacaagcaattgagatggtgtttcagggtacaaagattggtgctactctctggcaagaattgttcgctaagttccgacacaagattgttgacaaccagtctgaatacagagttagcccagttccacatttggtttattttgtcagaactacgtctgtcaaggagatccagcgtctagaaattcctcctaatgtctacatgagtactccgtttgctgatataatctctggggtggcaccatgtcatactttaatggacattgttggggtggtcactgatctcattggtgttaagatagttaatccccctcacaggatgacagtcagactcagaggtaacagtaactcggacatcataatgacttttgggaggactatgctattcagcttcatgatgctattgacaaaaaccttttgcttcaggaaccattga

SEQ ID NO: 75227 - DNA, 171 bp, Glycine max
  Peptide Sequence Number=SeqID_192005
atgatgggagtggtgaaaatgacagtggtgacaatagagacaatagtggcagggttggtggcaagatatgatagttattctaccctatcttattctatcttgaccgccaaatgggtagtcaagatccatggcagtaagagaatagaatatgaagcggtagcaagatattaa

SEQ ID NO: 75228 - DNA, 375 bp, Glycine max
  Peptide Sequence Number=SeqID_192006
atggtttttcacttaaggcttgtaatgagcttcaaaacaaagaaaggggaacataggctcaaagaggctatcaaaggaattaattcaaggaagcatcaacaagaattaagccaaggctattgtgcaagcaatcaatggggcaaaacacaccaaaagattatgatgatggatggctcaaattctcacaaagtaaagaaggagataggaaagaaaaactctctaagtcatggcagaagaagagtatggtggagtaaggaagtctcttccaccactacgtccactaaagaagggtttgtaaggaatggcttaagttggtgtccattgaccttgaagctcttgtttgtggagtcgcttctgatctcaactataccataa

SEQ ID NO: 75229 - DNA, 933 bp, Glycine max
  Peptide Sequence Number=SeqID_192007
atgattgcggagacaaagccctttggcagcgacgagaatggtgaagaggaggaggaggaaggggtggttgagatttgtgtccctgaccgtggcagcacacacaatagaaagggagaagcgaatgtcaaagagaaggatgttgcgactggatggctttgtgagaccggcaacgtgatttctactattggtggaggcagtatggtttttgctgttggtggtggtttaacagaggaagaagatgggttggttaccttgggaagcaaaggcgacataggtggtgacttcgcaaaggcagaagatggagagggttgtctgggtaccatggtattcagtatccggagaatgtcatcaagtttggaagcaatggaagtttgggctgcagtggtggaagtttggattgcagcgagtttggccatggcggcctcaagacgatccacacaggcggtggaaagttcggtgtccgccattgaagagtggcaggacttcagaagagtgttgggtattcatgaaggcctggtggttcattttgctgcacccgatagaaatacaagcttttatctgcattttatgccaccactagacagacaaacatctggcaggccttacagtaccaccagaacatatgtctttatcgttgatattactaatcatatcatctctactcctacacctctggtgttgccacctgatgctgtggatatcattgggtatagatctcaatatcttactgttgaaccaccccgtggtcgtcagatttggtggatgtctatccaagatgggctgcaaactctcactacaccttggtaccaattcctaaaggacaacaacttgatggctcgagatgaggttatcttttattaccaaccaaaccaaggtgtatgggaaatcatcctgaggaaggagatcggatggaatgaagacgagtccacctaa

SEQ ID NO: 75230 - DNA, 309 bp, Glycine max
  Peptide Sequence Number=SeqID_192008
atgagaatccaaagaataagattactgcagtacctgcttaggaagaggaaatctggggtggattcttcaagagaatcagtgatcagtcccaacagtaatataaggttaatgtcagttgagactgcattaggtacaaagggaaaatgtgaggccagagacaatagaataggagttcataaaaagcccacacatacagcgaaaatttcactaaacggaaagcgtagtgtccaaaatgaattggtaatcttagagcttaagaatttagagttgaacatccattatgtagctaggattgccagttgcaactaa

SEQ ID NO: 75231 - DNA, 784 bp, Glycine max
  Peptide Sequence Number=SeqID_192009
gtggctgcagaggccaataaactgctgaagtataatcctaccattggtgtagaagttgtgaatggagggacaagacttactttagaacagaaacggatgcagccaaacccttgccaggctggtgatcatatctgggctttaaggtacatcctcgaggtagttccttttcttctactaggagtggagtatggccacctaattgctggaaacttaatatctgagggcttcaaatcatggttgttggacacatggagtgcttgcactcacaagaagaaagtgatggcatcagcactcatggctttctggaatctatcttctaaaatagaagtaatcggtgttaagataacctctggttccaatagatcaactttccttaggtgcttggagtttaggtgcctcaccaatatgacatttgagtttgtgtccccaaaccttaggctcacaatgttcgaggtttcagctccccttgtgcatgtggtttctatggtgatcattggttttcatattttgtttctaatcactgctgatgatgatgattctaatcactgcctagccttcatgttcatgaatttggtgaatccttgtttgataacagccaatgtagttccttttcttctactaggagtgaagtatggctacctaattgctggaaacttcatatctgagggcttcaaatcatggttgttggacacatggagtgcttgcactcacaagaagaaagtgatggcatcagcactcatggctttctggaatctatcttcaataaaaactcgaatgttcacag

SEQ ID NO: 75232 - DNA, 316 bp, Glycine max
  Peptide Sequence Number=SeqID_192010
aattggacaactcgctcaacgggcaaggtcaagctcagcacgcactctcgctcagtgggcaagtgcgcaagccaagcttagcgcaagaagtcccatgaggaaagcccaaggcgcccttagcacgaagggtgctgttttggctaataaaggacctaccatgaaggatggagttgagaaggatgaggacaatgaagatgaagagtatgatgatgactatgagagtgaatacataaaaagaaaaataagaaacaagctgccaatggcaccgggaataaacttggcaaagctgcagaaagttcttgctctagtaccatga

SEQ ID NO: 75233 - DNA, 2007 bp, Glycine max
  Peptide Sequence Number=SeqID_192011
atgctggtttcaacgctgaaaccatggtggagttggatgcaaaagcctctactccactccttcatcagagccataacaactcttacaccaatacctccacacacttttcttcaccttcacaaccccagcgacagtgtcatctacctcaagaaccgcgaaatcgacgctttcataaaacttagaaacctgaacgctgcactcgcagtgttccacaccacgccactgcgcgacactgtcacctacaacttaattatttccgcgttccgaaaccaaccaaatcacgctcttcgtttctacgctgaaatgggtttgcgtggaataagagaaagcccaaccacgttaacctctgttatagcggtttgcaccaacgctatgtttttcaaagagggtgttcaggtgcattgcagggtgatcaagttcgggtttacatgcaacgtgttcgtgggtggtgcacttgttgggttttacgcgcacgtgggggaatgtggggtggcactggacttgtttgatgagttgccagagagaaacttggctgtctggaacgtcatgctgcgtgggttgtgtgaactgggtcgtgtaaatgttgaagacttgatggggttttattaccctcggatgctttttgaaggtgtgcagccaaatggggttacgttttgttatttgcttagaggctgtggtaatcagagacggttggaggaagggaagaagattcaagggtgcgttttgaagatgggtttggtggaatcgagtgtttttgttgccaatgctctggtggatttttactctgcgtgtgggtgttttgttggtgcaaggaggtgttttgaggacatagaaaacgaggatgttatttcgtggaactcgttggtttcggtttatgcggagaataatatgttaattgaggctttggaggtgttttgtgtcatgcaagtgtggaggaaaaggccatcaattcgttctttggtgggtttgttgaatttgtgcagtagaagtggagagctttgtttggggaagcaggttcattgtcatgtgatgaagtttggttttgatgaagggagtgtgcatgttcaatctgctttgattgatatgtatggaaagtgcatggacattgagagttctgtgaatgtatttgaatgccttcccaagagaactttggattgtttcaactcattgatgacctctttgtcttattgtgatgcggttgacgatgtggttgaattgtttggtttgatgtttgacgagggtcttgtgccggatggagttaccttatcaaccacactgagggcattgtcagtgtccactttagcaagttttacgagttcccagttactacattgttatgcattaaaatctggacttggaggagatgctgcagttgcatgttccctcgtggattcatattcaagatggggccatgtggagctttctcgtcgaatttttgagagtcttccttctccaaatgctatttgcttcacatccatgatcaatgcatatgcccgaaatggagcggggaaagaaggaattgcagtgcttcaagctatgattgagaggggactaaagcctgatgatgttaccttattatgtgcactaaatggttgtaaccacacaggattagttgaggaaggaagattagtctttgaatcgatgaaatctcttcatggggtcgatccagatcaccgccatttttcatgcatggtggatctcttttgccgtgcaggacttctacatgaagctgaagagttgctgctacaggcaccgggaaaaggagactgttttatgtggagctctttgctgagaagttgcagggtccacaagaatgaagaggttggaacaagagcagcacaagtgttagttgagctagatccagatgaccctgcagtgtggttgcaagcttcaattttttatgctgaaatagggaattttgatgcatcaaggcaaatcagagaggttgctctatcaaggaagatgactagggaaattggtcatagtttaactgagataagacaatga

SEQ ID NO: 75234 - DNA, 183 bp, Glycine max
  Peptide Sequence Number=SeqID_192012
atgacaatgagtccaaggatttcattctcacatgacttctcccaatcggatgtcatcccagttgagaagcaccctttgagatcaaactcatctggcttgaactcaagcatggactttgatttctgtgttcgtgaaagcttagagcttgagtcctcttcagcagatgagcttttctcacatggg

SEQ ID NO: 75235 - DNA, 312 bp, Glycine max
  Peptide Sequence Number=SeqID_192013
atgcatttttatgagaaaatttttatatttatgcttcaacttcacttgggggtgaatagtggagctgcaaggtttgtcattgagcatcaggcagcaaatgagccaactttccgctgtccagatgagttaggatggcaaccgcagagtactcctatgttctgcatatccaaaactcattatttgtttttcaattttctttctcggcaagtcccaatagtccttgaggatggaggaatttctcgaaccagacagaattctatgcccgttgatgcaatcttgaaatccttgaagaagggagagcttatgacgtga

SEQ ID NO: 75236 - DNA, 2622 bp, Glycine max
  Peptide Sequence Number=SeqID_192014
atggattctaaaacacccttgtttaagggtaaaaattataaattatggacagctaggatgaaagcccaccttgaagcgaatgatctctgggaagttattgaggaagactatgaagataacctaaccatggctcagctgaagagtcatactttaaagaaatcaaggaagtcgaaggaaaaagctacattatttgatgttgtttcagaagagaattttaccagaatcatgcaccaaaacatagcatttgaagtttggaatttccttaaagctgaatatgaaggagatgacaaagttaaaggtatgcaagtgctcaatctaattcgtgtgttcgagatgcagcgaatgaaggaatcagagacaatcaatgagtacacagataagcttcttagcattgctaaccaaataaggctgcttagttctgaattttcttattctagaatcgttcagaaaatacttgtaacccttcatgaaagatttgatgctactatatctgtcatggaaaatagcaaagatgtatcaaaaatcaccttggcggaactaaacaatgccttacaggctcaagaacaaaggagactgatgaggagtgaagattttgtggaaggagcattgcaggctaacttacaaagcaatcaaggagagaaagacaaaaggaggagttttaagaagaatttcaaccaagtgttacagctggcgaaaaggagagggaatttcctccttgcaaacattgtaacaagaaggaacgatgcccaagcagtaagcgaacaagaggaagagcagcaactattcgtagcatcatattttacaagcagtagttcaagctctagtgactgttggcttgtagaaagtagttgtactaatcacatgaccagtaatgaagaactctttagagatttggacaagtcacaagtatccaaagttagaattggcaatgtcgattacattactgtcaaagggaagggaactgttattataaagagtagcacaagtacaaaacaaatttatgatgttttgtatgtacctaacattgatcagaaattactgagtgttgggcagctacttgagaagggattcaaagtcttctttgagaaaaagcagtgcacgatcaaggatccgtatgacaatgaggctactatgacaaacacagagacttggcataagaggctaggtcattttcatcacgtaacaattttgaatatgcaaaagaaggagttagttcgtggctttccccatattgagttcaatctaccaagctgcaaggcatgtcattttggtaaacaagcaaagcttcctttccaaaagggagcttggagagccaacatgaagctgcaactcattcatacagatgttgtcggacctcataaaactccttcactaaataggagtaaatattacattgcttttattgacgattatacaaggatgtgttggatctattttcttaggttcaagtcagaggaatacacctcaaatgaatttgataaattctttgaggagactggaattgagcatcaacttacagcaccatacactccacaacaaaatggggtcaatgagcggaaaaatagaaccataatggagatggctagatggctgcttcataagaaggaacttcccaaagaatattgggcggaggcaacaaatactgttgtacttttgttgaacagacttcccacaaaagcaattgatgggaagactccttttgaggcctgttgcaaggctagatacaatcagaatgttactagctattgcaacacaaaagcaatggaagattatcagcttgatgtcaagcttgcaaaaggagatgaagacaaggtgtatctattaaagaaggtactgtacagcttgaagcaggctccaagagcctgtgataatttttttgtggtatccttatatgtggatgatctcttagtcactggtagcaacattgagcttattcaacaattcaaagaagacatgatgcgagtctttgagatgactggtcttggagaaatgtcttatttcctcataatagaaatcaagcagagacaaaatgaaatattcatttgtcaaaaaaagtatgcagaggagattctaaagaagttccacatgggtaactgtaagagtatgagcactcctatgtgtcaaaaagagaagttgtgcaaggatgatggaacaactaaagtggatgagttcgaatatagaagtttggttggcttcttgatgtatctaacaacaaggccagatattatgtatgctataagtgttctttcaagatttatgaattatgctaatgagtctcatcttagagttgcaaaaagagttcttagatatgtcaagggaattgtaagcttcagtgttaagttttgcctgacaccaagctttgagttgcaaggttattctgatagtgattgggttgggtctttagatgacatgaaaagcacttctgatttttgtttcaacttcgaatcaggaatatttacttggagttcaaagaagcaagaaattgtggctcaatcaagagccgaagtagagttcatcgctgcaacaacttctctatctcaaacaatccaatttttcatggcaagaccaagcatttcagcatcaaactactcttcgtcagagatgtttagaaagatcgtgtag

SEQ ID NO: 75237 - DNA, 657 bp, Glycine max
  Peptide Sequence Number=SeqID_192015
atgtcaacactgaaccacctctttgatcttccagaacagatatgctacgtacaatgtggattctgtacaacaatactaatggtgagtgttccatgcagcattttgtcaacggtggtgacagtgagatgcggccactgcacaagcctcctctcagtcaacatgaagaaagcttcctttgtccctttccaccttcttgcttcccttactcatcttgagccaaaagaaggtgcttcagatgatggtgcaaacaagagtttgaacagctataataatgcatccataataaccaccaattcggactgtgaggaagagaacgtgactcaaatttccaatgtcgtgcataaacctccagagaagagacagagaacaccatctgcatataaccgcttcatcaaagaagagattaaaaggcttaagtctgaaaaccctaacatggcccacaaggaggctttcagtactgcggcaaaaaattgggccaattttcccccatcacagtgtgatggagaagccgacagctgtaacgggacagagcaacttggggatctggactcccatgaagagcctcgtgatgctattgaggttcataaagaaggccaaggtttccgtggaagaaaggctccaaggaattctatctgggaaagggcaccttttgaatga

SEQ ID NO: 75238 - DNA, 495 bp, Glycine max
  Peptide Sequence Number=SeqID_192016
atggcaatgaaacctgtactcgtgggtatccgtccaaactcgttccgatttggacgggaaatatccgagttgatcgagtacggattcggatttggggattacccaacttttttaatcgaggtcggggtcagggacaaagatgtcactacccatcccataccattcccgtatcggagacaggtacaagtatatattgaggagtcggaatcgaggactgagagacaatacccgtccccaccctgtcctgttgccatgtctacttacctccatgttcctcaaacagtgaagtggcgaaactacccttcagcaattcttcttccggaagatgatttttccggaaactttccggaaaatctctttccagaacttttccggaagaaccttcttccggaagaagaatttgtgtcttccggaagtacttacaaacaacttccggaagaatgtcatccagaatgtttccgaaagaagcttcttccggaagttagttttttttaa

SEQ ID NO: 75239 - DNA, 216 bp, Glycine max
  Peptide Sequence Number=SeqID_192017
atgaatactggttccttcagcttgaagtcatttgagggcccaagcaagctagaggctagcctgggtgagatagggtctaggaaaactggtcgacgactggcaagtgtaccagatcgctcaagtagtataaaacgttgtggttcaacaaataagcgtcttgtgataaaggctacggagatttggatgacgccacttccagtgaaggaagataagtaa

SEQ ID NO: 75240 - DNA, 1227 bp, Glycine max
  Peptide Sequence Number=SeqID_192018
atggcaaatgcacttccagaagcttcaatgagtttcagggctcaattttgccatgatggcaaggacaaagagtcagtcatacaaggatccaattccctcttagaagaggaagcaaccagaagaggcacaaagaagatgagtttcccgaagaacgataagtttttaaggataggattgaatcggctgataaacataggagttcacagtgaacccctggttagggagttttacgtgatcgttgtactcaaagatgattacacaaagatgaaagcttgggtgaagaatcattttgttaaatatgatgctatctctattaatagtatgttgggttcaacttttaagttaagaaaagggaaacaatctagttatgaggaatggctcaataaagagaggagcacccaaaaggaacaacagccaatgattactgagatggaagaggtcttgtgtcttcctaatagacatttcaagtgtggggtgatagttaaaaagctccacaaagtagacatgactggcttggctcagttttggactactttcatcctggataacattgttcctaattcccacaagccaaatattcctatgaagagagctcaactcctctatgctattatcaaggatctttctattaacattggccaaatcctttcctacaagatattcacaatctctaggaagaaatgttctccacttggccttccatgtcttatcactgctctttatgctagaagaggcattgacaacaccggtgatattgttgagccatacgtggctttgaaacctaacatggatacacgctacatattaaaaaccttttcaaagattggtgacgaatccttacctgttcaacctcctcctcctcctcctaagcctttgagcctcaacgaaagattggagaaaatactagaggaaatgaatgagaacctagaagcaaaccatagattgaatctactcattttttatcatctgagggtcattgatcctagaagtagccgaagtagattgtcgaggtcaaggaaagagcttcttacggaaggccaaaggggtggtgaggcaacccatggaattggagctagagctgaagatgtagctaatgatgggatcaatgttagtaatgctattgttaatgatgaagttagagaagagaaagagatttctcttgaggacactactgagggtgcacctcaagaaaacaacaatgaagaagaatttgaaaccactgaatga

SEQ ID NO: 75241 - DNA, 312 bp, Glycine max
  Peptide Sequence Number=SeqID_192019
atggatgaatcatctagttatgaaacattggaccatccagacctaacattgagaggtttagctacttatctttcccctttctacccatttctatctcaggaggaagtgttggctgccattggttggcctactacttttggggaccaagcttcagaaggccaaatgagtagtgaggcaaccaatggagttggagatggagttgaagatgtttttgatgctggtggatttaaagagggaactgatgttgggaccaccactgccactattggtgttaatgatgaagctggagcaaaggaagagagtgctccttga

SEQ ID NO: 75242 - DNA, 519 bp, Glycine max
  Peptide Sequence Number=SeqID_192020
atggtgatggaaaagatgaaaatcgagaggttcacaagatcaaatgattttagtctttggcgagtaaaggtgaattcattgttggttcatcaaggcttagacgctgcattattggaagaagcaatcatgaaggccgaagaaaaaaaggaaatccaaagaaacggtgactcaaagagagacaagattgatgaaggtctattcacacgaggtagacaagagaagaaggatttcaagcccaagaaatcattaagatcgaagtccagaggcaagaaaattaggtgcttcttcatttgtgataaggaaggaaacttcaagaaggattgtccaaacaacaaagatcgctcaaatgagcaaaacaagcacatgggaaatgaatggtttgagacatacaagcaaattgatggaggatcaatgttgttaggcaacaacaaagcttgtaaggtggttggaattggttctataaggcagagaatgtatgatggagtcaaggcagtcttagggtgtgcaaaaggtcactag

SEQ ID NO: 75243 - DNA, 357 bp, Glycine max
  Peptide Sequence Number=SeqID_192021
atggtttctggaaatacaacgataggacagcctagggaagattggagtaaggaagaaagaagactagtacaatataaattaaaagccaaaaacataattacatatgccctaggaatagatgaatactttagggtatcaaactgtaaaagtgcaaaggatatgtgggataccctacaagaacatgagatggagttgcaaagactaaatcaacatgaagaaaatgataagaagaagggaattgctcttaaagcctcatcttcaatccaagaagaaagtgatatggaagattcaattgacttgtatgatgatgaagaacttagtctctttgtcaaaagatttaacaatttcttaggatga

SEQ ID NO: 75244 - DNA, 1140 bp, Glycine max
  Peptide Sequence Number=SeqID_192022
atggtaatagtagcattatcctcctcccttcccgccggaagaaacctcttctcctccattccaccaacgccgccaccccccaccaccgtctccgccaccccacaaccaccaatcccaatccccaaatacccccctccccgcaaaaaaccccaaccacccccaccacagaaccccgccctcaaacacccccgccgctccaagtaccaccggccagttccccgtgacggcggcatcatcgcctccgacggcgcggaccgcgccgtcgtaatcggggagtccggcgtgtcgtacctgctccccggcgcgccgttcgagttccagttcagctactccgagacgcccaaggcgaagccgatcgccatccgcgagccggctttccttcccttcgcccctcccacgatgccgcggccgtggaccgggaaggcgccgctgaagggcaagaagagcaagaaggttccgctcttcgactcgttcaatcccccgccggccggcaccaagggcgtgaagctcgtggagatgcccgggccgtttcccatggggcagtttccgctagaggggaagagcagggaggagattctcggagagcctctgaagaagtgggagatacatatgctggttaagcccatgatgtcttacaatcgccaggttaatcttggtcttgaatggtggttccattgcgatatgttgggtacaaatgtggttggtgagactgcaattgcggttgtgaatggaagggatggattaacgcataacatgctggagttgatacattcacattggaagcgtcgccgagtctgtaaaattcgttgtttaggtgttccaactgtagatatggataatgtttgccatcatattgaggagaaaacaggggggaaaataattcatcgggttggtggtgtagtttatcttttccgtggcagaaattacaactatagtactcgtccacagtatccagtgatgctctggaagccagctgctcctgtttacccaaaacttatacaggatgctccaggaggattaacaaaagatgaagctgatgaattacggatgaaggggaaaagcctgttaccaatatgtaaattaggtaaccatctattggggtttcatatctgtctttctaatgcacacactcgtatgtag

SEQ ID NO: 75245 - DNA, 357 bp, Glycine max
  Peptide Sequence Number=SeqID_192023
atggatatgggtctagcatcgggtaccaagtctttggaaaactctatctctctctcaggtggtaaaccgaatacatcctcaggaaactctctgaccacaaggaggtcacccatggaaaccttggtttctacttccagatcattattcaaagaagacacaaaaagcttaagattctccacacacgaacaagatataaatgaatgggtcgcaccggaatcgaatagcacaagtaagggaatctcacttatgaaacatttaccttcaattaaatctttggattttgaagcctcaacatcgttaagagtaaatgtaggatcaagtggcctcggaataattacgaaggggggggggagttga

SEQ ID NO: 75246 - DNA, 849 bp, Glycine max
  Peptide Sequence Number=SeqID_192024
atggaagggatttattcagaaaatttaaaagtttgtatgaaaaggacaactctttgtgaaggggaaatctttacagccaaaaatggagtatatacatcccttgtaaaggatgtcagagatgcttttgaaggaagtattttggtgaaaattaactgcaagggattggatcctagtgattacaagaaaataggtgccaagcttaaggatttggttccttgtgtgctgttgtcttttgatgatgaacagatattgatgtggaggggcaaagactggaaatcaaggtacccacaacctctgccagtttttacgccttcaaaagctaacattgttgggaatttggaaaattcaggtgagactgacgacaatcaatacaagcatgatggcaacatggtgaacacgagcccaaaaatgttgtctctgtggaagcgtgcaatccagtcaagcaaagctttgttgctggatgagtttaatctcggtcctgatgctctcttggagaaggtagaggaatttgacactgtttcacaggccttggagcactcccatccagcatttagtttgtcaagtaaagaaaatgatgctgaaggttcatctgcaaactttgaaaatagttattctagtgatggcttacatactgaagaggattatgcaaagttcgaagatagttattctagtgatgccttacaaactgaagaggaagaggaagaggaagaggatgaggatgaggatgaggatgaggactactatgatgatgaagacgatgacttgtatgcggtggacacatcggctcaacccggatcattacctgttgatatgattgtcaaaaagctaaaacaaagaccattggagtaa

SEQ ID NO: 75247 - DNA, 1032 bp, Glycine max
  Peptide Sequence Number=SeqID_192025
atgagtttcttcacagagtcctctagccatacatggcaaccaaccataacttcagactctactaccctaagttattggttgaattggaggttcttcttctgtgcactatggattttagcctccatggctctagcatcttttttaatattcaaatatgaaggattcaacaaatcaagatcgaatagtggagaaaatcagggggaggaagaagctggattgctatatgaggatgaagcatggaacacctgtcttaaaggaattgatccttcatggctccttatttatagaataatttgttttgttgtgcttttggctttgatcattgcaagtgtggctgcagatggagcaggcatattttacttctatactcaatggacctttacattggtcactatttactttgggtttggatcatatttctctttatatggatgttccctaaaacaaaataaatatgggagcagcacggtcaatggcacttctttagatccagaactaggcacttatatagttgatgctcggaaaacagctggtttatggggttacatttttcaaataatttttcagacttgtgcaggtgctgtagtgctaactgactctgtgttctggttcatcctttatccatttctgatgtccaaagattacagtgtcgattttttgattttttgtatgcactcaattaatgctcttttcctcctcggtgacacatcattgaattgcatgtggatcatccatgtttgtgtttcactttggtggccttatcctttccttgatttatcatcctcgtatgcacccttatggtacttggctgtggctttgatgcactttccatgctacggcgtctttgctttaatagatgagcagcagctagatgcttgcttgcatcacagggcaacggatgcttttccacatcttgctagttaccttgtgattttcataaattatgttcatggagactcaaaaataaccaatcgaaaaatgaaggcgggtaaaaaggaaacagttagccaaaaagatcagaaagcaaagtga

SEQ ID NO: 75248 - DNA, 1383 bp, Glycine max
  Peptide Sequence Number=SeqID_192026
atggaggctgggaagaagggtggtggagtgaatgacaatgagaaaaatgacatatattggtttcctgttgaggatcttgcccgtttgcaatttcagaaaactcctatctatattgatgtagatgatgggagaaccaaggtttgtgctttcgcccctgctgtgctggattcaattgtcacatttggattcgattgtttcaacccctttcaggcatttgatgattcaaagactggtgtccaaggactggtagaaaatggtgtaacaaaagttccacttatgttctattgtgaaaactctaatctcaatgatggtgtaaccaatgcatcaaattcaaagatcagcatccccataattgacctcacaggcatccatgatgatcctattttgagagatcatgttgtgggaaaagttagatatgcatgtgagaagtggggcttctttcaggttataaatcatggaattccaactcaggttttggatgagatgatcaaaggaacttgcaggtttcaccaacaagatgcaaaggtgaggaaagagtactacactcacaaagtaagccaaaaagttgcttatctttccaattatactctttttgaagacccttctgctgattggagggatacacttgcattttccttggcacctcatccacccgaagctgaagaatttcctgcagtttataggttaatttcattgccactgcctacaaatcgaccaaatagcattgaccctgcattgaaaaggtctggtagatttgatagtgaaattgatattggtgttcctgatgaagttggaagacttgaagtccttcgcgtacataccaaaaacatgaagctttcagatgctgtaaattcagcatgcttaacttccatttctgttgctactcttcaatgcatcagggagaagatggatgtcattgatttggaagatgagagtattgatgctgaagtactgaattctatggcagtttcaaatgagcatttccatactgctctgggaacaagcaatccatctgctttacgagaaattgttgttgaggtgcctaatgtcagctgggaggatattggaggccttgagaatgtcaagcgtgagctgcaagagactgttcaatatcctgtggagcacctagaaaaatttgagaagtttggtatgtcaccattaaaaggggttctcttctatggtcctccaggatgtggaaaaactttgttggccaaagcaattgctaatgaatgtcaagctaacttcatcagtgtaaggggcccagaattgctcactatgtggtttggtgaaagtgaagccaatgttcgagaaatttttgacaaggccaaacaatcagctccacgtgtcctcttctttgatgagcttgattccattgctactcag

SEQ ID NO: 75249 - DNA, 988 bp, Glycine max
  Peptide Sequence Number=SeqID_192027
tacacttgctgataaatttcgcaattgtaaagaggcggaacactggtccttgtataagttcttcaatcttgtccttcagggcctaacagtctttggtgttgtggcgcttgtctgccttgtgcctcctgtccggtttgtgcaagtcggccttggtgtttactttgcgcttgtcgtgcttctatttggtttggtagacttcattatagaatctggatgcgaagagcatggaatgaaacgctatcttgggattgagattttagatttggacggttattcacgcaaatttgtccatgaactttctgagggactcgtcgttttcttgtcattaattggccaaggcggccgaggtcatgcggtgagacctgttaccgatgacctgtgcactgaatcgttcgacaagggtgtcgaagctgtttatgcacctaggaagacatctagatgctcatttggatctgttgtctcatcgtaccgattgaggttgagtggcttccaccccaagggtatgtctgcctccaaaatatggtcgacaaaaagatgccgacggacaatctgcgctttgcggtgcatgtgggagagactcaaatcatctgcagtgttgcctatgtgttgggggtgtgatttcccttgggtgcgttcaggcgagcctctagctggtcatggtcagcatttagcattgtcaactcttcctcctggcgttgctccatctaaacaatgtagttttggagttgttgtagtgtttgtgtttgtcatagatcgagtgctaaccatgggtgaatgtgagaggattgatgagaagccgcaagagtggatgtggttaagtgaggtcttgaacttcacacgtcgattagagagcaagtatatgctatcaggagctcgtatgagggagagaggaagagggaggcacaagggctattgtagccttgtagataatagcctggagcttatagataacgttagagataaacatttgcctatagataaaaggtag

SEQ ID NO: 75250 - DNA, 312 bp, Glycine max
  Peptide Sequence Number=SeqID_192028
aaattcccaatcaagaacttagccttccattgcaaggcagcacctttcaactataagatgagggtttttgaagaaaattacagattacacagtggtagggatgtctcctccacctctaagaacctagaaattactcctaaacctagaatcttcttgaaagctaagcctttaaaagggttttctgtccttaaaggctcgcttagtgtcattttcgcgctgagtgcgacacgtgcatgcgtggcaaattctcttccagattctcctcactcgctaagcgagctaatgtctcgcttagcggatgttgctcgctaa

SEQ ID NO: 75251 - DNA, 1431 bp, Glycine max
  Peptide Sequence Number=SeqID_192029
atgagggttctatcaagtgcttctgggcagcccaacaatcaagagctcaaacaattttctgattggctattggacataggtgatggcaaagttggacaagctaatgatagattttctgaaatcaccctcccagatgagttccttataaaagactatattgatcctgtccaggctattgttgaagcaacatatcccaacttgatacataactatagcaatacagattacttgcaaaaaagagttgttcttgcctctaaaaaagatattgttgacaaaataaatgattatgtcttatcactgatacccaatgacgaaaaggagtattgtagcgcagatagtgttgataaatcagatgaactactcaatcctgctttcggattattgacacctgaatttctaaattcattgcaaacatcaggcatacctaatcataaattaaaacttaaggttggtactccaatcatgttgatacagaatttggaccaagctgatggattgtgcaatggaactaggcttattatcaccagacttggttctaatgtagttgagtcagaagtcattactggacctaatacaggaaatagaatatacatacctagaatgaatatgtctccatctgattctccatggccattcaaacttattaggaggcaatttccatttatagtttcttatgctatgactataaacaagtctcagggtcaatcattggaacacgtaggattgtatttgccacaccgagtttttagccatggtcaactatatgttgccctttcaagagttaagagcaaaaaaagactacatattcttattcatgacaatcaagaaccttctggaagtccattgtcttttcataggcaatggatgtacagatacccaaagcatgttttattccactatgatggcaacaaacatttcattcgagtgaggacgtatggtagcaaatgtttatttgccgatggcctaaaggaattcagaagagcacacgatctaaatgagagtgtcattcttcattttgttgcttttcacaaaaatactactttctccattgatgtcatcggacctatacacaggcaggtgcgtgtaaagcccgttatatcaaccaagagacatatttttacaactgatgtcacaaaggagatgatacaacataggctccctttaagtgttcatacagtttcttccagcagcagcttcgaaatttgtctatggttccaaaaaatttattacccttcagcggggactggcaaaacgcacccagtggcacgtcaccatcctgtagaagcaaagcttcatgatgaatcaagattgattcaaagatgttttgatgataacaaagatgatgacaaaggtgatgacaaaaagctcaaaggtcaatcaaagaatgagttcaagatgttcaagatagaatcaagaacacttaaagattaa

SEQ ID NO: 75252 - DNA, 387 bp, Glycine max
  Peptide Sequence Number=SeqID_192030
atggcctcaacaacaaactcgttggtggccatggtagactcttttacatgtatgataaggagcttgagctctttagatgcacacacctatggaggatgcattgttgggatgtgctacttccgtgaaggcgaggagcttttagaaatcaaccctaatgccgctgcagagcaagataaccacgaggatggaagtgccgagggagttgacaatgacacgaatagagttatgggagacaacaagaatgatgtggaagcatttacgaagaaggttgatgattatgatgatgccaagactccttcaacgagatctcttccgcctacaactagtgtttcactagagcatgcgttgcgggtgtgggagtcattgttgagaatgggttgtgagtaa

SEQ ID NO: 75253 - DNA, 192 bp, Glycine max
  Peptide Sequence Number=SeqID_192031
atgaaatttggcggagctgttccatttctcattcctatgacgaggtgtattataaattgtagcaatattaaggttgaggggaaggagcaccaagatggttgtggtggcagcgacaacaatttaggagacgatgtggttgtgagagtggataaccggttggggatggcatcgatcgtaatgactaactattga

SEQ ID NO: 75254 - DNA, 387 bp, Glycine max
  Peptide Sequence Number=SeqID_192032
atggcaggaggtaagagacaagttgaaccaattgttaggcacaagaacatccatttatggtggtggactgtgcttccattgccggatttgaggaactgtccaccaccactatgccgtttccgtcgtcgagtggagttacttgaagtcaatggagatgaagctagagctgagatagtacagtgtcatggggcacatcgttggatttatgagcattttccatctattgttaaggcttttacaaactcagactatgaggaaaggtcaccacgtgccttccgctggacatctacgaagacattactagcatcgacgtatgggaagcgtctagatcgactgacaactgctgatatttgctggatgccttacggtaaccactatgcagtttga

SEQ ID NO: 75255 - DNA, 465 bp, Glycine max
  Peptide Sequence Number=SeqID_192033
atggtagaagtctctacagaggccattgcctccctcgcccagtattatgatcagtcgttgaggtgcttcacctttggggacttccagttgtcacccatggtggaagaatttgaagagatcctaggatgccctctaggggggaggaaaccatacctcttcatagggttctatccctcattagctagaatttccaagatagtccaaatctcggcgcaggaattagaccacaggaagcaagtcgaaaatggggtggttggaatactgagaaaatgtttggaggcaaaagcaagagtcttggcaggtaaaggcgagtgggccccgttcatagatattctcgcactgttgattttcgggggagtcctctttccgaatgtggatggtttcacacctttttcgccaagaggtgaggcatgcttgcctgttagaaagccaccgttcatgcacagagaaagggagggcgaatga

SEQ ID NO: 75256 - DNA, 1155 bp, Glycine max
  Peptide Sequence Number=SeqID_192034
atggaaactagaggtttaggtcgtgtcttaagcagagttataggaagagccttggagagagaggataatcatcatttagatgatgttccccagcagcgaaggcccacaacatccgcacgtaggcaacaggaagttgccgctattgttgaggatgttcctcacgtggatgacgtagctgaagaggagcatcctgaattaaagttatcctcccatggaaggaaagttcaaaaatttgggaagcctgctactgaaattaaagggctagttgctgtcacaggattaagtcctttgatcgcatgttcattgaacactgacgatcggggacttatattggctttttttcgagaagttgcacaaggagacgagcagtttccatcttctagtaggagaggtgcactccacagcttcgagactcttcatgtcgatgaagcggtgttgatgttagtcgagttacttaaagtccctggagatgaagctagagctgagacagtacaatgtcatggggcatactgctacacatgtatatgtgatgttcttggacgccttccgagacctcagtcagagtggaagctacgcatggggagctgccaccctagtgcatattgttggatttatgagcattttccatttattgctgaggcttttacggacccagactatgatgaaaggtcaccacgtgcttgtcggtggacttttacgaaggcctctacgaagtcattaccagcattgacgtatcgaaagcgtctagatcgactgacgattattgttgtttgttggatgtcttacggtgaccaccatacagttcgagagttagacctcatttcatatttttctggacatatccaatggggtcccgttgtcgtgatacaccgaccagaaagggtggtgcgacaatttgggtatgttcagaccattcctccacactctccaggatcaaggttatcatttgaagatattgatgacagatggatgcatttctctgagtacctggcaccagtgggacagatttgcgttgtgtctggacaatgtgcaccaaactacatgcactggttctacatgatttcgcatctattcaagacaccgacacatgccggggatccgcccagacatccacatgtcaagctagatgagacatgtggaaccagatatgcttga

SEQ ID NO: 75257 - DNA, 573 bp, Glycine max
  Peptide Sequence Number=SeqID_192035
atggcacctgcaggtgcactgataggtccaattgcatttgccattattgtcattggaaattctgctattatccttggactttggagtgcacatgctgtttggacatactactgtgtggcaaggttcggactggtcttcaagcttgtggtgctcatgggtttgccagttcctctgctactttggccaatagtgggtattgttggaagccttttaggtggaattggatatgggttttttgctcctcttcttgcaacttttcaggctgttggggagggagagaatgttaaccagaaattttaccattgcttcatcgttagtgtgaatttctgcttgtgtaatgtatctttcagtgccccttttggtcatttaactttgcttgtggaagtatctttcaattctaacccttttcatgatctagagcttctggacttgagcagaatgcaggaagctttaatgccacttaactctgatatcaggatggttgttggtcaacaattgaaagaagctgcacagtggttcaggatgtcacagacttctgctttcactcctatttttcatacatggatgaactaa

SEQ ID NO: 75258 - DNA, 159 bp, Glycine max
  Peptide Sequence Number=SeqID_192036
atgtctagttttgctctggaaattgcttctgggatatcaaagatgtttgctcagaagaaagtcacgctgagcccggggaggcacaagatagtgatactggatgaagctgataggtatcagatacgttatttatgtggcctgactagcgagctaaactaa

SEQ ID NO: 75259 - DNA, 246 bp, Glycine max
  Peptide Sequence Number=SeqID_192037
atgaagctctggattctctatacggtaaccaccgtcactgtccctgattttggttccataaatcggtccagatcctccacctggattaccgacttcgtcgttgtttccatcaatagaaacttcagatctgaaggggaagaaggagaaggggaggcagaggccgaggtcagcgccaagggcagagtcgacggtgcggttggtggtggtggtggtgtagggttattttctgttggagaaggggaataa

SEQ ID NO: 75260 - DNA, 498 bp, Glycine max
  Peptide Sequence Number=SeqID_192038
atggcagccttccagaacttcgttattatgccgctgacatttttgtcaggcgtgttttactcgattcattcgttgccgccgttctggcaagcggtgtcgcagttaaacccgttcttctacatgatagatggcttccggtatggcttttttggccagggggatgtgtcgccctggctcagtttggcagtagtaggcagcttcttgctggtattagcgtggctatgcctaaagatgttaaaatccggtggttatgtgttaacagcggcgcaacttgaggcctatatccgtagtggcctggaatgtgattacctgaaagtgaatggagatgacgggacgcattttgatgcggtcatcgtcagcgcggctttcgagggaaagcgtatggtgcaacagcatcaattggtctatgccgcattgggcgaccggatgcgtgctgagattcacgcgctgtctatgcaaacctataccccgacgcagtggcagcagaagcaagcctaa

SEQ ID NO: 75261 - DNA, 240 bp, Glycine max
  Peptide Sequence Number=SeqID_192039
atgtcccttccttgtgggttcgacaaggaagggccaccgctgaaaatcacaacggtgaataagagtgaaaataggagttaccaacaaggacaaagtgtgggggaaggagagccgatgcaaagagaagaagaggatgaagccaccatggacattgactgggagaagatgaagtggttgtcctcggagtcgcaatcgtcagagaagaagtccttggttggagatgggaggccatggagttaa

SEQ ID NO: 75262 - DNA, 393 bp, Glycine max
  Peptide Sequence Number=SeqID_192040
atggagggggcattcccaagtgggggatgcctaaccctcgagagagagttctcactgatgaggaccttgacttggaggttgaaccctgaagtaaaggaaatactgacgtttatccactctcaacatggtcctagactgcctagttgtgagagggataagagggaaacccttgggtggaacattcatgacatgaagggtttggaccctacactatacatctacaagatcaacactaaagaaggatctctacccaaatggtcatcccaagagaaacttattcccaacatgatggaagttgtcaaaggagaggatgctaagcccactattaagataaaggcataccatgagggattccaacaggtgctaaccattatgcaccccttcgacctttga

SEQ ID NO: 75263 - DNA, 531 bp, Glycine max
  Peptide Sequence Number=SeqID_192041
atgatactcaaatttcacgacgatccaacggtgaacgggttcgagatcgtcgtttttctgagactggtttgctttttaaatttatttacgaaaaattgggatgttacatctttctcctcccgcttgaaatctgctggaaaccgctccctcgacacccacattgttctcaatactgccggaaacccctcggccgaacccacagaaccccctacactgctcttcgaagtgtggctcgaagaataccctacatacattgtagtattgctgattgaggtacgaggaaagcttcaagtttcgtgccattttgttacatctcactgccattgtcactgtttgggttggaggtgttcactctttttcattgtcactgccattgtcactgtgtgtaaaaggtctgaccaaaaagctggtccatctattgtctgtgttgctttttgtagtttctttggcaattttcagtttacgtgtgtgaactgcaatgcattgattgctggtgttgctgcaatgtttgaatgtaaaaacaacaaatag

SEQ ID NO: 75264 - DNA, 312 bp, Glycine max
  Peptide Sequence Number=SeqID_192042
atggcctggattgatcagcgaatgaagcaggtgaagtctcaattgaccaatatacaacctttcttgtcacaaaggaagttgaacaaccttctttcacaacctaaaacaaatcctaagagggaggatatcaatgttgtgatgattagaagcaagaggatttcgaggagaaggaaggttttttcccccaaaattacaaatggtgtccttactgagaaggaccaagcatcgaagaaagttgagattcctactaatgggaatccagtgccaaagaaagaaggggataaaaagaaggagataatgacatctccttag

SEQ ID NO: 75265 - DNA, 702 bp, Glycine max
  Peptide Sequence Number=SeqID_192043
atggttgcacattccacttctggcaactatagtgagcaacgacttccaacctatctaaacctttctatgaagtctattgttgattcatcaaccatttacttcatgttcatcaaatcaactatagttacttcaggtaaatttgagtaccaggtaaaagctacacctgtcagagaagggaaaaagatgcaacttgtgaaactcattttgactagcttcaccattctgagcacaaaggcatcatatggtccacccattctggatatggcgaggctctcgggtgcgtcttccaaaggaggaaaatacgcggagtcgccaccaatgtttatttgtggaaaacgtcagaaaaaccgaaggaaaccggtcataaagaatattccagattcgggagttgcatttacgtttgaggaaggtattagcacctctcacgtcgacaaaagcggggctcttgctcctacgtaccctccatcgaagaggaaatcagacctacgtagttctttcttaaggggtgctaagtacctcgaagcagtcaaacaaaggttacatgccatgaaacaatggtccccgaacgaaattagggataaaccccatttggctacaaatcggttagactatgtgaaacattcttgcatattcgacgaagttgcttgccatgtagacataaaagccatattcggttggaacaatgggattaattctgcctaa

SEQ ID NO: 75266 - DNA, 783 bp, Glycine max
  Peptide Sequence Number=SeqID_192044
atggcacatcacaggttccatttattctttcttgatcccaagaaaacaattagtttccttaattggtggcttgctgtaaaagatgccctattttcgaaagggcttcctttttaccttttacaagaaaatgaccatgttcaactaaatcctattggccaaactccaagccaaccccaacctttttctcattcggcttttgtttcaactaaaaagaagaagagctcatcaactgaaatcaccattaatcctttactagctttgcaatcagaagagctcacttgtctagagtcaactcctctgactttcaagagaactactagatctgttattgctctgaaattctctactcctgatcctccttcaactcagaaatcagctgccgcacctagccgaagccacaaaagattgaagcttaggtccatttctacacttattcatctaaggcagttgcaaactcaaaagtctacttatgctgccaactttcaagttgtcgaagcagagcaacaagctaacttggccaaacaaaagcatctcaacaagaggattgttgatctaatagttgagcttggatggctcaacatgttaaatcccaagattactctccccaattccaaacttaagggtaatttggacttgtgcgttcatctgtctgccttggcaaattcatttcacaccaacatcattcatttgctttatcaacatgaaggacaagaaaaagatttgagcacaactgttaatgcccacaatatttcaactgagtatcaaattgatgttttatgttga

SEQ ID NO: 75267 - DNA, 282 bp, Glycine max
  Peptide Sequence Number=SeqID_192045
atggattacgcaacgatactctttttttccctctggaatgttgcgggactttacgtattacgcaacaatgctctttttgacttccgaaatgttgcgaaaatttacggattacgcaacaatgctctttttgacttccggaatgttgcggaattttatggattgcgcaaaaatgcttgttttgacttctggaatgttgaaattggaaaggaagattggtgccatcctttgaagagtttgagtcaagaagcaaggggcaaaccacctttagagctattggactaa

SEQ ID NO: 75268 - DNA, 211 bp, Glycine max
  misc_feature (179)..(179): n is a, c, g, or t
  Peptide Sequence Number=SeqID_192046
gtcactctcactaagtaagatcatagggagacaactcagggtcacgatgttttacgagaatgctccaaccatatgggatcagcataagcttaaaggagaactcaaacccagtgaccccaaggcctacactctgaagagtctgtcatggcctctccctgttgatttaggtccaacccctnaaatcattttagcacacagacactgcttgtga

SEQ ID NO: 75269 - DNA, 573 bp, Glycine max
  Peptide Sequence Number=SeqID_192047
atgggttctatatctggacttttagtcctcgatactactgtgtatggtacacttgcccttgttgtagaagcaagcttcatgatgatgaaccaaacaattttgatgatgccaaaagcccaagtgattgattcaagacttcaagatcaagcatcaagaatccaatccaagattcaagattcaagagaagaaaccaagaagcagcaagtcaagacttcatataggataaggtacatcctttgtggtacaagtagagcgtacatctacttgagttgtaatactgagaacaagagagggtacatctcttgtggatcagttcaagtggagtgtacatccacttggttgttcaaagagaacaagggagggtacatcccttgtggatctttgcttgtaaaggattttacaaggttattggaaatctcaagaaccggtggttgcttggggactggacgtaggcatgggttgtggccgaaccagtataaatcttgtgtttgtctttcttcttgcctacactctttatttttctgttgtgcacttttcatttacgctttacttttatctaagttattgttttga

SEQ ID NO: 75270 - DNA, 1491 bp, Glycine max
  Peptide Sequence Number=SeqID_192048
atgagtgaaaaaagtggagatgaccaaaataacaaaaagaaccatgatcaagagaaaaagaaagagagaaaagagacctatcttgcaaaagaaagaaaggaatttgaagatgttttcctaaaagaaattcctcatggtctaccagctttaaggggaattgagcaccatatagaccttgctccaggggatgtcctacccaatagaccaacatatagaagtaatccacaagaaacaaaagagactcaaaaacagaaagatgggacttggaggatgtgtttggattatagagccataaccaatatcaccatcaaatatagacatctcatcccaagctcacaaggagtacgggttgatcaagagaaggtgaaacccattcaagagtggccaatcccaaaaaatgtaagtgagggacaatgcaagttgaataagagaaatgccaaatgggttgagtttacggagaaattcccgtatgtgatccagcacaagaaagaattgtatgagcatgattcatatttctcttctaaatattcttcatgtgtgcatattgctcaaaatgaatactttaggcataatgattatttgcttaaagggaaaagattatgtatgccaaaaggattcgtaagagaattgcttgtgaaagagaggtgcatgaaagggtctaagtctaaggaaatgcctcatggactttattttgctttgcctatccttgattttccttggattgacttatctatggactttgttttagggttgcctcagacaaggaatggcaaggattccatctttgtggcgatgcatagcacttatatcttaaagcataaagatggaaaagttaaggctgaatatgtgaagaagttacatgaacaagtgaaagctcaaattgagcagaaaacaaaaagttatgttaaacatgccaacaaaggaaatccaagcttcaaccacgagaagatggtccattttcaagtgctgttcaaaatcattgataatgcttacaagataaatttacctggaggggatgatgaggatcaaacaagtaacatggacaatgaggcactacaaggacttggtgcaccaatgacaagggcaagtgcaaagcaaaggaagccttacaccaaatggaggacatcatatggtgatagatatggttatcaaattggtggtgcaaagggtaacaacaacagtaacaaggcctcatatgcacagggagttaacttcaatgtaacaaaaggagatatggagtggctgaaaaactctttagtagggagggtgaaaaatgttactaaagtggccacactccctcaaaccctaatcatggaaggagttgaatgcattagggttaggtaccttggagataacttagtactcttgtctgatgtttatggtactaaagtagaggaagtggtgaaaagagaggaagtgtggtttacaaaactctttgcttccatcaataagtggtccttagaggataggtctggccatagactagcttag

SEQ ID NO: 75271 - DNA, 441 bp, Glycine max
  Peptide Sequence Number=SeqID_192049
atgtctcattttcaaggttttttcaaaggaaacataaaaacatccaataacgaaattgcaaagcgatggtcgggaggtttcgttaccgaatccactagttgggttttgaagattcaactccaatcaaaggcttccactccatgcggtggtctggaggcaagtggtggcagcttgtggtggtcgccggtggctgtgggtgaaggaagaggtggaaagtttccgctaagtgagacatttgtgctaagcgcaatttctcctctagctgaaattgcgcttagcaagctggtgtcactgagtgaaatattttctctaggtggaattgtgcttagcgagttggcgttgctaagcgagctggtgtcggtaaccgagctgtcaacaaatctccaaggtgctccaacatatttcactgcttttgtgcaaaggtcatatctcacactttag

SEQ ID NO: 75272 - DNA, 913 bp, Glycine max
  Peptide Sequence Number=SeqID_192050
gaaaaccaagaagaacacgaggaaggagaaagagaaagagtgtttgggagggaagtcgtgcgcaaatctggtggcgtatgggttggcgacatgtggtgacggaacggaggagatggtgctggttggtgtccttggctcaagcggcggtgtgacgcggaggagacggggtagggtggttggtcgcgcgttgatcggggctatagtgatgatggcgcgcgcgatggtgaggttcaaagaagatgaagattttgtaatatatcttggtgatgtcatcacggctaacaatataatgattgcaaatgcaagcttgtattgggatcaggcaaccgccccagcaagaaatagaggcataccatgggccagtgtatttggaaaccatgatgatgctgcatttgagtggccattgaagtggttctctgctcctggaatccctccaattcactgccctcaaaacacaacttcatattcaggagaagaagaatgtagcttcaaaggaacaggacgtttgaatctgatgacaaatgagatcaagcacaatggatcattttctagctatggccctagaaatctttggccaagtgtatccaattatgtccttcaagtttcatcaccaaatgatccacaaacaccagtggctttcctttacttccttgattctggaggcggttcctatccggaagtcatatctagtggccaggtagaatggtttcggcagaaagctgaagaagttaaccctgactcaagggttcccgagattattttctggcacattccaagtacagcttataaggtggtggcccccaagtttggcataccaaagccttgcgtaggatcaatcaacaaggaaactgttgctgctcaagaagttgaaacgggtatgatggaccttcttgtgaacagaacttctgtcaag

SEQ ID NO: 75273 - DNA, 387 bp, Glycine max
  Peptide Sequence Number=SeqID_192051
atgcgtcccataacggctacgcatagtcaaaatgtctttctcaagggatttcctctctgtgctttatcaccctgtgtaatcgattacacacccttggtaatcgattaccagaggccatataacatcctatctccatttttaagccctgtaatcgattaccagaggctaatttccagataccacccaagatacatagctggccagccgccacacaagcctccttgcttcgtggactttgttcttttattggttgactgccatgagctcgcctttttaggtggcgatcgggcgatggcgcaaatcaactctcccacttccacaagtcaggcacaagcataccatccccagttgcccacctttaacttgagctcacgcactcctacgtag

SEQ ID NO: 75274 - DNA, 606 bp, Glycine max
  Peptide Sequence Number=SeqID_192052
cttggagggcttgatggggaccctgtgctgagaggaacgaggataagggctacagtggtacctggagatatgtcgcgggggtcaggagaccttggggacgtcaggcgagctcatggcagtcaaccaataaaagaacaaagtccacgaagcaaggaggcttgtgtggcggctggccagctatgtatcttgggtggtatctggaaattagcctctggtaatcgattacagggcttaaaaatggagataggatgttatatggcctctggtaatcgattaccaaggggtgatagggcactgatcgcgatggcagcgcagttgatccatgatcgtgttgtgatggagtgcctagagggtgtttgggagaccttcgaaggcaatgagaggtgccaattccgtggcacaattcgactcactgctacttcattagtacatctggaggaacccgcacgcacacttcagcagcctatggagtggatactacctacacctactccatatcgactagtggagccagttcaagtgatagaggtgtcatcctctgaagaggatcttgaagaggacctagaggagttacctcctgaacctgctatggacgcccttgactaa

SEQ ID NO: 75275 - DNA, 492 bp, Glycine max
  Peptide Sequence Number=SeqID_192053
atgtactctcaactatgggttcccaaactactagcgaaaattcatcttggccttccgacaaagaaagagattgtagtgacatcaaatgcaagttccaaggcatgggtgtttgagcatcttcccaatgttggttacttggagccaaatgattacattgataaggacccgttagccactaaatggaagccattgagaggtagcgaacatgcgcttctgatgaaggagagattggatgagctacgaatggatgatgggcacaatgtagtcctgtgcgtttaccacccattccatgacagtcacaacctgggcagtcattggcaaacaggattgattccagatgttgtcaacagttatgcagagcttgttagacctcaaagttgtactaaagggtatgagtcatcattaactcatacaacaaactttgcaattgttgtaggagggtttagtagccaagtgcaacttagacacacagaacctcaagaagaggactag

SEQ ID NO: 75276 - DNA, 258 bp, Glycine max
  Peptide Sequence Number=SeqID_192054
atgatgccatgtcccacaaagggaaatgtagaagcatgtttttttaaacttaatctgtgtttgggaatgaagatggatgatggggactttccggaacatgttcatgcaagacaagatgggaagacaaaggatttggctaatgaagttgtcaatgggactgctgcaatggtccagaatgatagcaaccctttccattatcaccaaagtggatggttaataggaacaaaagaatgttgggccagattttggggattatga

SEQ ID NO: 75277 - DNA, 234 bp, Glycine max
  Peptide Sequence Number=SeqID_192055
atggtattgaaagagtcgcaaaaaacaaggttggagaaaaatacttgggtacggtgccaaggtgtcacggtggcaagaatccacctcaaggattcgatggagaataatccctcaatcctttctttcataggttctctgagatgcgaggagaccaaacatgcgaagaagaagaaagaagtggcggtgcaagggagctcaagtggtgacgatgatgacacaggttcagggaaataa

SEQ ID NO: 75278 - DNA, 1032 bp, Glycine max
  Peptide Sequence Number=SeqID_192056
atgtcgtctaaccgcaagaatatggatctggatcaggactttgcgcggatgcagcagcaattgaccgatctgttgcaacggtatgcgggttttatggatgtgtatgaagtcagctttttgtttggcgcagtcgctgtgttcagttaccttggctggcgctggtcggccattgcacgcctggtgttgggcgtggctgtccttagtctgattggtgtgtatagttatcagggcgatctggcgaatggaagtcagcgtttcctgcttaagttcttgcttaccagccagtctgcggtgatgtggatgaatgtgctgtttgtattggcgatggtgacttattggctggcattgttccagaagtctgcatttactgcgaaagtggcttctgcattgacttgggctgcaaccttgttcggttttgtaggcctgatggtgcgttggtatgagtcatacctgattgcgccagatgttggtcatattccgatcagcaatctgtatgaagtatttatcctgttttgcctgattactgcgctgctgtatttgcactacgaaaaactgttcaatacccgccagttgggcggatttgtgttggtggttatcaatgccgcggtgggctttatcctgtggtatacctttgatcgtcatgccaacgaaattcagccgctggtgcctgccttgcaaagttactggatgaagatacacgtaccagcaaacttcattggctacggctcattctcgctggccgccatggttgccggcgcttacttgctggcgaagcgcggagtgctggccagccgcctgcctgcgctacatgtgctggatgacttgatgtataaggcgattgcaattgggtttgccttttttacgatcgcgacgatcctgggcgccatgtgggccgctgaggcctggggtggctactggtcttgggacccgaaagaaacctgggcgttgattgtgtggcttaattatgccgcctggttacatttgcgtttaatgaaagggttgcgtggttcagtcttggcctggtgggcgctg

SEQ ID NO: 75279 - DNA, 381 bp, Glycine max
  Peptide Sequence Number=SeqID_192057
atggaggtatcggagggtactggagctgatggtggtggaagagttgatgcagaaggagctgatgtagaagcaggggcagaagtagaagtaggagcaggggagcagaagaagatggaccctcagatcctcgagcccgagccttatggtgagtctaatataactcctcgggcgatgcataaggcggtgataagggctgggaagccgagccgcgaggagttggactggaccatttatccttcctcaggagcttccagggtgcctcttcagcattcaaaacaaattcacgccctggaatatagagcttggaagcaagctcctaagggtttacgcgcatcctgcagaaaagagaataagaagtatacttctcccctggctgaatga

SEQ ID NO: 75280 - DNA, 273 bp, Glycine max
  Peptide Sequence Number=SeqID_192058
atggccaaatttggaatgtcattatcagtaggcatgttggctataaccggggatggggatgatgtggatgtaggtactaggaacgatccacacgtatcaagatgtgatggagatggtctaactttagtcagaggtggagatggagtaggtgcaacctcgaaagatctaactgccatagatacagtaaacgagaatgggatagatgatactagactatctctaggtgcacaccaacctcgcatgtcccttcttgttgctggatatgacacataa

SEQ ID NO: 75281 - DNA, 471 bp, Glycine max
  Peptide Sequence Number=SeqID_192059
atggaacgttcaactgattgtcacactactacaaaatctagatttaacatcgttaagttaacgtcgatttttgataaaaccgatgttaacaaaaatgcggtgacaaaatgttttgcaaaccctttctccctcaccgtcgtctccctcctccacgacactgcattttgcgacccatcaccaccgtctcctcgtcaccccaggtcgttaggtgtcaccatcagcgccagtgaacctacaactggtcctcgtcaccccaggttcatcactactgttgcgagattcaggaaatctaggaaaggtagcagcaaaggtatactcactttggaaacttattttagagtagaaatgtgtgatttatggtctgattggagacctataaaatgtgctggcacatatcatatggtagtagaaacatggagagaaatcagagaattagtattcacaaatcccaatgctagaactttccattaa

SEQ ID NO: 75282 - DNA, 315 bp, Glycine max
  Peptide Sequence Number=SeqID_192060
atgggtgccaagtacctcgaagcggtcaagcaaaggttgcatgccatcaaacaatggtccccgaacgaaattaggttaaccactgccgctgctagtgctatgtatgcaaggaggaacaacgcagaaagaaaaaggaaaatactgcaggacaggacatcaccatcgattctagaggaacctcaatcatctgagttgtcttccatctttccacaaccaagagaacctgaattaggtgcatctgaggctaacataatggctaaagaccaacctagaagagtcacccttgaagattactctagttttactgtgccgtaa

SEQ ID NO: 75283 - DNA, 144 bp, Glycine max
  Peptide Sequence Number=SeqID_192061
atgtggtggcatgtgaaagagggagtgcagtatgatgaagaatttggaaaagagaacaagtacgaaggtgctgcaaatgaaggaggcagaggaccaagtacatgggatacctattctcataaatatccaggtatctctgtttaa

SEQ ID NO: 75284 - DNA, 255 bp, Glycine max
  Peptide Sequence Number=SeqID_192062
atgagggaatttgggactatggcagctcacccaggcgagctgatgcttagtcctgaaaaaattgggtcacccaatcgagctggttccttcagccctaagcaatttggggccccaagcgagccaaaggctagtctaggcgagccaaggttaaataagaaattttgtagaagtgttgatcttgagcctctagctaagctaattatctggcttagcgagccatccgctaagcgcagtagttcatggctaagcacatag

SEQ ID NO: 75285 - DNA, 330 bp, Glycine max
  Peptide Sequence Number=SeqID_192063
atgggcgggcaaggagagatgaaaatgtgcatcttccaaaaaggagaatgcgagggagttgccaccaacgtttattcgaggaaaaacgttagaaaaacaaaaaagaaaggtctacaaatttcaaaaataagggttcgagagttgtttacgtgtagggaagatgaatggcagcagaatggagaaaggaagagagagaggagatgccacttcaaggagaagatgagtctagaagaagctcaccaccataggaggccatggctaagagcttggaggaaggagatgaatgaagggagagggagagaagagcacgaaattctgtgctctaaatga

SEQ ID NO: 75286 - DNA, 240 bp, Glycine max
  Peptide Sequence Number=SeqID_192064
atggattggtcacttaggctaactgatgcaatcctacccccaaggacattggataaaagactccaagaagattgggtcagtgatgcaagagaaggccctagggttctcatgagtcttaggacctcatttgttgcaaaaaatttcgtgctccttctccctccatcatcttctcatacctctaagctcatattcatggcttcctatggtggtgagtttcttcttgactcatcttctccttga

SEQ ID NO: 75287 - DNA, 777 bp, Glycine max
  Peptide Sequence Number=SeqID_192065
atgaatggacaagaggttaggattgaaacggaggatgcagatctcaaggtttcagattgtatactatctactgttgtcaatggcttcagcaagaaaatagggattttggttatggttaaggttttcaaggagctgattttcaagggttatgaatcgggtcaagtcacctatgcttcagttataaatgcatatttccatcttgagcaatatagcaaagcagaagaggtatttttagagatggagcaaaaggggtttgataaatgtgtttatgcttactcaaccatgattgtgatgtatggaagaatggggagggtgacaagcgcgatgaagttggtagccaagatgaaacaaagagggtgcaaaccaaatgtgtggatctataactccttgatagacatgcataggagggacaacaatttgaagcagcttgaaaagctgtggaaagaaatgaagagaagaagggtagcaccagataaggtgagttatactaccatcattggtgcttatagtaaagcaggtgagtttgaaacctgtgtgaagcttttcaacgagtataggatgaatggggggcttattgatagggccatggcaggtataatggttggtgtgttctctaaagttggtctggttgatgaattgttgaaactcttacaagacatgaaagcagaaggaaaaagactagatcagaggctgtaccaatctgcttggaatgcttttaaagatgtcgggttgcaaattcaagcaaggtggatgaaagagatcttttttgtgacataa

SEQ ID NO: 75288 - DNA, 267 bp, Glycine max
  Peptide Sequence Number=SeqID_192066
atgattttcgaaggcaccatcttagacttgatcgtgatttactcacgtgaaaccagttggctagctatcttgctcagtcactacttgcattatgatgccgtagctagctatcttccacgctgcgtcaccccctcatcgaacatcttcggtcgtcattcacttaccgtggaagcaagtggatggggagagtcaacgattgttgcaacaacaacagtagcagcaggaggtagttcgattgcaagatatttacatgcaaagcagagctga

SEQ ID NO: 75289 - DNA, 264 bp, Glycine max
  Peptide Sequence Number=SeqID_192067
atgaagcttttgagggagctaggccttcaacctcgccaaatcgctgtttggtttcaaaatagacgaacaaggtggaagaccaagcagcttgagcaattgtacgatgtgcttaaacaccaatatgatgtcgtctccaatgaaaagcaaaagcttcaagaagaggtggagcaaaggtaccggcagtaccacaaccagatgaagatagtgatatcctcatcatttgagcaatctgcatttctccaagtggagtctaaacaaatgtaa

SEQ ID NO: 75290 - DNA, 219 bp, Glycine max
  Peptide Sequence Number=SeqID_192068
atgaaccgacaagcagccttccggtcatatctgtttggttggtgcaaaccaaccggcggtcatcatgtacagagaaatcaaatttccaatcatcattcagtgtaccttcaaatgggagtgatttggacaagaaatgagggagatatggcagaaacaagaattgggaataagggttcacgagaaaatgagaaattgcagatttctgattttgaattttga

SEQ ID NO: 75291 - DNA, 117 bp, Glycine max
  Peptide Sequence Number=SeqID_192069
atggccccctctctttacagcgacgttctctgcttgtccagcgccgggaagggacgacgatcggtcagtcgtgaccctatcgtccatttgcatccgttcctaagtacctataagtag

SEQ ID NO: 75292 - DNA, 300 bp, Glycine max
  Peptide Sequence Number=SeqID_192070
atgtcgatgcctactgtgaaaaagaggctaagttttgaagtgcaaaaagtgacagttaagcttagctcagtagttgggctaagcgtgcatccaccgctaagtgcagcttcagcgtgcttagcgcgaaggagaatctcgcagagcatcagcatcaagaccggtaagcagatgattggcacagattccagagcacaccacagtgcctattttaggaaaagagccctagaagcagcaagagaagcagcttgtgcgttgaagcctagcttttataagattattattgttagggtttctttgtaa

SEQ ID NO: 75293 - DNA, 225 bp, Glycine max
  Peptide Sequence Number=SeqID_192071
atggctacaccaatgagcacttcttgttatttagataaagatgaaatcggtcagtcaatagatgttaagcaatatcgagataaaaagagcacaagtggaacttgtcaattcattggaactgctctagtctcttgcatagtaagaaacaaaacagtgttgctttatccactgctgaagcggaatatatctctgtcggcagttgttgtgcacaaattttatggatga

SEQ ID NO: 75294 - DNA, 324 bp, Glycine max
  Peptide Sequence Number=SeqID_192072
atggggacaaggggttgcatcagttacaatcccgttcttactataagacaacttggctaccctatgagaggggcaccactagaggaagagctcgcgcctattattgcacgaggtttcaataagaccaacatggaggcgcttcagaaggtccgcaaggcatgggagatggtgcaaaagaaggatacgaaactcagaggcaataacaatgggcccattggcagctaccgtaggtggttgaaagcccgcatgcaaagtttggattggctcccgagtttgagaaccactaaaggggtggaagttgaggctcgagaggaagatgaagag

SEQ ID NO: 75295 - DNA, 1038 bp, Glycine max
  Peptide Sequence Number=SeqID_192073
atggttattcaaacacacctcaagcgtctgtttggaattagagacgaatggatgtttgccaaaggagtcatttgtatctttcttccagcaggtttggaggtgtgtgaatgcaacaagaaaaaacctgcgactgctagtgagtgcaaattgaagcaaaggttgctgcaaccgccgttgagtgagggcggttgggttacgatgttgcaagcaatgcatctgatgatggccaacacttacaacgttgccgtggttttggtcataccgtgggatgtggagtggcagaagggttaccacagaattcattcacatgtcacaattagagggctaaagtgttcttctaggggtgcatgtgcatcttttgtgtgtgaagcgaggaggaaccctgaatctttctctaggcaaaacaagcatggattttccagaagcaggaagtggctcaatgtagacagagacagctttgagaacattgaaaaagacatgttatcattgaaaaatggttcattggtatctcattctagcacactaaaaaaccatgccaatgccaatgctgcccctaggcctaaagagaaggagattattacactgtttaagaagctactgaggaaacactcagttgagcaagtaaagagaagtagtggtgttaacagaggggaaaacgatagtttggactggttgcaagattgtggtcaagacaatgaaagtcaaagcacaaaatttcctgatttaaatgagaaagatcaggatcaaatcggcatcaagcttgatcctgagccagagcatgactctgaactggaacttgatccaaaggataagcccttgttccccgaagtggggattgcgatttcacatgatgatgattatcttgattctgaacaaatatataatgatgaacatggggaggaccaacaagtggaacaacatgaggatttgagtacaatgaagctgtctgaactaatggcacttgcgaagtctcgtggcctcaaagggttttcaataatgaagaagagtgagctcatggagttgctaactggaagctga

SEQ ID NO: 75296 - DNA, 2499 bp, Glycine max
  Peptide Sequence Number=SeqID_192074
atgcaaatcgtgcataatggctcctttcaagggtttcctacacatgctcaaacggttatgtgtttgcatttgaaaccagtgctcgatgatattgtggatttcaaaatccctttcgatgaaaatctgcatagagaatgtgaagaattggatatgcgggttaatgaagctagggagttcattgaaaaatggggcccgaagatgagcaggattcacagtgttcttcaaagtggggaattgttgatcaagttacagaactcttcatataagatttgtcacatgatagttaaatcactaaagggacctgcatctgttttggtttcgggtaatcttcaggaacttcagtgtcttaagaaggaacctgcaatgatctatatagaagacgcattgagaaatcaaagggataatatcgaaccttgctatgattctctaaaggaaattatacggttactcatgatatcaaaccaggagctactgatagaaagtattgctgtggaaaaggaaaggtcaaatgctgaagtcaataaaacaaaaggggacttggatgaaattaaccaaattgtgaatcttgtgtgcagtttacgtgattatgtgatgaaatttgagcgccctgaagtcaaaagtggtgtttcaattcccccctattttcgatgtcctttatcattagaactcatgtcagatgctgttattgtggcttcaggtcagacatatgaaaggcaatccattcaaaagtggcttgatcatgggctaactgtttgtcccaacactcgccagatacttgtccatacaaatctcattcccaattatactgttaaagctatgatagcaaattggtgtgaggaaaataatgtcaaacttcccagtaactctaagcaaagtaattcctctcatatttcatccccctcagatcatttattacatcaagatttagatcgtctgtgtagctttgagtcttcagctagtagcgattccaattcaaatcaaattgcaaatgcatttgagaaaccaaaggatgataactctttcagatcaagcagggaatctgatagaagctggaatggagagacagaaaagtttgagcaacaatcccctgcaccttcatgtagtaacagcagaagtgaatcattttcaagttctatttctagtactgattatgtatttccagttttgaaagaggtgtcaggcatatctaataagcatcaaaatgtggagttgtctagagaaattactgatgggtgtcctgcttctcctgcatataaagaatcagtgatttatccttggttatctggaaagcaatttcatagccctggatcaaaaattggaaggatggaggatgaaaataagtataatgagagtaacaatattagtattaccagtcattcaaaagttgcttcccatcctgtaggatccaatgaattgatcaccacatcccatgtcaatgagttgattgaagatctccagagtcaatcgaatgaaacacaaactgctgctgcagaacaattgaggctctgtaccaagcataacatggagaaccgcatcagtgtagggcggtgtggggcaattatgcctttactctcactgctatattcagaaaggaagataatacaagagcatgccgtgacagctctactgaatttgtcaattaatgaaggcaacaaggccttgattatggaagcaggggccatagaaccacttatccatgttttgaagacagggaatgatggtgcaaaggagaattctgctgctgctctgttcagcctctctgtaatagataacaataaggcaaaaattggccgttctggtgcagtcaaagctttggtgggtcttctagcctcaggaactcttaggggaaagaaggattctgccactgctttattcaacctatcaatattccatgagaataaagctcgtatagttcaagctggagccgtgaagtttctggttctgctattggaccctactgataaaatggttgacaaggctgttgctcttttggcaaacctgtcaacaattgcagagggccgaatagaaattgcaagggaagggggcattccctcactagttgaaattgttgaatcaggttctctgaggggaaaggaaaatgctgcttccatcctcttgcaactatgtcttcataatcaaaagttttgtaccctggttctccaagaaggagctgtacctcccctagttgcattatctcagtctggtactccaagagctaaggaaaaggaaaatagtgttcaaatcttggtgttcaatcatggttacagaatcaatttgttgaaacaatgtgctaaaaaatctggcattctaatctatgttctgcagtgcattcttcccccagccttgcccccaaaaacagtgaagaaagtctcacatcataagcataatctgaaacgtggaagaagtgctaacaatatgttcgcttacatgcaggcacaacagcttctcagtcattttcgtaatcagcgtgaaggagtcaaggggaaggggaaatcatga

SEQ ID NO: 75297 - DNA, 294 bp, Glycine max
  Peptide Sequence Number=SeqID_192075
atggaatgcaaagagaagagaatatatggttggtgtgcttctaaaaataagaatactgatacggcatgggaagtcgtaggggaatcgggatacggcgacatacatcacctcacccgaccacaacattccgtcagcgatccaaggaatgatcgagatcctccgcgccggcaagcacctccgtcacgtgcaattctatgtgtccccctacgcccgcacccgatcgacgctcgcaagttcagacggcgtttcttgaagaagatgatcatcgacgtgagggaagagtcacgagtttga

SEQ ID NO: 75298 - DNA, 612 bp, Glycine max
  Peptide Sequence Number=SeqID_192076
atggattcaaatattcaagactttatagacacatgtaactccgacaacacctgcaacctcatcacaaatagcatcaccaccgccaacttaacagctagtgctgcctcttcctctcctgcttccacctccatcaccagcagcagccgctacgagaaccagaagcgccgtgactggaacaccttcggtcaatacctcaagaaccaccgtccccctctctccctctccaggtgcagcggtgcacacgtccttgaatttctaaggtacctggatcaatttgggaagaccaaagtgcacacaccgatctgccctttttacgggcacccgaaccctccggcgccatgtccatgtcctcttaggcaagcttgggggagccttgacgcactcatagggcgtttgcgtgcagcttttgaggaaaatggagggaagccagaggcaaacccttttggagcccgagctgtgagactctaccttcgtgaggttcgtgatctgcagtccaaagccagaggaattagctatgagaagaagaaaagaaagcgtccaccacctcagcaacaacccatgccaatacctcatcaccctcttcctcctccaggtgcaagtgcaactcattag

SEQ ID NO: 75299 - DNA, 270 bp, Glycine max
  Peptide Sequence Number=SeqID_192077
atgacaaacattcagagtcaaatactcctgtcaaaacataaagagctgaggggtgtttcgggggttcaacggcaagcaacaacagcttatggcagtcaccaatggtcttgggttgtgaaaaataagcgagctcatctcgctaagccagagtccactttttgtgcttaccatgagaattcatgcttagcgcaacttccactgcactatggctcgcttatcgtgctcctgctcgctaaacgcaatttcctctcgggttggaaatgcgcttag

SEQ ID NO: 75300 - DNA, 803 bp, Glycine max
  Peptide Sequence Number=SeqID_192078
aactgttggtgttggggatcatactgtttccaaatgcaaaagaactagtggatttagcagtgatcgatgcttttcttgcttatcaccacagcaaggaaagctcagtcattgctgtcttggccgatgcatatgacacattcgacataagatgcgaaaagagcaatgcgaggattgtctgttgcacgattgctctttatgtgtggttggtttcccatgtttttcatcatgaaggtatgataagagcgtccgttagttggttcccccgatggaaagaaggaggggccgaagttttatgctcgtgtgaaggattcccaaatgtccccttgatgggaacaagaggttgtattagttataatcccatgctggccataaggcaactaggctaccctatgagaggggcgccgtcggaggagatcattgcgccttttgtcgcatggggtttcagtgatggcaatgcaaaaatacttcagagagttcgaaaagcatggaatacagtggaaagaaaagataaggagcttaggggaagcaacaatggtgtcatcaacggctatcataagtggttaaaggctaggacgcaagggataacttggctcccaaagctaaaaggtccaagtgaggaagaagctaaagtccctgaggaaagcgaagaagtgcaagccttgaaagcaaagcatgaaaagatgagagtggtcaaggaaaagctaaaaatgacattcaccagggtcaggaaagagtgtgatgagctaagggatgtcaacatgactacggccgaagcgttagagagggaaacaaagacggcctaa

SEQ ID NO: 75301 - DNA, 234 bp, Glycine max
  Peptide Sequence Number=SeqID_192079
catttgggaccatggcagctcgcctgggagagctgagacttagccatgaagcaattggctcacccaggcaagctggttacttaacatggaagtcttttggtggcccaggcgagatagaggctagcctgggcaagccagggttcagaaaacttagtaacatgacccttttgcctctccgttttggtatctttcacattcctgatcaaaacgttgaacgacctctcattttatgcg

SEQ ID NO: 75302 - DNA, 936 bp, Glycine max
  Peptide Sequence Number=SeqID_192080
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatatcatctgaaggcaatacagagccttcacgtcccttgaagccctccagaggtgaaccccaaggagctggagtagaagggtttgagctagaagcgtcttggttgacgcctagtgcagttgtgttctgcggcgaattcccagcaggccttctgtttgatgcactagctgacgtcaacgaaatatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 75303 - DNA, 222 bp, Glycine max
  Peptide Sequence Number=SeqID_192081
atgaaaaaggtctcaacattgtttcaattagaagatcatggagccccgtcagcacctcaacagaaaggtgttgtggagaggaaaaatagatcccttgaagaaggtgaaagaacacttctaaatgaaacaaggttgcgaattaatgaagcattgggcttgaatctagaattgggcttgggcttgaatccagaattgggcttggacttgaatagggcagactaa

SEQ ID NO: 75304 - DNA, 174 bp, Glycine max
  Peptide Sequence Number=SeqID_192082
atggctcgcttagtgcgcataagtggcttttggcttagcggcagtcttctcgctcagtgtggaggattggaggcgccaacggtgatcgcacttagcgggtttctcgctcagcggatgaattggcttagcgagttgacaattttacacttcaccaatcttgcctatttcacctga

SEQ ID NO: 75305 - DNA, 375 bp, Glycine max
  Peptide Sequence Number=SeqID_192083
atggagaacaaaaatagaaaggaaaatcttaatgaggagttgaaggaggttttattcaacaaattgagccagagggcatcacagcaacaacctgcaataaataaaggttatcagcattgtacccacctagtggcattgggaaaaatatatgaggggtcattaatcgtatgccatgtgagtttgaccgatgatatagtgaaggtcggtgtctcaaaagctatagatgaagttgttgaagttccttttcctactttagaggatttacagagacatccaaagaaaccagttcaacatgttgataggttaaagcccattgattatcccttagttgattttgttatggttttctctgacctttaccaacaaccttattag

SEQ ID NO: 75306 - DNA, 750 bp, Glycine max
  Peptide Sequence Number=SeqID_192084
atgtcgccgccaccatgggaagctctcatcctcgtagccacttaccttgaccccaaaaccctagccatggcctcatgcgtctcaaagtcatggttctcttccatgtcctctgacatcatttggaaacccatattagccacccacttcccctctctctccacccttccctcctccgcccccactgtcgcctaccgccgtctattctcgatgggccacaccgccaccacgcaccgcctccggggaccctcgaagccgagcctctcgctcggtgacctcgtcttcgccgtctccatctgcacgcgcgactctaacattgtctccattgcgagcccttgtgacgcgctgcgcgtggacgcacctggggtgtttcgcttcggcgtgggctgcgacggcgccgttttgagggagggggtggaagaggtgaggatggcgtggaacgtggtgttgagagggtggcgaggggttttcacgatgatggagcgcgtggggaaggtggggttcgcgcccggcggcgaggggtggttctcgcaggagctgccagcgccggggtgttgctccggtgcggtggagagtgcggtggtggcggatttgaaggtgaggatgtgtggaggggaggataagaatgtgaatggggttagggtgaacgaggtgagtgtggggattttaagtgttgtggattggaggtacgttagggttgaagatgggcttaggtacttgcaacattttcttctcactaactatgcaaactaa

SEQ ID NO: 75307 - DNA, 294 bp, Glycine max
  Peptide Sequence Number=SeqID_192085
atgtcttttgatttaacaccagtctatgacttaagtgactttgttgatcatgtgatgcaagttcatgaagatcagagaccagaaagaaaagaatgggaaagagttgtgcaggaagctctagctgaaatacaagttgaagaagatattgccaaggtcactaaagtgcttgttgatcttaaaacctttggtgctttgcaagagaatcccgaccaagttacttcaccaaaagtgtcaactgctgccaaggctaatgaattgttacacactacacatcctaaacttgcatccagttag

SEQ ID NO: 75308 - DNA, 867 bp, Glycine max
  Peptide Sequence Number=SeqID_192086
atggctccaaagaaactctccacgaagaggtctagaagagacgccacaggagaaggatccagtgctgcctcaggggatgacttccaggaggagatagctcgcagacattggacaccgctagtgacccccatggccaagttcgaccctgagatagtcctagacttctatgctaatgcctggcccacggaggagggagtttgggacatgcgctcatgggtaaggggtcaatggattccctttgacacagatgccctcagccaattcctgggcgacccgctgattttggaggaaggccagcagagtgagttcagccagaggaggagcagggctgacggtttcgatgaggaagccatcgcccagttgttgtgcataccggggcaggattttgcccggaccgctgcagggaggcgggtgcggatcatgcgcaccagcatgaccactttgacccagacatggatgacatgctgcttagcaatgtcttacctagcgatcacaactctgacctccctctgcctaagtgctaccttcatcgagaagtactgcacgcctaggcaggtgcagcagggtgacacacatcaggccacaagtgcaccgccaccaccttggcaggcggccaaccaccgtgggcaggtgcagatacatgagtgtctctaccggttcagcctcagtcagcaggggcagggtgtcgccccttttgtatgccctaccacagagcagtttggggctgaggtcgcttggcctggagactggcccgatgcccaagtaggggaggagcctgcaggatcccccggtgaggcggatgaaccccatatggatgaagatatgactgacctgctcggtttcttgggagggagcggagccacatga

SEQ ID NO: 75309 - DNA, 297 bp, Glycine max
  Peptide Sequence Number=SeqID_192087
atggtcacttgggatgactctgacaatgagaagagtaacaatttagatgatgagaaagccaacatctatttgatggcagatacaaatgaaaagcttgaggtaaaaacctgctttgaatttgatacctcttcttgttcttcatccaacaatgaagaagagatgccctatgatgttcttcttcagaataatcatatgatttctcttcaatgcaaaaattataacactttaaccatgctgttaaaattccatcaacatccttatgacaagtctggtctaggtctggaaaaaggagcataa

SEQ ID NO: 75310 - DNA, 381 bp, Glycine max
  Peptide Sequence Number=SeqID_192088
atggtatgggattttgatatgtggaatgatccagctaagtccaatgacatcattgtcaagttggaaaacagtgccaaagtggttgattctctaagggacttgaaatacaagctaatcctcttgcttgctgcctttggtccaccatacttctttgccctattgtatgcccagcaggtagaggaagcaaagctgatcaatcagttggctgagataaatgttattgattatggtctttataaacaagcatatgaaacatcattggatgtgagtgagattctagatcagtatgagatttctaagcttcttaaagggcctttcgatatggcaggagcatgtttggttataaaagctggacctaatggcatctattcaaaggtttga

SEQ ID NO: 75311 - DNA, 429 bp, Glycine max
  Peptide Sequence Number=SeqID_192089
atggggaaacaactccaacagatgaaagagacaaccttgtatgtgaaggtcctgatgacggatagcaagaacttgacacgaggaagaaatctcagaaacccgagtccaactggatttgtatcttattcgtcagtgcagttgaacatacctatgaaagaaaaaacatggctaaataatacatgggtgggaagattgaagaaccttgcgttgtttgatagaatggaagatgatctcatgtggaatgggggcgacgacatcacgccaaagtatattagagatgacatggtattgttaataggcctcacagagaccaaagctgcacaaatggtgaaggaagcaaatgagcaaggctcatccttattctactcgttggaaaagtcgactcctcagctgagaactggatatcgtctagtctggctattatgctag

SEQ ID NO: 75312 - DNA, 648 bp, Glycine max
  Peptide Sequence Number=SeqID_192090
atgtatcttagatgggccaaaagacaaggttatgcaggaaggattgttgacaagtgtttgttcaagaatggaggaattaattctgcgattatagagtttgaatttgagtgtgcatatggatatctttcaggggagaaaggagttcactacatgataagaggttctccaaatgaatcttctcagcttgaggctagctcagcaactgtagatgttattcccatgttccttgagaatgcttgtgatcttgaaattgattctgaggatttgattatctcatctcccttgattcatggggaaaacaagagacaaactgatcatacagtttgcattcagcatatacctactggcataagtgtccaatcctctggtgagagaagctactttgcaaataagatgaaagcactaaacagactgaaagctaaacttctagtgacagcaaaggaacaaagagttgcaagtataaaaagtatacggaaggaaaacatcgtcaatctatggcaagaagaatttcggaggtacatctctcatccgtacaagttagtacacgatgtaaagacaggcgttgaggtgccagacctaaataatgttctggaggggaatattggacctctcattgtagctcatattaatagcagagtcatgtcataa

SEQ ID NO: 75313 - DNA, 513 bp, Glycine max
  Peptide Sequence Number=SeqID_192091
atgaatggcagatatgatggaaaggaatgtcaagtttatcacaagggatttatatataagacgtcatctgaagttctttttgaaagggaaagcaatgctgtcacagatggacgattgcaaaatttcccagtgtcttcatacgaaactgccatggaaaaaatttcctctcttattactcgccaaaggcgtggggaaaagccaccgatttccaacaaattagaaataatgtcattgtatctcaagatattgggtttggatgaagatataaataagctcaacattattcatgtggcaggcacaaaggggaagggttcaacatgcatattctgtgaggcaatattaagggagtgtggctttcgcacaggagttttcacatcccctcacctaattgacgtgcgtgaacgatttcgtatagacgggttagtaattgaaagaaataacttgtctagaatggctgatggagtatcagcattccattcatctattctgatctctgtcagtctttttcaataa

SEQ ID NO: 75314 - DNA, 507 bp, Glycine max
  Peptide Sequence Number=SeqID_192092
atgtggcggtctttgcgatggcaacgggtattgttcactcgtgaaaaaggcaaaaagatccaccggggatgccttgaggtggagggagagaagatcagtgtgacgctggtcgaagaagcgtcatgcgccgtgtgcgtgaacttcacacaccagggccctgcatggggctgcgtgtggcagtgctttgagttggctgccacacggacggcgtgccaattttcaaaaaggtcaccggaaaagcttaaacaagtcgttggaaagagacgaagcatgatggtgttgtcgctggactgtgggtccaccaaacagcggcaaaacagagccgaacaaaggctaaataggttcaccggaggaaaaggagcatggcagggaggtcgtcgaagaatgggtcacacatcggaaagggaaagtgcggtagaagaggtcacagttggcggtgttgggttcactggagagaggcactttggaacggagggtcacgccagcgagatggcagctcagtggtag

SEQ ID NO: 75315 - DNA, 303 bp, Glycine max
  Peptide Sequence Number=SeqID_192093
atgccaccactatttctgtttcttactatattggccttcaaaatatttatctctgaacaggttgatgctgccataatagaagttggtcttggaggcaaagaagactcaactaatgtgattaaagaacctactgtttgtggcattacttctctaggcatggatcatactgagatattaggagatactcttggacagatagcttcacacaaggcagggatttttaagcctaaggtacctgccttcacagtaccccaacctcctgaagcaatggatgttatccttgagagggccaaagaactaatg

SEQ ID NO: 75316 - DNA, 250 bp, Glycine max
  Peptide Sequence Number=SeqID_192094
gtttttgccgttaaaagttagatcggagttagacgagtatccacaagttcggaaattgtcatgtctagttgttttgaaggacaagcttttggttccactggaagtgactgaacctttcgattgtaaacaaatgaagggattagagcttggtttatctggtgatcaccaattctataatgctgctcttgccgtctcactttctagatgctggcttcagagaacagggaactggggaaaaaaatatcaaaag

SEQ ID NO: 75317 - DNA, 1152 bp, Glycine max
  Peptide Sequence Number=SeqID_192095
atggaaaagaaaagattagatgactatgaaccaggtcctgttccttcaccaagagcattagatagatttgggtttgtaaaacaggatgttaatacttctgaaggcttattcaagaatagagcagcctatgagtatgagagatatagggaggagagaagggttagaaaatggaggaagatgattggggttggtggcagtgactggaagcattatttaaggagaaaacctcatgttgttaaaaggcgtataaggaaaggaattcctgattgcttaaggggccttgtttggcaattgatatctggaagtcgagacctgttgctgatgaaccctggagtttatgagcaactagtcatatacgagacatctgcctctgaactggatataattcgagatatttctcgaaccttcccttcacatgtattcttccaacagagacatggacctgggcagcggtccctctacaatgttctaaaagcttactctgtctttgacagagatgtaggctatgttcaggttttactcaggaacccatcacctttctgtgcttgttacaaagggatggggtttttagcgggacttttgcttctttatatgagcgaggaggatgcattttggttgttggtggcattgctaaaaggagccgttcatgctccaatggagggcttgtatctggcaggattgcctctggtacagcaatacctctttcaatttgaatgcttggtgagggagcatctactgaagttgggagaacatttttcgaacgaaatgataaatcctagcatgtatgctagccagtggttcataactgttttttcgtactcctttccatttcatttggctcttcgaatttgggatgtctttctctatgagggtgttaaaattgtctttaaagttggcttggccctattaaagtactgccatgatgacttgattaaactacctttcgaaaaactcatatatgccttgaaaaacttccccgaggatgcaatgaatccagatacattgttaccactggcttattctatcaagagtctgagcaaaaaaggttttactgggccaaaccttgatcagttcattaccttgaacatgcagctcaaatatagagcacggtttaaataccattttaatttggtagtttccatgtcaagatag

SEQ ID NO: 75318 - DNA, 252 bp, Glycine max
  Peptide Sequence Number=SeqID_192096
atggcaccatcatcaacccatgaccatgtcaacccaccaaaatcacgagcagaaaagctcattagaagccttaacctatttccaaagaacccaataaacattgttaaaggtgatggccttgctaatgcttttgtctcagggaatatcgtggagaagaagttctcgtttcttggtgattctggaccttcaattgaagaccttggtcaccatgcaggttacttttcacttcctaattccaaagctgcaaggtaa

SEQ ID NO: 75319 - DNA, 192 bp, Glycine max
  Peptide Sequence Number=SeqID_192097
atgcagagagatcctcagttgtgcaatgatgcaacatgctttaaacctgggaagtttgatggggaaggagaagagaaaaagttggtatgggaagaagggcttgcccaggagaacccatggctatgcaaagaaagcggtgagtatctaaaacttatagttttagtgtccaagtggtggttgtgtacatattaa

SEQ ID NO: 75320 - DNA, 1515 bp, Glycine max
  Peptide Sequence Number=SeqID_192098
atggagcgattgacatgtgaaagattgaatcttggagtcccgaagactcaggttttatgggtttatagctttgattgtggaagaagcatggcttgtttttctctaccttgcaatactgggtcatttgctaccccaactttgactcaaagaagatatttgggtgtgtgtggagggtttaaccaatgcttcaaatttcaacatgagttggtgtggaacaaggagctagggtattgtggtagtagaagtagaattccctcattgagggttccttattgttgcaagactccacatggtgtttcaagtaaaattgagccacttgtgagtagaagcaagggtgagaggaagactcactatggtaagggtggaagtgatgggctgaggaagagattttcgttgagactgcggccaaggttacggttattggctatgagaatgaaaagggcttccattaggtccattttgaatgaggtggggatctttattcgtaagaacattagagcagtgacattttctgcttcaatttctaccgtgttctgcctttgtttcttgtttctaaaattgactacactcccccctcctaaaagtgttccatattccaacttgatcatcagccttcagaatggatatgttgaaaaggttttagttgaagaggggtcgcgacgcatatattacaatatgaagtcccagcatattgaaaatgatggggtttctggggaagaatctgaagtggcagatgtttcaattgataaggatgttgataagattgggagtgagggtacttctggagctggccaaactccagtggggaatgtactaaagaaattctccaagactcgagcttcaatccctgagtggcagtattccacaagaaaaatagatcatgatgaaaagttccttgttagtttgatgagagaaaaaggggttacatatagctctgcccctcaatctgtactaaggtcaatgaggagtactttgatcactgtgataacactgtggatacctttaattccattgatgtggcttctgtatcgccaactttctgctgctaacagtcccgcaaggaagcagagaccgaatggtcagacagttggatttgatgatgtggaaggcattgattctgcaaaagtagagctcatagagatagtttcatgtctgcaaggggatataaattatcaaaagctaggggcaaagttacctagaggtgtgttgctggttggtcctcctggaactgggaagacactacttgcacgtgcagtggcaggggaagctggtgtaccctttttcactgtatccgccagtgagtttgtggagttgtttgttggaagaggggcagctagaatcagagaccttttcaatgcagcaaggaaatttgcaccatcaatcatattcattgacgaacttgatgcagttggaggcaagcgtggaagaagtttcaatgatgaacgtgaccagacgttaaatcaggcaagtttacttatacattgtgcctttagcgaaaccaatgatctccaatag

SEQ ID NO: 75321 - DNA, 606 bp, Glycine max
  Peptide Sequence Number=SeqID_192099
atgcatccagaactgatcaagatgttatggagaaactctgagtttcaagacaagaagaaaattatctccagaattcttgggaagaaggtcattatgagaaccatgttcttaaggtgttatacaaggagaacctttacaaggtgggaaataagaaggttgagtacaacttcttatgcaaggaagcaaaattgtggcaaaatatttgtaacaagctttctgcacaagttagggtctaagaactctatacctgacctgcacatttttgccctctttcatctcatggaaagcataccctttaacccgcctcacaccattttcatcaacattcttcgcaccatcaagactttggatggatatgaagatatctactatgtagtcctggtcaacaagattctttgggagcaatgtatgtatcagattttcaactctaaattggatgagcaaacgaataatgccattatgatcaagggatcaatgattgccaagcaacaaaactttgctatgaagctggaagttgacatgacaaaaagggaggtacctcgagtggatgaggaagaaatcattagacgaagacaagagcaagtcactagagtcaaagctaattaa

SEQ ID NO: 75322 - DNA, 483 bp, Glycine max
  Peptide Sequence Number=SeqID_192100
atggatgaaagggactttgctgatcatgtgatgcaagtgcacgaagctctcaaatcagaaagggagaaatgggaaaaagctatacaagctgagcttattgcaacacaagttaaggaagccattgctcatgtcactgaagtacttgatgcttccaacatctttgaaccttcaaatgaagccacatatgtgcaaaaggatgttcttgatgttgtagttgtgttttctagcagctctagcaatccaaaggatgttgctttcattagttatgctgcccccaatgctctatcaaaagacagattccaagccattgtgactcaggctatgacaaagcaaagggaagaaacacaagaactggtgaatcaagcaatcatgaagcagagagaagaaatgcaaaaggagcaaactcagatgaacatgcttggcgctgtcgtccaaccaccaccaccagttcaacaacagaggcttcttggtcctccaccttaa

SEQ ID NO: 75323 - DNA, 1206 bp, Glycine max
  Peptide Sequence Number=SeqID_192101
atggaaatctcccccgaggtgaagaaagctgtttgcagatattgcaaaagtaaatttgctactggtggaaatgggtcaagtactacccatttgaaaagacattccaaaatttgcattcaaaagaaggctaaaacaactgctaaaagtagacaacccaccattccattccagccttcaaattcaaataacctttttatgattcccggtgttagatactctaacaaaaagatgagggaaataattgcaactgctatcatggttcatgaatatccttttagtgttgttgaggattctatttggatgtgggccttccaatatgcaaaccctgattttcataaggttacacataaaactgcaagaaatgattgtttggcattgtttgagatggagaagaaaacattgaagaaattcttaaaaagtgtgagcaagatcattttaactacaaatatgtggaaatctagccatcaagtagttgaatatatggttattactggacatttcattgacgcaagatggaatcttcaaaaaagagttttaagttttgtgaaagtgcctgctccaaggcgtgtgcaagatggccttaatacaattaaggatatcattttcaatattcgtgaaagtgtcaaatatattaacctcaacgatgcaagactaaaggcattttgtgttgttgttgagcaaaaacgcttgaaagaaatgaaacttgttattgattgtccaacaagatggaattcaacctttaatatgttttcaactactttgaaatttaagattgcatttgcttcttacaaagaaaaagagcctcactataattatgcaccttcacttgaggagtggaatcaagttgagaaagtttgtaagctgctggaagtttttaatcttgctactcatgtcatctcaggtagtgagtatccgactgcaaatttgtatttggcagaagtttggaaggttaaacaaatacttgataaggagattgaagacgaagatctcttcataagggaaatggcagttgtcactagttttgacaaaattatgagcatgctttgtgaaaaggaggtagtttctcctataaaatcagaattgcaagattatcttgatgaaggtatttatgttcctaacactaattcctttactgttttggactggtggaggaacaatagcatgaaatataagatattatccatagcagttgtgcacaacaactag

SEQ ID NO: 75324 - DNA, 369 bp, Glycine max
  Peptide Sequence Number=SeqID_192102
atggcttcctatggtgaagcaaatgactccattgatgaagaagatccaaggcctacaagctccacatggagctacatcagtccctatggattcgacacttggacttccaatgcatgcaaactaggtcccaaaatccaccactgcaatatgaatctgatattgacaagcgaatccgaaaacttcatgtacaggattcttgaagatttgtgctttcatccctacaacaactcaggggataggaggattatgaagagaggcatcaaccaagtggaaaatgattcccaaactgaattgggaaaacaaatgcaagctttgacactgaagattaagaaactcatgagatctcaagaccaagccccatcactatag

SEQ ID NO: 75325 - DNA, 231 bp, Glycine max
  Peptide Sequence Number=SeqID_192103
atggaggatgttgagtcctacgacaaaaaaggagagaatgttgagtcctatgaaagcataaagacagaggacattgagtcctatgaaaaatataggcgaggagagacagaggacattgagtcctatgaaaaatatagacagaggatgttgactcctatgaaaaataaaggcgaggatgttgattcctatggaaacataaagacgaagaactttgagtcctatgaaaaataa

SEQ ID NO: 75326 - DNA, 225 bp, Glycine max
  Peptide Sequence Number=SeqID_192104
atggttggcactggttacaacgcaaggccaaagggtcgctcagggtttgatggttgtttgtcagatctagaaacaaaaagccacaaggaaagggggaaaatggtcatttccaagacttttctggacctaaactcacccaggctagcatctggctcgcctcggccaagaagaagcttcaaacctaagcaagccactcgcttaggcgaagtaatacctttagcctaa

SEQ ID NO: 75327 - DNA, 681 bp, Glycine max
  Peptide Sequence Number=SeqID_192105
atgccaaaatttctagaactaggctataactccaagtatccctttcagtggttcagcacaaacaaacttcaattttcaaaaccggaaaaatcaccatccacagtttatcgcttcaaaacaaaagaaacctatcaaagacactcaaggaaactccaaacctcaattcactcactcaaacaattaacccaacatgaaaacaaaaccgaatccaaatcactcaaagcaaacaacgctccatcgagaaacttcaacacaggaatcgaatcaaacagctaccgataccctaaccagaagacatcgatcacaaagagaagaaaaaaacacctcggagggaaactgagcacagagacgctgcgagatgaagatggcattggagtgcatgaaatggcgaagactcttctgcgcgcaatctacgagtattgcttccatggctctctctctcgtttttctattctttatttggtttggttcaaattgggagcggcacgtgtgcacctctcatttttgaaattcggtcacgtgacatggcatcgctcaatgcggtgcgttttgcggaatgacgcgccgttggtatcactgtcaactgtggaaagtgcgggttggacggataatggtggctggagaaattctataagcagattcctaatcatcaatgagaacaaaaagaaaagaaaaaaatga

SEQ ID NO: 75328 - DNA, 330 bp, Glycine max
  Peptide Sequence Number=SeqID_192106
atgtatttccttaaagcaaccatctgtaaggggaaaagcatcaagccagtcaaacttcagtggggtgcgttttacaccgcaaatcctggaagtgttcccgctgccactaattcaaggctttcacctctgaagccagaacctgttgattataattatggctttggtgcgacagttgatatacctcttgattcatcaacggatttgaaaaagaaggagaaggaacttcaagccaaggaaactgaattgagaaaaagggaacagagttacaatttgaaaagtcttggagaaagcatttccagtttaggaacaatttactggatgagtggttag

SEQ ID NO: 75329 - DNA, 2049 bp, Glycine max
  Peptide Sequence Number=SeqID_192107
atggctcaatctcggtacttgtttgcgatatcttgctttcatatggatcttcttagcgaagctgaagctgcattacgtcctgccgatgagcctggtgcagaggttccaaacggtgcagctggtcattatctattagggctcatttacagatgcactgacagaaggaaaaatgccatacaacatttcaagcaggcactgtcaatggatcctcttatgtgggctgcatatgaggagttgtgtatattaggtgctgctgaagaagcaactgtagtttttggtgaagcagcagctttttgcttacaaaagcaatacctgaattgttcaacctctccaaactcacatatgtcacctgaacatagtaatgaagttgccgcaagaccttgtatgtctgaagaagcgagtccaaggcaactcaaacaaatgcaaagtctcaaggatattgctacatatcatcatggagcatctattttaggaggagctgctgttgtctattgttgccccccgccgttgtataggaatgtgctgccaaatggccaaaatcttactacacttagtactgacagttctcctaagtcaacagtaaactctcctattcaagcccctcgaagaaagtttgtgggtgaaggaaagttacgaaagatttcgggtagattgttttctgattctggtcctcggcgtagttcacgactttctagtgactcaagtgtaaacacaaatgctaattcaactgttgtatctggaaatggaaccaataactcttacaagggaggttcaaagctaaaccatatggcatttcgtaccatggcaattcgtaaagggcagtcatgggccaatgaaaacattgatgaaggaatttgtaatgatgttccagatgattcttctttaaatcgtacatctataaattcttgttcatctcctgtcattgaagccaaatcttatgagcaagaagcagcaacttttcacattggtgggcaagtaacaagtggttctaaggtcatcactggcacttcagaaatattaacccttctaagagttcttggtgaaggctatagacttgcctgtttatataggtgccaggatgctctggatacctatctgaaacttccacagaagcattacaacactggctgggttctttctcaggttgggaaagcatactttgagctagttgattatttagaagctgattgtgcctttagtcgtgctcgtcagattacaccttatagtttggaaggaatggatatacactcgacagtcctttatcatttaaaggaagatatgaagctaagttacctggcacaggaactgatttcaactgatcgcttagctcctcaatcttggtgtgccatgggtaattgctacagtctacagaaagatcatgaaactgcactgaagaattttcaacgagctgttcaactgaatcccagatttgcatatgcacacaccctttgtggacatgagtatgttgcactagaagattttgaaaatgggattaagtgctaccatagtgcactcagggttgattcaaggcactacaacgcatggtatggacttggaatgctatatcttcgccaagagaagtatgagttctctgaacatcatttccatatggcctaccaaatcaacccacgatcttctgttatattgtcataccttggaactgctttgcatgctttaaaggttaataatctcgtcccacttgttgtagtgagaagcggggaagcattggccataatggagaaggctatattggaagataagaaaaatccacttcccatgtatcaaaaagccagcatactcgtaagcttagaaagaattgacgaggctttggatgtccttgaggagctgaaagaggcgcaacctcgtgaaagtagtgtctatgctttgatgggcaatatctatagaaggcgtcacatgcatgagagagcaatgtttcattatggtgttgctttggatttgaaaccatctataacagatgctgctatgattaaggctgctgttgagaaattgattatacctgatgagttccaagacgaagatgactcttag

SEQ ID NO: 75330 - DNA, 168 bp, Glycine max
  Peptide Sequence Number=SeqID_192108
atggtatatacggatcagagtgacttaatggctaaccggtacgatggagatggcggtgggaaaaagcaagtccacacgatggttgacaagattgattcatttaagcttgagttccaccattgtgcctttcactcaataaacgtctcattcattggcattattgcataa

SEQ ID NO: 75331 - DNA, 552 bp, Glycine max
  Peptide Sequence Number=SeqID_192109
atgaagttccaaaagattgagcttctctttgggaacaaaaccccaacacaaatgctcccaaaagtgactttacttgcaatcttagccatacttatatttgctatcaccccaatgtgttatcctttgagttactcttcactcttgaagatcaataaatataagcagccttcaactacatatgatgggacagaaagcttgccttcaacatctgtgaagaagtgtgacattttcagtggggaatgggtgccgaatccaaaggcaccatattacacaaacacaacatgttgggcaattcatgagcaccaaaattgtatgaagtatgggagacctgattctgagttcatgaagtggaggtggaagccaaatgagtgtgaactccccatattcaacccctttcatttcctagaaattatgagggggaaatctatggcttttgttggagactcagtaggaagaaatcatatgcagtctttgatttgcctcctttcaaggccattattattcttctcaactaagctaagttcatctccaatgaattcgaaaggtgtttga

SEQ ID NO: 75332 - DNA, 237 bp, Glycine max
  Peptide Sequence Number=SeqID_192110
atgtcggcttccacggtgtccatcacggcggcgaacccggggactcgtcggagaccggtgatcgccactgagaagaaaaccgccactagcctcgaactcctcgccaacgacgtcgccgtctccccggccgtcgccacttccggagacggcgccaccgggcgcgacctcagccatcactcgatccgcggcgaggcgctcctcgaccgggcgccccgtgacttgactccagcgaagaag

SEQ ID NO: 75333 - DNA, 375 bp, Glycine max
  Peptide Sequence Number=SeqID_192111
atggatttgcctagatggctgtttttctgtatcacatatgttagtactgatgtttcttctgttgaacagagtgttgcatatgatagatcaagtgctcctaaagactgcagagtctctggttggctgcaggagcataatgctgattctgcaattgatactgaaaagatgcatcttctatcagaatttacatatgaccttgagaagagcaatgctcaaacattcaacgtgttgaattcagcagcttctggtgtaatcaacatggtgaggctcgattttacatccaaccatggaagcccttcacacacatgtatatatcgctttagagttcatggtcacgagcctgactcggtttctatgatggcattggagtcataa

SEQ ID NO: 75334 - DNA, 462 bp, Glycine max
  Peptide Sequence Number=SeqID_192112
atgcttataggaaaaggaaaaaaaagaagacgattacggttagatttatgtaattcatacgctgttaaggtgcactctccgcatctaatttttttttccttttccttctctttctctctcatcccttctccaactgccgctccgttctccgaccgtcgctcaccgctgccggaggcactttccggtgccgatgaccctcttttttttctattcctctctaaaaaaattagaaaaacagaaatgcttccaccgctaccgaagcggagctccgccgtcgctcccattgacaagagaatcgcaagattgaaattgtctgacgcggttgccgacgtagtcggaggcaccaagagaactttgacgatgaaggtgaaattcagagggttagggtttgagttcgaattgggttgggagagtgatattgatactgagttggaatccagggtggtggaagggcttgcgtga

SEQ ID NO: 75335 - DNA, 600 bp, Glycine max
  Peptide Sequence Number=SeqID_192113
atggcagattcacatggtccaagcaacaccggcctttttaacctttatcttgatgaggttgatgagaaatggacaacccaaattgaagaatttgactatatcattcttgatggagggcattggttctaccgaccaatggtgttctatgagaagcaaaaaattgttggatgtcactattgcctcttagaaaatgtcccagatttaaccatgttctatggttatagaaaggcttttaggactgcattcaaagctatcaatagtttagaaaatttcaagggtatagtattccttagaacatttgcaccatctcattttgagaatggaatatggaatcaaggtgggaattgtgtgagaactaagccatctaggagtaatgagacaaggttagagggcactaatttggagctatatatgatccaattggaggaattcaagaaagctgaaaaggaaggtagaaagaagggtttgaaattgaagttacttgacaccacacaagcaatgttattgagaccagatggtcatccaagacccatagacacatggagtgatttcttgctagaaatgttgaagatggaaggcgtgagatctgcaataagctaa

SEQ ID NO: 75336 - DNA, 225 bp, Glycine max
  Peptide Sequence Number=SeqID_192114
atggaggccttgttcatgagtcaaatcaagaagcactatcaaaagaatcatagggaggtgggcacaagcattcttggtgttacagagtgtctaggcataaagcggtacttaggtatgcttttgttagtgggatggaagaagaacgatgtttttaatttcgttaaggaaaaggtgtggcgaaaaattcagtcatggaattggggctggaaaataagtgatggttaa

SEQ ID NO: 75337 - DNA, 1473 bp, Glycine max
  Peptide Sequence Number=SeqID_192115
atggacatcgaatttgaggatagacaagaagaaacagtttcagatatgataccaagcaatcggcagaggaaaaaacagtcgtttctgtggaaagttttggccatgagagagagaaatggaaggacaatagagagaagttctaatgattcccttgatccactttctgtttcatcttttgacaatcgaggctcagaaccttctatgccttctaatgaagcaattcaaaatttcagagtttttgcagcaacatggaatgtaggagggcaatgccccactggaaaccttgatctgagtgattttcttcaggttcgaaatgaaccagatatctttcaggagattgtccctttaaatgctggaaatgtgctggtattagaggataatgagcctgctgcaaaatggcttgctttaatcaaccaatcactcaatggttcttcagatttggcttctaaaggactaaaaccgaccgcgtcttttggaggcccattgttctcacaaaagccttctttgaagaagattaagaaaactttcaagaaactaaatggaaagaggctaagaagttgtaactgtgttcttgaaatggaaaggaaggctggtaaggatttctgttttcgctgccaagaatcaaacttcaattcagatgattcttccaccgaagaggaggatgagaacttcccaattcctgttgcattggctactagtcagatgaaatacagtcttgttacatgtaagcaaatggttggaatttttgtaagtgtctggatgaggagggaacttgttcagtatgtaggccatttgagaatatgttgcattagccgcgggatcatgggttgccttgggaacaaggggtgtatatcagtgagcatgtcattttatcagacaagtttttgctttatctgtagtcatttggcttctggagagaaagaaggtgatgagcttcgcagaaaccttgatgtcatagagattctaaagaacactcagtttccaaggatttgcaagacaccacatagtaggatgcctgacaaaatcttagatcatgaaatttcattgagccatgatgatgcaaaaaggcttgtggaaaagagggactggcctgctctttttaacaaggatcagcttaaaatggaaagggaagcaggtcgtgtattcaaggggtggaaagagggaaagatctactttgcacctacttataaatatgccttcaactcagacacttactatgttgaaggtgtaaaagtttcaaagaacaaaaggagaactccagcttggtgcgatagaatcttgtggcatggagggggaatacagcaactttcgtacgtccgcagagaatttaagttctctgaccatcgaccggtttgtgcaacatttaatgtagaagttgaggttatgttcaggggacagaagaagaaagtttcaacttgcaactttcagaacattcatgatcttgtatccacaagaagtccatattattcttga

SEQ ID NO: 75338 - DNA, 253 bp, Glycine max
  Peptide Sequence Number=SeqID_192116
cccgggggtcccagtcccgaacccgtcagctgtcggtggactgctcgagctgcttccgcggcgagagcgggtcgtcgcgtgccggtcgggggaaggattaggaaacgggcccttcggggcctcttcaccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 75339 - DNA, 738 bp, Glycine max
  Peptide Sequence Number=SeqID_192117
atgacccgccgctattccgcgaccgactggcgcgacatcttctacaacgcggtgcgtgaggcgcctggcggcgtgacggctgccgctgcattcctgaccgaccgccgcgagaaggcgattcatcctgaggatctgcgcaggcgtctgcgtggtgctgatggcgagtcgctgagcacagaaatgcttgagctgctgagcgagtggctgattgacatggggcgcccggatgcgcggcgctggcttcagtcgttcaacgctcgtttctccatggcctccgcttatctgccgcccccgccagagggtggatgggcctgcgaggcaacggcgatacgccagaaggtgatgcagatcaccgcgaaaaacggattgcttgcaggcatctgcgcccgcgtcaccgaagacaaccagattgacggcactgagtgcgatgaactggaagccggctgcatggaaatcatcgagctggtgtttcgcctgcgccgcaatgcgcgccgtgctgctggcgaagttcgccaggcgttggtcctggcttgtgagcaactggcgacgcctggcagtggttgcacattgcgggaactggctgatgcggcgcgtgtgggcgtcgatgcctgcaggcgtgccgttgacaacatgcgccgcgccggcgttctggtcaaggtgggcgagcgacgtgtgagctaccgcaatcggcccgtggccctgtatgcgcccgtggcctcaaaggccagcggcgaatga

SEQ ID NO: 75340 - DNA, 348 bp, Glycine max
  Peptide Sequence Number=SeqID_192118
atggcagagccatcaaagaagagaaagggatcatcctccaccgctaccgctgctgcccatcgccgtcacggcccatccggagcacccacagcacctattcctccttctttgtcatctccaagatcatcaacattgttttcatccgatgatcaacgtctacggtatctttctcagttttcttctagaataatcttagaccctaagtacctagacgtagagttctttaatgatgaaacgtttgattgctattgtcgcaacctacccttcggtgggagggcgacgcgagactcgcgggatgcgtgttccacgaaaggaatacgcgcggagtcgccaccaacgtttatttga

SEQ ID NO: 75341 - DNA, 558 bp, Glycine max
  Peptide Sequence Number=SeqID_192119
atggctgcacttagtgaaatcgactggaaggatcttgttgacatgagatggagtagcggatctccctcgtcggtgagctgggtgcaatttctcatggaagaagagcgccggggcatcgatcttgtggtgggacgtttcaacttaatggtgaaatggattctctctgaaatcgttctcacacgcaatatccatgagcgggctcgcactataaccaagttcatccatacggctgcacatgccagacgcatgtgtaattatgcgaccatgcttcagattgctattgcgctatcttctacggactgctctcggcttcaaaaaacttggggacttgtgccatctgaagatagaggtctcttgaaagatatggaagtgcttatccagccagtgcggaatttccatgaccttcgtgtcgaaatggaaacagcaaatgtacaagagggctgcattccctttgttgaagccggcacaggttgcagcccatggcggagagcctttgatcaacttcgaacgctaccgcacgaccgccaagatagtgaaaagtcttcttcgcttgattga

SEQ ID NO: 75342 - DNA, 635 bp, Glycine max
  Peptide Sequence Number=SeqID_192120
atgaaaggcccaatcaatgagtcaatctcttgctttctcctaagggtggagccttgggtagtagtacctatcaccttcagagggctacgcgccctcgtcttcagagggctgcacaccctcgcctttagagggctacactcccttgtcttcagagggctgcactccatcgcctacagagggctgcacgtcctcgccttcagaggacagcacatcctcgccttcatagggctacatgacctcgccttcagagggctacacgcccttgcctacaaagggatgcacgccttcgcctataaagggctgcacaccctcgcctttagagggctgcagtccttcgcctacagagggcagcacaccctcgccttcagagtgttgcacgtcctcgcctccagagggttgcacatccttgtcttcagagggttgcgcatcctcgtcttcagagggctgcatgccctcgcctttagagggctacatgccctcgtctttagagggctgcacgtcctcgccttcagaagactgcacaccttcgccttcagaggactacacgccctcgccttcagagggttgcgcgtcctcgtcttcagagggctgcactccctcgccttcagggggcagcatgccctcaccttcagagg

SEQ ID NO: 75343 - DNA, 1751 bp, Glycine max
  Peptide Sequence Number=SeqID_192121
atggccgtaccgggtcatgaccagcgcgactgggaattcgccaccaaatacgatctcaatatcaagccggtggtgctcaacctcgacggtaccgcgccggatatcagcgccgcggcgatgaccgaaaaaggcacactgttcaactccggcgagtttgacggtctggaccacgacgccggcttcaacgccatcgccgatgcgctggccgccaaaggcgtcggcgtgcgtaaagtaaactatcgcctgcgcgactggggtgtgtcacgccagcgctactggggtgcgccaattccgatggtgacgctggaagatggcaccgtaatgccaacgccagaagatcagctgccggtaattctgccggaagacgtggtcatggacggtatcaccagcccaatcaaagccgatccggagtgggcgaaaaccaccgtcaacggtcagccggcgctgcgtgaaaccgacaccttcgacacctttatggaatcatcgtggtactacgcgcgttacacctgtgcgaactacaacgaaggcatgctggatccggcggcagcgaactactggctgccggtcgatcagtatgtgggcggtatcgaacacgccatcatgcacctgatgtatttccgcttctaccacaagctgctgcgcgacgcgggcctggtcaactctgacgagccggccaaacgcctgctgtgtcagggcatggtactggcagacgccttctactacgtcggcgccaacggcgagcgcaactgggtttcaccggttgacgttaacgtcgagcgcgacgaaaaaggccgcatcaccaaagccatcgacaatcagggccgcgaagtgatctacgcgggcatgagcaaaatgtcgaagtccaaaaacaacggcatcgacccgcagctgatggttgagcgctacggcgcagataccgtgcgtctgttcatgatgtttgcctccccggcggaaatgacgctggagtggcaggagtcaggcgtggaaggcgctaaccgcttcctgaaacgcgtgtggaagctggcgtacgatcacgtggctaaaggcgcgaccgtggcgctggatgtcaacgcgctcaacgatgagcagaaagcgctgcgtcgcgatctgcacaaaaccatcgccaaagtggcggatgacatcggccgtcgtcagaccttcaacaccgcgattgcggcgatcatggagctgatgaacaaactgctgcgcgcaccgcaggagagcgaacaggatcgcgccctgatgcaggaagcgctggtcgccgtaacgcgcctgctctatccattcaccccgcacgccagctacgtgctgtggcaggcactgggtggcgaaggcagcatcgacgacgccagctggccggttgccgatgaagcggcaatggtagaggattcgctgctggtggtggtgcaggtcaacggtaaagtgcgtggtaaaattaccgtggcgccggatgcgacgcaggaacaggtgcaggcgcgtgcggcacaggagcatctggtggcgaaatatctggatggcgtcacccttcgtaaagtgatttatgtccctggcaaactgcttaacctggtcgtgccaccggaaatgaaaacgctgatcgtccagagcggcgatccgtatggcccgctggcgcgcaccgtgcgtcagcagctgcgcatcaacgatgtcaaaatcgttgaagacagcaaagcggccagtgcgcaatacccgacgctgcgtctcggcgcggagagtcaggacgcgacaccgcgtcg

SEQ ID NO: 75344 - DNA, 666 bp, Glycine max
  Peptide Sequence Number=SeqID_192122
atggctcaagctattccctcatactgcaagagtgcttttcttcttccaccatcaactctccaggatgaaatccaaaagattatgaattcattttggtggggaaggaagcaaggatggaagctagcttctgaccaggatgttgttgtttcacaagttttcaaggcaaaatattaccataatggggagttcttgggttcctctttgggacataacccaactttagtcaaagatggcattagatggaaaatgatagatggcaacaagataaaaatttggactgagccatggcttcaagattcacaaaattcatatattgtttctcctcatattgatgggcttgcagatttaacacttagcaaagatggcatgttctcggtcaggtctgcttactattatgctatggagaacatgactgatagctttcatctccaaatgaatgtgttcttatggagggtttctcgtgggtgcctcccaacaagggaaaagttaatatctagaggagttgaatgccccatctcgtgtccctattctgtggattccatagaaaatgattggtatatttttgctggctatccgcatgctaaaaagctttggcttgaagcatccttgcttcaccaagtaaatgatattgcaactgtgacaccctctaccccgacatatatataa

SEQ ID NO: 75345 - DNA, 396 bp, Glycine max
  Peptide Sequence Number=SeqID_192123
atggtgatcagtctgagtctcaagggagttccaaaccgagtgacatgccctcaagttcaaagaaagcttagaagtcaagattaccttagagaagctacgaaagaaaggattcagtggattctaaggattctactccgattaaaatattcctcttggtgtggtggttcggcggcaagcaatggtagcttgtggtggccatcggtggtcatgggtggtggaggaggagtttctaggatctcgcttaacgagctcttctcgctaagagggagaccacttttggcgctaagcatgacaatttgcactgagcgcaattcctcttgcgctaagcgcgacaattctcgcccagcgcgattccttctcgggttggaattgtgcttagcacgcttctcgcgttaa

SEQ ID NO: 75346 - DNA, 548 bp, Glycine max
  Peptide Sequence Number=SeqID_192124
gcccaggggaattagcgagtagtgactacccaacatttggtgcactcatttggtgcgtggttgggccttattgtgaaatatgtgggatagttatgcacttaggacacgagagtgttgtttgcttagacaaccttacacagtggagcggaggactcacccatacaacccacaacattttaggagcaggtcatggagcatccgccaaggatgttcacgtggatcacgtacttctcggtgtggcattaaccatgttatcacctaccacacctacttgggatttgagcaaccaaatacctcactttagttcgtgcgacacttccttgggcatgatgctagtgggagggccactagatctcacttctatcataatacagccgttgaagtctatgaggatgtgggagattttatcgacgatgaggatctcatgccatccgatatctctttctattagggcgtctacggtgaagagatattcagaggagagatggtttcatccgataaggaatgggattcctcgggagatgagagtgacccttttaaggatatga

SEQ ID NO: 75347 - DNA, 504 bp, Glycine max
  Peptide Sequence Number=SeqID_192125
atgaggtcctacaattacaactcagtcacgaatgacgggcctaagatttggaaggtacatattagaaatggtacgaaggcaaatgctcaatacgaagagcaagctgccacagtatggcagggaaaggggtctgttgtgtgcaagactccttatagggagctgtatgtagaaagctgtattgtggagacaattgtattgtccactggagtcttggagagcatggacactcagaaaagccaacctgaaaagcagtcttcatccgctgcaactgccccatctgttacttcatgccaaaagaagaagaatgaagaagctgctttcttagacgatttgaaggatcacattgacgagtttattaaggcttctatggatgagcacaaaagttgtttcaagaaaataattcagaagatgtttggtatgtccaagactgttgcagaaggtcactccaatgcttccaaagaaattcaaagttctctgcatcttcagacaactgtacaagactag

SEQ ID NO: 75348 - DNA, 264 bp, Glycine max
  Peptide Sequence Number=SeqID_192126
atggatttggcgaataggttgtgtgattggggaatttgggagacaagaaactcagtgatgtggggtcaggtttggagaagaggtggcagagatgttagaccattaggtcggaaagtggaggaagaaggtgtggtggtaccactgttgctggtggcttgctggcattggcaaatggtgaggatgttggaggaaggtgcttaccttcgtagagagggaactttaaactttgatggtggtggcatcggagtgagagcgcaagagtga

SEQ ID NO: 75349 - DNA, 2099 bp, Glycine max
  Peptide Sequence Number=SeqID_192127
ttttggaagtttttgcaatgggtgcaactgaagatcttgtgaacagcacacagggtgcagcagaatgtcaggaaaaccgcaccacaggtccttcagaaaatccaataaaggacaacaccagtagtacttcagaaaatcttgtacagtacaaagcactagatgcagaaaatcctgtaagtgatcaacaaggtggtgcagaaattcctgaaactggaggtgctgaaaatcctgcaagtgaccaaaaaaatgtggaacaaattcctgcaagtgagcaagtgggtattgcagaaaatatggtaaatgaccaagcaggtggtgcagaagatcccacaaaggaccgaacagcaggtggtgcagaaaatcctttaaatgacctaatatttcttgcacaaaattctgaaagtgaacaagcaggtagtgtggaaaatctgttaagcgaccaagcaggtgttgcagaagatcacacaaagaaccgtgcagcaggtagtgccgaaaatccttcaaatgacctaatagatcttgcacaaaatcctgaaagtgaacaagcaggtagtgaggaaaatctgttaaactaccaagcaggtggtgtagaaaattctgcaaagaaccatgcagcagctggtgcaggagatcctccaaatgaccaagctgcagatggtgcagagaattctgcaaaaaacctatcagcacgtagtgcaggagatcctccacatgaccaagcagcagatgctatagaaaattctttaaacaaccaaacagaagctacagagaaacttgtaaaggatgaacagggtactgcagaaagttttgtagaagatgtagcagatgctgttgaaatgcctgaaaacagccaaagaaatggtgttgaaacccctgtaagcaacaaagcagatcgcctcccagaagaagcaaaggagatactgaaatcattggcaagtaaatgggaggatgtacttgatgcaaatgcattgcaggtgatccctctcaaaggggcaatgacgaatgaggtattccagataaagtggccaactatgacaggggaattgtcacgaaaggttcttgttagaatgtatggtgagggtgtggacgtgttctttgatagggataatgagatccacacatttgaattcatgtcaaagaatgggcaaggtcctcgtctactaggacgatttacgaatggccgtgttgaagagtttatccatgcacggacattatcagcatctgatctacgtgatccatctatttctgctcttatagcagccaaaatgaaggagttccatgatctagatatgcctggtgaaaagaaagtccatctttgggatagattgcgaaattggcttagtgaagccaaacgtttatcgtcccctaaagaagttgaagctttttatttggatacaatcgacaaagaaatctctattttggaaaaggaactatcaggctctcaccaacaaataaaattttgccacaatgatttacaatatggtaacataatgcttgatgaagagacaaattctgtgaccatcatagtgagtttctctttgcgggatcaatgggccataaccagcaaatacgatttaaaatgctaccttttgcaacaggactatgaatatgctagttataatcctgtagcatttgatatagcaaaccacttctgtgagatggctgctaactatcatacagaagagcctcatatccttgactacaataaatatcctgattttgaggagcgtcaaagatttgtgcaggcatatctgagtacctccggtgagcagcctagtgacagtgaagtggagcagctacttcaagaaattgagaagtatacacttgcaaatcatctattctggggcgtttggggaataatttcggcacaagtaaacactatcgactttgactacaaggagtatgctaaacagagatttcaagagtactgggcaaggaaaccttatcttctaataaactctgaagcgccttctccttataatgtgcctgagggtacaggagagctagcttcagcagtgcccactaaatcgaagaactctggtatctttaggaagatgaagagagttttgggtctcggcttgttcaggtctaagagctag

SEQ ID NO: 75350 - DNA, 1056 bp, Glycine max
  Peptide Sequence Number=SeqID_192128
atggcggggtcaaatgttgagaagcatctgcaagggctatccttggaggaagaaaaggacaatggggaaagaatggctaatctatggcgactgatgaaaggggtgatgatcacaaagtttgaccaaggtatcttcattttccaattctatcacaagctggacttgaaaaggattacaaggatgacccatggtatttcgacaacaacttttacgaatagtaatgatgggggtttgcaggaagcagtgggggtgcaagaaggaaatgcaagacccacaaggaacaaaaggtcaccagcgtattggaaagattacgagggacttggtcctcgaaatccaagtggtatcattggtgctttcatcgcaatggcagacgaaactcgctccaaaacttcctctgatcgggtggaagtcgccattgctaaactcactgcctcccatctttccatgaattccaaaatagatgatctcctccatcacatgtcgcagcttgagtcctcacacaacaacccctacacaccatcatctccttccttaggcccttctgtgacatcgtcccgtgagcctacccaccgtgtcaagctagacattccgcggtttgacgactccaaacccactgggtggatcttcaagattactcaattttttgagtatcattctacccctgatacggaacacttgactattgcctcattttacattgagggcccagccctcacatggtttcagtggatgcaccacaatgctcagctctcctcatggtctgcatttttgcatgctctccactttcgctttgcttcatccacttatgaggatcctacgagtttactctgcaaactcagccaacgttccttggtgagtgcctacctctcggaatttgagtctctggccaaccgcattactggtcttctggcaccctttgtgcttagttgttttatatcggggttgaacctagtaattcaaagggaggttcagactccaagtagattggctagagatccaagggaaggccctagggttctcatgagccttagggtagattttgaggccatgggctaa

SEQ ID NO: 75351 - DNA, 276 bp, Glycine max
  Peptide Sequence Number=SeqID_192129
atgaagacaaaagctcgcagcagattcactgacaatatagtaagtgaaattgaacaagaggctccataccaagatgatgagcttgtagggcttcaagaagtgttggaacttgaccctgatgtcattaatgaatctcttgcgggtgttgatggaggtggagaagagatagatgcagatttactcaaacaactaggcttgattgaaccagacaaggatgaatgcatgttaagtgagaatgacatcgagagtgattttgatgatacaaatacttcttag

SEQ ID NO: 75352 - DNA, 435 bp, Glycine max
  Peptide Sequence Number=SeqID_192130
atggagaaatgctttacctccgtgctcgattgggccaccaaggtttgtttcttagaccaccaagagactaggttaggaccaagaaatacgcaggacacatatgtgaagattccaacatctcagatgttgcagatgtgcagaaagctttcaactgtccaactaactgaaagacttgactattctaatttgcctggcctgaatcccaacatgaaaaatggaagaggctcttcgctatgcgaaggtattggggagggatattgtacgcagccttacccttgcatatgcaaagaggctgtttccggattcgaacccatgaccaacaagtcaccaaggcacaactttaccgctgcaccaggactcgccctccatttacattggctattgttcaataaacttgcacataaatacttgaattcccttattctctatttctag

SEQ ID NO: 75353 - DNA, 240 bp, Glycine max
  Peptide Sequence Number=SeqID_192131
atgaggagaggagctaagagaaagacgaagcagggtcaagaagccatacacgatgcacccgaagataacaagcccaaatctcagcctcgagctaaaagagccaagacctccaagcctcaatccgaacctaagtacttcgaagacaagcgcaacttgtgcacgctataccttcgtctcttctggtttggagctcgtacacatgtgctagtttggcatgctggaagcacaaagaaagaataa

SEQ ID NO: 75354 - DNA, 311 bp, Glycine max
  Peptide Sequence Number=SeqID_192132
atggacgcgattaaacaaattctgatcgatgaaatcgacacgctcaaccgcgaagagcggcgcgataatctgccgcgttttagctttaacttcctgaaaacccatccggggctgtggggcgtgatgtacctgtgctacggcctgtgcgtggcgctgattttctccaccgagatgctcggctggccagccttctggttcgccacggtgttcgtgctggtgatgagttttctgatgctgctggacatcaacccgaaataccgcttcgaggacatcgatacgctggatctgcgcgtgtgctacaacggcgagtg

SEQ ID NO: 75355 - DNA, 377 bp, Glycine max
  Peptide Sequence Number=SeqID_192133
ccccgcgaatttattgcctagcgctgttcgccatttctccattctcaatcttattcggagacccatgaattcattgcctagcgctgttcatgtgtcctccaccaacgagtctggagccccgcgaattcattacctagcgttccccgcgaattcattgcctagcgcttttcgccaattctccatgctcaatcttattcggagacccatgaattcattgcctagcgttgttcatgtgtcctccaccatcgagtctggagccccgcgaattcattgcctagcgctatttgccaattctccattctcaatctttcagagacccatgaattcattgcctagcgctgttcatgtgtcctccgttatcaagcgtggagcctccg

SEQ ID NO: 75356 - DNA, 153 bp, Glycine max
  Peptide Sequence Number=SeqID_192134
gaagcaaaagatctgaagaacaaagcagatatgatcaagaagttaatggagaagggttaccgagtgaagatgttttcatctatattgtctctacagaatctcgggagcaatcttgttagtaattgtgtttccactatgttctatcccgagtaa

SEQ ID NO: 75357 - DNA, 783 bp, Glycine max
  Peptide Sequence Number=SeqID_192135
atggtgaaggaaattatgagtacttccttcgtctatcaggatactgacagggtgggtgtcaaggatagatacagtagggggcgtgatgcaagctccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaagggagagggagagaagagcacgaaattttggcggatggccggaatccagggggttgtcctcgtccttcgtcaccaagaggaatagcgaggaagcacacttgtgccctcgagaaaacttttcatcacaatgaaagcataatcccttctctctgtggacgacaagttcttttgggggaagagaacgagagtctagaaatctcgagaaagagggcgtgcgagatgcgggaggacgacgtgcatcgaggagcttttcctcctgaagacgagcatgcgtcctttaatggtgattttccaccatggagatgcagcggaagacaaaggagaagaggtgagaggaggcgccatccactagggaataagccatggaagaaggagcttcaccaccaagatgagccttggataagaagcttggaaggatgcttcaatggaggaaaagaaagagggaggggggagcacgaaattgaaggaataaaagagggagagaagtggaactttgaa

SEQ ID NO: 75358 - DNA, 240 bp, Glycine max
  Peptide Sequence Number=SeqID_192136
atggtcatctccgcattccacacgggccctacgcggttcatcaagggttatgcttccttggctgcgccactcaccaagctcttgtgccatgatcagtttcaatggtcttctgaggcaaccaaggcatttcaggccctcaaggatgccatcactaactctccgattttggctttacctgatttctgcgttccatttgtggtcgagacgatgcttccggctctgggatggtggcagttctga

SEQ ID NO: 75359 - DNA, 1443 bp, Glycine max
  Peptide Sequence Number=SeqID_192137
atggaagaccagcctgcctccctctatgtcatatctatgcctcagttcctcttcctcaaggaccttcgtaaggagttattatccttacagggatttactgagttacgtgacaagatccagcgtgaccctgcaacttatacggagtatactttaactcctgactttattcttcacaaaggacgcatatggctaccctctaattcttctttcattaaaccattgctcgaggaatttcaccaatctctgactggagggcatatggggattcagaagacactccatcgtttttgtgtgacctgccaacacaccaaacccgataaccagaagccaacgggtctcctttgccctctcccgggtctgcatttgggaatgctacccacccaccatactgctcatgcaatggttgttctcttcatggaaatagttggcaagctccatggaatgccatggagtatcgtctcagaccgcggccttctgttcattagtaagttttggcgtgagctgttttccttgagtggcacgaagcttcgcctgagctcagcttatcacccccaatctgatggccaaacggagtggtcgtacaacacgtcgtaccactcatccacgggtatgacaccatttgagatcacctttggtcgcaagcctcccacattcccgcaatatgtcacgggcacttccaaaatagatgcattcgatgacattcttgcatattccaaactagccaagcgttattatggtcctttccaggttaccgaacgcatgggcaagccacccacgactgaccttccaccactggcacttgacaatcatcccctcctcactcctttggccattatggcatccaagttcattccttcggagtccggtccaaaacgcatggtgttagttcagtggaagggcctgccccctgaagaaacgtcttgggaagactggtcggctttcaagactactcaccacattgaggacaaggtgttgcttgatggggatgggagtgttatggatagtaatgatgggggtctacaggaagcagtgtgggtgcaagaaggaaatgcaagacccacaaggaacaaaagggaatatctctctgtaaggatattccctgatattgcatcttttccatttttccttgtcgggctatgtcccctaggacttggtcctcgaaatccaaggggtatcaacaacctattggcattgggaaggattcagctaggagacgtgcccaaccaagtgaaagttttaagttggaattgtcgagacctggttaaccttcgggtagttccagtgctcaaggacattcttggagtccacaaacctggcactttatttttgtctaaaactttagttcattccaatagagtagaggagattagagtagcgttgggttttcagaaagtgtttgtggttgataaggatggtaggagtggagggctagctttgttttag

SEQ ID NO: 75360 - DNA, 1101 bp, Glycine max
  Peptide Sequence Number=SeqID_192138
atggatgggacaaccaagggttgtgtctcttcccaaccgttgatttggatttttggaagagatttatcataccagactggtgcatctctttgcttgctagaagcttctagaacactatataaagtacattgtcatcaaccctctaatatgtccttttctagggagggttttgttcgcttcgatcgaatgttgtcgtgggaggttcaccctatagagaaagttccaacaatgagcccacccatcttcatggtggttctgacgttgctagggaccaagtctctgacattcgcatgggtgacgtcatcgttggtggtgtcgtggtccctcttaatgctggatgaggccgaatcccctcagctaaatcctcctccaaatgttatagatttggatttggaggcaataattatccaagtgcttcctcgtcggttgttcgtgccacctcctcccctctccaaaaacatgtttcaggaaaataagaagggtggttggatttcccttatcggcatcatcgataaggcaatcattactaactcgtataaaaaatttaagggtcatttctttcaagaggacatggttatcctccacaagcttcctagaggccttcatcgcaaaccttggtggacctctttttttccaagactccagatacggacaggaattgcaagtttgactattgttccattaggaaggctcagattgaaaaggttaagaatgtccttgtggaaaaggataaggagaattagaaggaaaatccccaagatgacttggtgcctcctcctcctcctattgctgccagtgtcatcattcggggcgagcatgggccttccagtagtggtccttcataaaggcagagtcgttgagagcatccctacttttttgctaataaaggaaagggtttcttctttgtggaggaaggactttaacactaaggctctcattcaggcctccatgcttggccaatcctacaaggatatgctaagggaggttggtcctcttgtgtcgatgcattccatcatttgctttgttgcaaggtcttggggtattgttgaattctggggtaatgagttcgaaagggctgaagccgagtcccaaaaggcataa

SEQ ID NO: 75361 - DNA, 132 bp, Glycine max
  Peptide Sequence Number=SeqID_192139
atgatgaattcaagccatggccctcattgtcctaaccaagcccctgttttttatgacattgtacttcaaggtctatttttgctccatgagtatccaacaaactactctcttatgaggtttatgaaagcatag

SEQ ID NO: 75362 - DNA, 450 bp, Glycine max
  Peptide Sequence Number=SeqID_192140
atgaatgagcttataggggatgttaaaaggatcctggagatgatggaaaaccacaataaagaatatgctgctcggtttgagaccttagaaacaacactggagatgacactcaaggataaaattggagatcctgggagtacatcactggctatgaacaatcacccttttcaggttaggaatgttaagattgattttcccagatttgatggattagatgttttacaatggatatccaaggctgaacagttttttaactattataaaacacaggatgaacaacgattgattattgcttcaattcacttggataaagaggttgtgccctggtaccaaacgatgactcgtgaaaattcattcaaaacatggattgcttttacgcaaaccttagagacagaatttggcccctcaccgtatgaatgtcctagatctcaattgtttaaactcacttaa

SEQ ID NO: 75363 - DNA, 930 bp, Glycine max
  Peptide Sequence Number=SeqID_192141
atgggtagaaacgaagccgccatttccttcctcaccaacgtcgcccgcactgccttcggcctgggcgcggcggccaccgccgtctcctcttccctctacaccgtcgacggcggccagcgcgccgtcctcttcgaccgcttccgcggcatcctggactccaccgtcggcgaagggacccacttcctcatcccctgggtccagaaaccctacatcttcgacatccgcactcgtccccacaccttctcctccgtctccggcaccaaggacctccagatggttaacctaaccctccgcgtcctctcccgccccgacaccgagaagctccccaccatcgtccagaacctcggcctcgaatacgatgaaaaggtcctcccttccatcggcaacgaggtcctcaaggccgtcgtcgcgcagttcaacgccgatcagctgctcacggagcggtcacaggtctccgccctcgtccgtgacagcctcattcgtcgcgccaaagacttcaacatcgttctcgatgacgtcgcgattactcacctctcctacggcggggaattctcccgcgcagtggagcagaagcaggtggcgcagcaggaggcggagagatcgaagtttgtggtgatgaaggctgagcaggagcggagggccgccattattagggctgagggtgagagcgatgcggccaagctgatctcggacgccactgcctcggccgggatggggctgatcgagctaaggaggattgaggcgtccagggaggtggcggccacgctggcgaagtcgcccaacgtctcgtatttgcccggtggacagaacttgctcatggctctcggtccttcgcgaaaattgccgacaaatgcggctgatgcagcttcaattgcgatcgcagacacatacaaaaccttgatgttgtggacaaaatcattgtgtcactga

SEQ ID NO: 75364 - DNA, 372 bp, Glycine max
  Peptide Sequence Number=SeqID_192142
atgggacacattgttgttggcacatcaactaatgaagcaatattcaagattcctggcagggtaggtgatggtcccattgttggatcctcagcatatgttgttgatgaagttggtgcatgttctgcaactggggatggtgacatcaggatacgcttccttccatgctatctagttgtggaaagtatgaggttgggaatggaacgcaaacttgctgctaaagatgcaatagcacgaatagcaagaaaatatccagattttttgggagccattgttgccctcaataaaaaaggggaacatgccggtgcctgccatggttggacatttaaatactcagttaggagcctcaatgaaagatgtggaagtttttactga

SEQ ID NO: 75365 - DNA, 1629 bp, Glycine max
  Peptide Sequence Number=SeqID_192143
atgagtccaaactggttagctcattttcaacatttggaaacagtgctgaaagtgttacaacaacataagttgtatgccaaattatccaaatgctcatttgggttacaagaggtggattacttgggccacatagtatcaggcaagggagtaccaatggatcaagaaaaggttcaagcagtcctgaattggccatatcctacaaatctgaagcaattgagaggcttcctcggtctgactggatactacaggaaatttatcaaaggttatgcgtcaatcgcaactcctttatcaaatctgttgaagaagcaaaactttcattggaatgaccacacttccatggcttttgacaatttgaaagccgtaattaccaaggcaccagtactagcattgcctgatttttccaaagcctttacattggaactgatgcctctgggcaggttggtgattcctagtaatcatgagttggtgaagcggattttgcatgaatttcacacttctttgattgggggacatgctggagtggccaggaccttgtctagaatagcctcgcaattctattggaaatgtatgcataaatatttaaaggaatttgtgcaacaatgtttaacttgtcaacaagctaaaagtgacactatgctgccatcggggttattacaacctctccttattcctatgcaaatttgggaagacctagcaatggatttcatcaccagacttcctccttccaatggcttcacagtgatattagtggtgatagatagactatctaagtatgcccattttttcactcttaagtctgattataatagtaaacaagttgctgaagtgtttgtcaaaaacatagtcaaattgcatggttttcccaagtcaattgtatcagacagagacaaggctttcactagtccgttttggcaacaaatgttcaaactcagtggcactacaatcaacttaacaactgcttaccacccccagccggatggtcaatctgaagccttaaacaaatgccttgaaatgtacctgagatgctttacccacgattcccctaaggagtgggccaaattactaccttgggcagaattttggtacaacactgcctaccataataacagtggcatgacaccttttaaagtagtgtacagaagagatctgccaaagttgacaagggatatagctgatcagtcatgttcaatgtcaataaaagagcaacttatgttaagggacctcacacgaagtaaactcaaacagaatctgatcaaagctcaggcacacatgaaaaaatatgcagatatgaaaaggagacaggtggagtttaacgtgggtgatttagttttggtaaagttacagccttacagacaacactcagttgctttaaggaagaatcaaaagctcagcctgaggtattttggtccttttccagttattgaaaggattggactagttgcgtacaaactcttacttcctcctacaaccaagatacacccagggtttcatgcttctcaacttaagccatgtaaaggagaccatcctcagctgtatatttcgttgccaattacaaatgatgaggtagatttagtgatccaaccagcgaggtttttgaaagaaagagtggtaattaaaggacaacaatag

SEQ ID NO: 75366 - DNA, 690 bp, Glycine max
  Peptide Sequence Number=SeqID_192144
atggggaagaagcagaacgacatccagaaaacggggctaggtcgagccctgctatctcgcttctacaggaagaagttccttgaatccttcaacgaagtctccgacatcgacgccgtcgtcgagcaatccctagaacccctccccaaactcgccgctgtcgcttcaaccactcttatcagccttagcgaaccaggttccgtccctgatgaaacgacgacaccagaagaagcgaggaagcagcagaagcaagaggagattgaacactacgcaaagattcagatcacgagggatgctgatgctgatcctctctgtgcaacaaggtctgtggaattgataggaattttggaaagtattgataaggcagaaaaactaatgaatgttgctgatgttggggattctccttcacttgtagctcgaggcctctcccctgctcaagctactgtgggatctgaacaaattcagatacaagttccaaatgaaaaggttggattaatcatagggagaagtggggaaacaattaaaagcctgcagaccaaatccggggtgcgcatccagttgatacctcaacatctttcagaaggggatgattccaaagaaaggactgtccaagttactggtgataagaggcaaattcaaattgcacaagaattgataaaggaagtcatgaatcaggataatgggtcatggtga

SEQ ID NO: 75367 - DNA, 269 bp, Glycine max
  Peptide Sequence Number=SeqID_192145
aaatcaagcaaaccttagatcaacacattgacagtggttcactttcatcacaaatcaatagtagtgcttctcaagtggattcaccccaagctattattactagtcctggtaatgctaatccagtagctgttgctgctctagaaaataaggatctagcattcctagtcgctcaacctggttcagattcacaccaaagcaacaacaacaacaatagtgaaggtgatgaagccaattttatcctctcctacctttcaatcactctagcctaa

SEQ ID NO: 75368 - DNA, 129 bp, Glycine max
  Peptide Sequence Number=SeqID_192146
atgacgtctcactgtcttcctcctcatcctaaatggaggtatccagaatctttttcccatctcagatggaattatcttatatctcttcccatcctagataaagtaattcatcatgaggtttcacaatga

SEQ ID NO: 75369 - DNA, 200 bp, Glycine max
  Peptide Sequence Number=SeqID_192147
ccttaccccctccacacaatattccagttcccattcttcatagtgtatttgttagaggggacctcgtgaactttgagctacgggaaaatgaccttgaagcttcaagcctatatcctgattataactacacatcaattcataaacttcttgatatatttcttgctaatcctccaacccctgcctctgctgcttttgagtga

SEQ ID NO: 75370 - DNA, 222 bp, Glycine max
  Peptide Sequence Number=SeqID_192148
atggggtggaaatggatccgaagaaactctccacaaagaggtctagaagagacgccgcagcagaagggtccaatgccgcccccgagtttgatagtcatcgtttccggagcgccaagcaccagcagtgcttcgaggccatcaaaggatggtcgttctattggaccttgtggcctcaataatcttaagagggataggcttagaatgcagaagaagcaacaataa

SEQ ID NO: 75371 - DNA, 294 bp, Glycine max
  Peptide Sequence Number=SeqID_192149
cacgtcttctcttcttctctgcgagcccgactgcttgttgtggttggatcagacgcaaatccttcgagacgccggaaaaaatggggaaaggagtggttacagtggcgtcttccggaagaaccgcgaaggcttcttccggaacttccggaagaaggtgttccgaaaaatttccggaaaaagggttcttccgaaagtaacgaaaggtcattcggaagatcactttcttttcgaaatcttcccggaacacccctcattgggaactttccggaagaaggttcttccggtgccctttga

SEQ ID NO: 75372 - DNA, 757 bp, Glycine max
  Peptide Sequence Number=SeqID_192150
atggcggtgaccgccatcgcggtggccaggagagcccgctcaagcgccgcgagcgcaagcagcgcgccagcgacaaccaggacgaggcgctggaggaaaccttccccgccagcgacccgacctcgccgttcgtaccggccaaggcccccgattgacggtagcgccgggccctgcccggcgcgcgcagcgcacgttctccagccgcgcgaaagcacgcagttcaccgctgggcagggtccagcggcgtccgccctccacgtgcaacagggcaaagcccggcgcccgttcggtggcgacgtcgttgaccacggtatcgctgctggccgtggcctccagtgcccattgccagtcggcggggctccactgcaggcgtgcgaacgcctgctggcgcggcacacccggcaagcgactgtccgccgcgaccacgttgttcgagttcaggtaaggcgagcgcacctgcgcctgcagccaggtccaggccaactgcagttccaattgctcggccagcggctgtcggtactgcagttccacgccctggcggcgggtgcggccaatgttgcgataggtgctgcgccctccggtgttgctggcaacggccagctcatcgtcagtatctgcacggaacaggctgatatcgagctggattccgctctgcgcgtgccacttgctgccaatctccagattgcggctgcgggcggccgccaggtccagtgccaatcccgcctgcccgtcggcgcgatagcccagttcgttgaag

SEQ ID NO: 75373 - DNA, 633 bp, Glycine max
  Peptide Sequence Number=SeqID_192151
atgatgaaagatttgtgtgaagagttcaagattgagcatcacaattcttctccttacagacctcagatgaatggcgcagttgaagctgcaaacaagaatatcaagaagatagtgcagaagatggtgatcacatacaaagactggcatgagatgctaccgtatgctttgcatgggtatcgcacttcagtgcgtacttcaacaggggcaacccccttctctttggtgtatggtatggaagcagtactccctgtggaggttgagattccatcaatgagagttctaatggaggcccagttatcagaagctgagtggtgccaaagcagatatgatcagttgaatctaattgaagaaaaacgcatgaaggccttgtgccacggacaactttatcaacagaggatgaagcaagctttcgacaagaaggttcaccctcgtgtgtttcaagaaggagatcttgtgctcaagaaggttttatctttccaacccgactctaggggcaagtggacgcctaattacgaaggcccatatgtcgtcaagagaactttctctggtggtgcgctgattcttacgactatggatggggatgagctccctcgtcccgtgaatgcggatgcagtcaagaaatactttgtctaa

SEQ ID NO: 75374 - DNA, 357 bp, Glycine max
  Peptide Sequence Number=SeqID_192152
atgctccaaccatatgggatcaacataggcttaaaggagcactcaaacccggtgacccccaaggcctacactccgaagagtccgtcagggcctctccctcctgattcaggaaacctacactttctctttaacactgcgcatttacacttttctcaagataacactggtcgggttattgtacaattcacagcttacaacacaaataatgtcacatcaagaattaatcacacatttattcacaaccaaaactcattcacaatttcacatctcataatgtcacaatccaccatcacatgttttcacgtatctcacaattcaacacctgttctactttacacttttactcaatctcaataa

SEQ ID NO: 75375 - DNA, 201 bp, Glycine max
  Peptide Sequence Number=SeqID_192153
atgttgctaagtagcaatgtcatctatatctatgtaagagtggtcatgttggtgcgcatgatctgcactcgtctctttgcagcggcacaggtgaatcttgccccgttggtcctcctccaatatcagggggtggcccaagaaccgttaaaaggaaactactggccccttaaccggaagtgcaagcctcggttaagcatttaa

SEQ ID NO: 75376 - DNA, 330 bp, Glycine max
  Peptide Sequence Number=SeqID_192154
atgacaaaaagaatgaagatgagaatattactcaagtggattttaatgattatcgaagtaattttgaatgaagtgaaaaataaaattaagggtttcctttttctcgatcttgttacaggcgatccacctcagcagaagagaagtctaataattgagatagaggaagaactcaagaatattacaaaagatgatgcacctcaacgggagagaagtcaaaaaatacagaaaaacaaagaactcaagaatattacgcaaggtgatccatctaaacaaaagagaagtcaaggaaataagaaaaagataaaagacgacaatattactcaaggttag

SEQ ID NO: 75377 - DNA, 255 bp, Glycine max
  Peptide Sequence Number=SeqID_192155
atgctacggaagcagctgcgaacgtctttcttggccgaaagcgagatgaattggcttgtgttattgaaggatgcgtatgatggaaatgggtttttgattgagaaggacccacaagtggtgtttaatgagaagctttataagtatgctcaggtggaccacatggaacccaggttttggggaggttcattcgagaatttcaagacgtcacttgaactctatttgctggtttgtcaatcaacttccggacaagactaa

SEQ ID NO: 75378 - DNA, 426 bp, Glycine max
  Peptide Sequence Number=SeqID_192156
atggtgaaatctgagggtgaattagggttttgcggaagaaatttgggagaaagagtgggagccctagaagggatcaagattggttccttgagagtagtatgtaggcatgagtctcgtctctcactcttgtttgtttggatgtatgagattgttgatgtatgtggcaagagggctacacacgtgtggatgatggacaaagatacattggggtataatgaacggagaggttcgaagaacctaggaaaattagcgagtggttattacccaacatttggtggactcatctggcatggagaactcagtcctcactttgctacttttgacgagcttcgagactatgcttttttgagctgggagcttgggaatcaatgtacgttgtatccgtatttggcatcactcttgactgtcattcatgcaattgtataa

SEQ ID NO: 75379 - DNA, 375 bp, Glycine max
  Peptide Sequence Number=SeqID_192157
atggtgagctctgttagggtttacgaaaaaggagatcaagggactatggtgagctctgttagggtttacgaaaaaggagatcaagggacaaccaatcaggaggggcacctcttgctacgcaatactaaaaaggtgctcaaggagaatgatgggaatagcgagcagaatatggatggacctcttatttcggtctcgaatttggaactgatgaattgggccacaccatcgttcaataccttagttgttaatgtcatggagaggagggttaattttcgtactctagaagcgaaattacaacgaagctggaccaagaatggtagtattcagattattgatcttcatgatggattttaccaagtggtaagaagaatataa

SEQ ID NO: 75380 - DNA, 279 bp, Glycine max
  Peptide Sequence Number=SeqID_192158
atgatttttgacaaccatgaagaaaatgaaagacaacaagatccaacactttatgaactagaatcttctaggaggacacaaaggaattgtcatcttccatccaaatatgaagattgtgttatatccaatgacaatgatccatctgatgaggagattatcaattttgctttatttgcagaatgtagtgagctagtaatctttgaagaagctacaagtgatgagaattggaagaaagcgatggatgatgagattcatgctatagagaagaataatatatag

SEQ ID NO: 75381 - DNA, 258 bp, Glycine max
  Peptide Sequence Number=SeqID_192159
atgagtcatcatcgactcaaacaacaagatttggaattattgcaggaaggcgtagcagctaagtgtagcatagatatacaaagacccaagaagaggactagcaaggacggtgacaagaaagccgaattgagctgcttgacactagttgtcgcgcaatacgaaaggttttttgatgtttcagtaaagaatgcggaaaatacccaaaagggagagcaaaaaggtcattttgaggctttttcagacccctggctcgcatag

SEQ ID NO: 75382 - DNA, 150 bp, Glycine max
  Peptide Sequence Number=SeqID_192160
gacgtacctcaatggataagtgccaaagacgatctccacaaacacgatctctacaatgtggttgcagtcacggaagcacaggcgactttgacacaaggagaaagaagaagaacgatatggttcaagcgcaaggagaaagaagaagaatga

SEQ ID NO: 75383 - DNA, 219 bp, Glycine max
  Peptide Sequence Number=SeqID_192161
atgagtcttatgatcattaagagtggcattctagaagtcgttaggggtgtagtgtccaaagggatcatcaatgttaaggatttccttgatgaactagagaaatgctttacaaaaagtgataaagtagaaacaagtacattgttacaacacttgatttccatgaagtacagcggaaaaggaaacattatggagagtacatcatggaaatgtctcatatag

SEQ ID NO: 75384 - DNA, 693 bp, Glycine max
  Peptide Sequence Number=SeqID_192162
atggtagaagtctctatagaggccattgcctccctcgcccagtattatgatcagccattgaggtgcttcacctttggggacttccagctatcacccatggtggaagaatttgaagagatcctaggattccctctagggggaagaagaccatacctcttctcagggttctatccctcattagctagaatttctaagatagtccaaatctcggcgcaggaattagaccacagaaagcaagtcgaaaatggggtggttggaataccgagaaaatgtttggaggcaaaagcgagaatcttggcagggagtcctctttccgaatgtggatgggttggtggacctagcagcgatcgacgttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttttccaagaaggtaggcccgtctatccgctacaaggttaccactctcccgttctcgccataagacagcttggctaccccatgagaggagcgccattaggcgaaagcatcacgcctttcatcgcacggggttttagtgaccacaacgcgagagtactccaaggagttcgcaaggcatgggatgcggcgtga

SEQ ID NO: 75385 - DNA, 1482 bp, Glycine max
  Peptide Sequence Number=SeqID_192163
atggaagggatgaagcttaaaaggtggctcgtgagtgttttgttcctcattgttgccacagtgagcaatgcagcagctgatgaagcatcacatttttttaatctaggtgcatttgtgggggtaaacattggcactgatgttactgatcttccatctgcttcaaacgtggttgctattctaaaagcacatcaaattacacacgtgcgtctgtacaatgccaatgagcacatgctacgagccctttcaaacactggcattgaagtgattgttggtgtcacagatgaagagatattaggcattggagaatctgcatcagttgctgcagcatggattagtaagaatgtggcggcatacatgccatccactaacatcacagcaatatcagtaggcagtgaggttctcacctcagtcccaaatgttgcacctgttctggttcctgccatgaaccatcttcacacagcacttgttgcttcaaaccttaactttcgcattaaggtttcaacgccgctgtccatggatataatttctaggccttttcctccttctacagccacctttaactcctcatggaactccacaatctaccaactccttcagtttttgaagaacacaaattcctcttacatgttaaatgcgtacccttattatggatacactaaaggagatggcattttcccaattgaatatgctctattcagtcccctctctccagtgaagcaaattgttgacccgaacacactattccattacaacagcatgtttgaggctatggtggatgctacctattatgccatagaagccttcaatttcaataatatacctattgttgtcacggaaactggttggccaagttttggtggagcaaatgaaccagatgcaagtacaaagaatgctgagacctacaataacaatttaatcatgagagtactcaatggttcaggtccccctagccaaccaaagatagccattaatacctacttatatgaattattcaatgaggacaagaggaaaggtcctatatcagaaaggaattggggtgttttttatgctaatggaagtagtgtttattccctgagttttagtgctgccaacatgagtaatgcaaattctctaggatcattttgtgtggctaaagatgatgcagacactgataaattgcaagctggcttgagctgggcttgtggacaaggccaagctaactgtgtagctattcaaccagggagaccttgctattcccccaataacgtgaagagtcatgcctcttatgcttataatgattattttcaaaaaatgcataatgctggtggaacatgtgactttgatggtacagctacaaaaactactgaggatcccagttacgggtcctgtatatacgcgggaagtgctaacgcaagcattggtggaaggagttcatcttctacagcacttggacttggacctctctatgtgccatcttttatggtctatttggggtcattgtag

SEQ ID NO: 75386 - DNA, 330 bp, Glycine max
  Peptide Sequence Number=SeqID_192164
atggttgaggggcacattgtttttctttattgtcatcgaatgcttttgcattatttgacctacaatgatcatctcgcgaagatggacgacttgtcatataagaaaattttgctccatttagtaaccatgaacaccatgtatccatgcaaccatgtatcaatgaaggagtgtgaaatttgtcaaaagttccttgactggttaatggttataagttatttgaggcacaatgtgtattcgccacaaagctcctttacaagttattggttagactctgaaattagtcaggatgatgtagatgaaatatggcgacatatgaaggttactatataa

SEQ ID NO: 75387 - DNA, 141 bp, Glycine max
  Peptide Sequence Number=SeqID_192165
atgggtgttttaaacattttgaggcggtcaagcgaaggtcgcatgccaacatataatggtccgcagacgaaattaggtctattacacaatacctgtaatcgattaccagagcttctaaacgttttgattttcaaaatttaa

SEQ ID NO: 75388 - DNA, 324 bp, Glycine max
  Peptide Sequence Number=SeqID_192166
atgatgagcccggtgtcgactctcccattctacattgacgacatcaagacattgtgggaacacgatgatgcgctctatgtggagttccacaccaccatattattgctttgccatgcttatgccagaggccatttccctactccgatgtctcctcaattggtattgcttgagtctcaagtactacctggggtagacttggtggatctcgtgtcgaaggacgagggagaagagttggaggaggacacatctttcaaggaggatccgtcgatggataaggaagatcctatcacggagccagagtttatgaaggaggatgcttcatag

SEQ ID NO: 75389 - DNA, 870 bp, Glycine max
  Peptide Sequence Number=SeqID_192167
atggagttagagcaactcgatgtcaaaacaatctttctccatggaatattggaggaagacattctgatgcaacaacttgaaggttttaaggtagaggatggttcctgcatctatttgctactctatatggatgacatgctcatagcatttcaaaacaagtttgaaattcaaaatctgaagtcactacttagtagtgaatttgagatgaaagatatgggagttgtagaaaagattttaggcatggagatcaagagggatcgagtccagaagaagcttttcttattcaacgtagtgagtaactatacgggaaaacttgcgaaggaacattggcaagctatgaaatgtatattcaggtaccttaagggtacaactgatattggactattctatcaaggtgacacatcttgtgccctttctagatatttagattatgactacgctgtagatttggatgcaagacgatctatgatagagtatgcattcacaattggcaattctcttgtcagttggaaagctacacttcaacctgtagttgccttgtccactacagaagcagagtacatgactttggcagaggcaacaaagaaagatatatggttgaaaggtcttattagcaacctcaagtttccacgggataaaactatcattttctatgacagtctaagagaaatttgtttaaccaaagatcaagtccaacatgagaggactaaacatattgacatcacataccacttcatccatattgagaagaggattgtagtccagaaagttggtacaaagggctcaaaaacacttgggaaagcttggaagcagagtggaagtggtttcttcttccctcttgaccagctcgtgaaaatggaggaagaatga

SEQ ID NO: 75390 - DNA, 723 bp, Glycine max
  Peptide Sequence Number=SeqID_192168
atgggtcatcaattcaaattcatttgtgtcaaagatgtagagaatgtattgaggttggagaaagatctagataacattcttattgatatcatcaagatacatagcaaagggaaacaaaacaaagagggggaaaataaggataatcgaagacaacaaccaacttatgcactgaagagattatcggggaaagggaagcctacaagagacaacaaccaacgtacattacaacaaatctgcaatggaacaaaaaaccacaatgggataaacagagtgaatctagagccagccagcaatgggggacggttgcaaaatcagatatggcaagtcaaaaaaggaaacatcaaagaagacaactttgaggaatggacaagtctcaatgtcaaagcaaatggaatacaagcgcagaggctacaagaatgttgggtaggcactctcaaagatacgatgttttgcaaactacatgaggagtgctatgagggaaatatgggggagattaagcttaagctttggaaaattggaaaccaacaatggtacctggtacaagaggcaataagggatggagatggtggctgtaaggagagatcgatagaggaaggaggaaacaccaatgagatgaaggcggttattgatcacaagggagaagacgaaatcatgcaaagcacaccagttaccttgatagatggaaattcgtactctctaggggaaaactttgtcagaaattag

SEQ ID NO: 75391 - DNA, 462 bp, Glycine max
  Peptide Sequence Number=SeqID_192169
atggactgggcaaacaaatctcaatcaagagtgtggaacactcccactcatgactttgctcgaacaactttaggtgctatggtcttgtctggacgtctaatgcatatggggagcatatcaagaggcaataatatggtacatttgacgaatgctaaagtaaaggcaaggaagataatggatacttgttggggcttactcactatggacgccaagatgaaatgggaaaagggggtgtgggggctgctaaaatggaaattcattaaagacattatagtaaaggaaggagttctgttagacactggacgatctagacatctcttaaggtttgatgactggaagcaacaccagatatggaaagttctgatcctatcagatcgaaacgcactatatccttttatttcaggaaacaagattaatttgcacaacagtcatattaatcaattccgaagatactctccataa

SEQ ID NO: 75392 - DNA, 414 bp, Glycine max
  Peptide Sequence Number=SeqID_192170
atggccacaatgatggaggccatgatgagcatgaagaagataatggatgccaatgcggttgcagttgccgctaccagtgttgttgctaaggtgaacccgatgcccccatttgacctcaaccatatgaatcatccaacctcaaatatggtaggccaagatttgggaagtacgggcagcccccatgatgtgcaaattcaaaacgagtacgtcttcccgccatatggcttgcctcccaactatacaccacccaatgtggcgtacactcccgatgaggatgtcaataactctgctctcatactcattgagagccgacaacgtcatcatgcacatgtctctcaacccatgggggagacatatgaaataccccaccacaatctagccgacttcgagccttgcctcggatatgccacttaa

SEQ ID NO: 75393 - DNA, 297 bp, Glycine max
  Peptide Sequence Number=SeqID_192171
atgccactaaatccagatttggccttccaactctcaaaacctcactctttttccactcataacaccatattctcactttctaaccctagtgagaaagaagtctacccaaacctgaaatttcgaggtcccacacgtagagatgcgcttcacgactccgaaaatgccctcctttcgcgatttggagcagaaatggtgaccaaaggttggagctttgttggagcttcaatggtggaggaagaagaagagaatggcaacgtgagagagagaaaagagctttctgaaattttctttggctga

SEQ ID NO: 75394 - DNA, 714 bp, Glycine max
  Peptide Sequence Number=SeqID_192172
atggacttcttttgggaattagcaaaggtggaaggggtggaaagggtgaggctagcgcaggctagggttgagattctgagtttaggatctgatggtggtggaggtgggtcttttgtcttagcagtttgggttaggcttgctaccccgtgtctgttgagacatagatccaaactcaagatcaacaggttgatcttgagtgcctatcgtctgatcaaccacaaactgtggttcctctttgggctccttcttgactttgcgatcaagctttatcgataccgtcgacctcgagggggggcccggtaccagcttttgttccctttagtgagggttaatttcgagcttggcgtaatcatgctaactcacattaattgcgttgcgctcactgcccgctttccagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 75395 - DNA, 852 bp, Glycine max
  Peptide Sequence Number=SeqID_192173
atggatgcagacaaactcatacgcatgaaaaaagcttatggcatgctagaagcccatgatatttgcatatctctcactagtctcgacaaacgtctgatgaggccagatgaacgacaagccacaaagtggattttaccttcaagaccacctatacctaaagctagtccaagtttacaaggctgggagcaatcaacttatggccttgagcttcgaatgaagttactcgcctataaagaagaaatcagatctagacaaacttcattcaaacaaattaaaaggctcaatgttcacatgcctttcatgattgggttccaattctcatgttttgacacccacaacacccaacttcagatattagtagacaagcctatgcagtatcaaaaggttaattactacaatggaaaggaattacttattgaagatgatgaagatgcttctccaactagatacgtgaaagctcatcctagaaggctttttaaacatgatcatgaggctcttaagcaaaagactgagctcacaaatttgaattggtctggaactagacaagaagcccctagtagaagttcaccaggagatagagtgctgctattagaccttcaatcatacttcttttactcaggaaatgcctttcaacatgatctattcatggacaagggagttttttgctctgatcgcacgttttcctttgttgtgaatcttccccattctagattcactttcactcatcatatgcaacctatcattaaggaagtggattctaatgttgaagctgaagttgatctcagtgccatggctgtagaagtgtatgatcgtccatcttcaagagagtatgtcaaattgattgaggcttag

SEQ ID NO: 75396 - DNA, 222 bp, Glycine max
  Peptide Sequence Number=SeqID_192174
atgtcttctactggatttgaatcctcatccaaggatactaatgcaacctctacttctttgatgtctccttgttcggtgtttccggagtcttgtgtacctccagggtggatatggaggatctcatgttcacttgcatttacaacatctctaagcatgtatgatttactttcattcttggtttactcgtcgactcaagtaaatcatacatgcttagaggagtag

SEQ ID NO: 75397 - DNA, 540 bp, Glycine max
  Peptide Sequence Number=SeqID_192175
atgggggttgctgatatttttccagaatacactcaaacgccaatcaaacgcaaagtcaagaaggagcccaaagaggaaccacagtttgtggttgatcagacgataggcactcaagatcaacctgttgatcttgagtttggatctatgtctcaacagacacgggcctgcgctagcctcaccctttccaccccttccacctttgtcacatcgaattcctgcagcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 75398 - DNA, 350 bp, Glycine max
  Peptide Sequence Number=SeqID_192176
tgtctctattgtttgctgggatcgtgcccgcaagacacctagtggacccgaagaaggccaacagggtcttgcagttgtcagctctaattacgggcctctgtcagttctacggagttcccgtcgcccccaacaagttcatcaggcaccctattaaccgagctttcatcaagaagtactgcacccctaggcaggcgcagggtgaaacaccacagcagcctggggagtgctggcagcgggcaaccgatgcaccgccaccacctctagagttcacctcagctcagcaacaaaaaggtagtgaaaataccttagatatgcatgtagcaagataccttggatatgcgtgtatatag

SEQ ID NO: 75399 - DNA, 351 bp, Glycine max
  Peptide Sequence Number=SeqID_192177
atgggcctcctgcatgcatctcgccagctgggctggcggttccttcattgcatgcatctcgccagtgttgctagcggaacctacatcatgcatgctggatggatggcacatggatgccgtatggatgcatgggaagcaaggatatctcgccagtggtattggcggaaccctttgggttgctgcagggatgttgttgaactaactaggaagagcatgaatgagttgaagtataattttgtccttggaggttattcggtttggaattcccgtgtggctcatgctgatcccatgagttggagtatcctagcaagacaggataaccttgatgttttaccaacagtcttatcttag

SEQ ID NO: 75400 - DNA, 408 bp, Glycine max
  Peptide Sequence Number=SeqID_192178
atggaagaagaactccatcagttcaccagaaatgatgtctggaaacttgttcctaagcctaaaaacaagagcatcattagaacaagatgggtgttcagaaacaaactggatgaacaaagcaaagtggtaaggaacaaagccaagttagtagctcaaggctacaaccggcaagaagttatagatttcactaaaaccttcactcttgttactagacttaaagctataagaatcatgtttgcctttgctactcataaaaacataaagccttttcaaatggatgttaaaagtgatttcataaatgactttattggagaggaagtgtatgtcaaacaaccttctagctttgaagatcatactcttccaaaccatgttttaaaactcaaaaaggctttgtatggtctgaaatag

SEQ ID NO: 75401 - DNA, 456 bp, Glycine max
  Peptide Sequence Number=SeqID_192179
atgttgacttggcggctcctacaaaggaatctcgcttcatatcttctcctgttcatctgctcccatgaacgaaggttcgcaatcatcacaagaaatagcctaaacgtgtccacacgacactcacacttaggaaaactaggcagcaagtatcgaggtcagcctatcatgcacatgaaactccctcccccacatggtgatcaactcgagtcacaagggagttccaaatcgagtgacatgcccccaagtacaactccatgtagaacttgtaggccttggatcttcttcatcaatggagtccttcgcttcttgaagatcaatggcagcggaatggagaatgacgaaagaacaagctcaccaccattggaggccatggataagagcttgaaggtaggagaagatgagtggagggagagggagagaagggggcacgaattttatgcctcaaatgaggtctaa

SEQ ID NO: 75402 - DNA, 231 bp, Glycine max
  Peptide Sequence Number=SeqID_192180
atggcaagttcgagccctactaagcctaccacccccttctcttcacccgatacaagaaggcagtcgaagtcccctccactcttcattttatgggaagacatcgcgttcctagtcgatttccctcattgcactgtccccttaatgctacgaagtgaagcaggcatagagaccaaccaaaccatagggtatctatcctgtgatctttcatcaaccccggctcggtatcggtag

SEQ ID NO: 75403 - DNA, 558 bp, Glycine max
  Peptide Sequence Number=SeqID_192181
atgtctctatctaaggttgcgacacatgcgagatttttcctctttcttcttcatctctgtaggagggttccaggaacgtgttcttccttctccaaaatcgaaatggaacttctctctctaaaaaatgcagtttcaactttctctctcatcgcttcgccagaatctcgccacctccatcgccggaaagtttcaactttctctctcattgcttcgctggaatcttgccaccgccgtcgccggaaaggtgagactcagagcttgcaagtcgtgacgctgactcgagttaaagcagttttcgttgctccgtggttttgcaacgtcacccagaatgtgaggaattcaggttggtcacaacctgatttgatcatggaggaatcaacaataggggcagcgttcttttcacaagtactggcagtaaatgacgcgacggtaaagtttgagatttgggacacatcaggacaagagaggcatgtttgctttattccgcagttctacggatcagaatcaaaagatgattacttcagtctacgaaatggtttcaaaagatgcatgatttag

SEQ ID NO: 75404 - DNA, 306 bp, Glycine max
  Peptide Sequence Number=SeqID_192182
atggaaatttgtaaaacccatatttccttcttaggaacagaaataggaaacgggaaaataaggctacagcctcatatctcccaaaaaatccttggtttcccagataaaatggaagatacaaaaactttgagggcttttctaggcctgcttaactatgccagaaactttatcaacgacctgggaaaatatacagtccctctttacaacaaaacatctctgactggacaaagaaaatttaatactgaggatataaaattagtccaaaagattaaagaaatggttaacaacttgccatatttatcctaa

SEQ ID NO: 75405 - DNA, 150 bp, Glycine max
  Peptide Sequence Number=SeqID_192183
atgggttttcctttgtcggcagtcatttaccctgccgaaaatttatctggttttagcattcgttattcgctctcccttgaggagattctactgtccttttcttcgggggaaaggatgaggattcttttcatgggccaaggttcaaagtag

SEQ ID NO: 75406 - DNA, 559 bp, Glycine max
  Peptide Sequence Number=SeqID_192184
atggctgaccggattagtaatttgcctgacgtagtgctctctcacatcctctccttagtcccaaccaatgtagcagttgcaacgagtgttctctccaagaggtggaaacttctatggcgctccgtttcgactctcaacttcaaccacagccaccatgacgacaacaaccacgaaacctgttccctctttgctcagagggtgcacgcattcatcctcatgcacgacatggaccaacccttcacaagattctgcctcagttcttcttgccctctcgatcccattcatgtgaacgcatggatttccgctgcaacgcaacacagagtcgagcacctcgacctctctctgggttgtgcggtagaattgccctccttcttgcttttcagctgcaaaacccttgtggtgttgaaactgttgaatgttgttttgtcgtttaataactcttgttgtgtctatcttccccggcttaagatcctgcacttgagcagcgtcgctttctcgaaagatagagatcttgcgcagcttctttctgggagtcctaatcttgaagacttggaagcca

SEQ ID NO: 75407 - DNA, 246 bp, Glycine max
  Peptide Sequence Number=SeqID_192185
atgcattcactcactcacgcaatcgcttgcactcgtgccctcactcacaagccattgaaggtgtctcccgaccagaaaggtttctcttttcaacacgcacaacacaacctctccaaaccttcacttctctttctccctctgtcactacgccatgctcgtgcactacaaccccaacctctcccagagccaggcaccaaaggaaatgattctcaccaaaaaccacaacacaccaaggaaacaaaatga

SEQ ID NO: 75408 - DNA, 348 bp, Glycine max
  Peptide Sequence Number=SeqID_192186
atgccgatctccccctgcggaagggttgcgcccacaagacacccagtggacccggagaagtccaacagggccctagggtttccagctctggttacgggcctctatcagtcctactgggtcatgccatcgcgacatagggatcgcgcccacaggacacccagtggacccaaagaagtccaacagggtcctggggtttccagatctgattgcgggcctctttcatcaggccccctactaatcgagctttcatcaagaggtgttgcgcccccaggcaggcgtaaggcgaaacaccatagcagcctggggatggccagcaacaggcaacaaatgcaccgccgccacctctag

SEQ ID NO: 75409 - DNA, 165 bp, Glycine max
  Peptide Sequence Number=SeqID_192187
atggatgatggacagagatacacagggtgtagtgggcagggaggttcgaagaacctaggggaattagcatgtgctaactacccaacatttgtggtcactcccgattgtcttccacatgattttgtaaggtcatcaagacctaggaggattggtggcagtgattag

SEQ ID NO: 75410 - DNA, 990 bp, Glycine max
  Peptide Sequence Number=SeqID_192188
atggctgataggattagctctttgccggacacacttctgtgtcacatcctctctttcttgccaaccatagaaagtgttgccacaagtgttctgtcaaaaaggtggagacctctgtggcgctcagtccccagtcttcatttcaacgaccaaatctattggcaatacggagagacctattatcgttttgttcagttggtgtacacagttatgctgagacgagacgtgacacgacccatcgaaaggtttaaccttgagtgcgtgtcttgtctttgcgacccttctgttatcgatacatggcttatagccacaatacatggaaaagttaagcatctcagccttttgcttccctctgacctcaacttgccgtgttgcattctcactagcacaacacttgtggatctcaagttgaaagggttaactttgaacagccgtgtatcttctgttgatcttccttcgcttaaaacgctgcacttgagaaaggttcatttcgttgaacctagattgcttcttcagattctgtctgcatgtccacttcttgaggacttgctcataagatctttgcatgttactaataacttttccagtgatgagcatttagaaagaatgccaaaattggtcaaagcagatatttctaatgcttccattgatgttcaaatggcgacattttataatgtggagtttctgcgcactcaagtgggatctgatttcttttctgataacaaacacacttttctcaatttaacccacatggagcttatcttccggttccggttcaatgtcttgggtcggttaattaatttgctgcatgaatgccccaatcttcaaattcttgtagttgacgaggggaatcttttcgtcaaaacaagttctgacgctctaaggctgaaattgaatcatatagagcttatccagcctgtacaattctttgatactgaacgacaaatgagttgttgccctgtgagaaagtataaaggttgtctctttatgtag

SEQ ID NO: 75411 - DNA, 840 bp, Glycine max
  Peptide Sequence Number=SeqID_192189
atgggccccgttcatagacattctcgctctgttgatcttcggaggagtcctctttccaaatgtggatgggttgtttcacacctttttcgccaagaggtgaggcatgcttgcccgctagaaagccaccattcatgcacagagaaaggaggggcaaattgggaccaacttttagcaaacaaagaaggagcatctgtcaactggttccctcaatggaaagaagaaagaattggggttcttatttcatgcggaggatttccgaatgttccctttatggggacgaggggttgcatcagttataatcccgttcatgctataaggcaacttggctaccctatgagaggggcaccactagaggaagagattgcgcctgtcatttcacaaggtttcaataagaccaacatggagacacttcagaaggtctgcaaggcatgggaggtgatgcaaaagaaggacaaagaactcagggacagtaacaacgggcccatcggtggctaccgtaagtggttgagagcccacgtgcaaggtttggattggctcccaagtttgagaaccgctaaaagggaggaggttgaggcatcggaggaagacgaagaggtgcaggcccttagggcagaactcgagcaagcccaaacagtcaaagaaaggttcaaatcagcagctcttaaaatccgaaaggagaatgccgaactgagagatataaatatagctaccaccaaggccttggaacaagaaaccaagagggctcgtagggatgagcacaaccggaacaagttccgaggggctctgtggggcagcaacagtgagcttaagctccggagagaggaaagggaccaatcatga

SEQ ID NO: 75412 - DNA, 114 bp, Glycine max
  Peptide Sequence Number=SeqID_192190
gtaacagatgcaccgcccccacctctagagttcacctcaactaattcacaaaaaggctggagtgttgcctacgacacatggccgactagcaggcaaccaagtccaaagccatag

SEQ ID NO: 75413 - DNA, 276 bp, Glycine max
  Peptide Sequence Number=SeqID_192191
atgaagaaactcagcaagaagggcactgtgttggttggtctccaattgagccattttctgaagcaaatcgtcaagttttgtggacatggatttctagtttgcagtgaggtggatttgggtggagctccatgtggagcttataggccttggatcttcttcatcaatggagtcctttgcttcttgaagttcaatggcagcggaatggagaaggaagaaagattattagagatgccacttcaaggagaaaatgagtcaataagaagctcaccaccatag

SEQ ID NO: 75414 - DNA, 198 bp, Glycine max
  Peptide Sequence Number=SeqID_192192
atggttccttctttctgcttcatggttgtgctcataatcctactagagtatatccttcagaagaacatgggactttatggccaacgagcaggatgcctgaggctcttcagtgacatttcttgtagttggggagtgcatatgctggaccttgatgatacacctaatacattggatgttgacaacctgcatgtgagctaa

SEQ ID NO: 75415 - DNA, 177 bp, Glycine max
  Peptide Sequence Number=SeqID_192193
atgagtatattttgcgtaggagtcgcgtggagtgtcgttataagaggtggaaagaggtgggattattctgttttttcgatgatgacattgcagaatggcacaatggggcagaagggttgcagtagtgggagatggaggaggtcatcgaggtggtgggaagagcaaacaacattttga

SEQ ID NO: 75416 - DNA, 1134 bp, Glycine max
  Peptide Sequence Number=SeqID_192194
atgtctccaacggtagatcggattagctctttaccgaacgaactcctttgtcacatcctgtcttttctgccaacgaaacaagctgttgccacaggtatactttctaagcgatggggccctctatggcgctcagtttccactctcgacttcaacgatgaaagttatttgcaaaagcgaacgttcttctactggtatcgttcagttcaatctgtttacacagttatgctccgccgagatgtggcacaacccatcaaaaggtttatccttgcgtgttccttttgtgacgtttatactgtaagcacatggataatgactgcaatagaacacagagctgagcatgtaagtctttccctcaatccgttgattactttgtcgtgttcgattctcagtagcagatatcttgtggttctggagttgtcagggccaactcttagagggatttcatcttgtgatttcccatcacttaaaacactgcatctgaagatggttcatttacgagaatgtagatgtcttgttgaaattcttgctgcatgtccagttcttgaagatctttttatcagttctctgcgagttaccagttcttattgtcatggcggtgaccagttgagattgtccaaacttgtcagagtagatattagtgattctgcttatttagcttgtattcagttaccaacattatctaacgtcaagtttctccgcactgatgttgtgcaactgcggactactttcgtcgggcttttcacttttgttaatttaacctacttggagcttatcgttgacgcccattattgggattggttgcttaaattgctgcattgttgtcccaatcttcagattcttgtgattgataagggaaattctttcaacaaaaccagtaatgatgaaaattgggtatattcacatcttgttcccaaatgtctttcgtcaaaacttaaaacatgccgtttccaaaaatatgaaggatgggagtgtgaatttcaatttgcaagatatattatgcagaatgcaagagctttatgcgccttcacaatctgcagtactggtttctcacctctagcggcaaagttccaaatgattaaaagattatcatcgtgtccaaggatttcaatcacgtgtaaattatcctttgaatga

SEQ ID NO: 75417 - DNA, 195 bp, Glycine max
  Peptide Sequence Number=SeqID_192195
atgacgaagcaacgcccttttagacaagctagcttcttgaaccactttcaatatctgaacctgaagaaggacagattcaaaggccaccttggaatgatgcatcccattattcgtacattaattggagtcacgttgatcatgaagatattttgggtgaagatgtgcataattcatggaatattggagatgagttaa

SEQ ID NO: 75418 - DNA, 288 bp, Glycine max
  Peptide Sequence Number=SeqID_192196
atgagggcgagccctggtgcagcggtaaagttgtgccttggtgacttgttggtcatgggttcgaatccggaaacagcctctttgcatatgcaaggctgcgagtgttcgtttcaggttcattttgtctgtctcacctccgttctcactgtgtctctccgtcttagctccgtctcgtgccgtcaggtggtgattgagctgtttattggattgttgctctatttttggatcgtgttgattgcatcggggaagtttctatccatacaccctgactctgaggagaataggtga

SEQ ID NO: 75419 - DNA, 171 bp, Glycine max
  Peptide Sequence Number=SeqID_192197
atgcgaggtaaagcgctagtggattcaaagccatttgatccgaaaattaccaacattgaaaggaagaataggaagaaaaagaaacaagcaaccgctaaaacaccggtactatgggagcttctgacgaagatgctgaagctgtctacctcagagctttaccatttttactag

SEQ ID NO: 75420 - DNA, 333 bp, Glycine max
  Peptide Sequence Number=SeqID_192198
atgtctgagcacgaaagtggatccttctcagcaaccacagaggtcaacccaagagaacaatgtaatgcaattacagctaggagggggatagtggttggtttgaaggacgaaagtgagtttagtgagaacaagacaaatgaaggagttgtgaaaataagtgatgaaaaagaagtagttgaaaaagagcaaaaaaatgaattattagctaaagagaagcaagtagagaagcagaaattgccagcatctaaaaaaggaaaagttatacttgatcattcaccaattcaacatcttccttatccaaatgcaccatcaaaaaaggataaggaaaagtag

SEQ ID NO: 75421 - DNA, 177 bp, Glycine max
  Peptide Sequence Number=SeqID_192199
atgctgacaatagttgaggagttcgtggatttccttgggcacggagtaggcgtctgccattgctttggccttggccagcaatcggggaagttcttgactcccattcaaagccttggtggtggctatgtttacatctctcagttcggcgttctcctttcggatcctaatagctgctaa

SEQ ID NO: 75422 - DNA, 500 bp, Glycine max
  Peptide Sequence Number=SeqID_192200
atggagggggcatccgttaattggttccctcactggaaggaaggaagaaccaggattctatcctcgtgtgaaggatttccgaatgttcccatgatgggaacaaggggttgtattaattataatctcgttctcgccgtaagacagcttggctaccccatgagaggagcgccatcagaggaaagcatcacgcctttcattgcacggggtttcagtgaccccaacacgagggtacttcaaggagttcacaaggcatgggatgcagtgcgaaggaaggacaaagagcttaggggaagtagtaatgggatcattgacggctatcgtaaatggctgagagtccggatacaaggattggattggctccaaaagctaagggctgtgagagacaaagaggctgaagctccggaagaaaatgaggaggtacgaaccctaaaggtggagcttgaaggagccagggcaaccaaagagaagttcaagtcaatggccatcaaagtccaaagaga

SEQ ID NO: 75423 - DNA, 192 bp, Glycine max
  Peptide Sequence Number=SeqID_192201
atggacgaaaacaatggaaaaagaatgaagaaaaacgaaaaagaaatgagcaagaaaagtgttgcctacaataaggattggaagaggaaattggtgcgttgcttggaggaatattttttagtcttagaggttaaccatcctaggagcaccattggatttgaagcaaccaaagcctcaccaaattttgagtga

SEQ ID NO: 75424 - DNA, 477 bp, Glycine max
  Peptide Sequence Number=SeqID_192202
gtccacaaggcatgggaggttgtgcaaaagaaggacaaagaacttaggggcagtaacaatgggcccatcggtggctaccgtaagtggttgaaagcccacgtgcaaggtttggattggctctcaagtttgagaaccgctaaaacagaggaagttgaggcaccggaggaagacgaagaagtgcaggcccttagggcggaacttgagcaagcccaaatagttaaagaaaggttcaaatcagcagctctaaaaatccgaaaggagaataccgaactgagagatgtaaatgtggctaccaccaaagccttggaacgagaaaccaagagagcttgtagggaagaacacggctggaacaagcttgctcgaggtccaaaagaagtttgtctcagcggttatgcgagacagagaccaacatccgacgagcatagagtggcggatgagtatgcccaagtgtacgcggagaagaaggctagaggaagg

SEQ ID NO: 75425 - DNA, 390 bp, Glycine max
  Peptide Sequence Number=SeqID_192203
atgaatttagaaggacgaaaaattattgtcaataaatcatctaaagagttggcggaactattaaaaacaccagacaactataaagaatttatgccggacggacttcaaaagtttgaaagcagagaagatggatttaaatttggactgcaggggatgccggaaattgctttaaaaatagatgaagttacagaccaaaaagctgttttgaaatcggcgagttcaagtctggatttttcattaacagcaactttaaaccctgtcaatgacagccaaacggaagtacaaatgctttttgagggtaagtttaatccatttataaaaatgatggttgagaagcctcttcagaattttatcaataccttaacggataagatagaagcttacaagtaa

SEQ ID NO: 75426 - DNA, 612 bp, Glycine max
  Peptide Sequence Number=SeqID_192204
atgtataaagtttttgtgaacgaaaaaaaattattgctgtctaaacagtctgaaaacctggaaaaaaatgtaaggtatgagaacttcacaacttttgaaatcgcattagatcttcttgaaaatacatctgtaaaagaattgaatgtattcggagacgatattgatactatttggaaagaatttcagagtctcttcagaattattgaggcagcaggcgggcttgtgaataacagcaaaggtgaaatgcttttcatcaaaagactgggcaaatgggatcttcccaaaggaaaaatggaaaaaggagaatcccgtgaggaatctgctgttagggaaatcgaggaagaaacaggacttaaggatgttgaattagtaaaattcatcaacaccacttaccatatctacgtagaaagaaacggtgaaaaaattctgaaatgtacccattggttcgaaatgaactttaatggtgaagacacttctaaacctcagattgaagaaggtattacggaggtagcatggaaaaacaacactcaaatagaaaatgaagttttcccaaatacttttaaaaacattcgcctgatcgtcactgaattcagggacggccagcctaaataa

SEQ ID NO: 75427 - DNA, 651 bp, Glycine max
  Peptide Sequence Number=SeqID_192205
atggacatcccactgagaagcactaggaagtaccttttcaaaaaaacagacctgttgagattaagggagctagcatctttagtaagtgatccagttgattttcaagctcatcatgggaagttgctcagaattcttagagtagatgttgaggaaggatgcctagagaccctggttcagttctatgacccgctctaccattgcttcacatttcccgattaccagcttgtccccacacttgaagagtactcctacctagttggcttacctgtgccagacaagatacctttccatggttttgagcctacccctaaaccctccgacatcgcagccgccctccatcttaaaacctccatcatccaagcaaaccttacctctaaaggaggcctccaaggtcttcccacccacttcctctaccaacaagcctccatatttgctgaagcagctagtacacttgccttccattctatcctagccctccttatatatggccttttactcttcccaaatattgacaacttcatcgatatcaatgccattaaaatctttcttacaaagaaccccgtacccactctactcgccgatacctaccattctattcatgacctggcttaccttccacttacctcaatcccgtgccttcaagaccaatga

SEQ ID NO: 75428 - DNA, 276 bp, Glycine max
  Peptide Sequence Number=SeqID_192206
atggggcatgccacattgtccccatcctcttgcaatttatgtccaaacatgcgctcaccaagtgctcggaaatggccccgaggaaacttgcctcaaagagatccaggaaggataaagcggccgaaggaactagttccgctcccgagtatgacagtcaccgctttaggagcgttgaacaccagcagcgcttcgaggccatcaagggatggtcatttctccgagagcgacacatccagctcagggacgatgagtataccgatttccaggaggagatag

SEQ ID NO: 75429 - DNA, 294 bp, Glycine max
  Peptide Sequence Number=SeqID_192207
atggtagcctggccttggacccaaccttctcttcatagggaagatgaaggtcccacagcccaggtacctcagcatatggaggatgagtcatctgaggccaccatcccagagccatttgatataggagaagaggcagaggagacacagccttcagcagacccctccactcctcttccagagatgccagaggacccgactacaccaatcctagctatggaaacttctcctctaactacttcagtgcttcagctaacagacgaggaggatggtcagacacaggacacccatgactag

SEQ ID NO: 75430 - DNA, 712 bp, Glycine max
  Peptide Sequence Number=SeqID_192208
cgaaaccacagccaagggaacgggcttggcggaatcagcggggaaagaagaccctgttgagcttgactctagtccgactttcggggcactgcccctctttttggacccaaggtcggcttcggccggtcgatccgggcggaagacattgtcagtacgaatacgaaccgtgaaagcgtggcctatcgatcctttagtccttcggaatttgaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggaagtgagagggccgcggcaaagccgtttttccataggctccgccccctgacagcatcacgaaatctgacgctcaaatcagtg

SEQ ID NO: 75431 - DNA, 416 bp, Glycine max
  Peptide Sequence Number=SeqID_192209
tctgccaatcctatggagttcccgtcacccctagtaaagtaatccacccgatcacccgggctttcatcgagaagtactgcacgcctaggcaggcgcagggtgatgcacatcaggccgcagacgcgccgccaccacctcggcaggccgatccagctgggtcactgggcgtggagcgttatctacatcatttggtttgccagcaggcggccaaccaccatgggcaggggcagggttctgccccttttgcatgccctactccagagcagtttggggctgaggtcgcatggcctggagactggcccgatgcccaggtaggggaggagcttgcaggatccctcggtgagccagatgagtcccatatggatgaagatatgattgacttgctcggtttcttgggagggagcggagccacatga

SEQ ID NO: 75432 - DNA, 653 bp, Glycine max
  Peptide Sequence Number=SeqID_192210
agccactcggcgcgcagtcggcgctgctcttcgctccaggtcgggcagaaggcgcgcatctgctcggcgctcatgcccggcagcgactgccggatcgagtcggcgtaccacggccattggccgggataggcgcggcggccggggccggaaaccggcggatcgaccagcaccagccgccgcacgccggcgggctgcaaaacggtggcgcgcagggcgaagcgggcgcccatcgaatggccgagcagggcgtaactgtccaggctcagcgcggcggcgaaggcgttgacgtcctgcgcgcaggtctccgcgtcataagccagttccgggccgctggacgacagaccgcggccgcgcacgtcgagcacgtagacgtcgtattttttccccagccgctcggcgacgaaaccccaggtgatcgccgggctggtgatgccggggatcaggatcagcgccgggccgtggccgccgtagcgcaggtagtgttggcgaatgccgttggcgtgaacgtgggcgccgtagaggaaggtgctcatgcggcgttctccgatttcagcgcttgcgcgtacaggaaggtgttggcgttggacaccgcctgcaccctggatgcgcgttccttgcggttggcttcatacagctggaaggcggtgcggtag

SEQ ID NO: 75433 - DNA, 309 bp, Glycine max
  Peptide Sequence Number=SeqID_192211
ctttaacaacggacgatgctgataaaacatcaaaagccgctgcagaattcgttaagacagctgctgcaatagattctaaagttatttcatcgactcatttgtctgctctgaaaaagaatgccggtactatttccggaaccaaaagtatagatacccaaagagaggcctttctgaatctttcaaaagatatgatcgcgctgacaaagcagttcaaactatccggaaaacctgtttttgtaatgtattgtcctatggctgacggaagctggctaagtaatgaaaagcaggttgtaaatccttactacggaa

SEQ ID NO: 75434 - DNA, 365 bp, Glycine max
  Peptide Sequence Number=SeqID_192212
atgcaccccccacccatagaaatcaagaaaagagctctcagtctgtcaatccttactatgtctggacctggtgccagcggagtcctaaaagcaacatccgctgatccctggtcggcatcgtttatggttgagactaggacgttgttcgtctttcataaatccaagaatttcacctctgactatgaaatacgaatgcccccgactgtccctgttaatcattactccgatcccgaaggccaacacaataggatcagaatcctcaccggaggcacgacccggccagttaaggacaggagcgcatcgccggcagaagggacgagccggccggtgcacaccggaggcggaccgatcgacccattttcaag

SEQ ID NO: 75435 - DNA, 378 bp, Glycine max
  Peptide Sequence Number=SeqID_192213
atgacaaagagtaaaaggtttgtggaggttgaggatgaggataatgttgtgcatgagaagaaaactgttgacaagaaaagtactaatggcaagaaaaatgaagtgagaggtgaaagtaatggaaggaggtcaagaggttctgaaagtaggaaccaaaacataagatcacccagtgagggtttcaatttcttggaaaaaggactgaaaaataacttagaaaaatattttctgaaaaatagtctttttgctaagcgcaagcctcgcgctaagcgcatctttattcatgcgctaagctgtgagtctcaagcgcttagcgcccaacccatgaatctgaggttgattgggtccgctaagctagccaaggttgagctaagctaa

SEQ ID NO: 75436 - DNA, 296 bp, Glycine max
  Peptide Sequence Number=SeqID_192214
atgggacaactggccaagcagatagctgacaagtcatcaaacagctttggagcaaatacggaaaataatcctaaggaggaatgcaaggctgtgatgaccaggagtaaaaggtttgtggaagctgaggatgaagaaaatgaggtagacaaggaacaactgagtgaaaagacaggtgttgaggttaagaaaaatgatgtgaaggagaagagtagaagtggaaaggttgtggaagaaagtgtggaagtaccatatcatgtggtgccttccaagaatgaaaaagatcgtcatttggcaag

SEQ ID NO: 75437 - DNA, 534 bp, Glycine max
  Peptide Sequence Number=SeqID_192215
atggccacgggaatgggtttgaacatgcaggcacgccggtcaattcagcttatggtgccatcgtccggggctgacgggaaacggcgcgtgcggctacggccagtcgcagttcacgtcgctgcccggaatcgagcacatccggccagaacagcaggcgctggcggcgccgatcctcacgccacagcaacaacagccatgggccacgcaccaccagccgtggcgtatcaacgtcctgcccggccacctgcagtggctcgggaagcggcggcagaagcacctgcacgcgcggcctgcgctggcgccaggccagtcggccaggccccacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 75438 - DNA, 249 bp, Glycine max
  Peptide Sequence Number=SeqID_192216
atgcctgatagcatgcagagactaacatcgtcttctgcaccctttggccaaccagtggcaagcgagcccgttgacacgcagaaactaacattgtcatctgcacctttgtcatccagagacggcgagtccaatgacattcgggggtaccttatggttatccgcaccttttgtcaaccagaggcaagcgagcctgttgacacatggagatttatgtcatcttccgcacagactacctctgtcaagcactaa

SEQ ID NO: 75439 - DNA, 355 bp, Glycine max
  Peptide Sequence Number=SeqID_192217
atgttggtgcgcatgatccacactcgtctttttgcagcagcacgggggaaatcttgccccgatatgcatagtagatgtgtgatagcctccctctctggaggtgctcgcacagttggtcaccctccaatatcagaggggaaaaggagcttctattctcctaaggtgtggatatggagcacactgaaaatgaggacgcgtagccctctaaagacgagggcgtgcagccctctgcaggcgaggatgtgtagtcctctgatggcgaggacatatagtcctctaaaggtccacctttatgagaaagcaagagatcgactcatcgagagggtcggtcatccaacaagattggacacgagat

SEQ ID NO: 75440 - DNA, 387 bp, Glycine max
  Peptide Sequence Number=SeqID_192218
atgctgggccctggtgtgggtagcccaccggctaaggcagtacatgctaagctacatcacttggttggtgtccaagatggacccagacaagcgataaaggggagtgccttggcagattacctggctcagcagcccattaatgactaccagtctatgcatccagaattcccggatgaggacatcatgaccttgttcgaagaggaagtagcggatgaagataagaacaaatggattgtgtggttcgacgacgtgtccaacacactaggccatggagttggagtggttttggttacccccaatgataaatgtatacccttcacagctagattgggctttgactgcatgaacaacatggctgagtacgaggtgtgcgcccgtgggatctaa

SEQ ID NO: 75441 - DNA, 289 bp, Glycine max
  Peptide Sequence Number=SeqID_192219
atgcctcctaaggcatcgggaatctccctacggggaggaaggagtacaagcaaaggagccagactggctcttccagagccaaccatcaagaaatcatcaacctcttctgggtcaccaacccaggctgggtcatctacccagaaaaccaatttagaaaggtcatcaacccagattgcctcaatcaatcctgagccatccactcaggaatctcccaaaccggcaaccgccaaacaaacatcggctgactatgcatggccaattgaaacccttcaggcccttcaagacatgg

SEQ ID NO: 75442 - DNA, 123 bp, Glycine max
  Peptide Sequence Number=SeqID_192220
ggtaggttgcgacaccctccttttcttagggtggtggcgaattgctctattgttagcggtgggcgacaggaaacaaaggggatgacatctgatggtgccgccggcaatgggagcactcattag

SEQ ID NO: 75443 - DNA, 171 bp, Glycine max
  Peptide Sequence Number=SeqID_192221
atgtattttccatgctacctaggtgcaagtctcacaatcccaagcttacaaaaccatgctcatatgccattgaggcatttcaccgagcacttggtgggcgcatgtttaggcatgaatagcaagagagtgggggcaatgtggcatgccccattgcttcaggatgcaccctag

SEQ ID NO: 75444 - DNA, 312 bp, Glycine max
  Peptide Sequence Number=SeqID_192222
atgttttccaagaaggagggaatgatgagaatcctgaaactgaccaaatacaggctaaaggcccaaacttatcaaggtaatccttgtggcgtctaccctgacttatcttccttcactggaagtggcgtcatccaaatctccgtagcctgtatcaaacgatccgctcctactcaggttcacatcaatgacttatcaaactgttacaaaaggaccactcattcagttggtgaggaaccatgttccttcatgggaagatgcctaggaaatgggtgtttagaccttaccttacttcaatataccaaacaccactaa

SEQ ID NO: 75445 - DNA, 357 bp, Glycine max
  Peptide Sequence Number=SeqID_192223
atgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttggacctgcggaaggatcattgtcgatgcctcacaatcagattgacccgcgaattgtttattcatcaccgtcgggagggaggggatga

SEQ ID NO: 75446 - DNA, 108 bp, Glycine max
  Peptide Sequence Number=SeqID_192224
atggcttctatggatacctctactatggtcaactctaagatctttccggcctttaaccttgacttggtaaaacctcttgccggtttgatttgtccccatgcttactaa

SEQ ID NO: 75447 - DNA, 381 bp, Glycine max
  Peptide Sequence Number=SeqID_192225
atggctggcctctctgttgtgggtcgagatcattatggggtgtttccattgaggggaaaattgctgaatgtacgggaagccagcagtaaacagataatggataatgaagaaattcaaaatataaagaagattcttggactgcagcaaaacaaagagtacacaagtgtgaagtctttgagatatggtcatttgatgattatggctgatcaggatcacgatggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 75448 - DNA, 648 bp, Glycine max
  Peptide Sequence Number=SeqID_192226
atgcacgccctcgccttcagaggactacacatcctcaccttcagagggctacacctcctcaccatcagaggactacacatcctcgccaacagagggctacacatcctcgacttcagagggctgcatgccctcaacttcagaggactacacattcttaccttcagaggactaaacgttctccctttcagaggattacacgtcctcgccatcattggactacacgtcctcacctttagaggactacacgtcctcgcctttagagggccacatgccctcgccttcagaggactacacatcctcaccttcagagggctacacgctcttaccttcagaagactgcacaccctcgcctacagagggctgcacgccctcgcctgcagagggatgcacatcctcacctttagaagactacatgtcctcacctttagaggactacacattctcgtcgtcatagggctacacgtcctcaccttcagagggatgcacaccctcgccttcagaggactagatgtcctcactttcagaggactagacgtcctcgccttcagagggctgcataccctcaccattagagggctggacgccctcaccttcagaggactacacgtcctcgcctttataggactagatgtcttcaaccttcagatg

SEQ ID NO: 75449 - DNA, 273 bp, Glycine max
  Peptide Sequence Number=SeqID_192227
atgagggtcgatgcactacgtcaaaaaggcttatctccattgcagaagtgcacagctgttattcgtatattgtcttatggatcacctggtgacattgtggatgaatacattcgaattggcatctataccatatttgggaatgaatacttgaggagaccaaataatgaagacactgaacgcctactacaaatgggagtggcacgcagatttccaggtatgttaggttccattgattgtatgcactgggaatggaaaaattgtccagtttcttaa

SEQ ID NO: 75450 - DNA, 267 bp, Glycine max
  Peptide Sequence Number=SeqID_192228
atgcctcccacgccaggtcgtactcataagcgcatcagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 75451 - DNA, 1065 bp, Glycine max
  Peptide Sequence Number=SeqID_192229
atgacgccgtggggcgccgggattgcgtacgatgtggacgccgcgcggcgttatatcgtcgaagcaccgatctactggctgaaggagtttaacctcgacggcctgcgcttcgatgccatcgaccagattgaggacacgtccagcaagcatgtgctgatcgagattgccgaacgcattcgcagcgaaatccactctcgcccgatccatctcaccaccgaagacagccgcaacgtgatcttcctgcatccgcgcgatgcggacggtaacgcgccactgttcagcggtgaatggaacgacgattttcataatgccattcatgtctttgccaccggcgagacgcacgcgtattaccaggatttcgccgacgtaccggagaaattaatcgcgcgcattctcaccgagggctttgcttatcagggcgagctgtcgccacaaagtggccagcggcgcggcgtacccagcgcaggccagccgccggtggcgtttgtcgatttcatccagaaccacgatcaggtgggcaatcgcgcccagggcgaacgcctgattagtctggccggtgtcgatcgcaccaaagtgctgctcgccaccctgctactgtcaccgcatattccgctgctgtttatgggcgaagagtacggtgaaaccaacccgttcctgttcttcaccgatttccacggcgatctggcgaaagcggtgcgtgaaggacgggcgcgcgaatttaccggtcacgccggtcatgacgatacggtaccggatcccaatgcagaagagaccttcgcgcgttccaaactggactggagcaaagtggaaaatcccgcaggccaggcgtggctgacgcttactcaccagttgctggcgttgcgccagcagcacatcgtgccgctgctgccggatgcccgcaggcataacggccaggtgctgcgcaccgcaccaggctttgtcgccgtcagctggaagttcacgcaggggcagctgtcgctggcgctgaatattgtacagcatagccagtcgctgcccgctatgcccggcgagacgctctttgcgtgtgcacaggaaagcggctag

SEQ ID NO: 75452 - DNA, 243 bp, Glycine max
  Peptide Sequence Number=SeqID_192230
atggaggagcaggttcaccgggatgcattgtccctggaaattaagtttgaaccaaatgtcatgtgtgaacctattgacaagaaagtaacatttcgaacaagccagggctgttggtgtccactgtcaacttatcaattatggcagacagtggtggattctggtgatgtgggcagaaggtgccttcctttgtcagtcagtggtagactggcaatggcattgagttgccgaggtgtggcaatttga

SEQ ID NO: 75453 - DNA, 186 bp, Glycine max
  Peptide Sequence Number=SeqID_192231
atgaagcaacctcctgttttcctaggaaaggaagacctaacatgtttgcctagtagacatgattcacaatctaagactgatagtttactaagattaggaaccatcatcttcaactttgccagactaggatggccaagacgatcatgccaaggttttggagaagaggctgcaaaactggacacttag

SEQ ID NO: 75454 - DNA, 321 bp, Glycine max
  Peptide Sequence Number=SeqID_192232
atggatgcagtatccttcgtcctcaaaaccagatcggcatcctcagctttgacatctttgattgtgccaccatctgcgctcagcggcagtgaacaatgcaagatctgcatcttaagcgtgggatctgcatcctcaactccgacttcttcgattgcaccaccatttgcatgcagaggtgatggtggtgcaagatgtgcatctggagctcacagttttgtccgtagaggctctccgcatgaggggaaagacagtgaacaagaacatttaatttcattgaatcagtttcagcttggtgttgtaaaaaatgcatgcactccttag

SEQ ID NO: 75455 - DNA, 624 bp, Glycine max
  Peptide Sequence Number=SeqID_192233
atgaaacatgctcagggactgatgacaaagctgtcgggaccaaacaggtcagcttccaacggcggtgcggcagcgcgtgggcttcacgcgtcggaagtcgcgcgagacaaaggcggcgcgtgggagctcctttggtggcctgacttccaggggtgggtcgcgtttttcgaggcgatcctaaccctagtctcgccggagaaaaacgactggagatggcggcaaatggcggacgaaacccgctctgatgccaacttgaagactgagcgtggcccatccatcgcgtccaacccacatgctggtatctggccactggaactcaggcgcgatgccatggttattctggatagtgggactattctctcgtgcttgtacaacaattgtttggttgtgaagttgggttccaggagctcaagtgcgcaagctaagaataagactttccttggcactattctcccttgttttggaaaccatgtaagtagtggaagaagtggtcgttctcggtgttcctatgttgagtatcaagaatatgtctggttgaagtccaatatccagacccagtcatcttcaacacctagtgtttcagttgcttctatttctcaatatgtggatagtcaaggtccatgg

SEQ ID NO: 75456 - DNA, 324 bp, Glycine max
  Peptide Sequence Number=SeqID_192234
atggcggccatgatggagttgcgttgcggttttctgaaaaaacgccaccgaacagcggtggcgtggcgggttaaagatggcggcgccatggcggccgccatagccatggcggccatggcggatgtggcggcgaggcggaaaatggcggatgcagctgcaaccctcgacctcgaagctccaacacagcgcgacgacccacgatccctgcgaccagccacgacctcggaaccacccacacctgcaaccagcaacgacccacggcggcgacgagcatggcagcgaccacccacggcaacgcgaatggcggcgacgagcacggcgtga

SEQ ID NO: 75457 - DNA, 330 bp, Glycine max
  Peptide Sequence Number=SeqID_192235
atgggagcgggcatcatcacggtcatggtgaattggaaccagcgacagcgagggcagggtgacgagaatcctaaaactgtccaaatacagggacctatgaccaggaataggaccaaacagtcagtagataccctccaacaaattatagcaggcatatttagcaaggcccaagtggagaaggacaaaagcccaaatggagaaggacgaaggccgaagtggaaaaggacgaagccccaagtggagaaggacaaaggtccaagtggagaaggacgaaagacccaagtggaaaaggatgaaggcccagaagcagaggcactactaagcatataa

SEQ ID NO: 75458 - DNA, 498 bp, Glycine max
  Peptide Sequence Number=SeqID_192236
atgactcggccctgcatattacagtttattgcagcattccacaatgaaaagagcctcataccagatacgcctcagacaataccaacgaaacttgttctttgccgatggcctgaaacagttgaggaagcacttaaatatctacgagcatgtggtagacccctaccagcatttagaatgcatgtctggactattgaactcactcagtccctgctttgtgatcctgaaccactgatgcttccacctcttgcagcaatataccttccttcttgtggtttccatatgaccattttaaggaagctcgagcctccattacaatggcctgttgttccagttggtcctagctaccatgacaagtatgttggcgacccatggtaccggtttcttgctgaaggtgattttgttcatggagacgaagttttattctattacagaagtcgtgaggatatttgggaaatgtttattaggaaacagaggaattggggtgacaatgatgattag

SEQ ID NO: 75459 - DNA, 1017 bp, Glycine max
  Peptide Sequence Number=SeqID_192237
atggaaaaccatagatttataagcaagtttgattcagcaaaagccagaagcaatagaaagcatattagacaacaaaagcttcatcccatactgaagatcattataaccaaccaaagacgccaccacatagtgtccatgcaactgtcaatcaggcttcagacgatgctgaagatcatttcatcctttttctgctttgaggttaatgtctccggttcatcagacaatgagagttctggatcaacacaagaatatcagactctttcttcagttggatatgcaaactgtgaatcatcacatcatgattctacaatggacacaggagaatattttgatcttggtgaccagcttatgcaatgtagacattgtaatgcaaaaatgtgccactataatgaaattgaggcacatattgtctcaaatctgcaaaaaatgctggatgaaaacaatgctcatgcaaagagtttaaggatggcaagggatagattaacaggcactgaagtacataatatcagactcaaattgatcgctgggcgggaaaaagatggtcgtacatataatgtgccaagtgttccagaagttgctggctcacttatatcaggtgatattgatgcaaattcgaacagaaatattattgttgaaactcaaaattgtcaattacagaggatacatgaattacattgtagttatctagctctacaatatcctctattgtttccttatggagaagatggatatagggccgacattctacaccgtgatacattaagtgggaaaaaaagaaaaaggaatcgttttacaatgagagagtggtttgcttatagactgcaatgcagacccaatgaaggtcaaactttgctgcattctaaaaaactatttcaacaatttgttgctgaaggatacacaatgattgaatcaaaaagactttcctatgttagaaacaaccaaaagaaactcagagttgacaagttctgtagcttacaacaatcatcggatgctggaaatacaaaaggtttaagctaa

SEQ ID NO: 75460 - DNA, 288 bp, Glycine max
  Peptide Sequence Number=SeqID_192238
atgaagaacgtcgaagaacggttgaaaccttgcgagattcctcacggaaaacgttacggaaacgttcggaagcgcctcggcttagatttcttcacggaaacaattttcccaagcaaatcgaaagagagagaacaaaataggggaggtggttgccgcccagctcgcccaggcgagctcagctcgcccaggcgagccaggttgcttcctccagaagcaacagccttctggaggaatattctggagggcccaagtgggcctgggtgctatttgcacccccatttttactaa

SEQ ID NO: 75461 - DNA, 948 bp, Glycine max
  Peptide Sequence Number=SeqID_192239
atgctgcaggcgttcatgagccatgaagcggtggagcactgcgtcagcctcaggcgcgtggtgtgcagcggcgaagcgctgccggccgaactggcccggcagaccctgcaacgtttgccggcagcgcgcctgtacaacctgtacgggccgaccgaagcggccatcgacgtcacccactggacctgccagccggacgaaaatatcagcgtgccgatcggccagccgatcgacaacctcaagacccacatcctcgatggcagcctgcaaccggcggtgcgcggcagtgccggtgagctgtacctcggcggcgtgggcctggcccggggttatcaccagcgcccggcgctgaccgccgaacgcttcgtgccagacccgttcagcaccgacggcggccgcctgtaccgcaccggcgacctggcgcgctaccgcgccgacggggtgatcgactacgccgggcggatcgaccaccaggtgaagatccgcggcctgcgcatcgagctgggcgagatcgaagcgcgcctgctggagttgccgagcgtgcgggaagcggtggtactggcccaggacgggccgagcggcaagcaactggtggcctacgtggtgcctgccgacagcacgcaagagcagggcgcgttgcgcgacagcctgcgtgccgcgctcaaggccggcgtgccggactacatggtgccggcgcacctgctgttgctcgcgcagctgccgctgacgccgaacggcaagctcgaccgcaaggccctgccgcaagcggatgccagccagttgcagggggagtacgtggccccgcagagcgcgctggagcaacagatcgcggcgatctgggcacagccgagcacgccaggccgggctcgagtttaccccccgggagctgttcaagcatcagaccgtgcagcgcctggccctggtcgcacggtaacagcgtaccgcacatga

SEQ ID NO: 75462 - DNA, 489 bp, Glycine max
  Peptide Sequence Number=SeqID_192240
atggattggagctacgcttgcttcttcaaattggaggaggctttgaagaatttggagaggaaggaggaggagggttttggaacgttgtcgtttggtgctgaagaggaaaagtcaagaccttgcttgaacctcgcagctctctcacccttacgggtcagctcgttgaagtacgccgctactttttcttcttccgtctccaaacttcacttttcaatttcattcttcatccatctcaactcaactaacaacccttcatcctccatgaaatgcatttttcattacaataattacaaaaatgccactagcttattttctaaggcggtccacttagtgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 75463 - DNA, 288 bp, Glycine max
  misc_feature (227)..(227): n is a, c, g, or t
  Peptide Sequence Number=SeqID_192241
atgaagaatggtggaaaatcttcgcgaaatcacccacggaaacgtctcggaagcgttacagaagtgcctcggcttggattttcttcacggaaacaatttttctcactaattttaagtgattctcagataccaggagggggaaaagagggaggtggttgccacccagctcgcccaagcaagctcagctcgcccaggcgagctaggttgcttccaccagaaggcaccgncttctgttggaagatcctggaaggcccaagtgggcctgatttgctgattctttttccgtaa

SEQ ID NO: 75464 - DNA, 345 bp, Glycine max
  Peptide Sequence Number=SeqID_192242
atgaagaacaaactcaagatcctcaggaacctatgctttatgagccagtacctttgtggagatctacaagagaaaggagaagtgttattccagatgattatgtcgtatttctcgacaaacatgaggaaaataatgggattttgcttcgttcgttttgtcattgtccctattcttcattcacgacgagttggagctgctcagatgacatggcggcgcggtgtggtggttgcctggttctgttggaagccgcaagtcccacccacgaacacgacgagctcaagagaagcttggcagcttgctgcttgtgtcaacgacgagcttgagagaagccgcgagtctgggtga

SEQ ID NO: 75465 - DNA, 474 bp, Glycine max
  Peptide Sequence Number=SeqID_192243
atgagcgcccacgtggcccagtcctacggagttcccgtcactcccagtaaagtaatccgaccgatcacccggcccttcatcgagaagtactgcacgcctaggcaggcgcagggtgatgcacatcaggccgcagacgcactgccaccacctcggcaaaccgatccagctgggtcactgggcgtggagcattatctacagcatttggttcaccagcaggccgccaaccaccgtgggcaggtgcagatacatgagtgtctctaccgattcagcctcagtcagcaggggcagggttccgccttttttgcatgccctactccagagcagtttggggctgaggtcgcatggcctggagactggctcgatgcccaggcaggggaggagcctgcaggatcccccggtgagccagatgagtcccatatggatgaagatatgactgacttgctcggtttcttgggagggagcggagccacgtga

SEQ ID NO: 75466 - DNA, 231 bp, Glycine max
  Peptide Sequence Number=SeqID_192244
atgacattatccatgctgacaacatctgcacgtagacaatgggtagatgcagctgttgttgaggaagatgaccttgttgatcatcatgctgacaaggttcatgaggagcctcaggagctagttactgatggtgtagaacgtcctgagttgaagttggcctctcatgggaggaagatagagaaatttggaaggcttatacctgagattgaaggcataatggctgctacatga

SEQ ID NO: 75467 - DNA, 307 bp, Glycine max
  Peptide Sequence Number=SeqID_192245
atgaagaacggtggaaaaccttcacgaaatcgcccacggaaacgtctcggaagccttgcttgtggagcttctatggaggctggatctttgagcttcaatgaggaagaaggagcttcaccaccaagaattgccttggataagaagcttgaagaggatgctttaatggaggaaaagaaagagagaaggggggagcacgaaattgaaggaataaaagaaggaaagaagtggaactttgaagtgtatctcataagactttcattcatcaaagttacaacaagtgttacacatgcttctatttatagactag

SEQ ID NO: 75468 - DNA, 243 bp, Glycine max
  Peptide Sequence Number=SeqID_192246
atggcttcatatgttgttgaggcccaagcaactgtggaagagctgaaattgattttagaggatggttcgtggaaaagactttttgattggcactttgcctggaaaaagcttctcaagcactttgagttgggctctgtagatagaaaaagtggagggtgtaagagccttggtgaggatgttcgcacactaatcaacagtaggaatgtgaaccactcaaaccagattagtgagcaccttttctag

SEQ ID NO: 75469 - DNA, 720 bp, Glycine max
  Peptide Sequence Number=SeqID_192247
atggctgaattcacagaaaatttgcaaagaattggaccctcctcatttccattcttggacattgatccaagcatggaactcctaaaccaattcatagggatgaaccaattatatgttctagacaactcaaacttgatgccttatttctcctttgacaccttcttattgggcccccaagaacctgagtttccaggaaacttggaagaagattttccttttctcttcaatcatgtcaaccacaataatgcacttcctatttccctccccattttccaagcagaaaatgagatccatgaaggtaaaaagaggaaatcaatggatcttcctgagaccagttcagtaaactcaactcctaaagtttctgagagtggaaacaagttcaaacatagttctggaagaggaaagagagtgaaaaacaatgtaacagaagaggagaaggcaaaggaagtggttaatgtcagggctagaagtggtcaagctactgatagtcgcaatttagcagaaagggtcagaagagggaaaatcaatgagaaattgaggtacttacagaatattgttccagggtgttacaagacaatgggtatggcagtaatgttggatgaaatcataaactatgtgcagtccttgcagaatcaagtagagttcctttctttgaagcttactgcaccaagtaccttttatgacttcaattccgagatagatgctttggaaacaatgcag

SEQ ID NO: 75470 - DNA, 897 bp, Glycine max
  Peptide Sequence Number=SeqID_192248
atggcgcttgcgggattggctggattgtcctccgtagaaaaatctgcccacaatggtgttgatcaaccctcttatttgctacgtgggtttatgttcttgtggagtcttggtgcttcgttctctcttgtcgagcttttgttcggcttgtctaaatttgttcctgaatatggacatttcttccatctagatgtagcccttgtcttgttcatgcaactcgtccattctactagggatttggacaacaatgtgtgcaaacctatccatgaatttgtggagaaattcatcatttgcttatcgcagactgctattgatggaccttggaggaagtccaccgtactaagtcaatgtcacacctttgagggacattgggaagacacgccacaagattgcattgtcattggtgtacaagtttgcttggggtatgttagcttccatgatgtggtcgacgaaggggtgtcaatgagtagtccaccctgtaggacggtggatgtgggagagacttggatcatcttgattgttgactatgcgtgggtatctgtcatggttgttggtggaggattggagctttcgaaaaaggtctcgcgtctgaggctagaccaagtgctaaccatgggtgagagagaaagaggtaatatgatactgcgaggtatgttttaccacgaccccacggtggacgccaaatgtacttaccaaaatccaaagttggcacacgttagggtggacgtggcaaaggctgaaggggggacctgcaaagcaaagggctctgacactcaaggagtacaagggaacctggtacttataggagtgagtggaagttgtgagtatttgtttataggagttgttacagcctttgtagataattatcaacttgtagatacagttagagataatgcatag

SEQ ID NO: 75471 - DNA, 234 bp, Glycine max
  Peptide Sequence Number=SeqID_192249
atggcgttttggagatccctcgcgttctctgccctccttctctcgctcttcgtccatggcgctctctgcttctacctccccggcgtcgctccacaggacttccagaaggttcgctccatcttcatttccatttccatttccatttcacgcgaatgtgttttcttaggtgataatgtagcaaaggttacggtattggtctctggagattattgttgccgtgtcttttatgcgtag

SEQ ID NO: 75472 - DNA, 690 bp, Glycine max
  Peptide Sequence Number=SeqID_192250
atgactacctttggtcaaggcccgctctccaggagcttcacaatcaggtatctaatcgctgatgcaaatacctcttactttgctttgattcgcaagaagacgctcaacgagctcagagccatcgtctctataccgcatctgaagatgaggttccccaccttgacaggagagatcatgactgtcaagacagatcaaaagcaagcacgactatgctacatagaaatcctgaagatgacaccttatcctcccaccagggagtctgccaaacctcaccccacagcggatgctaccactcaggtcatgagcgtggacgaagggtctccagtccgagccctgattgtccatcaagcaagcctatacgacaaatttgatgtagatccgtatgatgacacttctgacagaggcccaaagtctatcgaagaactcgtcaagctacagcttggacctaaactcggggtgggccccaatgatgcataccctctgcccagcatcgataggctagtcgatgaagcgtccgaattccaggtgctaagcttcctggacacttactccggatacaaccagatcaggatgcacgctctagacgaggagaaaatgaaattcatcattgaaaatgccaaattttgctacaggggtatgccctttggcctaaaaaatgcaagcgctacataccaaagattgatggactga

SEQ ID NO: 75473 - DNA, 243 bp, Glycine max
  Peptide Sequence Number=SeqID_192251
atgggtgtcgccaaaacaatagcgagattgacaaagaacttctattggacaggaatcaggaaggatgtcgaacgatttattgcttcatgtgttgactgccaacacacgaaatatgagactaagaagatggttctcgaatggggattcacttgggtatgctacccactcatcacacttcttattctgtcgtcatcctgttcatggagattgtcggaaaactccatggaatgccgtgaagcttag

SEQ ID NO: 75474 - DNA, 777 bp, Glycine max
  Peptide Sequence Number=SeqID_192252
atggtgttcatcgtggcctggagtgaagaagaagaacaggggaggaaaaatggctcgtattgggtcaaatttggatttcaagggctagaacctctacaaggaagaagaatagaaaagcaaaaacatgccatagttgatgatttggatcggtttttgagaagaaaaaagatgtataagaaagttggtaagccttggaaacgtggctacctcttgtatgggcctaaagggacaggaaaatctagccttgttgtagctatggctaactatttgaagtttgatgtgtatgatttggagctaggttctttgtgttctaactcagacctcatgtgtgccttgagggacatgtctaaccattccattgttgtgattgaagacatagattgctacaaagaggttaacacaaagaggtttactctgtcgggtctacttaacatcatggatgacttgtggtcaagtggtggatacaagcaaattataatcttcactagcaaccatagagaaagaattgaccctgcattgctatgccttggtcgtaaggacatgcacattcacttgtccttcctcaaaggcaatgcatttcgaatccttgcttccaattatttaggaattgaaggacatcatccactttttgaacaaatcgaagggctattggagaaagtagaagtcacacctgcagtagtggcagagcaactaatgagaaatgaagatcctgatgttgctttggaagcacttgttaaatttctcaaagaaatggacaaggaaaaagcctgcatttag

SEQ ID NO: 75475 - DNA, 372 bp, Glycine max
  Peptide Sequence Number=SeqID_192253
atgcaccttcgcccagaaccaagtcaaatcctaggccatgtggtctcatcgcgagggatcgaaccagtgctgaccaaagttcaagacattcaacaatggcctcaccctcattttgcgggagccctgcgtagcttcttgggcctagcaggtttttatcacagattcattcgaaggtacgctatgattgtggcacccctgaataaattgctgaccatagaaccattcgaatggactttggaagctcagtcagccttcactcacctcaaggaggttctcactttggctccaatcattcacctgcctgatttcacacttctttttacggaggagaccgacgcatcgggtatagccatgggtgcggttctatcttaa

SEQ ID NO: 75476 - DNA, 1035 bp, Glycine max
  Peptide Sequence Number=SeqID_192254
atggaggtattaaatcgagttatcgaacagtatcatcgcacttttgttcataagaagccttcgtcttggggaaaatcattacactgggttgagtggtcatataacacgtcttggcactcgggttcgggagtttccccttacgaaatcacttttggcaaaaagcctttcaatttttcgcaatatttggctagcgcctctaacatcaaagttgttgatgaaatgctcattgatatagcaacagttttcgctgaaatcaagaagaaactggaaaattctcaaacaagtatgaagcactttgcagacaccaaacatagagatgtacagtttgtgattggagacttggttatagtcaaagtccatcctcaccgacagaccttcgtttcgggtcaatccactggatattccaagcttgcaaaaagattctatgggcccttccgggtcattgaaaggattgggccgacagcctacaaacttcaattgcctaaagaagctcgtatccacccagcatttcattgttctctactcaaacccttccatccaccacaccctggtgacatatcttccactgcaactctaccagtgctcactggtgatgatcaccttatcattcaacctctagctatcctgaacacgtgcaaaccatatgactccacactggaagtgcttttggatggcaaagggaatgatagcaatacagtgaaaccagaaacaaggccacaaaggaagagcaagaccccgacttacctcaaagattttgctggatgtgttaacttggttttctgccaacagtgcctactgccccctgtggaatggattttgatggttctttttgctgcttgcatggcatgggagatagtcttgggcagcttgggacttggttggtttggcgatcccaaaactggtatgagattattgagtgctgttcttagcagcatcatgaatgtggagaaggctgcatacacctcaaaccatgatgatgatgctgagggaaaagaggaagagaggtttttctgcatgtatgatgccatggactga

SEQ ID NO: 75477 - DNA, 533 bp, Glycine max
  Peptide Sequence Number=SeqID_192255
aatactacacctccaaaataatagctcatggcgacaccccgcaaggtgttgactggaatgggaaagatggccagattttgcgcttccaacaactggcaaaattaatcaatattaatggggaattctctattaatgatattgggtgcggatacggggcactttatgaatacttgctcgaacagaatttcgaatttgactatcacggcatagatatttcggaagcgatgatccaggccgcagagttacgatataaagaccaaatcaaagcaaactttatatgtgcaagcacccctaggaaagtggcagacttcggtgttgcaagtgggatatttaatgttcgtatggaaaattcagacactgagtggctatcttacatagaacaaacgctagatgtgttaaacaacaccagtaaagtaggtttcgcgtttaactgcctaaccgcctactcagataaggacaaaatgcgtgactatctttattacgctgatccttgcagtttttttgatctgtgtaaacaaaaatactctaggcat

SEQ ID NO: 75478 - DNA, 327 bp, Glycine max
  Peptide Sequence Number=SeqID_192256
atggagcagttacagcgcctggctgagactatcgcagaaacatacatccgtgaccgaatccgggaacatggcaacgcacagttcacccataacggtaaaaccggtgaggtgcgccgtgaattgctggcatcggggctggtggataactgcgtttatgctgcccgcagcagcggcaaggtcgattatgaacgtgaggcatacaccatgctgatggagatgatttctctggacggcaaggagtaccaggtgacaaaccgcggtctgaacgtgatcgaaagcatgcaccgcatcgcgctggataaaactgcgcctcgaatcagtcattaa

SEQ ID NO: 75479 - DNA, 564 bp, Glycine max
  Peptide Sequence Number=SeqID_192257
atgggggagacacatgaagcaccccgagaccatactctagctgactctgagcctcacctcggatattccactgaggggcaggcgtttggtggcatacccctgccaaacactttggggggccctcagtatcgcccacaacccttacattttgcggcagaaagactacctcctgccatggtggaaagggaaaaaattgatcatatagaagaaaggtcgaggcccattgaaggaggcagagattatacctttgctgacatggcaaaattgttcctagtgcctgacatgatcattcctctgaagttcaaggtgccggattttgataagtacaaggggactacttgccccaagaatcacctgaagatatactgcaggaaaatgggggcatacgcaaaagatgaaaaattgttggtgcatttcttccaggaaagtcttactagggtggccgtcacttggtacaccaatttggagtcttctcgggtccgttcctggaaagacctaatggttgccttcattaggcaatatcagtacaattctgatatgactccgaatagaatgcagctatag

SEQ ID NO: 75480 - DNA, 261 bp, Glycine max
  Peptide Sequence Number=SeqID_192258
atgggtcgctactcgaagatgatggtgttcacaacaatattgctattgggtttacaacaaatatgggcatttaggccattaaaagaggatcaatggttgaagcagaggctagtaatacaatcactacaaagaggctccgtgcaacattccgaaagaaatccatgctccaccgttcctggggggagtaatggacgctgcacttctgaaatcaacgttgtcgattatgttgctcatgcaccaccaccagaagatgcaaattag

SEQ ID NO: 75481 - DNA, 351 bp, Glycine max
  Peptide Sequence Number=SeqID_192259
atgggtatgacggcaatgttactatatgttggaacatgggtgagctttggccttataaattctggtttggagattttagctttcccctgcaatcaatttggtatgcaagaacctggatcaaatgaagatatcaagcagtttgcttgcactcgatataaatcagaatttccaaattttaataaggttgatgtcaatgaaccatttacaactccagtgtaccagtttctgaaatcaagtgctggaggctttctgggtgatcttataaagtggaattttgagaaattcttggttgataaaaatggtaaagttattgaaagatacccaccaacaatgtctccttttcaaattgag

SEQ ID NO: 75482 - DNA, 804 bp, Glycine max
  Peptide Sequence Number=SeqID_192260
atgacgaatatcttcttacacactgttaaagtcaacccaaatctcccatctcaaaacccagttccctcccatccccatgaaacggacacaatgggtgagaacgagaacgccaccgtcacaaccaagaagaaaaccagcaaaacccttctcaccctcctaacggaaccatttcaatggattcaaaagctctcgtcacagctaaacccaaccttcgtaatcggcgtgttcctaatctacggcataggccaaggcttctctggctcactcttcaaggtagtggcagactattactggaaagacgtgcaaaaaatccaacccttcacagtgcagctctacgtcggcttctacttcatcccgtgggtcctcaagcctctctggggaatcctcaccgacgcattccccgtccgcggctaccgccgccgaccgtattttattatctccggcgtgataggcgccgtctccgccgcggttattgctttcgccgggaacctcgccgccgtcgccgcgctgatgtgcttcgtcggcgtttcggcatcgctcgcgatcgcggatgtgacgattgacgcgtgcattgcgaggaacagcatcgaggtgagggagctcgcaccggacctgcagagcctctgcgggttctgctccggcgccggcgcgctcgtcggatacctcgcgagcgggttcttcgtgcaccgccttggaccccaggagtcgttgggtcttatggcgctttctccggctttgacaattgtgctgggttttgtgatttatgaaaacagaacaagtgggtcgcatattgaaaagaagcag

SEQ ID NO: 75483 - DNA, 840 bp, Glycine max
  Peptide Sequence Number=SeqID_192261
atgggcaccttttgtcaaggcaatactgctggtgctaagctaacaaatcttgagtttttgtatattgtggtcaatttattaagttctatggatctgaaaggattctttctgttattggctatggagctagcagttattgtggcgagaggaagagacaattcaatttcatgctatcctgttgttgaaactatacacagggacaacatatgtcacatagttaaggctccggctaatgtgaaatggaagactagggagcttgccactgaagttgctttcaatgctgttaactctctagaaggtgctggtgtgtttgcagttgaattgttcttgactaaggatgggcagattttattaaatgaagtggcgcctagacctcacaatagtgggcatcacacaattgaatcttgctatacctcacaatatgagcaacatttgcgggctgttgttggtcttccacttggtgatccatcactgaaaactccagctgctatcatgtacaatatattaggtgaagaagagggggatattggttttcaattagctcatcaattgatcaaaagggcattgaccatccctggggctactgttcattggtatgataagccagaaatgagaaagcaacggaagatgggccatataaccattgttgggccttcccttagcaatattgaaagcaatcttgctgtagtggtggaagggaaaagattagatgacaagactgcagcatctatcagtttacgaagcacgaacactcttcttgctttagatgttgtagtggaagacatgcttctaacatacctccccaacacctatgtgacattgttggacacttcttactag

SEQ ID NO: 75484 - DNA, 189 bp, Glycine max
  Peptide Sequence Number=SeqID_192262
atggagggctcattcatggtggtgttttccccatgtttaagtgatagtaacatcttaagaagttccataattatcaagctcttggggacatcaaaatgctcacaagaaagagcaaatcctcttgagtataaaaagaagaagcaagatgtgaatgtttttgggtatagacccacaaatgttcccttctaa

SEQ ID NO: 75485 - DNA, 576 bp, Glycine max
  Peptide Sequence Number=SeqID_192263
atgcttcacagtgcacgcctagtcttttcagggcacacctccatctcagcttttgccttcagaccttctaatccctctattaagacaacctcttcactcggtttctacatggaacagtctcctcctttaaagctaaaacagtgtgaccaaccccatcttgcttgtcaagcaacaacacaggatgatgcagtttctctaaggaatgatgagtcacctgttcatggactaactgaagtggttgttggggttctgggaggagggcaacttagtcgaatgatatgtcaagctgcttctcagatggccattaaagtcatggttttggatccacaggagaattgccctgctagttccctttcttatgatcatatggttggaagctttgatgacagcactacagtggaggaatttgccaagagatgtggagtattgactgttgaaattgaacatgtcgatgttgatacattggaaaaacttgagaaacaaggagttgactgtcagcccaaagcctctacagataagtatcagcaaaaggttcacttctcccagcatggcattccacttcctgaatttatgaag

SEQ ID NO: 75486 - DNA, 228 bp, Glycine max
  Peptide Sequence Number=SeqID_192264
atgggtaatgctcgtaagggtactggggcgagggttcagagcggatcgaagggtttttgtgaattgaaggagaaggaagagaaatttgaaaagagtttgaggaaaattggcggggaaggtaaggagaggagaggaagattgggaattagaggggtagcagaagcatcgcttgtgagggctgagaagggaatacaggtttggggctatccacaaaaagagggtatttag

SEQ ID NO: 75487 - DNA, 729 bp, Glycine max
  Peptide Sequence Number=SeqID_192265
ccacaagggtggaggttcgttcaagttgatgaggatgttgtgcctaatgagccccaaaaacaacgccgttggagaactctccatcacctgaactccaccgccaatgggtatagctctatcgtggggatttcgacaagcaacaacagcgataggtgggaaaggttcttggggcaggttaatatctccaagaacaacggtgtggagaaagtcattgaggacaaggaagtttgtcttggccttgacgccacaaagggagtgggtggcgccgtcctaggtgagggcggcctcctcgggagtattgaatgtgaccagccaaacacgtgccttcttccacgggtctcttatttttgcggcatagcatccctatggtcgcttcctaacccctttgtagcggtggtggcgatcgacggcgcggtcggcgacgatggcgttggctttgacagtgctggtggtgcagtggtgtctagccatgcaaccgtcactgttgatgaaatgttggagactctgcagcgcacaacacctgacaaggaagaagaagatgaagctatgataaatcacttgtctttcataattcagaatgttatgtcaaaagaattcgtgaaaaaagatattgaaactgaggagcaattgaatggacatggcgaaacatctaattctagtccaagcaaacccactgacactttcacaaaagccactttggatgattctagcaaacaagaaaattcataa

SEQ ID NO: 75488 - DNA, 369 bp, Glycine max
  Peptide Sequence Number=SeqID_192266
atggcgaccgtagctgctgttcctgctttaactgcaaacgattcccacaagaagaacagaattcaggtttccaacactaagaaacctcttttcttttacgtcaatctcgccaagaggtacatacagcagcacaatgaggttgagctttctgctcttggaatggctatagctaccgttgtcacaattgcagagattttgaagaacaatggacttgccactgagaagagtaaggcttcttcctcttttctgttactcacatctattgaaattgtgctggggaaatctgacaagtttgacaatctgatgtctcctcctgccccaactgaatcagaagaagcagcagctgatgatgatgacaaaaaagagtga

SEQ ID NO: 75489 - DNA, 2259 bp, Glycine max
  Peptide Sequence Number=SeqID_192267
atggccaaccacgatttgatactcggtcaaagtcacaatttagcacttggtcatgatcagcaattggtgctgggccatgaccataatttgggcctcagtcagaaccatgaattggaaatgggatcagcccatgagcaccatttagatctgggacaaactcatgatcatgaactaggcttggggcatgcccatgatgaattgggattagaacagaaccatgaacatgaaggtgatgatggtcacacttacgagcatgagcatgagcatgagctagccatggatcaaaagcccgaacatgatgaccacgacttgccccttcctggacaaaatcatgatttagtcctatcagagaacaatgatttgactgtttcagagaaccaagatcttgatgagaacacggccctgtctgtggttcagaactcagacatgggaattgattctgcaaatgatatggatgttcaacatccacagcttgtggctgtttctacaccccctataattcaggctcgtactgcaagtcctagttatgaattgtcagtggggcaagaattccctgatgtcaagagttgccgaagggctttgagggatacagcaattgctctgcactttgagatgcagactataaaatctgacaagacccgctttactgctaaatgtgctagtgaaggatgtccctggcgcattcatgcagctaagctcccaggggttccaacttttactattaggacaatccacgagaatcatacatgtggaggaatttctcatcttggccatcagcaagcttcagttcagtgggtcgctaactctgtggagcaaaggctgaaggagaaccctaattgcaagccaaaggaaatattggaagaaattcatagggttcatggtatcaccttatcgtacaaacaagcatggagaggcaaggagcgtatcatggctgcaatgcgtggatcttttgaagaaggttatcgcttgcttccacaatactgtgaacaggtgaaacgcactaatccaggcagtattgcatctgtttatggaaatcaagctgatggttgtttccaacgtctcttcatctcctttcaagcatctatatatggctttttaaatgctttccggccactgttggggcttgacagaacatatttaaagagcaagtatcttggaacattgcttcttgctactggatttgatggtgatggggctctctttcctctggcatttggagttgttgatgaggagaatgatgataattggatgtggtttctgtctgaacttcataacctgcttgagattcacactgaaaacatgctaaggcttactattttgtctgatagacagaagggaattgtggatggagtggaagcaagttttcccactgctttccatggattttgtatgcaacacttgagtgacagcttccgtaaggaatttaataacaccatgcttgtcaatcttctatgggaagctgctaatgctcttactgtaattgaatttgaagcaaagattttggagattgaagagatatcacaagatgctgcatattggattcgaagaattccacctcgcctctgggccactgcttattttgaggggcataggtttggtcatttgacagccaacatagttgaatctttaaacacttggatattggaggcatctggacttccaataattcaaatgatggaatgcattagaaggcagctaatgacttggtttaatgagcgccgggagaccagtatgcagtggacatcaatacttgtaccatctgccgagagacgtgtagccgaggctcttgatcgtgcacgcacatatcaggttcttcgtgccaatgatgctgagtttgaagtgatatctcacgaaggaacaaatatagttgatatcaggaaccgttgctgtctttgccgtggctggcagctctatggtttgccctgtgcacatgctgtggcagcacttctctcctgcaggcagaatgttcatagattcacagaaagctgtttcactgttgcaacttatcgcaagacgtactcacaaaccatacacccaattcctgataaatctctctggaaggagttgtctgagggggatgccaatgctagcaaagctacagaagttgttatcaatccacccaaatcactcaggccacctgggaggccaagaaagaagagagttcgtgcagaagaccgtggacgcgttaagcgagtggtgcattgtagtcgttgcaatcaaacaggccactttagaaccacatgtgcagctcccatctaa

SEQ ID NO: 75490 - DNA, 546 bp, Glycine max
  Peptide Sequence Number=SeqID_192268
atgaattgcagccaaatcgataactgttcttccagaggccatgaaatcaaatgctgtttagcaatctatcccaatctgttgaaagctagaaacactattcagcatactgaaccatatctggatagccttgatgattcattgcagcttactgaaccaacatttgggcaatgcaatcagctgaagagagaaaatgatcatatatttcaacgggacttatattcttgtgcttgtacaggcatatgtgcactgtatgaaaggaaactgaaggagttgaatccggctatcagaaatctctcttatgacattactgatctctacaacttcatagatggtcttgcggacatgagtgccctagtgtcatgtatcattgatagaagtgttggagaaataatgatttgtaaccctcctccttctgttctccttgctcccccatctgccctttttgggcctagagggtatgatagttcaattcacgcttacttgccgcatgatcgactgtggatcaagcaacgaacattccaacatttgaagaaattagcacactga

SEQ ID NO: 75491 - DNA, 351 bp, Glycine max
  Peptide Sequence Number=SeqID_192269
atgcagatggcggacagaggtagaggtggtggtcgtagaacatttaatcgtggtagaagatgtggttttagtttgggagctccaattaccaccaacccttcctcttcatccattcacatatcaacctcagagtcgatgatacatgtcgttgcacagactccaaacacacttcctacatctcaagaccaaccaaatcctacctttgtaagggagtcaattcccactacccctgttagagatgcttcaccttcagcaccagatgattctcttacacctgagtacccactggatccaaattgtgaacatattgttgatcagaggcctttcattcgtgcatataaaggagagtaa

SEQ ID NO: 75492 - DNA, 432 bp, Glycine max
  Peptide Sequence Number=SeqID_192270
atgagtaggaggggcgcggcggtcgctgcaaaaccagggcgcgagccgggcggagcggtcgtcggtgcagatcttggtggtagtagcaaatattcaaatgagaactttgaaggccgaagaggggaaaggttccatgtgaacggcacttgcacatggggaatcgggttaaaattcctgaaccgggacgtggcggctgacggcaacgttagggagtccggagacgtcggcgggggccccggaaagaagttatcttttctgtttaacagcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggtga

SEQ ID NO: 75493 - DNA, 618 bp, Glycine max
  Peptide Sequence Number=SeqID_192271
atgcgcagcgcgtgcacttccgcgtgcggtctcgccggcgcgcagatgatagccttcaccgacaatttcgccgtcgcgcacgataacgcagccgacgttcggattgggtgcggtggtaaaacgccccagccgcgccagttcgaaggcgcgcgccatataaagttcgtcgcgggcgatctcttcgccgaactcgcgcacgtcttcgaagctgcggtataccgacgcgaagcgaatgtaggcgaccttatccagctttttcagcgcgtccatcaccagattgcccaccagtttggtcggcacttcgcgttcgccggtggcgcgcagttgggatttgatatgattaagggcgttttccacgtcgtccgagcttaccgggcgcttttccagcgctttcagcatgccgcggcgcagtttgtcttcgttgaacggctcgcgcacctcatcgcttttaatcactcgcggcatcaccaactcagccacctcgaaggtggtgaagcgttcattgcacaccagacactggcggcgacggcgcacttgcgaaccgtcccccaccaggcgggaatcaatgactttggtatcaacggcggcgcagaaagggcaatgcataacacgtcctga

SEQ ID NO: 75494 - DNA, 147 bp, Glycine max
  Peptide Sequence Number=SeqID_192272
atgtataagcagaatcagaaggactttcccaggcttgtagtgaggttcaggattcaattattggcaaaaatcattcagctcaaaaagggtgcaaagggtacaattatcattcaagagattgatgcaaagatcattactcacagctag

SEQ ID NO: 75495 - DNA, 486 bp, Glycine max
  Peptide Sequence Number=SeqID_192273
atggcggtacccctatcccgcagaagctgttggcggtaccctctctccctctctcctagtcagcccctgtcaacccctatcccgccattggcactggcggttcaagcttcccgccagtgtcaatggcggcacccaccattgcctctggttcgtgggggtaccagcgttgaacacagcggtgaagatgaatctaccagcgtcgagcattgcgatggccggtggcggcaaacgaggtacgcagatggtggtttactgtcgcggacgtatggatgtctttcggatcaagttgatccgaaagctggagttgctgcacatgatgtccaacgttatgtcaaggaatcagattgggctgcacaatgcacaaggcaagataaaatgtcaaatgaagaattgaagctgcaggatccacgatgtcggatacgatgtccaggacatcctgcccgaaaatactggacacacaaatctgttatatctttaacagattaa

SEQ ID NO: 75496 - DNA, 309 bp, Glycine max
  Peptide Sequence Number=SeqID_192274
caacacattcttgccaaaagatgcttccacagctattaactcagagggctttgttctccttgatattaggccaacttgggagagagagaaggcacgtgtggcagggtctttgcatgtgccaatgtttgtggaggacactgataacagtccaataactctgcttaagaagtgggtgcattttgggtacattgggttgtggactggccagtacctcactactttgaattctgagttccttattcaagtggaaaattccattcctacaggtaaggagaccaagcttcttgtggcatgtggaggaggattaag

SEQ ID NO: 75497 - DNA, 483 bp, Glycine max
  Peptide Sequence Number=SeqID_192275
atggcggaaccatcaaagaagcgaaagggtgtttcgagtcaaagtcaacggcattccaagactcaggagacacagattccctcctccatttcctcttcctcattgttctcatccgaagaacaacggatacgatacacaaaccttttctcttctttttccattattgatccaaaattcattgatatggatttcttttccaatgagagttgtgaatgcattcaggcatttgaaaactccaatctcattcctttcatgtctttaaaatttcctatttacactgaattggttaaagccttctattataacctagaaattcaagaaggcactttgatttctgaagtttatgggattaaaatggtcattgaccaatccctattctatgacttgacccaattatctagtgaaggtgtaccatttgaagttggtttgcaccaaccaagcggatatgaccggaaggcttcttgccggttcattggattttga

SEQ ID NO: 75498 - DNA, 246 bp, Glycine max
  Peptide Sequence Number=SeqID_192276
atgagtttcttgggtttaggttttagtcttggtactgttccagtgtgccatggagcaaaacataaagtgttggataggagggtgaggataacaaagctggtgctaaggtgtgtgagccttggtcttggagttgttgcaattgttcttgtggtgactgattcccaagttaaagagtttttctccttccagaagaaagctaaatttacagacatgaaagctttaatttgcaagtggactaactgttag

SEQ ID NO: 75499 - DNA, 1125 bp, Glycine max
  Peptide Sequence Number=SeqID_192277
atgaaagaaatgaaaagagaaaaacatgcctcctatagtagtcataactcttgcaagagcctaagtgaagaacttcatgactattatgaaggaaggcataggtcacatcttagaccttactcccatagaagagaaaaggaaagaaagcctcaagaggctaacattaacctcccatacttccatgggaaggacaatgtagaggctaacttagattgggaaataagggtagagcaacaacttaaaaagaagtctacttcaaaatcttatggctctcactcgtatccaaagaaagaccaaggccaaggcatcctaggggtgacaccttctaagaccaaagatgataaggggaagacaatagaaaaacaaccccttaaggctagacacattacttctaaatgccccaccaagaaaaccatgattaggaggggccaagacatttatagtagtcaagatgaggctactacttcaccttcctctagtgaaagtgaagaagcaaaaggggaagaatctagtgaagaaatctacccccaggaagaaagacaacctttaatggttaaggaggagtgtaaggagataaatattaaagaaacttcccatcttagacaacctccacatcttctcctttttaaaaagacacttgttagcactgccacacctcttgggcttcaggttattcctcaagtaaaggagttgttggatgagtgtttggttcgtaagagcttaaatccttgtgctttgttggtgcccaaaataggtattattaggcaccaaatccctacaataagtgatatgatgaatgtgttgagtgttgcaaccctcttttgtaaaatcagtcatgcacccaatgtcttcatgattcatatacatagggactcattaggtaggaataatcaacataaaaatacagaaaaaggtacgcgttattgcattactttccttaattttttaaatagtgatcaaggggttcccacggatcctaagagaataaaggtcattcctgattggcccactccaccaagtgtcgagggaaggagcctagagtatgaagaacctcgggatttgaggtcaaatcctttccaaggtggaggggatgatgcaatcctaccccccaagggtattggatag

SEQ ID NO: 75500 - DNA, 222 bp, Glycine max
  Peptide Sequence Number=SeqID_192278
atgggatgttacaatcaagtggctttggagcatggcctcatattggtagacactaagtatgagtttgggaatattgatatattggtacctattgatattgatattggtaatattgataacatggatgaaactcattgtagcccgagaagggaatttgattctattgttgccattgtgtttgttattttcacttattttctggtcagctttactggttggtga

SEQ ID NO: 75501 - DNA, 183 bp, Glycine max
  Peptide Sequence Number=SeqID_192279
atgataagcaatactatgatcatagatttacttgttaacggtggagtatggagtggtggactaacctggggactgatgactcgagctgattatgtagaagcaagtgaaaaaacattatccttgtttgaatatgggcagccagatcattttttctcttgcactgggagttggagactaagataa

SEQ ID NO: 75502 - DNA, 336 bp, Glycine max
  Peptide Sequence Number=SeqID_192280
atgtggagccgcactggcggcacaatggaaagtggagacggaaaagatgcgagtgtaccagcaagcggcaagcccaacgttcgtattgacgaagcatttaaattcgcatcggaaggttttggaattgaggcggcagaagaagctgcagcgactcaacggttgaagaaaagggccatgcgtgtgggtttggagggtggtggtgaaggtattggtggcgtacgttggcacactacggtgattttggggttttgcaaattaggcatggcagttaggagtggtggtgtgtttggttcgaaggtgttggattgtcgtgtgattatgggggtgatgccatga

SEQ ID NO: 75503 - DNA, 354 bp, Glycine max
  Peptide Sequence Number=SeqID_192281
atggcatcgaagcgaagcgcgaagtcgaaaggattaggattgagcaccaaagctgcgaattctccatcttcctcaacgacgtcgtcttccatgcagtttctagaaacttccgtcgacggtctgagctcgccggcgtcgtcttccgctaggagcaagacgccgtattcgttttccgagagcgtgcctttggatgcgaaggagaacgtggccgtgacagtgcggtttcgtcctctgaatcccagggagattcgtcagggagaagagatagcgtggtatgctgatggagaaaccgtggtgcggaacgagtacaacccatccctagcgtatgcttatgatgatgatgtgaaactctaa

SEQ ID NO: 75504 - DNA, 585 bp, Glycine max
  Peptide Sequence Number=SeqID_192282
atgctctcgggaacggaagcttcgagcacactccagacatcttctcaaagatcccaacggtcagatcatggagcattgtcttgtgaagctgcagaccaaatttcgagaagatccaacggtgttacagttgtggtggcacgatcgacgggtggcagatttggcgctactaaaaaaacatttttttacaaagaacattcgaagatgattctcaaaaaccatcttggaaagtcagatggtggcaattatttgaagatgaggtttttcaatgaagacgatctgacatcgcaccctcttccatcaccacctcagcacccacctcttcctcttcctcccataatatcattctcaagcgcaaaaaatccatcaccacgtcatgaagaaaccactccttggtcgacgatgacgaggagttggtcattaggggttttagtcccaggaagagaaatgacttctgcgtatgcttcttcttttgagtgcaaggtttcgagatctagatctattgggtgtggcagcaatagcttctctagggacttcttcaactgcatctctattgggtttggagattgtactctcaggagggtatag

SEQ ID NO: 75505 - DNA, 675 bp, Glycine max
  Peptide Sequence Number=SeqID_192283
atggttatctcatccattggtgggaagcaatgcttcatgacttttattaatgatcactctaggaaggtatatgtatactttcaaaaacacaagtcagaagtatttgaggctttcaagatatggaaagccatggtagaaaatgagatagagttgaagattaaaaaacttagaaccaaaaatggtcgtgaatatgaagataacatatttaagaaattttgctatgagcacagaattcgaatggagaggatcatgccaactacacctcaacataatggtgtagctgagcatatgaaccaaactttaacagaaagagctagaagcttcaatgccttccaaggttattttgatgatgccaaagaatcaagagtcaagcaaattccaaagattcaagaattaagtgttcaagaatcaagattcaagaataatcaagatcaagattcaagactcaagattcaagaatcaatcaagataaagggtacatctacttgggttgttgtgactgagaacaagagagggtacatctcatgtggatcagttctagtggagggtacatccactaggttgttcaaagagaacaagggagggtacatcccttgtggatctttgcttgtaaaggactttacaaggttgaaaagaaatctcaaggaccgcaggtcgcttggggactggatgtag

SEQ ID NO: 75506 - DNA, 165 bp, Glycine max
  Peptide Sequence Number=SeqID_192284
atgatgcaaccaagcaatattgaagaggcaaagaaaagcgccagaaagaaatatactctacctctagaccgtgtctttggtcccacaactacaactcggcaggtctatgatgttgctgctcaacatattattagtggtgctatggagggcatcaatggtaattga

SEQ ID NO: 75507 - DNA, 264 bp, Glycine max
  Peptide Sequence Number=SeqID_192285
atgaacatcattttaggtcaaaacacagtgacacaaacattcaaagaatcgcgccagagacgtaccttaatcgcagtgactgagagtgaatggaaagacacacaagttgcagtgacaatcgcggtagagacgaagtcctttgcgcgcagcttcaatggtagtggtagcaagaagaaagaggaaaaaggagaaagggcaatgtgtttgagcacaaggagaaaggacaaaggagaaaggtctgagcgcgaggggcctaaattttaa

SEQ ID NO: 75508 - DNA, 2286 bp, Glycine max
  Peptide Sequence Number=SeqID_192286
atgttgggtccacaaatttcaacctactcagcagcaggagccatacaatattttccctggtggactatagagagtagtccatgtggtaaaaataatgaaggagaagcagtaacactgtctcaactgaacctcatcgatctggcaggttctgagagctcaagggctgaaacaactggcatgagaaggagagaaggatcttacatcaataaaagtcttctaactcttggaactgttatttcaaagttgactgaaggcagagctagtcacataccttatagggactccaaattgactagattacttcagtcttcgctcagtggtcatggacgtatatctctcatttgcacagtaacaccttcatctagtaatgctgaagagacacataatacattgaagtttgcccaccggacaaagcacattgaaatacaagcagcccagaacacaataattgatgaaaagtcacttatcaagaaataccaacatgagattcagtgcttaaaggaagaattggaacaaatgaagcggggtattgtctcagttcagccaaaagaaactggtgaagttgactttgtgcttctaaaacaaaagctagaagatggtcaagtcaagttgcaatcaagattggaagaagaagaagaagctaaagctgctttattaggaagaattcaacggttgactaagttaattttggtctccactaaagcgccacacacaactagattttctaaccgtcctggtcctcgtagaagacattcctttggggaagaagagttggcataccttccctacaaaaggagggatttaatctcagatgacgaaaaccctgatatgcatgttaatttagagggaaatactgaaacagctgatgattcttttaaggaggagaaaaagacaaagaaacatgggttactaaattggttgaagatacggaaacgagatactgggttaagtgccttgtcaggcaccagtgataaatcatgtggagcaaaatctgttagcaccccttctactcctcaagcagaaactgttaataatttggagtccagacattcccattctctacctgcacaaagctctccagcggatcttatatcagtggcaagagaggataaggaattttatgaggatagtttattgggacaagagacacctttgcttttgaaaaaaggtgccattttctatgtaagcattaaatcaattgatgagattgatcttttgagagagcaacaaaagattctgtcagaagaagttgctcttcattcaagtgctttgaagagattgtctcaggaagctgcaagaaatcctcagaatatatctgagagtttgcattttttgtggttaactcataccaaggtggagatggaaaggttgaaagatgaaattaagtctaagaaagagcaaatagatttgctggaaaggaaaattgctgattctttcattgccaaaaataagttggataaatcaggagtatcacttagtctcaccgagctgatgacacagttaaatgaaaaatcctttgaactggaggttaaaacagcagataaccatataattcaagaacagcttaatcagaagatccatgaatgtgaaagccttcaagaaacaattggctctctgaaacagcagctggcagacgcattagagttgagaaacttcagtcctcatcatttctctgtaaccaaagactaccatggtgaacctcaccttgacaaggaaagtgccatgataaccaataccaatgaaaagattcttttgcaagagcaggcaagcgagatagaagggatgaagcaaaagttggcggaactattggaatcaaaagaacaattagaacttcggaatcagaaactggcagaagagagttcatatgctaaagggctagcttcagctgctgcagtggagcttaaggctttgtcagaagaagttgccaaactcatgaaccagaatgagagattatcagctgagctggcagcaccaaagaattctcccgctcaacttagaaatagtggaactggaacagtccgaaatgcacgaagagaaagtcatgttagacgaaatgatcatcagggtgggtcaaactctgatatcaagagagaactcgcctcgagtaaagaaagggaactttcatacgaatctgctcttttagatagggatcataaagaagccgagcttcaaaggagaattgaagaatcaaagcaaagagaagcatacctggaaaatgagcttgccaacatgtgggttcttgtagcaaagctaaaaaagtcacagggagctgacactgatgtttga

SEQ ID NO: 75509 - DNA, 1122 bp, Glycine max
  Peptide Sequence Number=SeqID_192287
atggctgaagggtgcatgactgaaggggcatttcaagttcatgcccatgtgatcaaatgcggtttggtgtgtgatgtatttgttgggacgagtttgcttcacttttatggtacatttggttgggttgctgaggttgacaaggtctttaaggagattgaggaacctaatatagtgtcttggacttctttgatggttggttatgcttataatgggtgtgtaaaggaggttatgagtgtttattggagtttaaggcgtgatggggtgtactgtaatgaaaatgcaatggctacgattattaggtcttgtggggtgcttgtagataaaatgttgggttatcaggtgcttagtagtgtgatcaaatctggattggatactactgtgtctgtggaaaactcccttatttccatgtttggtaattgtgatagcatagaggaggcatcttgtgtgtttgatgacatgaaggaacatgcgttatactcatgcaaaaacagattatattactacttcagccttgttaccagtgtgtggctttgctcaaaatttgaggctggaaaatctgagggttttgatgaatacatgaatttggttcttgatgatgctgaagaagtgaacatcaagaagaagagcagaaaaacattagggggaaatgatgaacactccttgacagttgtaaactatgttcctatcaaacaaaaaggcatagctatctttcccttggggaattccaatgtgtatggattcctcgagccacagtccattcagagatctgggcaatcgcaatttgaattgaaaagttacatgaagagttggatgcagagttcaaaacgcgatgtctaccttggagcctacctgaatggcgaacactggcaaatggtcgtcattctgcttaaggaaaacctagttgtctggttttgttctttacataacaggccagacaactaccttaagggaataattaacagtgctttgaaaggacttgatgatactccacaacctaaatccaaggttgctgctaggtggcttattgttaagtgtaatagacaaaaagaaagcactgagtgtggctattacgtcatgcactggatgtccacgataatcttaggatctttcaggaataattag

SEQ ID NO: 75510 - DNA, 4347 bp, Glycine max
  Peptide Sequence Number=SeqID_192288
atggtgatttcttactctgattttgctaccaatccctctaatccatactacatgcatccgaatgagaatccttctcttattctcgttcaacctgtgcttgataacaaaaactaccagatctggtgcagatcgatgaaggtggctcttatctctaagaacaaggtcaaatttgttgatggcactctttcccctccccctatctctgatcctctctatgaaccctggcttcgttgtaataacctcgttccctcatggcttcaacgttcaatctctgaagaaatcgcgaaatctctcctttggtgtgattgcgcttctcttgtatggaaaagtttggagaatcggttctctcagggtgatatttttcgcgttgctgatattcaagaaggcgtagctcgtcttcaacaaggaactcttgacatctcttcgtatttcaccaaattgatgacactttgggaagaaattgagtattttcgtccaattcgtgattgtacttgtgctataccgtgttcttgtggtgctgctacagatttacgcaaattcaaggagcaagataaggtaatcaagttcttgaaaggtcttggtgatcaatattctcatgttcgcttgcagattatgctgatgtctccacttccaaccctagacaatgcgttcaatttgattcttcaacaagaacgccagttcaatcttccttcaaccactgattcttcaattgagaatcaatcgttggtgaatcacttctcccaaatgccttctcgtccttctaataattccgatcgtggtcgtggtcgtggatattcctccggtggtcgtggtaaccggctacgcactcactgtaatcgcaccaatcatactgttgagacttgcttcatcaagcacgggtatcctcctggttttcaacttcgtaagtccaattcctctagaaatgcctctgtggtgaactctgttcaagatgctggttctgctcacatttcctcatcatcatctgcttccacatcaacaaatggatcaagtgcttctttgtccacgattcaagagcaatatactcagattttacagctactccaacaatccaacttgcaatctacttcaccttcttcagttaattctgtttttgctacaaattctgtctctcatacctctccctctccttcatctggtaagaatctctcaaataataccagtcactggtggattgttgacaccggtgccactgatcacattactcatatctttgacagtttttcttccacatatcacattgcacccaaaactatgaccatgcctaatggtgacactgtcactaccacaatagctggttcagttttgttatataactcccttgttcttcataatgtttactactttccttcgtttcatgtcaatattatctctgttactactctatttgattccaccttatatgatgtgaaactctaccctaattgttgtaaaattgtgcagctacttcatcccaagatgactggatttacagctaggaggattggcaaattgtatgtgcttgacaccacctcacctctggttttctctcccacacctggttctgccaacacctccttctctcatgatcttgccaccatttggcattttagactaggacatttaagttctcatatacacaaatgtatttcatcttactttccctttgtcactttcaatgacaaccataaaccttgtaatacttgccatttggctaaacaaagaaatttatcttttgctcatagtactactaaatctgttgccatttttgatttaattcatactgatatatggggacctctttccacctcttccatatctggccataagtattttctaacacttgtagatgattacagcaggtttacttggacaattttcatgagaaataaaagtgaaaccagaactcacttagttaatttcattttcttcatagaaactcaattcaataagaaactcaaatgtattcgtagtgataatgggcctgagtttctcatgactagtttttacctttctaaaggtatcatccatcataggtcatgtgttgaaacacctcaacaaaatggcatcgtggaaagaaagcatcaacacattttgaatgtagcacgtgctctttcttttcactctcatctccctcataacctttggcacctctccatacaacaagctatccacattatcaacagacttcccacccctcttttgaacaacctcaccccttatcaaatgcttcattctactcctcccagccttcatcatttaagagtttttggatgtcttgcatactcctcgaccttacataacaatagaaccaaatttgcaccaagggcaagaaaatccatatttcttggatatagggaaggcaccaaaggctaccttctttatgatcctatcacccatgagttctatgtttcaaggaatgtaatcttccatgaaactgtctttccttttgcctcacctccacctgccaataattctgtcagtgtcaaccctgatattactaacttagacacatctgacattctcctagatattccactatccttacctccaccaaatgaacctacctcccctcctgcaccaaccagaaaatcacatagactaacaaaacctcctgcttatctctctgattaccactgcaatttgctatcctcaatgctgccagcatctaatccaagtaaatctccttaccctctttcttctgtactgttatatgacaaatgtagtctatgtcacaaacgtttttgtctgtccattagttcccttacagaacccaaaacttataaacaagcttgtaagtttgattgctggaatcttgctatgaaatctgagttagatgctcttgcatcctcaaacacttggtctattgttgatctgcctgaaggtaagcaaccaattggttgcaaatgggtttacaagatcaagcatcatgctgatggatccattgaacgatacaaggcccgtttggtggcaaagggatacactcaactagagggtgtggattattttgacactttttcaccagttgctaagcttaccacaattcgcacccttctatctgtggctgctattaaggactggcacttagaacaacttgacgtcaacaatgctttccttcatggtgatctgcatgaggaagtatatatggatctgcctcctgggttcttactgcctggttcttcttctaataaagtctgcaaattacataagtccttatatggactgaaacaggctagcagacagtggttctccaagttatccactgctcttatctcccttggatactcaccttcatctgctgaccattctttgttcacaaaactacataattctcatttcactgctcttctagtctatgttgacgatattgtcttgacaggtgatgatttgcaggaaatacaatctctcaaacaattccttgactccacattcaaaatcaaggaccttggcaagcttaaatactttcttggattggaaattgcaagatctactcaaggcatctttctcaatcaaaggaagtatgcattggaattgcttgaggacagtggtttattggctactaagcctagtacaactccctttgattgctccttgaagcttcatgacagtgactcacccccttatgaagatgaaacaacctataggagacttgttggcagacttttatatttaactacaaccaggcctgacattgctttcattgttcagcaacttagtcaattcatctctcagccattacaagttcatcactcagcagcaattagagtcctcaaatatctcaaaagtgctcctgccaagggattgttctattcttcctcctccacactcaaactctctggttttgctgactcagattgggcaagttgccctgctactcgcagatcagtgactggttactgtgtctttcttggcacatctatgttgtcttggaaatccaaaaagcagtccacagtatccaggtcaagttcagaagcaaaatatagagctttggctagcttaacttgtgaattacaatggctgcagtatttgttcaaggatcttcacatctctcttgatcaacctatctcagtctactgtgataataaaagtgctatctatcttgctcacaaccccatcttccatgagaggacaaaacatattgaaattgactgtcatgtcattcgtgagaaaatacaaactggcctcattcatctcctgccagtttcttctgctgcacaattggcagatgtacttaccaagccattgcctgctccctccttcaattcattgatttccaagcttggtctattagacattcatagtccaacttgtggggggctattacatgatgtaaatagtaactctagttag

SEQ ID NO: 75511 - DNA, 369 bp, Glycine max
  Peptide Sequence Number=SeqID_192289
ttacccgttgtgcgtctcaatgccttcaatctagcacagggctatccagagcgagaaggtgataatgtggcaaggaaccatggcatgcagcgtgacgatggtggcggtgaggggaacgaacatgcgtatgacgtctttatagcacttaaagacgaggaagaggaacagaattttgtggcactagaggaagtaatcggacttggcggcaaagtagttgaactagagggtctccgtgaaggtgaggttgcggcccaacgctgccgcgacctctgggatggaagcgtaggggagcatcatcaccggaaccctaggattgctggcagcgttggatgtgatgtgagagaggggaggggccaagggagcgtgtga

SEQ ID NO: 75512 - DNA, 474 bp, Glycine max
  Peptide Sequence Number=SeqID_192290
atggatgtaggtgaaggtggtggcagtataggtgggtggtgggataggataggggttggtagggtgttgggtgggaataacggtggtaggcagaggaggagctcgtcgattttggtggtcatggtgagctgttgttgggtgagtcgtatgagggcatcctcgagcttgtcggaggatcccgaagatgggcttgaatccagcatggcaatgaaagcaccaaagttgataggtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 75513 - DNA, 252 bp, Glycine max
  Peptide Sequence Number=SeqID_192291
atggataatcatccgctcccttcaccacttcattgggaaggactggctcccgaggagtccacatgggaacgttgggatgagttacgtcacactcacaaccttgaggacaaggttgctttcagggatgagagtgttgatagcaatgataggctagatgataaccagataacagggaacaatgtagtagctagcagcaataacaagccaaggagggtcattagaaaacccacatacctgcaggagtatatgtga

SEQ ID NO: 75514 - DNA, 525 bp, Glycine max
  Peptide Sequence Number=SeqID_192292
atggaaattgagaagcagatttcagccatgcttgatgctaacctcatacaacctagtcatagcccattatcatcacccattcttttagtgaaaaagaaagatgatgaactactggatgacctgggccaggcatcttggttttcaaagcttgacttacgtcaaggattccaccaaatcagaatggccaaggaagacatacataaactgcctttcgaactcaccagggtttacgagttcagggtcatgccttttggcctgtgtaacgcaccatcaacgttccaattggccatgaatgatactctccgccccttcttgagaaagtatgttgcaatattctttgatgacatacttgtctacaactcagacttggcctcacatgccacacacttggagtcggtgctagccaccttatctgactggcaatttcttctccgacaatcaaagtgcctattcgcacaaaaccagctcaattatttgggccatataatctcggccaaaggcatagccctatgtagaagaaaatga

SEQ ID NO: 75515 - DNA, 1364 bp, Glycine max
  Peptide Sequence Number=SeqID_192293
atgggatggatgcgtgaagactctggcaagagggccaacgagccttcattgactcctagaccttgcggaggaggcggcgttggagagtctcatgcatggccttctgagaaactagtaagtgatcaacggcctcgatggaagaagagccttgcaggtattgggcgaccatcaacgggggaaatgaaaccattaggagggaaactgatgaacgtatgcacgaaggtactgttccaaggtccgattaagtacctctgtttgaccattggtctgtgggtgagcaccgaaatgggcagccttggagtaacgatcaacgatgaccattactacggtgaacccatgggaggagggaaggcccactggacattaagccacgaatcaacaaacgtctgcttggataatgggccaatcgaagttctggcgcaggcgatgaagtgtcttggccacgccggcactttgattgtcggagaagaaattgccagtcagataaggtggctagcaccgactccaagtgtgtggcatgtgaggccaagtctgagttgtagacaagccaaaaggcatgaccctgaactcgtaaaccctggtgagttcgaaaggcagtttatgtatgtcttccttggccattctgatttggtggaatccttgacaacagtgtttatcggaggtggaatgggtgtgattgatgaaggggatgaagggggttgtggatggggtggagggggcgtttgcgctaagggtaatgtgttggcccatatgaacgaaagtcatggtcaacgtttggaacttggccacgcgcgactaaatgatgttatgcatgctgccgccgtccatgagaatgaccacttggtggtggctcagagacctaaggaggcggaaggggtgttaatcgtggaaccagtgtgtgaatcgagggccgagggacctgacgaagtggccatgcaaccacttctcatcgcaatgatagcaaagcccttgatcacggcggatcgccatttcctctatcaggaacggtttccgcagcggcgatccaacattttgtcttcctgtaatcgtgcgagcttagtcgcctgggagctccctgtggatcgtcataatatgacggagcgaatcgctattctagcgcctgcaacatcgccgctcaggaagggaaaaatccatttcgagccatccactggtggcggaccgggggatgaggacggagactgtgtaggtgctgctatggtggcgaatcgctcgacgagggaatcaaattttgtagtaagcgagcctctttcgagtttatcggtagtaacttggcgagtgtggtgttcaggcatggtggatgtggtggttgtaaccattgcagttgaaggtggtggtggtggtag

SEQ ID NO: 75516 - DNA, 1080 bp, Glycine max
  Peptide Sequence Number=SeqID_192294
atgattctctcggtcccatgtttatcctttctaaaggaattacgatcccagctagacgtttatgcggactacggccaactccgtcgtgacattttggatgatcctaccaaacatcctgggttctctctcgcacagaaccttattcttcacaagggtcgcatctgggttcctcgcgatttgccaatcattgccactctcctccaggagtatcatgccactcctattggcggccatgggaatacgactgcccttgtggtggtggaccatttctcgaagggaatacatttgggaatgctacccatttctcacactgctcacatggtcgcttcattattcatgaacacggtggtgaaacttcacggctttccccagagcatagttttcgatcgagatcctttgttcattagccacttctggcaagaactcttccgcttgagtggcactctgatgcaaatgagctcggcataccatcctcagagtgatggtcaaaccgaggccgggaacttagggaaaattcctcccttggatggaatggtttcacaattcctcgtggtccgtgagcacagtgcaagaattgttggtggacagagacgcgacgttccaaaccatacgtcagaagcttctgaaggctcaagatacaatgaaaaagacaagctgttttatggctcattcagagtgatagaacgcattggggcggcggcttatcggctccagttaccagacggtgctaagatacattcagtcttccattgctctctgcttaagccattcaagggttcaccaacacaatctgaaattgcatccttaccagcacaattcattaatggacaacctatgatttctcctctcgctatcctcaatgatcataaggttccaggatcaacaccagactcctgggaagttctcgttcaatggcaaggtatgtcaccagataagacctcttgggatgattggactcaactatgccaagcatatcaccttgaggacaaggtgaatttccaagggccggggaatgatacgagcaagctcataattccagaaatagaggaagcaccagcaacaaaagtgcaaagagaataa

SEQ ID NO: 75517 - DNA, 117 bp, Glycine max
  Peptide Sequence Number=SeqID_192295
atggtgcaaagcaacttcaattttcaatggattagttatttggatcttgtaaaaggattagaccaagctagtttgcgattatacgaagcgacaatggatgcagttagtgtgacatga

SEQ ID NO: 75518 - DNA, 845 bp, Glycine max
  Peptide Sequence Number=SeqID_192296
atgccatcctgcgcctgcgccgccggtgcggtgaacagtggggcgcggccagcagcagcgccccgaacaggaataccttgcgcatcagcggtcgtaggtcatgcgctggccggccggttcacccaccagtttgctgccgtcccacaccaattggccgttgacccaggtcgaggccacgcgcgaacggaaggtggtgccttcgaacggcgaccagccgcacttggacagcacgtcctcgcgcttgacggtgaatggcacgtcttccaccagcaccaggtcggcgaagtagccttcgcgcaggaagccgcgttcttccacgtcgaacagctgtgccggcgcatgcgcgaatttctgcaccacctgctcgcgggtcagcttcccttcgtgcacgcgctccagcgcggccaccagcgcgtactgcaccagcggcaggcccgacggcgcctgcgcgtagggcttctgcttctcttcccaggtgtgcggggcgtggtcggtggccagcacgtccagcacgtcgtcggccagcgcagcggtgattgcttcgcggtcggacacttccttgatcgccgggttgcacttgatcaggttgcccttggtcgcatagtcggggcgcgcgaagtgcaggaagtgcacgcaggtttcggcagtgatctgcttgcggctgccgtcggcgcggatcagtggacccttttcgaacagcgccagctcgtcggcggtggagatgtgcagtacatgcaggcgggtgccgtgcttgcgcgccagcgacatcgccaggcgggtcgacttgatgcagggcctcgcgcgaacggatatccggatgcatgtccggggtcagcctcgtcgcc

SEQ ID NO: 75519 - DNA, 297 bp, Glycine max
  Peptide Sequence Number=SeqID_192297
atggatctcctagaacaatttagaaaccttagccttgcatgtgaggttacccctaataatttagaagctatagagttaggaagagataatagtttcaatgttggatcgaatagagccttgcgacttcaagataggatttgtgttcctaatgtgcctgaacttaggaagatgatcttggaggaaggacataggagtaacctgagcatccatcctagtgctaccaagatgtatcaggatttgaagatgatgttttggtggccaaacatgaagagagaggactacctaggacccccagag

SEQ ID NO: 75520 - DNA, 1068 bp, Glycine max
  Peptide Sequence Number=SeqID_192298
atgtctgcaactgcggaagaatccaaacaatatcttttcctggctgaccgtctggatgagggggagatcacagtcaaaggaaatgggtatgagacagcaggtggtacaatgtatgcattgaacaataaggcagtaacatttaaatataatcggggcgaccctggtaacgctgaggctcaggatcaccttatcgcctataatatcgggcgttcgttgaccacaccaggtacagcgtactgggtaaatattgccgataatcgtgtagacaagaccttggaagtcgatcaaaaactaatttacgtagacggtaagcatattgaaaattactttggatggccctatgcgatgtttgaatttggtgataaaatctatgcacctctctctccagcatatgggggaaccggtactcaggacaaagctgattataaggaccatgcgttcgtggctatttttgataagaacttaaaatttgaaaaaacaatagaagacaaacgcatgccttttattggacaatattataataccattggattgggacaggtatctactggcgatatttatgctttttcaaatggagatgtagagtccagtaacaaccactctgcatttctgaaaattaaaaatgatgcttttgataaggattattattgggatgttgaagcggtggcgaacatgcgaattagagcaggtttctttattaaagataataagtttgtgttggttatggtaccacgggatacgaaacaagctgaagcaagcggagtaaaactggctattgccgatgtggttaaaaaggaattcaaatggatttcgggcgttgacactaaaatcaccgacccaggctatgggttcccgctctttacaacagatggtaaatcctacctacctatgcaggaaggacagtcatcaatatcctacttatacgtaattgatgcggataattatacggctaaacgtggacttaaacttaccggtattaaagatatcacaggtgtaggaaaccaggagctggtcaccgataaacttgctcaatgtcaatttgtttactccattgacaagcactgttaa

SEQ ID NO: 75521 - DNA, 518 bp, Glycine max
  Peptide Sequence Number=SeqID_192299
atgcggcgaaggcatgtagcggcatacgtagggaatggaagcaccttagtcgggtttgatctcgttccgcaagaggcgtgcaaacatgcgcatgctgaaggttcgggcgcaacccttctctaccgcatttatggcccaaagccaatacaaaggatttcggttccatcttgctcgaatcttactgtaccccagaggaaaaggggattttgtgctgtgaaggttctgaaatgcagactcctcactacggggtcggatgaagggattcgaaagacagcatggatcggggagaggagggagaaaggtgaatccgctcatgatgcgtggaaagtaggggaagagtctgattcaaaaccgtctgcgatagatcacgctcatcaaatgcaaacatggctcttgttggccttggcccggccgtcaactgcttcaactgcagatgcggctgacctagatctagatgtcccatcaatagcgaaggaagtggctgaactcgttctttgggacttggactctgactttcc

SEQ ID NO: 75522 - DNA, 498 bp, Glycine max
  Peptide Sequence Number=SeqID_192300
atggttgggggtccgcccaagctttctcgatcaatagacaaatttaccctctccccgatccatgctgtctttcgaatcccttcatccgaccccgtagtgaggagtctgcatttcagaacctgcagctatctccaaaccaagccctcgaaagattctagtggttacagaatcctccagcggggaaaggaaggcggggtaaacggaatgaagtacatagagcctcatgatagtccttatccgtgtgtaccgatcccaccttcacagcacaaaatccccttttcctctgggaaatggcatggaagcgaacgaactaggaaagcagcatggaaagcgaggctcgtagcacccccgcggagcggtaagggacgggactcttataccccgactaaggtgcttccattccctacgtatgccgctacatgccttcgccgcatcctctcatgcccggtccagaacgtcacatcttaccatgattggtgggaacgcggtttctcatga

SEQ ID NO: 75523 - DNA, 285 bp, Glycine max
  Peptide Sequence Number=SeqID_192301
atgcttgtgcattgctggttatgggaaagagttttctgcctctactctgttttcttggttgagggtagtttcatgatagttggaattgaatttcttggatattgtggaagcttggaggggttgatgggacccggtgctgagaggaacgaggataagggctacgtagagtggtacctagagatgtgtcgtggaggtcaggagaccttggggacgttaggtggggtgctattgcccaaaaccaagcttgaccaatcccgacccaacccgggcatagtcagtcagtga

SEQ ID NO: 75524 - DNA, 324 bp, Glycine max
  Peptide Sequence Number=SeqID_192302
atggaggacgagtcatctgaggccaccatcccagagccatttgatataggagaagaggcagaggagacacagctgagacaggtagctgctaccactcctgagcaatcccttgaggctacttcagagccttctgcaccagtggtaaacccaccctcacctcagccagcatcacacccctccactcctcttctacagattctagagtatccaactacaccagtcctagctgtggacacttctcctcctactactccagttcttcagttgacagatgaggaggatggtcaaacacagaagacacaggaccaatcacaggaattttaa

SEQ ID NO: 75525 - DNA, 378 bp, Glycine max
  Peptide Sequence Number=SeqID_192303
atgcacagcctgcgggagttggctcaaaacaggccaattgtacctctagagtattttcttgagaaagtagcctggcctgaagctcaacttccattggtgagaaccaatgaggctgctccttcgaggcctgcactggcacaggttgaaccaatgccagccgagccacgaactccagtggtgaatccacctctttctcttgagcttgaagtagttcccccatctccacctctgattatcatctctgatgcatcatcagatgaagctgctacccctcctgaagaaacagttgacccccctgcttccccagttggaggaattgatgatctttctgattcgtcatcgggagaagttgttgctctcactgattccccagtgtag

SEQ ID NO: 75526 - DNA, 780 bp, Glycine max
  Peptide Sequence Number=SeqID_192304
atggaattcgaggatcaagaggagcaggaggaggagctgtgtatgggtggcggcggagcgggttacgacccgacccggatgaaggttccggtagcggcggagccggtaaggagcaccaacggcggcggcggaagggcgaggtacagggagtgtttgaagaaccacgccgttgggatcggaggccacgcgcttgacggttgcggcgagtttatggcggcggggatggagggcacccttgacgcgttgaaatgcgccgcgtgcagctgccaccgcaactttcaccgtaaggaggcggattcctccgccgtggtcgccttctccggcggggacccgtatttaattccccaccaccacccgccgccgcagtttgcggcgtactaccgtcatccggcggggtatctccacgtggcgggacagcagcaccgttcggcggtgggggggacgctggcgctgccgtcgacgtccggcggcggcggaactcagagcacgcgtgaggaccaggaagacatttcgaacaatccgagtgcaggaggaacagggtccaagaaacggttcagaacaaaattcactgtggagcaaaaggagaaaatgcttgaacttgctgaaaaactagggtggaggattcagaaacaggacgaggctgtggtccaagccttctgcaacgaaaccggtgtcaagcgtcacgttctcaaggtttggatgcataacaacaagcacaccctcgtttgttacaacggtggtgtagtgacgcgtttggaaccttttttttcgggtggatga

SEQ ID NO: 75527 - DNA, 468 bp, Glycine max
  Peptide Sequence Number=SeqID_192305
atggctacttggtgccggaaatgcatctatttgaagcccaaagtcaaattttatttcgtggatgtgaataaagtacctcagactctagtcaagcgtggcaacatatctgttacaacatccgcagccaccaccgatgtagaaaatcaaggttactacatcggtgcctacctagccaacgatgtagaaaatccatgttacaacatcggtacctcagctaccaccgttgtagaaaatccaggttactacatcggtgcctacctagccaatgatgtagaaaatacaggttacaacatcggtgccttagctaccaccgttgtagaaactactacatcggtgaattactacccgttgttgaaaaatatggaacatgccaccgctgtatcaaaaggtagacctactccagcattaagtggaagtgcatatatccgatctttaaacatggaagatttcaaatatgctcatcaatag

SEQ ID NO: 75528 - DNA, 537 bp, Glycine max
  Peptide Sequence Number=SeqID_192306
atgttcggccacgtcggcggctgcagcatcgccagagctggtgacggcacagaagaaacaaccatcgtagggtcaacggtggcaagtgctagaggagttgcggaagaacccacgcgccaaagacaaagcgggtgcacgtcggcaaggaacccatgttccatgtggaaagcgaacggatttcgggtacgagaaagacttcgagaatgggttttggtgctggagattgtttcatgcattcctgaatcaatccttgaattttggtggcagatggttctccccattacggttgaggatgttaagcgagaagtcaagatattgaaagaacttattggccatgaaaatgtggttaagttttttaatgcttttgagcatgattcatatgtgtacatagttatggagttatgtgagggtggagaactgctagatcagatattggccaaaacttactctgccttcacacttatcaggaaggatagttgttatactgaaaaaagatgtagttgtggttgtaaggcagatgctacaggttgcgactga

SEQ ID NO: 75529 - DNA, 444 bp, Glycine max
  Peptide Sequence Number=SeqID_192307
atggccatcgaaaccctagaagacaccaagcctcccctccaggacgacgaccatgaaaaattggagattcctaagaaaagaagagatcaacgaaaacaaagaggagaaagacgatgtcaaagacaaagaattgaagaagaagaggaagacaaagcagaagagaaagagaaagagaagggtaagggtaagaagagtaagaaagatccagttacgtcgacgctgagtgaaaggcccacgagggagaggaatacgatgaagtgcttctctgtgccctcgccgaccaagtctgcaaggtcctccactagtaaaggtttgataattgaaaaggatcgaaatagtgaagtgcttcaacgtcactactacaaaaatggtcttctacgatgctggttttacaacaactctaacaaaaccgatgtcgtgagtaaagcggtggcatttttgtaa

SEQ ID NO: 75530 - DNA, 360 bp, Glycine max
  Peptide Sequence Number=SeqID_192308
atggaacatgggttccttgccgacgtgcacccgctttgtctttggcgcgtgggttcttccgcaactcctctagcacttgccaccgttgaccctacgatggttgtttcttctgtgccgtcaccagctctggcgatgctgcagccgccgaccgttgttgttgcaactggagttgctgaccttggtggcagagaaacaaaggcagcagggacgacgaagaagggaagaaggaagaaggagtggttggagagagtgagggagaggtgggtgcctttgatgggatcagggacaaagtggatggtgagggagcgggtgtctagggagaaggggtcggtgtgggggtttagagacgaatgggaatga

SEQ ID NO: 75531 - DNA, 720 bp, Glycine max
  Peptide Sequence Number=SeqID_192309
atgggtcatgaaggagaatacaccgaggcagatatcctagatttatcagcagagaattgccaagatttggaatttgacagcagtacttggctcagttcaacgctggactcacaaaaacagaaaactgaaaacggtaaacgggactgccattacgtgaagaacaattggaacatcctcgcagttcctatttcggcagaggagctgaagatacgaagtgagctaggaatgcagattgagagggacttagaagaagagatcaaggagggtatataccaccttgctcttcggttgcaccggatttaccagcagaagaaggaaagaagtgcaaaagaagcatgtgaactctacaataaacaagctagggcagtttctgaagtgaacataagcataagaatggaaggagcaactaaagttgaaattaaagagatcaacaaagaagcagctgaaaaggattcacggaattctagaccacaaaatgtgaaggaagtgaagaaggttgattgggtgaagaccctcagagcaggttcaagccctgtttgtgctacaagatcatcatgtgtcagctcaaagaataagaataaaaagttaggcactgaccctaatgttttctccaactggaaaattcatggtgggaggggaaagaatgctggttctaccgagctagtaaaacggaatgcaagtgtggacaagaagatacttcaattggtgtggaaggtttga

SEQ ID NO: 75532 - DNA, 531 bp, Glycine max
  Peptide Sequence Number=SeqID_192310
atgtcgccggtgatcactcttcattgcttaacaacttcttctacccgttgctcctacggtttcaataactccaattctcgtttcaatgcattggtggaacctaccagaggctctagcgtctttgccaaggttaagagccaaagctctgcttccaagttcaacaacaatcctgattggaaaaccaagttcaaggacgactctgaagaccgtttcagactcccccatgtcactgatatcttccctgatgctgtttccatgccctctacgttctctcccaatatgagaactcctaggactagtgactttcctggttatcctttggacgaggattggtatggatatattaatgacaatgacagagtgcttcttaaggtatttagtttgattgatgttattaccgttgatactgtttcccgtgaatctttgttgcattcatgtttcaaattgcggttgcgattgcgaatgtcgccactgcaattgcggcagttgcgatgcttattgcggccattgcagtgtgaatttattttataa

SEQ ID NO: 75533 - DNA, 726 bp, Glycine max
  Peptide Sequence Number=SeqID_192311
atgtgggtattgcaccctatcattgattatgctttaagggcaacccaaccagtgccttgtttattccttccacgccccatatcagcactgtccattgctggcatatataaatttcacatatttgatgctgctagtgcaattaagcaccaactatacaacatgggtcatgaaggagagtaccccagggcagatatcctagatttatcagcagagaattgccaagatttttacagcagtacttggctcagttcaacgctggactcacaaaaggagaaaactgaaaaccgcaaaagggagagcgattacgtgaagaagaagaactgtaacatcctcgcagttccgatttcggaagaggagctgaagatacgaagtgagctaggaatggagattgaaagagacttagaagaagagatcaaggaaggtatttaccaccttgctcttcggttgcaccggatttaccaggagaggaaggaaagaagtacaaaagaagcatgtgagcttgacaatgattaccaagctagagcagtttctgaagtgaacataagcataagaatggaaggagcaactaaagttgaaattaaagaaatcaacaaagaagaagctgaaaagggttgtgcttattcacggaattctaggccacaaaatgtgaaggaagtgaagaaggttgattgggtgaaaaccctgagagcaggttcaagtcctgtttgtgctagaagatcatcatgt

SEQ ID NO: 75534 - DNA, 162 bp, Glycine max
  Peptide Sequence Number=SeqID_192312
atggctttctcaaatggagcattgatgctcacaaacatggatggtgaaaagcttccttcgcctgtgaattctgatgacatcaaaatatgcatgtacgtcatttacttgtttgctcatgtgacctatgctccggagttgatctccaagtatgcccaatcttaa

SEQ ID NO: 75535 - DNA, 456 bp, Glycine max
  Peptide Sequence Number=SeqID_192313
atgaaggccgataaggaggtcatgaagaggcatacgacaatgatgatggaagcaatgatgagcataaacaagatgatgaaggagttgtgtgaggatttcaagatccaacaccatgattcgacaccttataggtccaagatgaaaggtgcagttaaggatgccaataagaatatcaagaagatcattcaaaagatgataatgacatacaaagattggcatgaaatgttgtcattcgcatggcacgattatcaaaattctaggcgcacttttactggggcaaccctatttttgttggtgtgcaggatggaagttgtcctctttttcgaagtagagattccttatttgaaggttctatcggaagcgaaggtggaggaggtggaatgggcccaggtgttttttgattggttgaatcttattgagggaaaaatactggatgctatgagtcatgggcagtaa

SEQ ID NO: 75536 - DNA, 225 bp, Glycine max
  Peptide Sequence Number=SeqID_192314
atgttgttgtactcactattgaaagtgatagataaaaatgtaggaaggaagataatgagttgcggcttgtaccctgttgataaattacaattgtgttgttttggtgatgttgctcatcctgcatggcaatcagtgggtcatgagatggcctatgcaacttctgaaggcatcatggtgcccattgaagtcaaacaacttatggtgggctcttgtgggcaaggctga

SEQ ID NO: 75537 - DNA, 402 bp, Glycine max
  Peptide Sequence Number=SeqID_192315
atgaccaaacatcttaagcctttgtatgtcaaagctcaaataaatggcaaaacattggctagaatttttgtggatgagggtgttattcttaacatcatgcctctaaccactttaaagaaacttggtaaaagcttattcagtttttctaagaaggaattgaattcattccaaccaatgtgtaccttctacattgcatcaacaattgatgttttggaaaggggaccaaataggatatccgaatcagctatagccgagaaatataaaagtcagatcattgaggtaatcacaaagtataaggattttttgcctgggattatcatgaaatgccaggatctccgagagatttggtggagcatacataaccaattagagaaggatttaagccacattagaagcctctaa

SEQ ID NO: 75538 - DNA, 507 bp, Glycine max
  Peptide Sequence Number=SeqID_192316
atggcaccactggtgcaaggtctagttgcacgaggtggccacggggccggcgacgacacgacaatgtcgatggaggagggcccacaagtgcgaagctaccataggatagcggcaaatggtggtggcgacatggatagagacaccgcggccaagttgattttcaccaaaggtgaactgaaggaggttagtgaggaggttgctaagtacaagttcactttcattggctttctcatacctaacacttgctgctgcaccacactatttgtcaatgcctacaagaatgttcttgctgttgtagttaagatagatttttctttccttgaggtagacaagatcaagcagtatctaaaggatccaagtaaatttgttgttgttgttgttgttgttgttgttgctgctgctcttgctactgagtttggtgctcccactacaaccaaggaaaaggaaaagaaggaagaactaggtgaagaatcaaatgatgacataactcatccccttgggaactag

SEQ ID NO: 75539 - DNA, 360 bp, Glycine max
  Peptide Sequence Number=SeqID_192317
atggatcagttaaaggaggagttccaagggagtgaaagagcgaaaaaaatgcaagggttgaacttgagaagggagtttgaagctgtgaagatgaagaagaatgagtggttacacaaatcagattacttagtgaaagccttagtgatcaacgagttgtggataaaatcttggtgtgctttccagggagatatgcttaagcaccaactcttgggaatgcaagttttgaatattcaattagccttaagcatggctctatatacgcttaagcctaaatttcaagaagctccattatctcatatcaagccacgcttaagtgtggcccttcccacgcttaagctccaactactggaagtgcactaa

SEQ ID NO: 75540 - DNA, 264 bp, Glycine max
  Peptide Sequence Number=SeqID_192318
atggagggacttaatgccaagaacccattcttacaaaagaacggttcttccaatctggcgaacccctctcaccgcttcaatggtgaacttgaaaaaaggaaacatggtagatgttacattagccaagttgacattagagatataagtcacgcaccacaaacgaaactactatgtgaatcagtggtggggacccaaactatggtcaatgccactgccacactgatcaaggttggtggaagttttaacttccagaactttgagtga

SEQ ID NO: 75541 - DNA, 1395 bp, Glycine max
  Peptide Sequence Number=SeqID_192319
atgatgatgaaatctaagtttgagtgtggaaaccaagatgctaatgttgatgatggagaaattaatatgaataatggtcaactgctactgcaagacattcaagaaataagcaaagctctttatgccccttctagaccttccttttcctcggtccataatcgatccaagtctgcgggaaaaaccggtttgtcgaaacctcaagttgccctaaccccgggatttctaaaggaagatctgttgcctaaggacaagaagttgtcttcagcgtggaattggaagaagcccatgaaagctttgacccattttggtggtcaaaagttcaaatgttgctttaaccttcatgtccactctattgagggccttcctttgagttttgatggcattaggttgtgtgtgcattggaaaaggaaaaccaacattttgcagacgtgcccggcaagggttttccagggtgttgtggagttcaatgaaactttgagtcatggatgctctgtttatgttagtcgcactgtgtctggtcactctgtcaagtatgagtctaagcgtttcttgatatatgcctctattgtaggagctcctgaacatgacataggaatccatcaggttgatctcacaaggcttttacctctgactttagcagagttagggggtgatagaagttcagggaaatggagcacaagttttaggttggcaggaaaagctgtaggagcgagcctaaatgttagtttcagctatcaagtaatgaaggatgagttaatggaatttggtggtgataatttgaatgttttcaaccttgttaatctgaagccaggcaggccaagcagcactagcagtgttatggattttagtcctatcccttttcattctgatgatatgattttatcctgtgaaacattgatgaattccagctcaagtctttccaaatcaatcagtttcctatatcaaaagcttgatgaagggaacattcataattcagcacgagcagactcagaacattttgaaccacttaaatcccatggttttacagaatcagagtcacctctagaatcaaatcaagatgaacctgatgactctgaattttccattattgaacaacaagtagaaacattggaaggggattccttggaacttgatcagacaggaaatcaaacagttgatttgtcaacagttgatattattaatgtggatgatattgttaaggaagatggcatatttgttgacaagaacacaagatttgatttgatggatagcatatgcactagttgtgtaaatgggactatggcagatgatggcaaacataaacgcagtagttcatgtgtcagtataacttgcatcaaggatgcagatatgcttcctgagacatcagattttattgaccaaggatgctaccttaat

SEQ ID NO: 75542 - DNA, 459 bp, Glycine max
  Peptide Sequence Number=SeqID_192320
atgccaacgagggtcaattgtgttgttaaatttgtcaaactcaactacaagcacgtggttatggggaaggtagcagctattggaggtggcattgaaaagggtgaaagtatcacctgttacatttggcggaatcagtttagtgattcaactattttaaggggagaaggaaaggccaacacgagaagaaaaattgtgatcaccatctctagtaatctcagtgtctgttttttcctcccaatgttggatagagctaagaaaatcagaccaaaacgaaagatgttgaatgctaaaatttttactttcagcctcttggcgttagaggaaataatgcccgtggagggagaaattcacctcgcacaaagacagtggaatgaaggctccaatctcctctccttctctctaacacttggaaaccctaacacagagcagcaaccagaggaaaagtttgaggaatcttaa

SEQ ID NO: 75543 - DNA, 173 bp, Glycine max
  Peptide Sequence Number=SeqID_192321
atggctaaaactgcacgtaagaaattatctaacagttcaacttgggaagatgatatctgggttccgaatgtgtacattttcagctggcagctctctactattagtccccatgatactattaacacaagaaatgctccacaggatatcctcattcagcaacgtcttggcaaaca

SEQ ID NO: 75544 - DNA, 177 bp, Glycine max
  Peptide Sequence Number=SeqID_192322
atgggtcccaagggaggaaacacgttgggtcatgcaagcgatagtggtggtggcaacagtggtggaatgatgtcggtggtggtggaagcgacaacaacaaggtgtggtggtggtggttgtggaatggtggcgatggaggtggtagcagcaagggtgatggtggtggtggtatggtaa

SEQ ID NO: 75545 - DNA, 606 bp, Glycine max
  Peptide Sequence Number=SeqID_192323
atgataaatgttgaagcctttcaaaactcaatatcaaagctcctaatccacccattgctatggagactcacaggcttcgcgtcaagcatagctggattctgctgttatgccatcagcccctccttccacgacatgttcggccagtggaacgcgctgaagatcatcgtgtacggcgttgtgagctcacttttatctatcttcaagctcttcattaagagatgcaactgggtacacgggaggagtttcttgttgaaagcacaagtcgaagaagggaaagtggaaaatgcacacggcaaaatgatgaacctcacttacagtggcgcatttgcattgatggctatgagcttgtccagacaactccaacttggattcgaagttggtgtgttttacttcttggttggatgtttcttggtaacagttatgaagatgagtttgaagttagcttcactagcagccttgttctgctatttgcttgtcaacatccgttccatttctgaatacatacgtaagaataggtctgaggaagattttgaccactatggatatgatgcagaagaattagaagaccgcgtaacagatgcccgatttttagattatgattactaa

SEQ ID NO: 75546 - DNA, 1008 bp, Glycine max
  Peptide Sequence Number=SeqID_192324
atggctgagatagaagaggtgcaagagcaaatgaaggccgatatggatgccttgaaggatcaaatggcctccatgatggaggccatgttaagcatgaagcgaatgatggaaagcaatgcgaccgcagttgctgccaccagtgccgctgtcgaggcggatcctacccatccatccaccataaaccaagcaaaccagtcgatcccggacatggtggatcaaggagaagtgctaggcagcacagacggtccacacgtggggcataataggaatacttacctctatgacttaccccccaactacacaccacccaatgcggtgcctatgcccaacaagaacgctaaccgcgttgttcccgttctctttgagggccagcaacctcagcctatgggggaaaatcgtgaagaccctcgagatcatgctcaggttgactttgaaccatacactatgttcgccactaagggaccggcgtgtagtggaagggagaaatgggacctcatcgaggagaggctaagggccatcgaagggtttggtgattacccgttcactaacatggtagagttgtgtttggtgcctgacgttgtcatttccccgaaggtgtactccagagatgagaagttgttaatgcatttcttccaagagagtttggccaaagcggcggtcacctggcagtaccagtacaataccaacacggctcctaaaagaacccaattgcagaatatgagcaagagggagcatgagtcctttaaggagtatgcccaaaggtggagggacctggcagcacaagtgatgccccccatgatggaaaaagaaatgatcactatgatagtagacacactgccagtgttctactacaaaaaatgggggaagttcgactatgccacctccacaagcacaaataataggagatttggggcaagtggggccaagaagaaggagggagccacacatatggtaacttcagctccgacgtggcctaaaacccaacaaactcctcacaacacctactag

SEQ ID NO: 75547 - DNA, 351 bp, Glycine max
  Peptide Sequence Number=SeqID_192325
atgtgggatcagcacatgcttaaaggagcactcaaaccgggtgtatttacccccaaggctgacactccgaagagtccgtcagagcctctccctcctgattcagttttgagtttctgcgggaaaagaaaaagctacaatacaaggggtatttctctcagctccgactctaaaatttcacgacgatccaacggtgaatgtgtccgagatcgtctttttctaagacaagtttggtggtatgcgggaaaagagagggttttgggaggtgaagaagggaaaacgaaattgagaggaagaggaggcgtagagagtatcatgagtatgaaaactgacctaagacgtctctatttatag

SEQ ID NO: 75548 - DNA, 579 bp, Glycine max
  Peptide Sequence Number=SeqID_192326
atgggtcaaacatcaaatgtagagcctgccatcaatatggtcatgcatagaagtgggcgcacaaatcatatgacccacaagaaattggatcagtcctttgtctacaaggtcaccattggcaacgaagaatgtgttgatgtcaaaggaaaaggagttgtcgctgttgaaactccagcagccgtgaagttgaaaacaatgtcacttgagaaggaaccatttcaaaatctaaaatgtgatttgaatggacctacaacaaaagttgttgagaagatgaacctccttgctcacaacaaacatgaagagaagaagaataacaagcttttaaacattgttgtttcaaatgataagcaaggagatgcaaatgcttgtctacttgacggtgatcctccatacacacttgatgtaacaagtcttcatggctatgagcttgtcacgacaactccaacttggattcgaagttggtgtcacgaatttcttagttggatgtttcttggtgacgttgatgaagatgagcacaaagttagctccacttgcgacattgttctgctatttgtctgtcaacaggcgttccgtttctga

SEQ ID NO: 75549 - DNA, 204 bp, Glycine max
  Peptide Sequence Number=SeqID_192327
atgtgcaaaatactcaaaaggaggacaaaagggtcacttttggggcatttttcagcccctaggcccactaggaagcttagggctaaagtaaccagctcgcctgggcgagatgagctcgcctgggcaagcaaggttacttctggaggaagcaagcagctcgcctgggcgagctgctgtgcaacctccacgcctcatttcctataa

SEQ ID NO: 75550 - DNA, 171 bp, Glycine max
  Peptide Sequence Number=SeqID_192328
atgacaaatcaaagcacacggagaacttttttctccgaatctgcaatacacgccttcttgaaagaaaagttctgcacctcagcacttgcctcaattcgggggccaggaaccttgtatcttgcatatatgtctctctatatctttgaagcaaagtggggcccttttctctaa

SEQ ID NO: 75551 - DNA, 291 bp, Glycine max
  Peptide Sequence Number=SeqID_192329
atggcaatttccttgtcgtcaagcaaaagaaagatgctagcaagtgtctttttaaatagtgatcaaggggttcccatgaaccctaagagaataaaggtcattcctgagtggcccactccaccaacaccactcattgagttggtgaggaagcatgttccttcatgggacgatgcccaggaaatgggtgttgaggaaaaaagcccggagtttcaagaacctcgagatttgaggtcaaatccttttcaagggggagggaatgatgcaatcttaccccacaagggcattggatag

SEQ ID NO: 75552 - DNA, 423 bp, Glycine max
  Peptide Sequence Number=SeqID_192330
atgcccccgactgtccctgttaatcattactccgatcccgaaggccaacacaataggatcagaatcctgtggtgttatcccatgctaatgtatacagagcgtaggcttgctttgagcactctaatttcttcaaagagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcacgctccctctccggaatcgaaccctaa

SEQ ID NO: 75553 - DNA, 378 bp, Glycine max
  Peptide Sequence Number=SeqID_192331
acccattccatccaggcctcttggttggggacgcgggaggatttcaaagtcccacacgtgaaccactgaacgtgggtggtctagtgcccccacattgttccttaaaatcggttgtctcggaggacgcttgccctggcgcttgctttgttcaacgcgatgctactacttttattaaaaagctcgtagttggaccttgggttgggtcgatcggtccgcctccggtgtgcaccggtcggctcgtcccttctgccggcgatgcgctcctgtccttaactggccgggtcgtgcctccggattctgatcctattgtgttggccttcgggatcggagtaatgattaacagggacagtcgggggcattcgtatttcatagtcagag

SEQ ID NO: 75554 - DNA, 171 bp, Glycine max
  Peptide Sequence Number=SeqID_192332
atgaacaagctcaagaggttgctcaagaggttggcattaacagatccacttaaactgttacaagaatacaataagggattagacgaaacatacctacgtgaggtggcgaaggagaagaagcacagacttgtgacgatgctcgagtgcgacgaacacgatgctcgaccttag

SEQ ID NO: 75555 - DNA, 278 bp, Glycine max
  Peptide Sequence Number=SeqID_192333
ggatcacgccttctagacacccagtggacccgaagaagtccaacagggccctgggatttcctgctttgatcatgggcctttgccaattctatggagtgccgatcactcccaccaagctcatccggcctcccatcagtagagccttcatagagaaatattgcatgcccaggcaagcacaacaacaagaggagggccagcagcagccagccacaggagcaccgtcattgcctctacaggagacgcaatccttagaatccatatccgctctgaaattctga

SEQ ID NO: 75556 - DNA, 291 bp, Glycine max
  Peptide Sequence Number=SeqID_192334
acatccaatggacccagagaagtccaatagggtcttggggtttccagctttgattacgggcctttgtcaattctacggagtgcccgtcgcccccatcaaggtcatcaagccccctattaactgggctttcatcaagaagtactacgccccctgggcaggcgcagggcgagacaccatagcagcctggggatggccggcagcgggcaatagatgcatcgccgcaacctccagagcccctcagttcatctacaaaggttggagagttgcctacaacccgtggccgactagcag

SEQ ID NO: 75557 - DNA, 240 bp, Glycine max
  Peptide Sequence Number=SeqID_192335
atgaaccacatgaacatatgttgcactcttgttagaaaaaagggtgcaatccaccaagtgaaggaggtaagcacgagctgctacaatccaccgtcaggcatgacatctactctgatagacctcccaaagccacgaaagtcgtacatatgccctatgcacccgtacgatctcagctctagcctcctcattagagaccttaagcaactccatcaacaagaagactacctcgtccacaagtag

SEQ ID NO: 75558 - DNA, 570 bp, Glycine max
  Peptide Sequence Number=SeqID_192336
atgaagaaaatagatacaggccatcaaagtgtgtcattggagaataagacaggagattcaattgtgctgaagataggagattcggctaaagttgtgataaaacaagacatgaagggaggagagcataaatatgggtttaacaaaaataaacgtgagaagccacaaaagaactgttttacttttgatattctgggattaagaaggattgaatggaatctacaaggaagttggtcagctgccacaaatactgtccctgccattactttcatcatggctgtcttaattaggatggaaagcatttccataaaacgtgtgcatggattggccaagattttggggtccgttctaagccttgctggggcaataacatttgctttagttaaaggacctcacctgggtttcatgaaatggtatccagaaaatcagaaccatacttctcaccctttaacaattgtgcactccaaaggtgatactattagaggctctcttttgatgctctcagctacagattgtatctttataccaatcacagaaagtcttgttatgctttttcaacacccaattctttga

SEQ ID NO: 75559 - DNA, 330 bp, Glycine max
  Peptide Sequence Number=SeqID_192337
atgaagaaaatagatacaggccatcaaagtgtgtcattggagaataagacaggagattcaactgtgctgaagataggagattcggttaaagttgtgataaaacaagacataaagggaggagagcataaatatgggtttaacaacaataaacgtgagaagccacagaaggtaaggctggtggatgatgaaactggcgacaaacatgagttgtttgaagtcctaaggatgccatctagatgtgtatttttgaaggtcttcatgttattccttcatcattcaacgtcttcatgtcattccttccctgagagtttcaagtactcttctaaatga

SEQ ID NO: 75560 - DNA, 366 bp, Glycine max
  Peptide Sequence Number=SeqID_192338
atgtacaaagataagtgggctcatactgagcccatgggcccaaaatataccctaaggctcatgagaatcctagggccttctcctgcatctttggctcaatcttcttggagtcttctatccaatgcccttagggataggattgcatcagagaatatgcacttatttttcaataagtatgccatacaacgtcatctcccaccttcagtgcctaaacatgattttgaggatttttacaaggttgaaaagaaatctcaaggaccgcaggtcgcttggggactggatgtaggcacgggttgttgccgaaccagtaaagaacatctggaaaagaagctagaagagatagaacaagctcaaatgaaaaactag

SEQ ID NO: 75561 - DNA, 1239 bp, Glycine max
  Peptide Sequence Number=SeqID_192339
atggaagatgataatgaggatcctattagtacaattgtacctcagggtactcaagaagatgaaatagtagaatctgaagatcatcatttgtctttcaatgctttgaaaggtggtagaagagttggtacgatcagggtggccaagtttttgaaattacctgtggaaccagctactcaatttagagtaatggttggtaatggtaattatatgtctactgaaggattggttaagcaattgaagtttttgtggaagggtaaatttactactttacaaggagattgtgaactggtacctgagcaagctcaattacattgtataagaagaatggttgccactaattccattgctgaagtttatagtctgcaattgatggagccagatgttgttcctaagtctatgcttgacttaccaattacgatggagcctgaattagccttattattgcacacttacaatgtggtttttgatactcctagtagcttacctccacagagatcccatgagcactctattcctttattgagtggttcacaacctgttaaggttaagccttacaaataccctcatagtcaaaatgaagaaattaagagattggtgtcaggaatgttagatgaagcatcatacagcctaaaagatggttcatggaggatgtatactgattatagggctcttaatgcaattactatcaaggatagcttccctattcctactgtggatgagttgactgatgagatttttggagcttacttcttttctaaattggatctaaggtctggttatcacaaaattttgttaaatccggatgacagacataagacagcatttaggactcatcatggccactatgagtggttggttatgccatttggcttaaccaatgctcctgctacttttcagagccttatgaatgacatttttgctggaatactaagaaaatttgtactggttttctttgatgatatttttgtgtacaatgctaattggaaagatcatttataccatttggaagtggttttaagagtagctatagagggaactaaattggaagctattcaaaagtggcctgagcctagtaatctcaaacagttgagagcatttttaggactcacaggttattataggaggagtgttgttgcatcagaagcattccaacaactcaaaatttacatggcatctgctcctgtattggctattcctaatttcaaggaaatttttgtattggagactgatgcctcatga

SEQ ID NO: 75562 - DNA, 579 bp, Glycine max
  Peptide Sequence Number=SeqID_192340
atggctgagaacaagcatttgaaggatttgcaaaaagaaattcgtacacattcagatgatattcgccatcttggtcaaacgatggatatgcgttaccaagagaaaaatgataagatgcttcatatccaaaattctatgggtcaaattcagttagcgatgaatctgttattgcggaatgcttctcaacctcctgaaagttctccaaacaatggctccccgatggtgcaaccaattaatgcttctttgcctgttaaagagatctcacttggatttcctcacttcgatggaacaacaccagtgatggagtggatcttcaaggcggaaaattttttcacatatcataatactcctgatgcgtctagagtggatattgcggcaatgcattttgataaggatgtagtggcatggttccagatgttgcagaaattatctctggtgtctacttggtctgagttgactcatgctctagagtctcaattcagtccttcaccttttgattgtccaatggttgagctcttcaagtttcaacaaacaggttcggtatcagcttattacctcaaagtttatgtctctagctaa

SEQ ID NO: 75563 - DNA, 1464 bp, Glycine max
  Peptide Sequence Number=SeqID_192341
atggaggaatttcacagttctaagattggtggacattctagagttcatagaacagtagctagaattggtgctcaattttattggaatggtatgagaagtgatattagtaaatttgtgagggaatgtgccatatgtcaacaagctaaagttgatcatgttttgtcagctgggttgttacagcctcttcccattcctcaacaaatatgggaagacatagcaatggactttatttttgagtttaataacaaggttgtggctgaagttttcattgccaacattgtcaaaattcatggcacaacattgaccatgagctcttcatatcgccctcagtccaatggccagactgagaatcttaataagaccattgagatgtatctaagacctccaccagcggtgatgcactacgaggttgatcctaaggatcccgatccactcaaggctttattacaactacgtgatcaacttttgagcaagcttaaagttaagctacaaccctataagcaacattcagtggctttgaggaagcatcagaagctaggcatgcgttattttggtccatttctggacaaggttgtttttgatgaggagggtaatgtaacgtgcataaagaaggaaggagatgtgacgcgaaattctgttagaatcgaaggacacatggctcacgatccgcaaagtgaaggagacaggcgtagcacaagcttgtttcttctcccggttattcctttctctcaccctagccctttctctcaggtgattctgttgccggattccaatgaaatccgtcttcggggagatgttgttcctaatggtcagtgccaatttcctagtctccagttctactcaatcgtgccttccataactattgtttccagtgttactccttgtataaatgttgtttccattgatgattgtaataataaagtgcccgttaataaatctgatgcgctaaatgtttttagacaattcaagtcaatggttgaattacagattggggcgggaggacctgctaatgttcatcctatggtcactagagcaaagaatgggatagatcaaccaagaattcatcctactttgcttcttgctcgtgctgaacctaaatatgtcaaacaagcactgcagggtcctaaatgggctatctatggtctaaaacaagctcctagagcttggtttgaatggctgaaaacaactctgttacagcttggctttgctgacagcaagtgcaacccttccttgttcacatacaaaactaaaactgccacagtttatatcctgctgtatgctgattttatcatcatcgctggtagttcttcatctcaaattgatgtgttggaatctaaacctatttcttctcctatggtttctagctgcaagttgtccaagcatgattctgatttgctgcaggatgcttccttctacagtccgttgctggtgccttacaatatgttacttaccctgagcagctga

SEQ ID NO: 75564 - DNA, 645 bp, Glycine max
  Peptide Sequence Number=SeqID_192342
atgggaagtgctagtccaatggtggggactgtcccccacgacacctcatgggaagactgggaccagctgcgacaggatcatcaccttgagaacaaggtgattcttcaagggccgaaggaagatgatagcatagcagaaccaataacagaaagagaaataggaatcacaacaacaaacacgggtgcaaatggcaaagatgatgagtggagtgatcctcaaagaatatctcttatcaacttcatgtttgacactgagagtggatcaatattcttaatggtggtaaattgctccggtgatataaaggacaagtatttcattgctcaacacatcaaagatgcaattttggaggttgggtcatcaaatgtgccaatgatgctgagaaaaacaatgatacttatgaacaatattcttggatcaaacaatactcttggattaaaatttttatcatggaaaactatgagattatcaatgtacaacaacgacaactcattgaagttgctttctgttgctcctataagatttgcttcaactattgtgatgcttaagaggtttaggagtttgaaagaaggactccaaaagatggttattagtcctgaatggtctacttacaagaatgatgatgttggaaaggaaaaaaaaaagtga

SEQ ID NO: 75565 - DNA, 858 bp, Glycine max
  Peptide Sequence Number=SeqID_192343
atgtggaaaatctaccctcttgaagttttattttgtattcaaattgcatcgctagaagaagataagaatgcttttggaatgactcagtcaaaagagctggcaacattgcttgaagcagagaagatttcatgtgtggagataagcaaacacaggatgtactggttcttaaggattgttcgatttgcattccttgcagttttattttgtattcaaattgcatcgctagaagaagataagaaagcttttggaacaacgcaacattgcttgaagcaaagaagatttcgtgtggataattacatcgagtacattatcgagaccaacaaagaggcttcaggcttctcaaaaatccatccaatcatcataaacattggaacaaacaatttggaaacacaaaaggagtctgactgcaccttccttcctctcgggttctgcggaaacccaaaacagagattcttaccatcaacttatcctgccgaacaaatccactcaaacatgatcaagatgagtactactcagtcatcaacttcttctaatgtttccataaaaatcgaactttctacccaagatgatagagaaaaactagccaaggctacaaatgggtatgataaagtaaatgatctaataagtaaatttggaaagcctattgctcaggaagaaagttcagaaaaatatttggtggcacaggaggaagtattgttagctcaacttcgtcctattcaaaataaattgaatgcggttcttcagaaaattacaaacattcaatcatctaaagagtcgaatgagaaacaaaaagaaatgttattttcggtagctacttccaatgcaaaatttttaaagaacatctggaaaagaagctag

SEQ ID NO: 75566 - DNA, 285 bp, Glycine max
  Peptide Sequence Number=SeqID_192344
atggtgcaatggttgtttgggcgagcaaatctgaagaagtggaggttggtggtggcctattggtggttttggggagcagatttggggaaggggaggctggtggtggtttgggcgattggatctagtgaaagggaggctactggtgtgcggtggtgtggtttggatctgatgaacaggaggctgcttggtggcacgatgatggtttgggtgaagagatctaataaagggaggttggtggtggttttggtgagcggatcaagtgaaggtagaagtgtgagagtgtga

SEQ ID NO: 75567 - DNA, 1143 bp, Glycine max
  Peptide Sequence Number=SeqID_192345
atgccgagacaccacccttctacgggtcatggtaggcaatgggcagtatctggaaagcacgatagctcttggcatttttgtgtggactatcgggctttaaattctttcacgattaaggacaaatttcccatccccaccattgatgagctcctcaacgaattaggtggtgcacagtgcttctccaagctcgacctgttgcaaggttatcatcaaattcggatgcattctgacgacatccctaaaacggcctttcgaactcatcatggtcactatgagttcaagacatacttatatatagtggggtcagtggatgatcacttgcgccatttggacatgacattccagaaagaggtcgaacctgtggccgaaaaagtcaccgccatttctaactggccaacacctcagtcatctaaggttgtgcaaagttttttgggtttggccggtttctaccattggttcatcagaggctacgctatgattgctgatcccctggtcaaatccaccacagtggaaccttttcaatggacatctcaagcccaggaagcctttgagaacctcaaacatgctttgtcaacagcccttgttctggccttaccggaatttcaggtgcctttcacagtcgagacagacgcctcaggtaatggcatgggagcagtgttaacacaacgcagacaccccatagcttattttagtaaagcattcaacaagaagcttctcaaggcatcgacatatgtacgaaagttatttgccattacatctgcagtgaagaagtggtgccagtatctcttgggccactcattcacaatcatcactgaccacatgagccttaaggaattgttgactcaggtcatccaaactcccaaacaacatatgtatttggcctgcttgatggggtatgactaccagattcaatacaggtctgggaatcataataaggccactgatgctctatccaggctaccggaaaccacatcctcactcttgatgatactctcagttccttgtctgacctttctcgaggaattacaccaacaattggcctctcatcctcaatatcacagtcagtgtcaagctatcctagattcctcggcggcacatcccgactacaccattactcaggaccttattataaagaaaggctga

SEQ ID NO: 75568 - DNA, 195 bp, Glycine max
  Peptide Sequence Number=SeqID_192346
atgaagaaaatagatacaggccatcaaagtgtgtcattggagaataagacaggagattcaattgtgctgaagataggagattcggctaaagttgtgataaaacaagacatgaagggaggagagcataaatatgggtttaacaacaataaacgtgagaagccacaaaagggatttagttttgagctgtgtttttaa

SEQ ID NO: 75569 - DNA, 542 bp, Glycine max
  Peptide Sequence Number=SeqID_192347
ggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccggaccctgcccacctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaag

SEQ ID NO: 75570 - DNA, 2076 bp, Glycine max
  Peptide Sequence Number=SeqID_192348
atggataagagcttgaaggtaggagaagatgagtggagggagaaggagagaaggagcacaaaattttatgcctcaaatgagggaggcattgacttaggcccaaccaaaatccaccatggccaagtcaggcgcctcatcaacacgaaccgggttgcggccttattcaatattcagctccatacccacgacccacccttccctagcttaccttccacacccccttcccttcgtcccctcctcaccaaatactccaacctttttcaaactccgacaaccctccctcctccccgaccaacagaccactccatccacctcgagcccaattcgaaaccagttaacgtccacccctatagatacccctattcccagaagcgagagattgaacggcaagtcgacgacatgcttcgtcgtcaactcatacgccccagccgtagcccatactctagtccggtgctccttgtcaagaaaaaggatgggacgtggcggttctgcgtggattaccgcgcactgaactcaatcacagttaaggatagattctcacttccaaccatagacgagctccttgatgagttgggaaattcttcttggttctcgaaaatggacctcgcgcagggctttcatcagattcgcatggaggagcatgacatttccaagaccgctttcagaacacaccaaggccactacgaatatgtcgtgatgccattcggcctctgcaatgcgccatccactttccaggccacaatgaatgagctatttcgcccattcatacgcaaattcgtgctcgtctttttcgacgatatattggggcaattccatttgaaaccttccaaatgcattttcggccaaaggcgcattgagtacctcgaccatttcgtctcttctcagggagtggaaccagacccatccaaaattaaagctatgttgcaatggcctcctccatccacacccaaacagttacgtaggttcctcgatttaacagggttctaccggagatttgtccaccgctatgcacaaatagcggagccattgacccagctcctgcgcaaggataactttaaatggacacccgaggcccaagaagtcttcgtcaaactcaaagaggccatgactgccacacccgtgttggctttgctggatttcatcattccttttattatcgagactgatgcctctgggtccggtatgggggctgttttaatgcaaaggggccaccccattgcttactttagcaagcaattctgccccaagctcctttgctcttccacctacattcgtgagcttcacaccattaccactgctgtgaaatgttggcgtcaatatctcctgggccatgctttcgtgatactcactgaccataagagtcttcgtgaattgatgactcagccagtacaaaccccagaacaacacgtatacctggccaagcttctaggctacaattactcaatccagtataaggcaggacataataacgtggtggtggatgctttctcgcgtcttcaagaaccagagcaaacagcagaatacttccaaatcttctccatgcctcacccgaaattccttgatgagctgaaaaaggaattatcgggatcagaggaattcaaaactctcatgcttcagggcaatcttttcattcctcttttattggaagaataccacaaatctccacttggtggtcacatggggctagctaagactctcggccgcctccagcaaagctttttttgggaaaacatgcgccgcgatactctggacttcatcaaacaatgtcctgattgccttcagactaagtacaatacgaagaaaccggtagggcttctccagccaattccaccaccatctcggccatggaaggatttggccctcgatttcatcactggtttaccaatttcgaacggagctacggtcatcatgacggtggttgacaaattctccaagggtggtcacttcggaactctgccatcccatttcacagctcacatggcggcccacctgtttattgacctcgtctgcaagcttcacggtttccctcagagtttaatctccgatcgtgaccccatttttctaagaaaattctag

SEQ ID NO: 75571 - DNA, 282 bp, Glycine max
  Peptide Sequence Number=SeqID_192349
atggattccagtgctagtttgagtaaaaactctccatttactgaaaaatatccgaagtacaggcttcattgtaaaagactccaaggttcttcagttagtggcttatgcaagatggtacaagacaaatgtcgagacaataaatcaaagggaaacttgtcacaatctggctctccacaaggtcctctcttcctaggagggtctggaaaaggtctttcaagctccgaatgcaacaacatggacacagaagaagataagcaatcagattgccgcaattggaaatga

SEQ ID NO: 75572 - DNA, 642 bp, Glycine max
  Peptide Sequence Number=SeqID_192350
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgataggaaaccacccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctggttctccccgaaatgcgttgaggcgcagcagttga

SEQ ID NO: 75573 - DNA, 4872 bp, Glycine max
  Peptide Sequence Number=SeqID_192351
atggctacggctgcaagaggccatggtcttatggctcgtgttaaacagcttgaggctgaagttccttcactagagaaggctttcttttctcaaactcatcattcctcattctattcaaatggaggtattgattggcatcctaatctacattctgaacaaaatctcgtgactcgtggagacttacctcgatttataatggattcatatgaagaatgtcgtggtcctcctagactgttcctgctggataagtttgatgtagctggggctggggcatgtctgaagcgttatactgatccatcattctttaaaatagaaccaacttcatctgtaactgctacaatagaagttcaaagagaaaagagaattcgtaaagtaaagctgaagaaaggagcacggctgagggatggtgaaacccctaatgctgtaccatcacatgcaaaattacatcaactgcttcttgaggagcgtattgagaatggttatagtaatcctgcacgcctagtgaagttgaagaaaagacaattgaatggaccagcagttgaaacaagagctgggaagagttacatggagaaatttctggaaactccttcacctgatcataaaatggtttgtgaaacttcaatctttccattgcctgtgaaacagacatcagatgatgctagcgaggctgggattaaaattcttgaaatcagcagcattagtcctgtgaaaaagtcattgggaaataaaaacacctattcatcccctgatgagaaggaattagaactaaaaccattttcacaaatggatggtgggacaaatggagatcttgtgaaggtgaaagaacaaatctcagatggtgtggcagataagaagtcttctaatcatcttatgttgcctgatgaagcagaattggctatcgatgaacaaaagaaaatagaaggcagcttagatgggtaccaatctgatgatgtgactagtgaagttgacaattacatggatgctttaactaccatggaatcagaactggaaactgacaatgagtttaaacctaagagtagtttcttgaatattcagaaggcagcaaatactaatgataaagaagaacatcaattacaagctcaattttcagattctcaatcatttggggactcctcaatgtctgatgactgtagttctttcaaacaagatagaaatgaagaacatattaaagttgaagctcagttgtcagattctcaatcaactggaacctcatcttcattagatgataatagttcattcaaaagagatggaaatgggcagcatatagaactgcaagctcacctttcagattctcaatctgtcgaaagctcctctacatcagacaaaaatttcaagaaagatagatcctatttacctcactctgattcgttaaccactgcagttgaaaatatgcaatcagaacctatattattcacaaatactaagtattgtgaaccggaggttgaagatgcaccatccaaccagcttccccataatgttgagtttcaacacacagattgtgagaggtttgtcatgcatgatgatgcacctgttcatgaagaagatatttctgatttggggcaagcctcttcagatctgacaacttcaggactggtgttgtgttctgatcttgtatccacctcaccagtgatcctaccttcagatgaaaccccatctgaccctgctgaacttaatttacgattagatgatgacgatgcagacagaacaggtcttgttgaatctattacttccaaacctgtttctctctccctaggaacagatgatgctcaccctttgggttcttctgataaaacatcattagacaacttggatgatgatgacccatatattcattctgatgatctgttacaagttcctaatgatttggaattggctcatggagatgaatgcagtgatcattccgaaatcaaaatttcccaggcagagtctcccaatgaaaatccttctaaaattttggttaatagagatattggttcaccagtagaggatcctgtttctccatccatggaagaattaaacttgaattcaggtgctatgctggctcgtgattgtcaagactcaaaagatgaagattgtactgtagcaacccaacttaattcggtagctcgtgttcctccagtcagttgctttaccggggagctatcatctgattcaactcataacaacacactgaatggaccaggctcagcagaaattgaagtttcatattctgatctgcaatcaaaagctgaagagataccaaagatggtgcatgatgataaaataaatggatccaccttcagtgctaattcagttgaaggtgatgctcattttaaacatcaatctcctgataatcatgtgatggtaaatgatctggtcactgaaaatgttcagtcagaagatcaagctgtgtattctgttccttctgttgatagtgctgaaaatgatgtgggtgttgttacttgtccagcttcaagtcagatttgttctccatcaatgggtctttcagatttggaagagcctctgttgagttctcattcttatcaaatggaaataaaatccaatgaagtagaattgacgcaaattgccatggacacaaatgctgagaagagaaaaaatcaatcagcaccattgctagatgtaacatcatctgatgtcgtaaattcttcaatgagtaatattaccaagttagaagagcctctttctacctttgcagattcaccgaagaaagagatggaagttgatgaggcagttgctagagattctttgacagaattagaggaacagaagatagtggatcaaccagaaattgcttctgtggatgtacaattgaacctgaacaaactggttccctgtgatcttccagattcagaaatatgtaataataatcaaaagtcatctcctagggagaaattccaacatgatgcttttgttgatgatgcagaaatggtgcctgaattttcggggttagatgatcggcagtcagaatcattatcttatggccagcatgatccattacaaaatggcagagatagtttttcatcatcttctggcaaccagttagaacctgaaactgatttagatctgctctcaaaatcccaaattggtgaacaggatgcagaattcccagtcagagatgagaaaaactttgcctctgagaaatctcaatgtcagcagatgcagatatgtcaattggagcaagaaagtactcatgctacgtctgaatgtgcatcagaaatccatgcagatgagccatcatcattttattcctttccacagtcatctagccaggagaacaatgctgcaaaacatgtcatggatccattgaagcctcttcttcctaacctctttcccaaggcaactgaaaataatcttgatgagatgccacctatgcctcctctaccacctatgcaatggagaatgggcaaggttcaacatgcttccctagcttcacaaagagaagaattagaagtaagtccggcctcagtccagccaattagacccgataaacaatctctatttggtttgccaacttctgaaagagatgccttgttgtatcagaatccatttttgcctgtcatggctgtggaaagtgataagctccaagattcttctgggtttcctgttgatgtttcagggcatcctgttgctataccttttcaatttcctgtcatggttaatgaatcaaaaggtcaatataattacctattgctggacagaaaccaaattcagaatcccttcttaacattacctgtggcatctacggccatgcctcctcaaggtttctttgttgctcctgagggagaaatgatacagaattcaaacccatgtgcaccgataccatctgctgcatatgatgtttcaggacacaattccatccctccacaagaaaaaccaactcaaccgcccaatcagttaatgatggagactagtccagatgataaatcacttctacagagtatgagtaatatggtatctatggacaggcctccacatggtcatgcagttgcttctgagggagaaaaggtactgaattcccctacaattccacctgctgaatgtgctgtttctggacatgattctgtctcacctcaagaaaaactgactcaacatccaagtcaattattgacggagcatagttcagatgataaaactcttctgcagtctgtaactaatgtggtgtctatggacagttctgacagtcaaattgtttcttctgagggagaaatggaacaaagttctaacccaaaccctccatctccacctgttgagtgtgctgttcctggacctggacatgattctatctcttctcatgaaagcctgactctacctccaagtcaattaatgtcagagactagttctgaatttaaaacacttcagcagtctataagtaatgtggaaggggaacaaggacgtctgcctatctcattcatgtctccatcaaacatggaaagtatggagcctaatcagagtttcccgccctttgaggggggaatgtcagcttccttggatacatctgatcatacatcagacgttgagagtgaaagaacaaatggaaaaccaaagaataagcttcctcgtcctcgtaatcctctaattgatgctgttgctgctcatgacaaaagcaagcttaggaaggttactgaaagggttatgcctcaaattgcaccgaaggtagatgaaagagattctttactagaacagataagaacaaagtccttcaacttgaagcctgctgtgactacacgacctagcattcaaggtccaaaaacaaatttgaagcttgctgccatcttggagaaagcaaatgcaattcgccaggctttggctggaagtgatgaagatgatgatgcggattggagcgattcttga

SEQ ID NO: 75574 - DNA, 399 bp, Glycine max
  Peptide Sequence Number=SeqID_192352
atggtaggcggagaaggtagtggaggggagttcgagctagtcacaggtgacagtggtgggggttctgtcgggggtgacagaggcagaggagcaccaggcatttgtttggaggaagagggggtagaaggtgttggaggagacgtcgtattcgagggagtgggcggtgcagttggagagtctgaagtcgatgcattcaaagatcaccatcctgtcggtgtggaggagctgcatgtgcatcgccataatgctgatgctttgttggaggacctcccagtggccaccaccgccaactttcactatgaccaggagagttacatgaaggaggatgagaaagagagaagttgtcatcattttatgaactgtgtgaatgacatgtctttggattatgaaacagagtga

SEQ ID NO: 75575 - DNA, 219 bp, Glycine max
  Peptide Sequence Number=SeqID_192353
atgccgctgtcgaagtactgcgttcggaatgagtacagcctggcggatcccgagctgtgccgcgccgccgacaaggacgatcccgaggcgcttctcgaagccgtcgccatggccggcctcgtcggactcctgcgccagcttggcgacctcgccgagtcagtttctacttcttcttcttcttactatttcgttacttccgtgtttctatctctctgttga

SEQ ID NO: 75576 - DNA, 246 bp, Glycine max
  Peptide Sequence Number=SeqID_192354
atggatagaatttctcctttcgaagttgaagatgtgttctatgtgaacaataagtcagaaacgactattgtggccatcaaaatcgaagacaaggaggaaaagatggataccgatgccatagaagaaaagaagaaaatattggatgagaagaagggaaatccggtttgtcagaaagcgcaccagatcgtcatgtatttaaaattaaaacggatgaatctgagtatcgaacttagggaactagtctaa

SEQ ID NO: 75577 - DNA, 432 bp, Glycine max
  Peptide Sequence Number=SeqID_192355
atgcctatttgtcgtaacctacccttcagcgggggtgtgaaaaggccaaagcgtttgtctccaagggagaaaacaagcagagtcaccaccaatgtttatttgaggaaaactctagaaaaaccaaaacgacaaaggtctgtggattttgaaaatgatggttcaggaattgtttatgcacggggaagaataatcaaccaaggttgctttcaatatcaattcaacaaacattcaaaggttaagcattgcttcaagattaagacaaggttgcttcaacaaacaagcattgcttcaagattcattcaagatcagcttttgcctcaaaacacattgtttccaacatgtcaaggctctggtaatcaattaccaggcagtataatcgattaccagaagaaaagtttgcaaagcagcttcttaaaagggcttgaaatttga

SEQ ID NO: 75578 - DNA, 432 bp, Glycine max
  Peptide Sequence Number=SeqID_192356
atggctttgtgttcagtttttctcaatcttcatcttctgctttttgtttgtttgaccatagaagcattaggtgtggcaaagccttcagtagctagttaccttagccaggagatactagcagagcaaaaagctgatagagtgcatggattacctgcgcagcctccggtcaagttcaacaatatggtggttatatcactgtctatgaaactcaaggaagagcactgctctattggtttttcgaggccactcacaaaccagaacaaaaacccgttctcttatggctcaatggagatagggatgctgattaaaatcaagcatttaatttttcttgatgtcaagaatcacaaaccagaaggtcaggaagtgagtgcagcaggagtaaacattgataatcacatgaatgaaggcagtggctggattaactcagcctaa

SEQ ID NO: 75579 - DNA, 371 bp, Glycine max
  Peptide Sequence Number=SeqID_192357
ttattgaggtcgctggtccaacaagactgcctcctgctatgatagaatgggaaaaatttaatcatatagaggaaaggctgagggccattgaaggaggtggagattatgcttttgttgacatggcagaactatgcctagttcccgatgttgtcatccctccaaagttcaaggtgtcagacttcgataagtacaagaggactacttgccccaagaatcacctgaaaatgtacagcaggaaaatgggggcatactccgaaaatgaaaaattgttgatgcatttcttccaggaaagtcttattggggcagccgtcacctgcatgaatctttcagagaatacacctaaaggtggagggatctaccagctcaagtag

SEQ ID NO: 75580 - DNA, 138 bp, Glycine max
  Peptide Sequence Number=SeqID_192358
atgttgcattcgagccgtatccttagaaaattggaggttgaggaacatttgctggggttatggctaccattgcattatcgagtagatatgggagattgtgttggtattggatgtgcggcaggcaagctttgtagctga

SEQ ID NO: 75581 - DNA, 252 bp, Glycine max
  Peptide Sequence Number=SeqID_192359
atgtacaaagataagtgggctcatactgagcccatgggcccaaaatataccctaaggctcatgagaaccctagggccttctcctgcatctttggctcaatcttcttggagtcttctatccaatgcccttaggggtaggattgcatcagagaatatgcacttatttttcaataagtatgccatacaacgtcgtctcccaccttcagtgcctaaacacgattttgaggtgatcaatctcacaatcgcattgtag

SEQ ID NO: 75582 - DNA, 510 bp, Glycine max
  Peptide Sequence Number=SeqID_192360
atgggagtcgcaaagatgatagcacggctctcggagaattttcactggcctggactctgggaagatgtcatacagttcatcgctaagtgtgttgaatgccatattacaaagtacgaaacaaaaagggtagtgggattactctgtccctttccagtgccattttgtccatgggaggatccttccttggacttcatcaccggccttcctccataccagggcaagaccactctactcgtcgttgttgatcgcttttcaaaaggcattcatttgggtatacttccccaggaacatatggctcacatggcggcctccttgttcattaacattgtcatgaagttacatggcattcccagaagcttggttttggacagggatccgttatttattagtgagttttggcagaagctttttcggctcaacgacatgcgtttacgaatgagttcagcttaccatccccagagcgatggtcaaaccaaagttatgaatcgcatgattgtgcaatacttgcgg

SEQ ID NO: 75583 - DNA, 510 bp, Glycine max
  Peptide Sequence Number=SeqID_192361
atgacatacttatatatagtggggtcagtggatgatcacttgcgccatttggacatgacattccagaaagaggtcgaacccgtggccgaaaaagtcaccgccatttctaactgtccaacacctcagtcatctaaggttgtgcaaagttttttgggtttggccggtttctaccattggttcatcagaggctacgctatgattgctgatcccctggtcaaatccaccacagtggaaccttttcaatggacatctcaagcccaggaagcctttgagaacctcaaacatgctttgtcaacagcccttgttctggccttaccggactttcaggtgcctttcacagtcgagacagacgcctcaggtaatggcatgggagtagtgttaacacaacgcagacaccccatagcttattttagtaaagcattcagcaagaagcttctcaaggcatcgacatatgtacgcaagttatttgccattacatctgcagtgaagaagtggtgccagtatctctag

SEQ ID NO: 75584 - DNA, 396 bp, Glycine max
  Peptide Sequence Number=SeqID_192362
atgccgagacaccactcttctacgggtcatggtaggcaatgggcagtatctggagtgccattgcccaaacatcgtcctgggcctcagtggctaaaatcgttgggggtcgtactcactgactacaccaccttgtgtatgcaattcatttacgacggtcatttgaaccagggacctgggatttacttccatatcactgttctctccgaggagaaatcctcttcgcacttggaggacttactgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 75585 - DNA, 246 bp, Glycine max
  Peptide Sequence Number=SeqID_192363
atgggctggtactgggctaaatcaggcctttctgaagcatggagtcaacttgcaattcaatctcctgcttttgaaaatgaggataccgatacagtcttatggcttgaattgaaggaggtaagtgatgcaatcctccctaggaagggaccaatcactagaaccatgagcaagaggctccaagaagattgggctagagctgctgaagaaggccctagggttctcatgaaccttagggtagatttctga

SEQ ID NO: 75586 - DNA, 642 bp, Glycine max
  Peptide Sequence Number=SeqID_192364
atgaggcccacctacgaattcaaagaaatttgggtcgggtataggtctgggttatcgggtgggtctcggggtggtgtattgggtgggttaggaatgggtatattatgggtagttgggtcttcctcatccgcaatgaggagaaaaaccctagaggcacatcgatgtcctatgtggaatttctcctcacaattgaaacagagacctcgttccctccgagaggcaatctcctcgggagacaagcgtttcaaggccagtggttggggatgggaaggggttggcaaaaggggtgggaggggtatcgaggatatcggggacgcatatccaggaacttctcttcttgcaagcgagcgaggccgacttcctacaccagagtcattggttgatgggcctgcacctccctgcgtatctccaggccaccgtgcctctctgggtgaacttaaacagcgcaccgatgggatcatcgtactgagatggggcaaagcaagtgtgcaaggcttgaaggaaaatggaccaggaggtgaactggccattggtgttgaggaggaggcaatggtgttggcatggatggagttgagtcattgcattgacagactcaccaaggtacaactgctggttggtgaggcgaatgagggcatcctcaag

SEQ ID NO: 75587 - DNA, 339 bp, Glycine max
  Peptide Sequence Number=SeqID_192365
atgacctcgcattattgggagcttagggaaaatggagctcatcaaacagtagaagagatatgtggaggtcaagggtatgcaaggaagatcacctttaaggatattaaacttgtggaagctacaaatcttgtgattatagatcaactttacaacccatgtgacaatgtatgtgcagtcagagtgaatgatgttagttaccacaatgtgaggggaatctcaagttccacgcatgcaatcaaattgtattttgacaaaatcataggttacacaaacattgtattgaagggggttaaagtaactacctatactaaaaagaaaacttatgcatcatgcaaacat

SEQ ID NO: 75588 - DNA, 936 bp, Glycine max
  Peptide Sequence Number=SeqID_192366
atgtcttcacgggtaggcggcagcgaacctgtcggtgatggtgctgatcggcaccccctgctcgcgcgcggcggtgttgatcttgtcgtccacgtcggtgatgttgcgcgcgtagcgcaggccaccgaaacggcgccgcagcaggtcggccagcacgccgaacaccaccgggccacgggcgttgccgatgtgcacgtagttgtagaccgtggggccgcacacatacagggtcggacaggccgggtcgagcggggtgaacggttcgagctggcgagtcaggttgttgtgcaggcgcagggtcatggggctgtggctgggggacaagcctgtgattttagaacgtgtcggccccctttgggggcaccgcctgccaccggtggacgccgggtccgtccaaggtggggtgggcaggagcagcgtggacgggcgcaggaggccgagccccgcaaccgggtggtgatcgtggagaacgtgaagttcgactacgcgcaggtgctgaatgtcgagcccgtgttccagaccctgcgcgcgacccgcaccgaagaacactgcgagccggtctcgacccggaccctggcgccagtcaatgtcaccggtgaggagccggttgaggacaagggccggatcagccgcttctgggactcggtgcgctcgatgttcaagcgcagcgatgaagaggtctccgaggacaccgccgccgagtcacccgccccggcgccggcaccggccaacaatggcccgatgctgacccgtgactgccgtatcgtgccggtggggcgtgaattccgcaggcccatcgcctacgacgtggattacgtctacaagggcaccaagtaccgctcacggctgccggaagaccccggcaaccggctcaagatccgggtgtcgatcaccccttgggtcggccccgagcagggcgccacgggcaatccctga

SEQ ID NO: 75589 - DNA, 348 bp, Glycine max
  Peptide Sequence Number=SeqID_192367
atgggaactttttgggattgtgggcccggggagaggatgatggcgcgggtggagttggggtcgggggggatggcgggggcgcggatggggcgggggggcgaaggtggtggggccgccgcacttgcagcaggtgccggtggcgagaggggaggaggacgaaggtgggtggtggttgtggtcgccgtcgtcggtgtggtggtggtggtggaggttaccagagtcttccatggttgcgatcgatggtggtggcgatgttgcagtgcaagtgaaggggaagagaaaaaactgaatgagtgcgtccgtgggcccggcccagttataaccttgagttttcgtaaaggcctttga

SEQ ID NO: 75590 - DNA, 174 bp, Glycine max
  Peptide Sequence Number=SeqID_192368
atggagaggaggttcccgcctacttgcccagggtttcaggaattttatggaagcattacgaaagccccgaaagccatttttcaacaaaggagggaggtgcttgccgcctatctcgcccaggtgagttggttgcttagccaggtagaaagaaaaggtccagaatcctctagatag

SEQ ID NO: 75591 - DNA, 432 bp, Glycine max
  Peptide Sequence Number=SeqID_192369
atgggggaaatgtgcgaggagtttaagatccaatatcacaattccaagccctaccgaccaaagatgaacggagccgtggaggcaggcaataagaatatcaagaatattatccagaagatgaccttgtcatacaaagattggcacaagatgctcccattcgcattacacggttaccgagcctcagtgcgcacgttaagtggggcaacacccttcttactggtacgtatgcgccggttcagcgaaggggacttggtgttgaagaaagtctcccaagctctgaaagacaacagagggaagtgggccccgaacaatgaagggcctttcgttgtaaaaagggctttctccggaggggccctggtgctcaccaacatggatggcgaggagctaccttcacctgtgaacttcgatgttgtcaagcgatactatgcttag

SEQ ID NO: 75592 - DNA, 204 bp, Glycine max
  Peptide Sequence Number=SeqID_192370
attatgaaggaagatgataacaactggcccgaaccggatcgggtggggcggcaggagctcgagattgttatggggaacgagcacatttcgttcaccacgtcgaagattgggtctcttgttgatgttcagagcagtgctgaccccgagggtcttcgcatcttttactatcttgttcaggtgaggatcatgcttttgagtttttga

SEQ ID NO: 75593 - DNA, 132 bp, Glycine max
  Peptide Sequence Number=SeqID_192371
atggtcgacgacaacgatgacactgctggtgtgcttcacgacgacactgctggtgtgattcacgacgacaaccaacttagagagacaaagcttaagggcacaacagtactcaggaatctccactccatgtag

SEQ ID NO: 75594 - DNA, 435 bp, Glycine max
  Peptide Sequence Number=SeqID_192372
atggctagtgttggtacccatttaaggttgggtatgtgttcttgcactttcacttgcggcccaagctttggttcttcttcttccacgaagaagaggaagctttccaacaaagccaatattggttcaagaaataagaagttcaagaatgatgatgatgatgaggtttggaagatcaagaaagtgttggaaaagagcaatattgggaccatgcgcaggttgatactgaggagagagatggaagaggagtttgtgttgcctgtgttgggggatgatgctgatcagattgatagtggagtttctgttcagatttgggatgtggacaccaagtccatactctctggttttcaagagatgggtttcttcaagaagttatgtattcattggtgtgacatcctggaaatttctatccggaattttgtaagcgttatattttaa

SEQ ID NO: 75595 - DNA, 297 bp, Glycine max
  Peptide Sequence Number=SeqID_192373
atgccaacaactcagaatattgctgctgggaagtacaccttacaaggcaatcatatgccctctgggacagtcttacttgtaaggaaactgatctctatggacatgaaaataatgcactaccagagcaagatagttatagttatagagcttcgaaggctgagaaaactaagtcatgaaaattggtgtagctcttctcattcatcagtatctacccaaagaatattggctcaacttctttatgaatctacaatactacctggaattcagcctgactggcgtgctagactatcacaatga

SEQ ID NO: 75596 - DNA, 450 bp, Glycine max
  Peptide Sequence Number=SeqID_192374
atgaagccttggaataagaaaccaagaaggcccgaaaggaagaacacgaccaaaacaagttttgaggggctttatagggcagcaatagtgagctcaagctccgaagaggtgaaaggaatcatcacggggaatacgtgggccatcatcgataagttcaaagagaagctaaatctagcggcgactcacgagcaaaggctagaggatgagtacgccaagatatcagtagaaagggaagcaagggaaagggtaattgattcattgcaccaagaggcaacaatgaggatgggccgatttgcttttactttgaacaggagtcaagaacttccccgattgctagccaaggccaaagcaatggcggacacctactccgcccccaaggagatccacggacttctcagctattgtcagcatatgatagacttaatggaccatatgattagaaaccgctag

SEQ ID NO: 75597 - DNA, 231 bp, Glycine max
  Peptide Sequence Number=SeqID_192375
atggtggaaagaaaagataaggagcttaggggaagtagtaatggtgtcatcagtggctatcataaatggttgaaggctcggacgcaagggataacttggctcccgaagctaaagagtccaagtggaggagaagctgaagtccttgaggagagcgaagaagtgcaagccttgaaagtagagcttgaaagaatgagagtggtcaaggaaaagctaaagatgacagtcatcagg

SEQ ID NO: 75598 - DNA, 649 bp, Glycine max
  Peptide Sequence Number=SeqID_192376
atgaaccagattcttaatgcatcttaccgctacaccgacgacccgcgccgcggctacagcggcaccagtccgcaggcgcgcaacggcttcgcggaaatcgctattgatggccagccgccgtacaccgtcaaggtcgacgcagagggccgctggagctggacgccgcccgccgactggacgccgggcgaacacatcgtgtcggtgcgcatgattgacgccgccggcaacattggtaatcccgcccagtttattcaggtggtcgactacacggcgccggacgcgccgcgcctgctcaatatgtacgatgaccagggcgacatcaccggcagcttcgacgccggacgcatgaccgacgaccgccgcccgaccctgaccggcgtcgcggaaaagggcactgtggtgtacctcaaagagggcgatacggtgatcggcagcgcgcaggccgacgccaccaccggcatctggacgctggagccggacgccgatctgagcgacggcacccaccagctgacgctggtggcggttgaaaccttcaacggcaagctgcgcgagggcgagccttctgcgccgttcgaactgctgattagccgcgacgggtctgccgccacggtgatttcccacgcggtggatgatgccggcccggtcaccg

SEQ ID NO: 75599 - DNA, 378 bp, Glycine max
  Peptide Sequence Number=SeqID_192377
atggtcatctgcaccctttccgaagatgtaggcatcttctggtggagactttttcaagtctcacaagttatccagaactacgtagaggcggcgggccagatgatacacggagataccttacgggttatccgcacccttttgtcatccagaggcgggggcccgatgacaagcagagacaaaatttggtcattttgcacccttgtatcatccaaaggcggcgggcccgatgatacgcggagataccttacggttatccgcacccttgtgtcatccagaggcggcgggcccgatgatacgcggaaatacccgagtggttatccgtataaacattcttttgctatctgtaagacagaacgcttgatagcatgcagaggctga

SEQ ID NO: 75600 - DNA, 222 bp, Glycine max
  Peptide Sequence Number=SeqID_192378
atggtacctggacattggctgctcatgtcacatgacagaataaaggtgcgtgttccaatgcctgactccttatcatggtggaatagtcatattcagaggaaatcagaagggaaagataaccagagtggtggatataatctcttattcaacaaagatgagcgtgttgtcctatgtaaagatgggtctcctctattctctgccaagagaaaaggtaacctctaa

SEQ ID NO: 75601 - DNA, 1001 bp, Glycine max
  Peptide Sequence Number=SeqID_192379
tacgaagcggcggaatcactggcgctcggttactggaaaacgcaggggctggtcattcttccacaagctctcaagctggttatcccgggactgcgtgcaacaggccaccgtggaccctgtctggctgggcatgtccacagaaggatatgtctttgcagcccttatctactggatcttttgttttagcatgtcgcgctacagccagcatctggaaaagcgctttaacaccgggcgtacaccgcactgaggaaattatgagccaaataactatgacacccgccgacgcgatgattacgctggaaaatgtgaataaatggtacggacagttccatgtcctgaaagacattaatctcaaggtaaagcagggggaacgcatcgttctttgcggcccttccggctccgggaaatccacaaccattcgctgtattaaccatcttgaagaacatcagcaaggacgcattgtggttgatggtatcgagctgaatgaagatatccgcaacattgaacgcgtgcgtcaggaagtgggaatggtattccagcactttaatctttttccacacctgaccgttctgcagaactgtacgcttgcgccaatttgggtacgaaagatgccgaaaaaggaagcggaggcgctggcaatgcactacctcgaacgcgtacgtattgcagagcatgccaataaatttcctggtcagatatcgggtggccaacagcagcgcgtggctatcgcccgctcgctgtgtatgaagccgaaaattatgctgtttgatgaaccgacgtcagccctggatcctgagatggtgaaagaggtgctggataccatgattgggctggcacaatccggcatgaccatgctgtgtgtgacacatgaaatgggattcgcgagaaccgtggccgaccgggtgatctttatggatcgcggggagattgttgagcaggcaccaccggatgagttctttgcccatcctaagtcagaacgcacgcgagccttcctgtcgcag

SEQ ID NO: 75602 - DNA, 531 bp, Glycine max
  Peptide Sequence Number=SeqID_192380
atggttgcattggatgcctttggagtttcgtccatgacaccaatgttgccttcttcttttgctgagcttcatggagctgggtcacatgagctatcatctgttcttcagtcattgtctttagattataagtcccctcctattgaatggtgtaggattaccattaagggttcccttggagcatcccttcttaaccagtctagatggatgaaggatggagatggacatggtagtgtagatggaacatgtttgcggagaggaaagataaaaactacctactctttctcaccaatcttgggattggctttggtcgccctcttcttgatgtgtcttcgtatcatagaggggatgacaaattcacgtggtttagaggctggtgggactttcttagctctttttgggacaggagaaatcagggcaactattttcctcttctggaaggaaacttgtatgaagccttcatcttcttcattagtcttacttaggtctttcaacctttgtggaactgaggttgtagttcgctggactcagtag

SEQ ID NO: 75603 - DNA, 414 bp, Glycine max
  Peptide Sequence Number=SeqID_192381
atgagggttcactgttatcaagcaagtcgaagacctagcatgatcacagattcgccttcactccttatgttcccatggactcggtccccagtggagtcgccaactgtcgcaacctacccatcagcaagagggcgacacgagggcttacggatgcgtcttccaagaaaggaaaatgcacggagttgccaccaacgtttattcgaggaaaacgtcggaaaaaccggaaaaggatgtggtctacgaactttaagtgtgaaaggttcgggagttgtatttacgcacggggaagggttatgggaattttacggaagcattacgggggtcccggaagctccggaagccatttttttaacaaaacgggggaggtggttgccacccacctcgcccaggcgagctaggttgcttccaccttaa

SEQ ID NO: 75604 - DNA, 426 bp, Glycine max
  Peptide Sequence Number=SeqID_192382
atgtaccctccactagaattgatccacaagagatgtaccctctcttttctcattcaaacccaagtagatgtaccctctacttgtaccacaaaggatgtaccttccaatgtgttaagacaaaaatctcaggctgttaaacctttgatactttgtgaatggggatacaaaagaattctcaggcgggagaagggaaatacaaaagaattcaggcggttagtcctttgttcttttggaaaagggagaagagagatacaaaaagaattcaggcgattagtccttggcgaattctttttggcaaagggagaagagaatgaaaagatgaatagcacaagttttcaaggtttggaaaaccaaaaaacttcagaaagcttttggtacaaagaagaagaagaagttcaaagagattcagggcttgtaaaagattga

SEQ ID NO: 75605 - DNA, 231 bp, Glycine max
  Peptide Sequence Number=SeqID_192383
atggttggagcattctcgcaaaacatcgtgaccttgactggtctccctatgatcttacttagtgagagtgatctaacaaacccattgtgtggtgtgtcttgttatgtactcctaagcgccccagggtggtttttcactgacatggaatgtgacaactcacttcctgtgtgttatttgtgtttggatcctgtgatgatcttgaactttgtgttcgggggagcagatgaccag

SEQ ID NO: 75606 - DNA, 169 bp, Glycine max
  Peptide Sequence Number=SeqID_192384
atggactacagcaggagcagcaaatggatgatgggtcaaccgcacgcgtcagcagctcgccggcggcgacccgccaccctggcggccgcacgtgcggccgccccggcccggccaggagacgctggagcagaccctggccggcgtgcgcagcaagatctacccgcgctcg

SEQ ID NO: 75607 - DNA, 240 bp, Glycine max
  Peptide Sequence Number=SeqID_192385
atggatttgggaggtcttggagtaacaaatattgaggtggttaatgatgtcttattagggagatggagatggaatttgttccatagatccgatggggcgtggaaggatgtgcttatgtcaatgtgtgtgggggatctaggcaagaaaaatggtttgataatggaatccggtggaaaattggaagaagtgagaaagttagattttgggaggactcgtgcctggaaggaaagtgtttggtaa

SEQ ID NO: 75608 - DNA, 647 bp, Glycine max
  Peptide Sequence Number=SeqID_192386
aattcatcacttccactaccgcctcaaccgttggcaaaaccatcctccacctcgaccctaactcattctatggtagccacttcgcttctctttccctccacaacctcacttccttgcactccctcccctttgccgccgccacaaccactaactctgatgatgtcattgtcatcgacctcatccaccaacccctctgctccgacgtagaaattgtgacctacgatgaatatgcatttctcaacaaaaaatttagtatcgatttgggaggcctgagggcattgttctacgtggacaagatgattaatctgttgatgaaatcaggcacggcacaatatttggagttcaaaggaaacgatgagagcttcgtctacgaagctaatgcagaaactaagcctgaaagagtaagggaaatcaaggtgcagtgcattggactgttaggggatgtagcagcggtgaaaggagagttgtggttgttgcgatgtgagcacataggtggtgaggagttgaagatgaagcttggggcacccaactttcatatgcttgactatgcagatatcttcagagcaactcctaataacgatggtagcaaatttactacttggatgaatagggttgagttgacttatggagacttatggagaaactag

SEQ ID NO: 75609 - DNA, 486 bp, Glycine max
  Peptide Sequence Number=SeqID_192387
atgagtttggctaaagatgtgaaagaaaaagttgagagagggaaggacgacggaggcaagttcgagatacaacctagaggactcaacattgtgtggggaaatgattctcgatactggaaaattccagaacaaggtcctgcggagctgatccaagtttcatggttggaggtatccggcgtggtaaacttaccaggtgtcaagaaatatagggttgaattcgaagtgagagttaaagacgatgggttcggttggagtggcacggacgtgctagtgatggctaagattgggaaaacgggaaaatatacgtataaggtgacgaaactaaaccctggtgaaaccttgaatattccaaaatcaactgacccacttgagattcaagtgaacaagcaatctgaggaccttcactttggattatatgaagtgtggagcggaaaatggaagggaggccttgaaattgtcagagccctcatcaaacctttaacttaa

SEQ ID NO: 75610 - DNA, 870 bp, Glycine max
  Peptide Sequence Number=SeqID_192388
gagaagctcctgggtgagaagaccaagaagaagatgcaggaaggtgcacagtcaggaagggttgatgggaagccacgtgaagtggaagatggcccgcacgaagaagaaaggggagagacgactgaggccgcaaaggaaatcgctgagaagattgccacacaaggatcgttcgtctcccatggacgtcaggatgttctggccgctgctattggacgtccagagcaccctggacgtgtccgtgctgctggagccggtgtcaccatcaagcaatactttggattggctccacggacggaccagctagaggagtccatcacagagaaagtgacgaggcaggtcatggaatccttcagccagcttcagtcgcagatgcaatctcagggacttgcagtgcctcctgagcctgtggttggtccctcaggtcctcgagtgagcacaaaggggagttgtgttgatccctcaggaaacgatcctgagacgggtgactttgacaggtgcggcttgtacatagaagcagatcctgcccgcctggttgccatggggagagtttatgagggatccactgttgttcataacactcctttgttgcctggccaagtaaaggtgagtgtggaggaggttacagatgcatatgctccaattcctgtacccactaatgaggtttccttagcggggcaggcacttcacaccttctttgcttggccaacacatctggtcaagtctttatcacaacaggtagttgtgtctccggcaaaaccacctccgaagcccgatccggaggtcgatgatccgctttatctgatgacattgaccatcccagagcttttcttgaggccttatcaggttagatgggatgccaccgtgttcggg

SEQ ID NO: 75611 - DNA, 284 bp, Glycine max
  Peptide Sequence Number=SeqID_192389
tgtcatcccccagcaaggtaatccgaccgtcgatcacccgaactttcattgagaagtactacacgcctaggcaggcacagggtgatgcacatcaggccgcgggcgcactgccaccacctcgacaggccgatccgtttggggctgaggtcgcatggcctagagactggcccgatgcccaggcaggggaggagcctgcaggatcccccggtggggcggatgagtcccatagggatgaagatatgactgacctgctcggtttcttgggagggagcggagccacatga

SEQ ID NO: 75612 - DNA, 513 bp, Glycine max
  Peptide Sequence Number=SeqID_192390
atgtatctggccaacgaaggcgactcggacggtattaaggagctcttggacgccgggagtgacgtcaatttcaccgacattgacggccgcaccgcgctccacgtcgccgcctgccagggccgcaccgacgtagttggcttgctgctccgacgaggcgccgacgtcgatcctcaagaccgctggggcagcacccctctagttgatgcaatgtactacaaaaatcacgacgttgtcaagcttttggagaaacacggtgcaagacccccgatggctcccatgcatgtgcaaaatgctcgtgaagtcccggagtatgagattgatccttctgaacttgattttactaatagcgtttgcataacaaagggaacttttcggattgcattatggcgtggaactcaggttgctgtcaagacacttggggaggaattgttcactgatgatgataaagtgtgggttggtctacttatgcaagctgtcgtttcattcatgtcaattggattattcaattcttaa

SEQ ID NO: 75613 - DNA, 273 bp, Glycine max
  Peptide Sequence Number=SeqID_192391
atggttagtgacctcgcagtcttgctcccaaccctaacacaactcgtagtcttgcactcggcacagcagccaatactcaagcttgctcatccttggcctgagtggttccaactcatgaagtgcttgctcgacaagggatacttctgtcgtgaagagggaaaaatgttatgcaatgctggtatgggcatgaaggatttcaacgtcattagaaccaagtttggccgtgcttcagaactctgtcagactgtgatattcaattggacaagaacctag

SEQ ID NO: 75614 - DNA, 372 bp, Glycine max
  Peptide Sequence Number=SeqID_192392
atggaggattcaatcgggaaaataacaaagatcacatttcccagtcaagagggtccgctcttgacggtgaagaacacattggagattggaggattcaattgggaaaataacaaagatcacatttcccagtcaagagggtccgctcttgacgggtctgctcttgacggtgaagaacacattggagaatggacgaatccaatcgggaaattaacaaagatcacatttcccagtcaagacgggttcgctcttgacggtgaagagtacattggagatggaggattcaatcgggaaaataacaaagataacatttcccagtcaagagggtccgctcttgtcggtgaagaacacattggagattggaggattcaattg

SEQ ID NO: 75615 - DNA, 701 bp, Glycine max
  Peptide Sequence Number=SeqID_192393
caaggtcaacgccacgccggacgcgacccctgcgcaggctacggacgacgccaccatgctggccgaccgcgactatccgctggtggccgatgctgatctgtatgcgtggaccgctgctggcggcccgctgccgaccctgctcgccagcctgctgctggccctgccgttgtcgctgtccgccgcgccgcagaccttgaacgtgccgctgccgccgccagtgccgggcagttcaccggcggctacggccccggccaccacaagcacgacacccgccgcgttcgcccagcttgacgccccgcagcagcgccagcgtcgggccgattacgcggcctggcgcgccctgccggagggcgagcgcgagcggatccgtcaggccgctgcgcgattcaatgcactgccagccgaccagcagcagcgcctgcgccagcagttccaggcgcaggaccaggcgttccgcgaaggctggcggttgggcccgcagctgggcctggagttccccaagctgcacggcctgttcgggttcgtgccgccgcaacagcgcgaggccgcgctggccgtgctgcgccagctcagcccggcgcagctggcccagctcaccctggtcgcgcagcgcacgccgccgcaggagcgcgacacggttcgcagcgcgttcctcgcggtgccggccgccgagcgcgacacctggctcaagcgccaggcgg

SEQ ID NO: 75616 - DNA, 294 bp, Glycine max
  Peptide Sequence Number=SeqID_192394
atgcgagcgggaaattctgttctgtatggattcctcgagccacagtccattcaaaggtctgggcaatcgcagtttgaggctgaaagttacataaagagttcaaaacgtgatgtctaccttggagcctacctgaatgggcccgacaactaccttaaggggataattaacagtgctttaaaaggtcttgatggtccacatcctaaatcaaaggctcctgctaggtggattgtcgtcaagtattttaacgatcttagaccattggagccagagagattaaaggtgcttcagatctag

SEQ ID NO: 75617 - DNA, 165 bp, Glycine max
  Peptide Sequence Number=SeqID_192395
atggcacgtagcgtgtccgcttcgtgcccctattcaagggacctatatgggagagagctaaaaagattcacctccactccttatgttcccacgaacccgggtattggaccctttttcaactcactgtgtgtgcaaatagtgttggtgtttgtgtgcatcaaatga

SEQ ID NO: 75618 - DNA, 450 bp, Glycine max
  Peptide Sequence Number=SeqID_192396
atgaagtatcttagaggaaccttacatgtcgacttgtggtaccctaaaggtgttgagatctctctataccgccgtgccgtaggctaccccaccgtggttgccagctgtgtcgtgagagtgagaagcagagggctatcccgccgtggttgccagctgtgtcgtgagagtgagaagcagagggtaacgaggaaggtgaagtggttcaatgaccagaagggagtgggtcgcgtctacgacgtcagcactggaaaatccttttacggccccagcggcccctacgccatgtttgccgtcaaagacgccagcagagccctggcgaagatgagcaagaacgacgatgacatctccccctccctcgacgacctctctgacaaggagatcggtgttctcaacgactgggagaacaaattccaagctaagtaccctgtggttgctcgtgttctcaattaa

SEQ ID NO: 75619 - DNA, 1719 bp, Glycine max
  Peptide Sequence Number=SeqID_192397
atgatgggcagagatagtagtgttatgaaggcatgggaggcaacggtgagaaagacacaagcggtggccaagaagcgcgcaaatagcatatttgggtcaacatatgtggcccatgcagaagaagaagaagaccataaggaagacacaaatggaagcgaggcatctgaattgtaccatgcagagaaggttctcccgaatggggattactacaaaggagaatgggtagataatttcccacatgggatgggtaaatatttgtggactgatgggtgcatgtacgttggagaatggttcaaaggaaaaactatgggaaaaggaaggttcacttggcccaatgggcccacttatgtaggggaattcaagagtggttatatggatggaacgggaacatacgtagcctccaatggggacacttataaggggcagtgggtcatgaacttgaaacatggtcacggtgtcaagaatttttccaatggagacaaatatgaaggtgaatggagaagggggatgcaagaagggcatgggagatatcaatggaaggatgggagctatgttggtgagtggaggaatgggagtatttggggtaaaggttcatttgtttgggatgatgggaataggtatgatgggtattgggaagatggtttgcctaaagggaatggaacttacaaatgggatgacggaagtttttatgtggggaattggagcaaggatccaacggatcaaagtggaacatactatccaagagggtcatcacaggaggctaatcttgagtggaatcctcaagaagtgtttactaagttgagtgagtatgcaatttgtccaggggagaaggtttcaattttaccatcacaaaagaggcttgcagtgtggaggtctacaaagggaggggatggtgctaagccaaggagaaagtcagttgatgggagggtaagcgtagggctagagaagccaaatgatagaatgcaattatggggtggtgtagagggtgattttagtggtactaaaactccaactagagggggggttgctgtagatgatgaattgttaggtttaagcatagatggtgctatttcaagagagactcaactccaaaccctgaaagcaccaaggaaatcaaagaggcagggggagaccatatgcaaaggacacaaaaattatgagctcatgctcaatttgcagctgggaattagacattctgttggaagacctgccccttcagcatcacttgatctgaaaccttcagcttttgattccaaggagaaagtgtggacaagatttcccactgaaggatccaaatacactccaccacatccatcatgtgagttcaaatggaaggactattgcccagtagtgtttagaactcttaggaagctattcaaggtggatgtagctgattacatgatatctatttgtggaaatgatgcccttcgcgaactttcctctcctggtaaaagtggtagcttcttttatctaactaatgatgatcgctacatgatcaagaccatgaagaaagctgaggcaaaagctctcttaagaatgcttccagcttattacaatcattttcgagcatttgagaatgccctagtgacaaagttttatggtctacattgtgtaaagttaactgggccagctcaaaagaagagcaaacaaaaacaaagaaaaagtaaggagaccgaaccaaagccaccttatcaagctggaagggcaaacctagagtaa

SEQ ID NO: 75620 - DNA, 420 bp, Glycine max
  Peptide Sequence Number=SeqID_192398
atgagacaagaaggaatagtggaatgtgctttccgttcccaattgaagatcaaaaacaaaggtggcaaaaataagaaaaaggaggaagctgaagaaggaaaccaaaacaataatccacaatcttttttgccatgtccttactgcaaaaaagctaatcactcaccaaagagatgttggtggaggcccgatgcaaaatgctacaaatgcggtcaattaggaaacttggagaagatatgcaagtcgatcatcaacaacaaaatttatcaaaatcttttaagtgtttctcaactattggatcgagaaaggctacaagacttaaacagcatggaagtgatcaaagttcagatgaaaggcaagagctttgctttaaatttgatgcaagaggagctgactatagatgaagaagataaaaaagaatag

SEQ ID NO: 75621 - DNA, 333 bp, Glycine max
  Peptide Sequence Number=SeqID_192399
atgaggattgagagtgctcattggtcattaaagagacttctacaaaacagttttggtgacatatgcagtgtttgggaagcaatgaacatgatgacacttcaacacacccaaattaaagcatcttttgagacaaacaaaaacccttcacgttgtagatgtgtcatgaggactacccatggtctttcatgtgcatgtgagttgtctaaatatgttgttggctccataccaatagagacaatccacattttttggcgtagactcagtttttcagatcaagggttatgtgaggctgaggtgaccataactgaggagatggaaatcatatcaaaatga

SEQ ID NO: 75622 - DNA, 252 bp, Glycine max
  Peptide Sequence Number=SeqID_192400
atgatattgcatgagattagaaggcctaactctctgaaaacaatccctagtggagtcgccaactgtcgcaacctacccttcgacgagagggcgacacgggactcacgggtgcgtcttccatgggaggaaaatgcacagagccgccaccaacgtttattcgaggaaaacgttggaaaaaccgaaaagtcatgcgctaagccaagcgtacctgagctaagcgcattgcattgcagcaacccttgggctaagtga

SEQ ID NO: 75623 - DNA, 211 bp, Glycine max
  Peptide Sequence Number=SeqID_192401
ggattgtgcccacaagacacccagtggacccgaagaagtccaacagggtcttggagttgccagctctgattacgggcctctgtcatcaggccccctactaatcgagctttcatcaagaagtactgcgcccccaggcaagcgcagggtgaaactccacagcagcctagggatggccggtagcgggcaacaaacgcactaccaccacctctag

SEQ ID NO: 75624 - DNA, 292 bp, Glycine max
  Peptide Sequence Number=SeqID_192402
tccttgtggcgtctacccagacttatcttccttcactggaagtggcgtctacccagacttatcttccttcaccggaagtggcgtctaccctgacttatcttccttcaccggaagtggcgtcatccaaaagctctacagcctgtatcaagcgttccgccccgtaagattcacatcatctggtatcagagctttggctcttgatacagcctattcgaattctgtttggggtaaaaattgcctaattgctgaattgctaaattgtcaaatttgcctaatgatgattgcctattga

SEQ ID NO: 75625 - DNA, 1295 bp, Glycine max
  Peptide Sequence Number=SeqID_192403
aggtctacacatccttgccttcaaaggacaacacatcctcgccttcagaggtctacacatcctaactttccgagggctgcacgccctcaccttgagagggctacatgccctcgccttcagtgggctacacgccctcgccttcagaggactaaacgtccttacctttaaagtgctatgcgccttcatctccaaaggactacacgtcctcgccttcagagggctgcacgccctcgccttcagagggctgcttgccctttccttcagagggatacatgcccttgcctttagaggactacacgtcttgaccttccgagggctacacgccctcgcctttggaggactacacgtcctcatcttcagaagactacacatcctcgcctttagaggactacacgtcctcaccttcatagggctgcacgccctcacctctagagggctacacgtcctccccttcagaggactacacgtcctcgcctttagagggctgcacgccctcgccttcagagggctacatgccctcgctttcagaggactacacgtcctcacattttgggtactagtaccctcgcctttagaggactacatgtcctcgccttcagaagggctacacatcctctccttcagaggactacacgtcctcgcctttagagggctgcagaccctcaccttagaggactacacgcccccgccttcagagggctacgcgtcttcaccttcagtgggctacacgccctcgccttcagatgactacattcctcgccttcagagggctacatgtcctcgccttcagaggactacacatcctcgccttcagagagctgcattagtttccttttatcagttcctgggccacccccgtgatctcaaaggagggccaactgtgcaatgcacaaccagaggatggggtagggatcgtgcccgtaagacacccagtggacccgaagaagttcaacagggtcttggggttctagctctaattatgggcctctgtcagttctacggagtgcccgtcgcccccaacaaggtcatcagggcgaggcaccacggaagcctagggacggccagcagctggcggcagatgcaccaccaccacctccagaatccacctcagctcatctacaaaggctggaacattgcctatgacacgtggccgaccatcgggcgaccaaccacccaggcaggaagggcaccattaaagaggattccagtgtggccccacaagctgacacaggctttgacaaacaccgattctagagcatggaacatcaatagcatttcgaggccatcaaaggatg

SEQ ID NO: 75626 - DNA, 183 bp, Glycine max
  Peptide Sequence Number=SeqID_192404
atgggagaaaacgagtggagtcgccaccaacgtttatttgaggaaaacattagaaaaaccaaaaagaggtctgtgaatttcgaaaatgagggttcgggagttgtttacgcatggggaagaaagattgattttaattgcgaacaaaagtcatttaaggcattggaccttgaaacgatgttttag

SEQ ID NO: 75627 - DNA, 1270 bp, Glycine max
  misc_feature (1228)..(1228): n is a, c, g, or t
  misc_feature (1267)..(1267): n is a, c, g, or t
  Peptide Sequence Number=SeqID_192405
atgccgacgcgctgcccggtctgtggctcggagatcgtgcgtgaggagggggcagcggcgtggcgttgttcgggcgaactgtcctgcccggcgcagcgcaaggaagccatcgcccatttcgcttcgcgccgcgcgatggacatcgatggcctgggtgacaagtacatcgaaaccctggtcgacgccggcatcgtcaagagcgtggccgacctgtaccgtctcagccgtgaccagctgctgcacctgaaactggtactggacgccgaggatccgtcagcactggccgctgcgctgaagctgcatctgtccgccgagggcagtggtgcggtgctcaatgcagtgctgaagctggacggcaacgatccgggctggcgtgcgcgggcgctggtgcagccggccagcttcgaatggaacccgaagaagatcgccaccaagtgggccgacaacctgatcgcggcgatcgacgccagtcgtgctgccacgctggagcgcctgctgtttgcgctcggcatcgagcatgtgggcgaaagcacggccaaggcgctggcgcagtggttcggtgacctggagctgatccgccatctgccgtggccgttgttcaagcgtgtgccggacatcggtggcgaagtggcgcgctcgctcggccatttcttcgagcagcagggcaaccagcaggccatcgatgacctgttgcaggttggccaggtgcgcatcagcgatgtgcacgcgcccagtgccaagctgcgcgagggcctggatctggcgcagttgttggtcgagtcggagatccccggcattacccgcctgcgcgcggaaaagctggtggctgcgctgcctggcgcgcaggcggtgctcgacgccgagcatggccagttcgtcaacgccggcctaccggacgacactgcgcgcggtctagcggagtggctggacgccgaaggccatggcgcgatgctgttggccgccgagaagtgcgatgcagcagatcctggccaatgcgccggcgctggccgagatcgttgcgggcccgctggacgggcagaccgtggtactgaccggcaccctggcgcagctcacccgcgatgccgccaaggagcgcctggaggcgctgggcgcgaaggtctccggcagcgtctcgaagaagaccagctttgtggtggccggtaccgaggcaggctccaagctggacaaggcacagtcgctgggcgtgccggtgtgggacgaagaccgnctgctggcctatcttgccgaacacgaatgatgaccccgncgg

SEQ ID NO: 75628 - DNA, 303 bp, Glycine max
  Peptide Sequence Number=SeqID_192406
atgaacgcttggctgcacaagccagtatcctgtgatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 75629 - DNA, 154 bp, Glycine max
  Peptide Sequence Number=SeqID_192407
ggttttatgcgatttcaatgtgaaggttcggttttatccgttccttgttctgtttgattctcagattttggatactgatatcgcaattgatgatggttctgttgatttgatagcctcgtgcaaggaaggaatgactaattcgttcgacgattag

SEQ ID NO: 75630 - DNA, 239 bp, Glycine max
  Peptide Sequence Number=SeqID_192408
ctgaagcactagaacatacgaagaaaagagatacaggccatcaaagtgtgtcatttgagaataagacaggagattcaactgtgctgaagataggaaattcggctaaagtcgtgataaaacaagacatgaagggaagaaagcataaatatgggtttaacaataataaacgagagaagatagtgaagaaaagggtggtggatgatgaaacggcgacaaacatgagctatatgaagtcctaa

SEQ ID NO: 75631 - DNA, 2253 bp, Glycine max
  Peptide Sequence Number=SeqID_192409
atgggttccatcttttcacccttaaccactatcttcctcctactcctactcgtactttggggtggcgaggcacgtgacccttttgcttgtgaccctaagaacaccgccacaaaaaacttaccattttgcaaggcttcgttggcaacaggggcaagggtgaaggacctcattggaaggttgacactgcaagaaaaagttaacttgctagtgaacaatgccgcggcagtgccacggcttggtatcaaagggtatgagtggtggtcggaggcactacatggggtctcaaatgtgggccccggaaccaagttcggtggccagttccctgccgccactagcttccctcaagtcatcaccaccgctgcttctttcaatgcttctctgtgggaagcaatcgggcgggttgcctcggacgaagcaagagcaatgtacaatggtggaacggctgggctgacatactggagcccaaacgtgaacatctttagggacccacggtggggccgcggacaggagactcccggtgaggacccaatactagccggtaaatatgcagccagttacgtgagggggcttcagggaactgacggtaaccggttaaaggtcgctgcctcttgcaaacactttacggcttatgaccttgataattggaacggtgtggatcgctttcactttaatgcacaggttagcaagcaggacattgaggacacgttcaatgtgccattcagaatgtgcgtgaaggaaggcaaagtggcgagtgtgatgtgttcttacaatcaggttaacggggttcccacctgtgcggaccccatcctcctaaagagaacagttcgtggccaatggggtcttaatgggtacattgtatcagactgtgactctgttggggtgttttacaatagccaacattacacatctaccccagaagaagctgctgccgatgccattaaagctggctacgaagctgatgtgaatggggctttattgaacacattaacagtccaaatgaggttagggatgtatgatggtgagccatcaagtcatccatataacaaccttggtccaagagatgtgtgcacccaaagtcaccaagagcttgcccttgaagccgcaagacaagggattgtgcttcttaaaaacaaaggtccttctttgcctctctccactaggcgtggccgcactgtagctgttattgggcccaattctaatgtcactttcacaatgattggcaactatgctggtattgcttgtggatacactagtcccttacaaggaatagggacatacaccaagacaatttatgagcatggttgtgcaaatgtggcttgtactgatgacaagcaattcgggagagccataaatgcagcccaacaagcagatgcaactgtgctagtgatgggcctagatcagtccattgaggctgaaactgtggacagggctagcctgcttcttcctggacatcagcaagaccttgtgtccaaagtagcagctgcctccaagggcccaacaattttggtcattatgtctggtgggcctgtggatataacatttgcgaagaatgatcctcgaatccaaggaatcttgtgggccggttatcccggtcaagctggtggtgccgctatagcagatatcttgtttggaacatctaaccccggaggcaagttgcctatgacatggtacccacaagggtacattaaaaacttgccaatgacaaatatggcaatgagagcaagccgaagcaaagggtaccctggaagaacctaccgattttacaatggcccagtggtgtatccatttggttacggattgtcttacacgcactttgttcatacattaactagtgcacccaaattggtctcaattcccgtggatgggcaccgccacggcaacagctccaacatcgcgaacaaggcaattaaagtgacacatgcacgatgtggcaagctttccattaaccttcacgtggacgttaaaaatgttggctccaaagatggcattcacacgttgttggtgttctcagccccacctgcgggtaatggccattgggctccacacaagcaattagtggcttttgagaaagtccatattcccgccaaggcccaacaacgggtgagagtcaaaattcatgtttgtaagctcttgagcgtggttgaccggtctgggactaggagaattccaatgggtttgcacagtcttcacattggtgatgttaaacactccgtgtcacttcaggcagaaacacttggaattatcaagtcctaa

SEQ ID NO: 75632 - DNA, 543 bp, Glycine max
  Peptide Sequence Number=SeqID_192410
atgggaaaccaagtctcagaagtgaggggcaaaatagtaatgtgggatggttcggtgcaggaaatagagcaacctttgacagtggcagagttgatgctggagcacccagagcaagttgtggttgagttgcattcagcagtgaagcagaaaagggcaacaccattgccagcagataacaagttagagacaaacaaggtgtatctgatgcttcccattaagcgagggaagcccgttggattaagcggggaagacactcggcgcattctcttgatccttaattctgctctgcaccactccaagtttgttccctggctcacgcgtctgtgccagaacactactacaattgtcgaacctcagagaaaggaaataacaaaacaagaacaagagagctgccagttgtttttcccggaaatcttggaagggaggcctgaatatttgaataggcaggtttcagggaaagggtggaagcctactctggacaccattaaggagaataatattgacagaaaactcactcactggttgttcctcaagaccttttag

SEQ ID NO: 75633 - DNA, 702 bp, Glycine max
  Peptide Sequence Number=SeqID_192411
atgcctaaatatgaccctgaaattgtcatggaattttatgcaaatgcttggcctactaaagaaggtgttatggataagcgctccaaagtgcagggtcaaccgattccttatgacacagatgccatcaaccaattgttagggaatccattgatcttagaggaggggcaacaatgtgaatataccgcaagaagaagacgtgattttgtactaagcatggcagggaagcggttaagagtcatgcataccaacatgatgactttgactcaaatctggatgactttccttctcagtaatatccttctgagtgaccataactctgatcttactctacctaaatgtcagctggtctacaacattatggagcatatcagtgttcatgtggctcaactcattttggatgctatccatcagtttgttggtactaaacctccaaggcacccagtggacccaaaaaactccaacaaggcattgggatttcctgccttaaatataggtctctaccatttctatggagcaccgatcacaccaacaaaacacattcggcctccaattaacagatcatttattgaaaaatattacatgccaaggcaggaggaggcaagacctgcagatgctcggggtgctgcccaaggagatggaggaagagctgaggatgatgaagacatggtggatttggttcattatttcattggaggagactga

SEQ ID NO: 75634 - DNA, 1056 bp, Glycine max
  Peptide Sequence Number=SeqID_192412
atggcctttttgcaacaggaggctcaaaatatctttaaaagtctcttccaatccatagaaagatgcacccctagtagcttggtccttcatgatatccctaaggtatctcaggattttcatgattctctacttaatcttgttaccagtgaggaagtttgttttgcaaccttttccatggcaccttacaaggctcctggagttaatggttttcagcctattttctatcaatcatattggcatattattagtgatggtgtttggaggttggtgaataaggcattctatacaggtagcattcctcctaaacttgatgagactctcattgtcccagtacttaaagttgataatcctacatcttttaggggctttaggtctattaatttgtgcaatgttattttcaacgttatttgtaaggttcttgtcaatagaatgagacctcaccttggcagtataattggccctcttcaaagtagcttcatccctaatggaggaacatttgataatgctatgattacccattatatgcacaagaagaaagggaaatatattggattcactatgttgtctggtagagttacaagtcaagactttgcctatgtgatggatcgtattaattccaagcttgctggttggaaagggcattgtcttaataaggcgggtatggttactttggctaaatctgtgttggcaacaagttatacttacaccatgcagaatttgtggttccctgagggcatttgtgaagaaattgattctattgtgaggaaattttttttggaaaggtatctgcaaaaggagaaatgtatgttggccccaaaagtttggtctatcatccatcaacctcaccatcttggggttcaaatgggggagatttctttgttctttgataaattcatggatgatggacctattactcaacttattgactatgttcacatttcttgtggaagaaatgtcttccaagattattttgatgatgtcaaagaatcaagagttaagcaaagtatcaagcaaagattcaagaatcaagtttcaagtttcaagattcaagaataa

SEQ ID NO: 75635 - DNA, 117 bp, Glycine max
  Peptide Sequence Number=SeqID_192413
atacttggttctggggaaagcatgttgccacctaggcctaatggaagacgcaatggtccttctccaaaccggcaaacgcctagccaccgccgcattccgccgcgagagcgtgtgctg

SEQ ID NO: 75636 - DNA, 237 bp, Glycine max
  Peptide Sequence Number=SeqID_192414
atgcatttggaccagacattggaagctacagagcccggtttactacctctgagcaaaaaagaaaaagagggtgacaaaattgtccatctgtacaagaaagcgacgaagcagagattcttagggggatggaggaatcagcagctcatcgcctcgtacttcaccggaatggagcggttgaaccccgattgcgaaagcaagttcccaaccaccgcaatatcgcggcaaaacaccccctga

SEQ ID NO: 75637 - DNA, 1041 bp, Glycine max
  Peptide Sequence Number=SeqID_192415
atggctagtccaagagccaacctcttgttcctcctatggcttctgtgttattctctctacgccattgccggaaagagctattacgacgtacttgaaatcccgaaaggcgcgtcggaggagcagataaagagagcgtacaggaagctggcgttaaagtaccatcccgataagaaccctggcaaccaagaagccaataagagatttgccgaaattaacaatgcgtatgaagtactctcggacagcgagaggagaagcatttacgataggtacggcgaagagggcttgaaacagcatgctgccggaggcggcagaggtggtggcggaatgggaatggaattccaagacattttcgcctccttcttcgggggaggtccaatggaggaggaagagagaattgtgaaaggtgatgatgtgcttgttgaattggatgcaacgctcgaggatttgtacatgggaggttccttaaaggtttggagggagaaaaatgttttaaagccagcatctgggaagagactctgtaactgtagaaatgagctttatcacaagcaaataggtcctgggatgtttcaacagttcacggagcaggtctgtgacaaatgtccaaatgttaaatatgaaagagatggtcatttcatcactgttgatattgagaaaggcatgcaagatgggcaggaagtgctattttttgaggatggtgagcccataattgatggagagtctggagatctaaggattcgtatccgaacagcaccccatgacctcttcagaagggaaggcaatgacttgcacaccactgtcactataacactggttcaagcacttgttggctttgagaagactgttaaacacctagatgagcatctggtggacataagcacgaagggaatcacaaatccaaagcaagtgaggaagttcaaaggagagggcatgccactgcatatgagcacaaagaaaggagatctttacgtcacgtttgaggttctgttcccaaactcactaacagaggagcagaaaacaaatataatagcaattattgattag

SEQ ID NO: 75638 - DNA, 4527 bp, Glycine max
  Peptide Sequence Number=SeqID_192416
atggaaactatgtgtttaaaatctgggatagttcccacgatctctattagtgggtcgctggacgcacgtgccaatccttcccaggtgagcacggtggggcgctccgcatcggataaaccgccgcagaggtcggtgttttcgagattttccttttggtaccctttggaatctctctggcctcgggggaacaacagcaggtacaaggggttggccctcgacgacgccgttttgtcggacaacaacgccgaagcgaaggccgttggagatgacggaacggaacggcagaccggaaactgggttttgaagattctgcatgtgaagtccctgtgggaggggaaacagcgcgatgaagaggagggatcggttcgtgatcaaactcaaaccaattacgaggaggaggaggaggtgtgtgaatgtgatgcttgcgatgaagtagaggaggctcaattcgatagaggctcgttttcgagaatgcttcggagggtatcgttagccgaatctagattgtacgctcagatgtcacacttggggaacttggcttacgatatacctagaatcaaaccagggaagctcttgaaacattatggtctgcgctttgtaacttcatcaatagagaagaaggaattggcagtggcagcaacagctgaaaaggatccccagaaagttcaaactgatgagaaggtagacgaaaaagaagagagaaaggatcctaagaacggtgaatacaagataagtgcaactgctgcttataatattgccgcctctgctgccacttatctgcattctcagactagaagcatatttccattgaaatcctcaaatgctgtggctggtgaaggttcacttgcagggaacaatgaaagccttgacagtgttaacatgctaaacacagaggtggcatctttgatggcaactactgattcggtgacagcagtggttgcagcaaaggaggaagtaaagcaagctgttgcagatgatctgaactcttcacattcaacaccctgtgaatggtttgtctgtgataatgaccagagtggtacaagattttttgttattcagggttctgagacattggcttcctggcaagcaaacctactttttgagccgattaaatttgagggtttagatgtacttgtgcacagaggtatatacgaggctgctaaagggatatatcaacagatgttgccagaggtacatgctcacctaaaatctcgaggctctcgtgctacttttcggttcactgggcattcccttggtggaagcttggcattacttgtgaatctcatgctgttgataaggcatgaagtgccgatctcctctctacttcctgtgataacatttggttccccatccatcatgtgtggaggtgatagtctgctagaaaagttaggtttgcctaagagccatgttcaagcaattacaatgcacagagacatagtaccacgagcattttcttgcaattaccctaatcatgttgcagaactattgaaagctgtcaatgggaacttccgtagtcatccttgtctcaataaacagaagctactatatgcaccaatgggtaatctgctgattctgcagcctgatgagaagttttcaccaagccatcatctcctgccatcaggcagtggtctatatcttttgtgttgtcctttatcagaatccaatgacacagagaagcagctccgagctgctcagatggtcttcttgaactcacctcatccacttgagatattaagtgaccgatctgcttatggatctggaggaagtgtacaaagagatcatgacatgaattcctacttaaaatctgtgagaactgtgatccgccaagaacttaaccagatccgtaaagccaagagagagcaacggcgcaaggtgtggtggcctcttttattacctcgtggagttgataccagcattgttgctgggaggactgagtatgaccgaggagtcaacaccttttcccccgaaggacgtttgtttcaggttgagtatgcaatcgaagccatcaagctgggatcaactgcgattgggttgaagaccaaagagggtgttgtcctcgcagttgaaaagcgcatcacttcgccgctcctggagcctagtagtgttgagaaaattatggaaattgatgagcacataggttgtgcaatgagtgggttgattgcagatgctcgaacacttgttgagcatgcacgggtggaaactcagaatcataggttctcctatggtgagccgatgactgttgagtccaccacccaagctctttgtgatctagccttgcgttttggtgaaggtgatgaagaatccatgtctcgcccatttggagtttctctcctcattgctggccatgatgagaatggacctagcttatactacactgatccatcgggcacattttggcaatgcaatgcaaaagctattggttcagggtccgaaggcgcagacagttctctacaagaacaattcaacaaggacctaacccttcaagaagccgagacaattgctttatccattttgaagcaagttatggaagagaaggtcactcccaacaacgttgacattgccaaggtggctccaacatatcatctttataccccctctgagtattatgcgggaacttttttggtggatgatgctgtgttgtgctacacttgtggccaagttgtacactcgacttactcatcgcgaatgtttcgcggtgttcgtttcgttctccgtggcttcaatcccgtcgccgaaaatcagatccggttcaagcttgtgaatggcggcggagtcgacgtaggacagtacggtgggagttgcacgcacgtcattgttgataacattgcttatgacgatcctgtgtgtgttgctgctagaaatgatcggaagacggttgtgaccgcattgtgggttgaacacagtgctgatattggaatgcctgttgatgctacttcggttatgtacagacctcttaaagacttagatggaataccaggtgcaaaggatttgataatgtgcttgactggttatctacgtcaggatcgggatgacattatgacaatggttggcctaatgggtgcacagttttctaagcctttggtggcaaacaaggttactcatctcatatgctacaaatttgaaggagagaagtatgagcttgccaacaaattgggcacaataaagctagttaatcatcgttggttggaagattgtgctgctgtttatttcttcagcttgaaggaatgggtgcttcttcccgaagacaaatataacaagagtggttttgaactagagacgatggtggaagaggctaaggattctgaggaagaggctgaagattctaagctgggacaatcagggggaagaaatagaaaacaaagcccccttggttctaaaattggtatagctgctactcctggattgtcgaaatcagtaagagaggcatctaaggccttaccagattctactggtctacaggtcttgccaaatgtcaataacggtgaaaactctttaaccattccaggaaataagagcagacctgatcaagactcgagctttcataatgttgatgactctaagataagctattgggcttctgatgtttctagacattctatatcatgtcagttacctgacaaatatgtaaagatcagtgagtctaagaatgctgattctccaaaggcacctggctgccaggatcttggcaatatgggaaatacaaattcgtctggtcagaagcctgctctgcatggcgacatctcagagtctaagaaattgacaagtgacttgagagcaccttctgcaagtgctgttggagttgcacattcaaatgaaaagcttagaactgtgagttattctacgaagaaccaaaacggatttactctcccaaggatcttagatgaaagctcaggcagagaaggcaacaactgtgataacaataaggttaaaagggctagtaagggtgtcaaatctatcagtgttgaagtttctgggaaaggaaatgattttattaaagaagatgagccaattagtttattgcctcaaaagaggataaatgaagcttcttttactaaattaaaatcgagaaagaagacttgtgtcccgtcagcaaatggtaaatctcaaggattaaaagtgacatctcaggttgatgagccacctgaagtcgatgactatttttctataggcaaagatggtataaataactcaaacacttgcttagttttgaaaccttcaggctctacctccaactcactggcatttgatgagcttttttcaagaaatgcaaacccagaatctgttcagtgtgataatgtctgtcagaattcaccaaaaacggctgttcagagcttaagtgaatctaaaattaatggcaagcctgatatcacagattctggaatgcaacaagttgatggggatgaagcagagcaacataatgtcactagaaatctagattgttcttctctgggaaacaaaaagtcatgtaatgtggaatctgctggttgtactaaattggatttaatcactgaagaaagtaataaactg

SEQ ID NO: 75639 - DNA, 228 bp, Glycine max
  Peptide Sequence Number=SeqID_192417
gtgtccaggaaacgattgttcattgttttgggtcaggtctgctgggtctgggttggatattcttcaaggagggatgggggatacgtccttgttgggttggttaaggaggaaggtttatcagcacgggataatcatctcgatagttatttggaatgcgtggtgtgctcgcgataggttaatttttgagaaccaagctaggaatctgttgtggggagtgtttgcattcag

SEQ ID NO: 75640 - DNA, 411 bp, Glycine max
  Peptide Sequence Number=SeqID_192418
atgatgtacaaaaaggatattttaataaaaattctagtaataagattatatgattcaattaaagatcaatttttctcgactagacataagaagggctctctgacatggaactcgatcactaaagctatggattgtttggatgaagggttctctatcaagatgggagagagagtctggatattttgtatgactcttgggttcttaaggaaccgatggctacttaggtgccttgggtggatattcatgatgtggggtatacagtccaagacctttgggaggaagatggttggaggttggagaagctttaattacactttgcttcctgatgatgttaagcagaatatcctaaccttgtgccccaagtttgttccaagcatgcctgatgtttggatatggaactggaatacgtag

SEQ ID NO: 75641 - DNA, 285 bp, Glycine max
  Peptide Sequence Number=SeqID_192419
atgggaagggctccttgttgtgagaaagtgggattgaagaaggggaggtggacagcagaggaggatgagatcttggcaaaatacattcaggccaatggggaaggttcttggaggtcattgcctaaaaatgcaggattattaaggtgtgggaagagttgcaggctgagatggattaactatttgagagctgaccttaaaagaggaaacatttctgctgaagaggaaaataccattgttaagttgcacgcttcttttggtaacaggttagtgccagtggcatattga

SEQ ID NO: 75642 - DNA, 390 bp, Glycine max
  Peptide Sequence Number=SeqID_192420
atggaggagtctcaagcccttggaattatcgccagcaatgatttcttccttggcgtgtggaacctatactgtaggaaactgctccctgaagtacaacaaagtcgaaataattgttgttaccataaattgttatcagaaattgaggaaaaaaggggttggtggctgagattaaggaaaagaggaaaatcaactgtgttaattaaatgtcagaagagtcaaaattgtgagtttagagaactaaaattgcggaatgaagtgcaagatcagaccatcaatcaactttttttaaatggcttactaggagttaaagagaatactcaccatctccaaagacaagatacaaaagcttgttatgcccttctctttgtcaaaggattcaacaagaagtag

SEQ ID NO: 75643 - DNA, 270 bp, Glycine max
  Peptide Sequence Number=SeqID_192421
atggtcaaaataaatccttacttcaggaactcaaatgtgaaattgaagctcaaagtaacatccattgacgagacgcaactgacctaccattttcagaatacaccttctgcaaacttgacaatgattggtcctgcgaggcttgcgtcgagggaggtggcgaagaaggggagtttgaaggcaatgctggacttgagggtgagggttggggaggaggagggtggagtggacgtggcgaaagatgaaaggaggcttttgaacaagaacgagtga

SEQ ID NO: 75644 - DNA, 189 bp, Glycine max
  Peptide Sequence Number=SeqID_192422
atgcagccttgggtgcatcaaaaggccaatcttccaatgacaagggttaaccctctaagtgcaaaaagtggcaattgggctaagcgtgcatccaccgctaagtgcaacttcagtgcacttagcgtgaaggagaatctggcaaagcatcagcatcaaggccacgcgctaagtgcgagatcagtgcgctaa

SEQ ID NO: 75645 - DNA, 582 bp, Glycine max
  Peptide Sequence Number=SeqID_192423
atgggtttgaagaaccgtggcgttggtcatagagcatggagcctcctgcgggcgtcattgttgtgggcacgtaaaggtggcttgttaaggcgcagggttgccatggagctgcgtctggtaccaaagtacttgaagcgactcggccacactgcgccgccgccaagccacattcactactttgagcgcgagctctcgttcgacaagacccccatattccatgtcaagatgtaccgtccaacctccatgcgcttccacttgccgcacattccttgcataaagccacatgttgattttgactatgactttaatgatgatggcaatgttgaatatgatactggaagaaagagtgccctcatggatgcaggagacagcagagaccaggaattttgtcatgattattatgaaggatgccaagagatgatgggttgtggtgaggaagaggaagagcaacaagcagatgcacaggggatagataagcaagctgaggagttcattgctaaattctatcagcaaatgaggctgcagcgccagatttctctactagaatacaatgaaacacccagatcagacacaagttgttga

SEQ ID NO: 75646 - DNA, 1713 bp, Glycine max
  Peptide Sequence Number=SeqID_192424
atgaaatacgtgatcatcagcggcggagtggtcagtggcctcggcaagggcgtcaccgccagcagcataggcgtcgtgctcaaagcttgtggccttcgcgtcacttccatcaaaatcgatccgtacttgaacatcgacgctggcaccatgtctcccttcgagcacggtgaggttttcgttctcgacgacggcggagaggttgatttggatttgggaaattacgagcgcttcctcgatgtcacgcttaccaaagataacaacatcaccactggaaaaatttaccaggtgcttgcttgcttttgcttcgctttgctttatgtctgtaatggatatggaatatggaactccctatctgttcttgagaaggaacgtaaaggcgattatctcgggaaaactgttcaggtggtcccgcacatcactgatgctattaaagattggattgagtcggttgctgtgattcccgtggatggaaaggagggccctgcagatgtttgtgtgattgagctgggaggcactgtgggtgatattgaatctatgccgtttattgaggctctacggcaattgtcctttcaagtagggcctgataacttctgtctcatccatgttagcttgataccagtgttgggtgtagtgggcgagcaaaaaacaaagcctacacaacatagtgtcagggagctgcgagcattgggattgacacctcatcttttaacaagtcgctctgctgagcctcttctagaaagcactaaggaaaaactctcaaagttttgccatgttccagttgagaatattctgaacatccatgatgtaccaaacatttggcacattcccctgttactgagaaaccaaaatgctcaccattcaattctgcatcagcttaacttactcagccaagctacacctcctgatttacagcagtggacagagatggctgagacctatgataatcttactgaatctgtgaggattgcaatggtgggaaagtatgtgggtctaacagattcatatttatctgttgtaaaggctcttctgcatgcttgtgttgcacgctctttcaagccatcaattgactggattgcagcttctgaccttgaagatgacagtgcagaatcaacaccagaagcacatgctgcggcctggaagactttgaagagtgcagcttgtgttttggttcctgggggatttggagatcgtggtgtgagaggtatgatgctagctgccaaatatgcaagagaaaacaatattccttacctggggatttgcctgggaatgcaaatttctgtaattgagtttgctagatcagttttgggttgggaaagagcaaacagtgtagagtttgatgcccaaacaccaaatcctgttgtgattttcatgccagagggttcacggacacatatgggaagtaccatgaggcttggatctcggagaacactcttacagacatctaattgtatcacttccaagctgtacggcaattcagagtatgtggatgaacggcatcggcatagatacgaggtaaatccagatgttattggaactttagaggaagctggactaaaatttgttgggaaggatgaaagtggaaaacgaatggaggcagaatggaagttgatctacgatttgttactagaaggctcactcctacaatatttttctagggtaaactggtactccaaagggaagataattggggagagggaagggagtgggaactga

SEQ ID NO: 75647 - DNA, 588 bp, Glycine max
  Peptide Sequence Number=SeqID_192425
atgggagatcgcttagaggaaatgattcatgatcttggacatgaatcttttcatctggttaatgtcaaggccaaatatgggtggagtgacaaaagcttcacttcacttcttcaggtggtgcaggatatgcttctagaggaaaacactttgccaaaaaaaatgagtttgaagaaatgcataactaccaagtgtggggtatcatggtacaaagtgaaggatgatgacgagtgtagcagtgatgaaagcaccaagaaagtccccccaacaaaggtgttatggaattacaatggaatgcttcaccatccggctgattcctctcagtggaagaagattaatagtttgtattcggaatttggaaaagaggcaagaaatcttacacttggaatttctagtgatggaatgaatccgtatggaaacccaagacaactaggaaatgacattgatgtttatctcactcccttgattgaagacttgagaaagttatgggacgagggggttgttgtgtttgatggcacgcttcttaacattcaaggcaagacaaaggatggtttgaatactcgccaagatctagttgagatgggtatatga

SEQ ID NO: 75648 - DNA, 681 bp, Glycine max
  Peptide Sequence Number=SeqID_192426
atggatttcttttccaatgagagttttgaatgcattcaagcatttgaaaactccaatctcattcctttcatgtctttaaaattgcatgtttacactgaattggttaaagccttctattctaacctagaaattcaagaaggcactttgatttctaaagtttatgggattgaaatggtcattgcccaatcccatttctatgacttgacccaattatccagtaaaggtgtaccatttgaaggtacactaaatgatgattggaaatttgatttctctgtgcatgatgcccgtcgattggtttgcaccaaccaagcggatatgaccgaaaggcttcttcccagttcattggcttttgagagccacatccttcattatctcattgtgcaaatcttacttccaagatcttcaaaccttgcacagtacaatagagggtacatctcttgtggatcagttcaagtgaagggtacatccacttggttgatacaaagagaacaagggagggtacatcccttatggatctttgcttgtaaaggattttacaaggttgaaaagaaatctcaaggactgcaggtcgcttggggactggaagtaggcacgggttgttaccgaaccatgattacaccaagaggcaatcccacttcttgcaatgaaccccaagggacctttctcctttgtgttcagtga

SEQ ID NO: 75649 - DNA, 201 bp, Glycine max
  Peptide Sequence Number=SeqID_192427
atggagtcaagagctatgcaaagcttgttagacctcagagttgtgcgagaggacacaagtcgtcatcaggtcatacaacaagctttacaattgttgcaggagggcttagcagttgggtgtagctcggacacacagagacacaagaagaggcctaacaaggatagtggcaagggtgacaagaagggtggcagaggcggttga

SEQ ID NO: 75650 - DNA, 414 bp, Glycine max
  Peptide Sequence Number=SeqID_192428
atgaaactggccaaatacaggctaaaggcccgagtggagaaggacaaagcccccgagtggagaaggatgaaggcccaagtggagaaggatgaaggcccaaataatccttgtggcgtctaccctgacttatcttccttcactggaagtggcgtctacccagacttatcttccttcactggaagtggcgtctacccggacttatcttccttcaccggaagtggcgtctacccagacttatcttccttcaccggaagtggcgtctaccctaacttatcttccctctttggaagtggcgtcaaccaaaaactctacagcctgtatcaaacgatccaccccgtaagattcacatcatctggtatgagagcttcggctcttgatacaggttctatcctatcctattatttttctttgtaa

SEQ ID NO: 75651 - DNA, 240 bp, Glycine max
  Peptide Sequence Number=SeqID_192429
tcatgggcttggtaccgaatgccatttattgcaccaagagtcccacgacccgaaacaacttatccactggctaaaagatggagtggtgatagattaaaatatagggtcacacctcatggtgacttggtcagatatagatctcgtatagatcatatggagggccatgagttttcttgggtcccatatagaggatttgaagaacagctatcgagacatgcatatagagacatggagatttag

SEQ ID NO: 75652 - DNA, 375 bp, Glycine max
  Peptide Sequence Number=SeqID_192430
ggaggcatgcttgaggccctgagcatttacaagaagtggaaaggttatagcttagactacgaaggatcaaggaagctgatgttcagcttgagagaatccaattcttgttttgttaagaacaatgcaatcagaatcttcactaggaacagaggctgtgactttaagatcagtggctgtttcccggataagtgttgtagcattgttgactccaaaggcaacgaggtagcccaggtgaggatgatgaaggaagtggagaaattgattgaaagcaaggatttgtaccatgtagtggtgaatcctgggatggatcaagcttttgtctttggagtcatcgctatccttgattacatttatggcgaatctacccactgctaa

SEQ ID NO: 75653 - DNA, 174 bp, Glycine max
  Peptide Sequence Number=SeqID_192431
atgaaggaggggtctcgggttcagagatttgaaagccctcttgggaaagcaagcggcaaggcttctgatatatgggaaataacccaagttatacttggagaagcctttggtcaggaaaagctcttgttatggaaggttcacggtggagggtgggaaggacctgtggcttcgtaa

SEQ ID NO: 75654 - DNA, 432 bp, Glycine max
  Peptide Sequence Number=SeqID_192432
atgtttaggagagccatctcaaggccattgctgaagtgtgtcgacgaagaccacacggagtatgtcctgaatgaggtgcataggagaatttgccaaatgcacaccagaggtcgaagcatggcaacaagagtcatccgtgttggttactattgggtaaccttgagggttgataatgctgagtacattaaaacctacaaggaatgccaagaattcaacaatgtacaccacgcaccacccgaggcactccacaacatgacgtccccatggcctttcgccataatggcgcgtatcaacttgaagacatggcaggaagggtcatcactaggacttggattgcaacttgatgtgatcctcactaggaacggatcgcttgatacaggtcacagagtttggatgacgccacttccagagagggaaaataagtcagggtag

SEQ ID NO: 75655 - DNA, 854 bp, Glycine max
  Peptide Sequence Number=SeqID_192433
cggctggcgcatcagttttgcctgctgccgcatccggagcatgccgataccggcagcggaccgtggcgcctgacgcactttacccgcgagctggtgcggctggagagccatgcgcgctggcaccatcagcgtccgctgattcaggtggtggaatactggattacgccgcagctattcgatcgcgggctgggcaccagctgtcgccatccggtgcagatcgccattggcgatcccaacgagctggacacgctgcggccggtggatcgcagcatcagtctcggtttctgttacctggcgccgcgcttaattacaccaaccgcagagctgctgcccggctggccgctgcccgccccgcaccgcccggagggcacactgcccgcaacgctgacgctgcattatcacctgcccatcgaactgcacgtcatggcccaggcgctggtgccgctgctggcggcacagggctctggcgcgacgacatcgatctgagtgacgccgacatcatcatgggcgaccgtctgattggtgatgcgccgcagtttaccctggtgaactggctggaaaatgatgcggcctggcaaccgctgcgtccggcggtactgcaggcaccgctgcacgctatcgcccgtcaggccagtccggcactgcgcagcgccgcgattcatcagctgtttcagcagctaatgcgcgacggccatctgctgccgctgtttaactatcgctaccaggtgtttgctccgccaggcgtcgaaggtattcagcttaacagcatgggctggttcgatttcacccgcgcctggatcccgccgcctgccgcaggcggtgctgttcagcccgcgccggagccagtaccatag

SEQ ID NO: 75656 - DNA, 2443 bp, Glycine max
  Peptide Sequence Number=SeqID_192434
cgacgacgaaatcaatcagtactaccagcagcatcagagcagctttatggcacctgagcagttccgcgtcagctatatcaaaatggatgcggccagcctgcaggagaacgccagcgaagcggatattcagagctggtacgatcagcacaaagccgactattcacagccgcagcgcaaccgttacagcatcattcagaccaaaaccgaagccgatgccaacgcggtgctggatgcgttgaaaaagggcgaggatttcgccacgttggcgaagagcaaatccatcgacccaatctctgcgcgtaaaggcggcgacatgggctggctggagccgaacaccacgccggatgagctgaaaaacgccaacctgacgcagaaaggccagctgtctggcgtgatcaagtcctcagtaggtttcctggtggtgcgtctggacgatatccagccagagcaggttaaaccgctggcggaggtgcacgacgcggtggcggataaagtgaagcaggaaaaagccgtcgacgccttctataagatgcagcagaaggtgagcgaagccgccagcaacgacaacgaatctctggcgggcgccgcacaggcatctggcctgaaagtggtggaaacgggctggatcacccgcgataacgtgccggccgatctcgatttcgatgcggttaaacaggcgatcttcaacggtggcctgaccggtcagaacggcgcgccgggcaacaattctgacatcatcagcgtcgatggcgaccgggcgtttgtgttgcgcatcagcgagcacaaaccggaagcggttaaaccgctggatcaggtcaaagcgcagattgccgacagcctgaagcatgacaaagcgacgcagcaggccaaagcgcaggcagacaaactgctgaccgagctgaaagcgggcaaacaggacgcgctgcaggcggctggcctgacgctgagcgccagcaaaaccgttgatcgcaacgcgcaggatccggtggcacaggccgcattcaacctgccacagccagcggataaccagccgtcgtggggtgtcagcgaagatatgcagggcaacgtggtgctggtcgcgctggataaggtcagcgcgggcaacatgccgcaggcgcagatcgacgaaatggtgaaaggcgtgacgcaaaacaacgcgcagattgcctttgaagcgctgctggaaaacctgcgtaaagaggcgaagattaagtacggcgccgccgcacaaaaccatgcgtttctcgcttgtgccaccctgcagtggctgtcaaacacaaggagaaacacagcatgcggactggcggcggcggaaagccccagtgaaacgcaggcgacgcaggtgtccacaccgcagccggaacaggtcagcatcaatcaggccacggccgagcaactggccgccgccatgaacggtattggactgaaaaaagcgcaggcgattgtcagctatcgtgagcagtacgggcccttcagcgccatcgagcagctgaaagaagtaccgggagcaatcatgcaaaccaccatcaaagtgcgcggctatcatcttgacgtctatcagcatgtgaacaatgcgcgctacctggaatttctggaagaggcgcgctggcagtggctggaagatgccgatgcctttcactggctgctggagcagcagctggcgtttgtggtggtgaatatcaacattaactatcgtcgtccggcggtgctgggcgacgtgctgcacattgagagcgaggtctcgcagctcaacggcaaaagcggcattattttacagcgggtggtgctggcggttgataacacgctggtggcggatgcggcgctgactttcgtctgcatcgatttgcgcacgcaaaaaaccgtgccgctggaagcacgccagcccgcagcgcggccgcaatcagcgcaggccgcttttctgtttcatcgccgccatcacgctggccgcattggcctggtaatcggccagaccgcgcgcgcgcaggtggcaggccgcgcactcaccacagccgtcgcctttaacgccgttgtagcaggtttctgctttattcagccacatcagcggcgtttcaaaacgcacgtcacgcgccatgccgagagtaacggcgttattcagcgctttgacgaactcgtcacggcaatccgggtagccggaaaatcggtttcacacacggccggccagcgtcagaaacaggatgttacgccccgggacaaaggtgctgggcaggccgctggcctgtggattgtaggccggcaccggaatgttatcgcgcgtcaggctgctgaccgccagttcattaagcagcgttacgtccagcactttgtgcgcccgcgcgcccagctggtgcgccagctctgcggcgacgctgatctcttcgcgatggcgctgaccataatcaaagcgcctgaatcagacaggtggtggagtcttgtccgccactga

SEQ ID NO: 75657 - DNA, 1803 bp, Glycine max
  Peptide Sequence Number=SeqID_192435
atggccgttgagttcacgcgccagacgctcggattcgctgtacagctggcacggatcggcgacgaagtggcactccccgccgtaaaagcggatcagctcgattttgcgccgtgcggtactggctggcatcacggcgataaacggcaggccgagcagacgggcaaaataggcttccgacaccgcggtgctgccggaggaggcttcgatgatcggcgtgttttctccaatccagccattggccagaccatagagaaacagcgaacgcgccaggcgatgtttcaggctgccgcttggatgggtgctttcatccttaagataaaagcgaatgccggggaaatcgtccagcgtaaaacggatcaggtgcgtatcagcggagcgctgaaagtcggcgttaatttcattgatagcgtggcgaacccagggcgtttgcatggtgcgattccggcagcgagattgcgctcagtgtggcgaatgctagataaaactgaccgcacactgctggcgctgctgcaaaaagactgcacgctgtcactgcaggcgctggccgatgcggtgaatctcaccaccacgccgtgctggaaacgcctgaaaaagctggaagatgatggcattattcgggcgcgcgtcgcgttgctggatggtgaaaagctcggcctgtcgctcaccgccttcatgctgatcaaaacccagcagcacagcagcgcctggtttcagcagtttgtcgcggtggtacagcagatgccggaagtgatggccttctaccgcatggcgggcgagtacgactacctgctgcgcattcaggtggccgatatgaaaagctacgacgcgttttacaagcgtctggttaacggcgtgccggggctgattgacgtcacctccagcttcgctatggaagagattaaatacaccaccgccttgccgccagttaagttggtattttttgcgcgagtggcggcgctatctgggcgccatcagcttgctgattatcattgcgctgctgcaactgctgcctccgcatctgtgattgtctatttgctgcgctacgtctggcgcgtgctgctgttcggcgcctcttaccagctggcggtggagctgcgcgaagatttttaccgccagcttagccgccagcatccggcgggtgctgacgctggtggattcgctggtgatggggctggtcgtgctggcggtaatgagcgtgcagatcagctgggagctgacactgctggcgctgattcccatgccgattatggcgctggtgattcagaaagacggcgcgcgcctgcatcagcgcttcaaagtggcgcaggcggcgttctccagcctgaacgatcaaacgcaggagagtctgaccagcatccgcatgatcaaagcctttggcctggaagatcatcagtcgagccagtttgccgatatcgccagcgacaccggccgcaaaaatctgcacgtggcgcgcgtcgatgcgcgcttcgatcccatcatttatattgccgtgggcttttcgaatctgctggcgattggcggtggcggctggatgggctgatgatttggccgatgctggcgctggcgtggatgattaacatcgtcgagcgcggcagcgccgcgtggagccgtattggcgcgctgctggcggaagcgcctgcggttgaggatggtggcgatccgcgccttccactatccggcgagcagcgcgccggtgctgagcaacgtgcatttccagctacaaccggggcagatgcttgggctgtgcgggcctaccggctgcggcaaaagcacgctgctgagcctgattcagcgccattttga

SEQ ID NO: 75658 - DNA, 522 bp, Glycine max
  Peptide Sequence Number=SeqID_192436
atggcgcatgaacccttcccggtgccacacaccctgatcatgagcgccggcaccggcggcacctcggctacgctggggcgctacatccgctatcagggccacgacacgcgcctgctggtggtcgatccgcagcactcggtgtttttcgattactggcacagccgcgatcgcacgctgcgcagcgagcgtggcagcctgattgaggggattggtcgcccgcgcgttgagccgtcgtttttaccggatgtgattgacgaaatgatgaaagtgcccgacggcgccaccgtggcggccatgttaaggctggagcagatactcggccggcgtccgggtgcctctaccggcaccaatttctggggcatgctgcaggtggcaaaacggctgcgcgcgcaggggcaatccgccgcgctggtcacgctgctgtgtgacagcggcgagcgctatccggatacctattacaatccacagtgggtcgctgagcagatcggcgatattcaggcgtggcagcgcgagctgcaataa

SEQ ID NO: 75659 - DNA, 615 bp, Glycine max
  Peptide Sequence Number=SeqID_192437
atgggctactatccggtgacgcgcggcagcatagaactggatggtcgcccgctgcgccagctgacgcacgatgcgctgcgcggcagcgtggcgatggtgcaacaggatccggtggtactggccgatacgctattggccaacgtgcgcctgggacgcgatatcagcgaagaggacgtgtggcgcgcgctggagaaggtgcagctggcaccgctggcccgcgcgatgcgcgacggcattcatacccggctcggtgagcaggggaacacgctgtcggtcgggcagaagcagctgctggcgctggcgcgcgtgctggtgtcgctgccgcagattctgatcctcgatgaggccactgccaatatcgactcaggcaccgagcaggcgattcagcaggcgctgcgcacgctgcgccagcacagcacgctggtggtgattgctcaccgtctttccaccatcaccgaagcggatcagattctggtgctgcaccgtggtcaggtggtcgaacgcggtacacacaccgaactgctggcgcagcagggccgttactggcagatgtaccagctgcagcaggctggcgatgaactcgcggcgggcatacccgcaacggcagaggggtga

SEQ ID NO: 75660 - DNA, 327 bp, Glycine max
  Peptide Sequence Number=SeqID_192438
agacaggtccagggtgatgcaccacaggccgcggacgcgccgccacctcatcaggctggtccagccggatcgtttgatacggagcagtatttgtggcatttggttcgccagcaggcggccaaccaccgggctcatagccagggctttacatcttttccatgccctactccggaccagttcagggcagagatcgtatggcctggaaattggcctgaggcccgggcaggagaggcaccagcagaggctcccgacgaggcagatgaggtccgcgaggacgaggagatgaccgatttacttgatttcttaggaggaagcgaggccacatga

SEQ ID NO: 75661 - DNA, 135 bp, Glycine max
  Peptide Sequence Number=SeqID_192439
atgcaggttagctctcctgggcgagcaacccttgcacgaaatgggttaaaaagtgggaaaggggaaggggatggccttaggcctagggtgcattctgagataatggggcatgtcgcattgcccccattcccttga

SEQ ID NO: 75662 - DNA, 179 bp, Glycine max
  Peptide Sequence Number=SeqID_192440
atggctccaaggaagctttccgcaaagagatctaggagggacgccgcggccgaaggaaccagtgccactcccgagtttgacagccatcgtttcaggagcgccgagcaccagcagcgtttcgaggccatcaaaggatggtcgttccaccgagagagatgcgtccagctcagggacgatga

SEQ ID NO: 75663 - DNA, 147 bp, Glycine max
  Peptide Sequence Number=SeqID_192441
atggagaaagctcatttcatttttctttcttctcctaaaaatgcttctggagaagctcatccaaacagaggagtaagatcctatgagcacaagctagtgcctttaatatcattcctccttcaaacaaaggttaaagatgatatttaa

SEQ ID NO: 75664 - DNA, 306 bp, Glycine max
  Peptide Sequence Number=SeqID_192442
atgcagcggcgggcgggtacgctcagtgttggccagcaacaacgcgtggcggcagcgcgcgccctgatcggccgtccgacgttgctgctggccgatgagcccacctcggcgctcgaccgcgaagcggcgagcgccttcctgcagctgatgtccgcgcagtgccaggcggccggcaccacggtgctggtgcctgcgcagccgcgcgttgagcgtgggcctgaccgtgctggtcatcaccctcagcgtggtgctgctgctgggcgtcgagcgtgtacgcacgcaggcgcacgagggtttgccagcacc

SEQ ID NO: 75665 - DNA, 183 bp, Glycine max
  Peptide Sequence Number=SeqID_192443
atgtgggtgcaagccattggtctgtttgctcaagcgacctgtgctcctaagtttggacttccaagaccgttcaatcagagattacttgtcttgcacgttggtggggagagaagtgagttatcaagaataggatgttggacaaatggcctcagttatcttaagaagggggggggggttgattaa

SEQ ID NO: 75666 - DNA, 534 bp, Glycine max
  Peptide Sequence Number=SeqID_192444
atggcttctaggaaatgcaagagtattggtttaggacccacaacacaatatgatactaggagattttcctccttaaatacttggaaccgatacacagataatgtcctggggagaaacatttttcctgagaggaaggtggagctctatcacactaagctaaatgattttaagactgaattggagaggtgtaatttccgtaaatgcctcaccaatttggttaatggaagcatagacttggctttggtgaaagagttttgtgcaaacttatatagctctgagggcccttcaccaaagcaatccagagttagaggccacctagtgaagattgatgctggtagcatcaacacattcttagagacacctgtggtattggcagagggtgagactttgcccacatactccagatactataggctgcccacagattacagagagattgaggctgccttatgcatactaggccgagggttcatcttgaacacagagggccatcctaggaagattctcaagaaggatttgactactctagctcag

SEQ ID NO: 75667 - DNA, 252 bp, Glycine max
  Peptide Sequence Number=SeqID_192445
atggaagtactacgtatttattacctatctttaataaaaaatgaagttaggcataagacagtgtcgcaacctacccatcggcgggagggcgacgcgagggctcacgggtgcgtcttccaagggaggaaaacacacggagtcgccaccaacgtttattcgaggaaaatgtcagaaaaaccggaaaagacgtggtctatgaactttaagtgtgaaaggttcaggagttgtatttacatgcggggaaggtattag

SEQ ID NO: 75668 - DNA, 561 bp, Glycine max
  Peptide Sequence Number=SeqID_192446
atggaaagaaaaactagaaagagaagaaaaagaaaaagagagggaatacataggtcacatcttagacctcactcccataggagagaaaaggaaagaaagcctcaagaggctaatattaacctcccatacttccatgggaaggacaatgtagaggctaacttagattgggaaataagggtagagcaacaacttaaaaggaagtctactttaaaatcttatggctctcactcttatccaaagaaagaccaaggtcaaggcatcttaggggtgacaccttctaagcccaaatatgataaggggaagacaatagaagagcaaccccttaaggctagtatgcaagagaagactagctccatgaagtgctttaaatgtcttggaagaggacacattacttctcaatgccccaccaagaaaaccatgattatgaggagccaagaaatttatagtagccaagatgaggctactacttcaccttcctctagtgaaagtgaagaagcaaaagaggaagaatctagtgaagaaatctacccctcaagaagaaggacaacctttaatggttaa

SEQ ID NO: 75669 - DNA, 249 bp, Glycine max
  misc_feature (175)..(175): n is a, c, g, or t
  Peptide Sequence Number=SeqID_192447
atggaggagtttgatgctcaggtggcctggctaggagaccagccctcttcttctggagggggtggggcctctgcagcccaagagccagatattgagaagccaccagcaccagcagaggaggagactactcctgaggagacccaaccatctatatcagttgcggagccagagcagnctatcaaggattcatcagcagctccaacattggatttgaatgaagaccaaccacaggaggagcaggacgtttaa

SEQ ID NO: 75670 - DNA, 237 bp, Glycine max
  Peptide Sequence Number=SeqID_192448
atgtatattgttgtggtaaaacaggggcaggatcaccttgggctaccttctggagtggagacaaaacacgaacggcagaaaccaatcaaggcacttaaggatgaacgcaagcggggatggggtcacgaccgaccgatcgttgctcttctctgtgcgaagcaagcagggaatgtcgctgcaaggcagccccgtatcctttgtattttgcagctttcttttactatttgtttgttttaa

SEQ ID NO: 75671 - DNA, 1093 bp, Glycine max
  Peptide Sequence Number=SeqID_192449
aaaagcagtagggtgtaaatgggtttttcggatcaaagaaaatgcggatgggtccatcaacaagtacaaagctcggcttatcattactcttgcccttactaataattgggggttatttcaattggatgtgaataatgctttcctcaatgaccttttagatgaaatagtttacatggtgcaaccttcaggatttgaagttgaagacaaatcctttgtttgtaagcttaacaaggccctttatgggctgaaacaagcaccaaggctgtggtttgaccgactaaaaattactttgattcagtttgagtttcaagctagcaagtgtgatccatcatttcatcagattacaactcaacttaattctgcattctctctcaaacaactaggtcaattggactatttcttgggttttgagatcaagtatctacctgataggtcttttctcatgactcaaggcaagtacattaaagacctccttcacaggactcacatggctgaagctcattctatttcttctcatatggccttttcttgcaaactgtctaaaattggtggtgatttatttcaagatcctactctctacggatctacagttggtgctttgcagtatgctactctaacaagaccaaaaattgcatttgctggcaccctctcctatggtcttctcatgaaacctgctgctgttgggaaacctttatcaattacagccatgtgcgatgctgattgggcttctgatgttgatgacagaagatcaacctctggctctactattttcttaggtcctaatttgatctcttggtggtcaagaaaacaacaagaacttcaggttcccttctctactcctatactgctctgtgacaatcagagtgcagtagctagtgctcataatcctgtttttcatagtaaaactaatcatatggagattgatgtcttctttgtcagagaaaaggtcctgtccaaacagcttctcatttatcagatgccaaccttgaatcaatggactgatatattaaccaagcctctctcctcaactagatttgagttgctaagaggcaaactcaatgtgcaacatttctctagcaaccctccaccttga

SEQ ID NO: 75672 - DNA, 114 bp, Glycine max
  Peptide Sequence Number=SeqID_192450
atgtttaggaaccccaacagagcaatcgaaggaggagctctagagagcaccagaaacatcacaattgataatggagaaggcttgagcgactacatcaagttgatgtcccaatga

SEQ ID NO: 75673 - DNA, 426 bp, Glycine max
  Peptide Sequence Number=SeqID_192451
atggctattggaagaccggagcatcctgttcgtgtacgtggggctgggacaggggttacaattacgcagtactttggtccatcatcgcgttggtctaccacttcatcaaacatcactgtagaacagttggctgatataattgccccacttcaaccaaatgatatacaagtattagcagcaagggtaagcacgaagggaagctgtgcaacagcagagacaaatgcattagctaaaaaaccctctcagttgaatggtgacaacgtcaggctgcatgtaactgccgagaactccaataaattagtggcagtgggcaaacagtgcgacagttttggcaccatccacaacgtgccctatgctgatgatgttgttcacgtgagtgtggtggaagttattttcggtgatgcggaggttccaatccctacataa

SEQ ID NO: 75674 - DNA, 246 bp, Glycine max
  Peptide Sequence Number=SeqID_192452
atggacatagactatgctataagaaaagatgaatcatctgcaattactgatgaaagtagcccagctgctgttgcgctatatgaacggtgcgagcaatccaatcggctcaacgtgatgttcattaagaccaaaatcccgactaggatacgtaattctatcgaccaacatgaaaaggtacataatgtcaatgcgagatattttagctctgtaatgacccgcctcgtcgctatggtatccacactctaa

SEQ ID NO: 75675 - DNA, 531 bp, Glycine max
  Peptide Sequence Number=SeqID_192453
atgaatatcttgacggcacacgatcaagaatgggaaaaggagttaagtccttacaatcaatatgaagaagaaagaactcttaatcttgaaagtgtgtttgaagaattcagggcataccatgctagctcaaaagctaatcaaaatttaatgaaaaatcatgaaattcattttggtacgagctactcaatagaaaactttcaagggagaccagagttacaaccttactatcaaaatgaagtagaaagaggttccaatctggataaactattgatgcaattcatggaaacaactaaatcaactcaacaagcactccaaagtgtagaaatccaggttggtgagctggcagaagcagtaactcaatttatgtcaagacaagaaaaatcctttgtagaggttgaagctaatgatcttcttcatcaatggattcctttgcttcttggaagaggaatggcagcggaatggagaaaggaagggagagaggagacgccacttcaaggagaagatgagtctagaagaagctcaccaccatag

SEQ ID NO: 75676 - DNA, 423 bp, Glycine max
  Peptide Sequence Number=SeqID_192454
atgacgttagtctctgcatgctaccggactctgagtttgacggatagtgaaaaattgggtatctccacatgtcacctgacttcacgggtctggatgacagaaaccgtttgtacggataactgcttgggtatctccgtacgttacctgacttcatgggtcaggatgactgaaggcgcggaagacgatatgaccacattggcctctgcttgtcaatcgaacttggggtctccgaatgacgcggtgtggataaccggaaggtgtttccgcatgctaccagactcttgggtcatgatagaaaaaggtggggtggtcgacaaaagcgaggtttttgctcctatgtatcctccatttgtgatgaggaactcaggcctacgtagttctttcaaaagtgagactaaaatagtctcggtgttctctcactaa

SEQ ID NO: 75677 - DNA, 513 bp, Glycine max
  Peptide Sequence Number=SeqID_192455
atgtttcaccctcaaactgttttagattcaaatggctatccaatctattgtagaagaaatgatggtcgtaccatttcaaggaatggagttattaatagatatatagtaccttacaatgaaaaattgttgaggaaataccaagcacatataaatgttgaatggtgtaatcaaaatacttccattaaatatctatttaaatatataaacaaaggttatgacagagtcactgctgttgttattcatgatgataatggtacacttgagaatgctatcagtcaaaatgatgagattaaagaatatgtggattgcaggttaatatgggttccaccaaccactggtgaattgttttatctaagaatgatgctcactgcatgtaaaggagctacttcatttgaagatattagaacagttgaaaatgttctataccctacatatagagaagcatgctttgcaatgggttttttgcaagatgacagagaatttgtggaagcaatcaaagaagctaaggactag

SEQ ID NO: 75678 - DNA, 447 bp, Glycine max
  Peptide Sequence Number=SeqID_192456
gtggaggccgccaataaggttgtgttgaacgcactagctgcgtgcattgagcatactcgaatgtcttgggttgatgaaggtccttggatcttgtggtgttatcacactaccctttactcgttaacccatgaacttccttacaccttggtctatgaaactgatgctatgacccccgttaaagttgtcgagccaactttcaaagtaaacatttttcatgaagaacaatcagatgtagaccaacttgttgatttggacatggttggagaggtgcggggcataatgccggtccaagaggaggcagctgatcttcgcgctaagcaaaggtacaattcccaagtggttccatgggaatttaaggaaggagacttagtcatgaagagggctcagccaaaccaaatcgtcaacaagttgtccccaaagtgggttggcccgtattgggtccaccag

SEQ ID NO: 75679 - DNA, 145 bp, Glycine max
  Peptide Sequence Number=SeqID_192457
atgacttcaaaagaattgaacgaggagccatatgaagtgaaaatctcatgggggagggttaaagatttacccggtgtgagatatcacattgttcgaggaaccctagatgctgtcggagtaaaggatcgtcaacaagggcgttcta

SEQ ID NO: 75680 - DNA, 414 bp, Glycine max
  Peptide Sequence Number=SeqID_192458
atgttacaccctaatttcatccggggaccattgttgatcgcttcggaaggcttaacacccatcgccgtggaatccgtaaagttcagtgaggtttcggaaggaaaacaaccaaaaaacacaaaaatgggaggaagcaacctagctcgcctgggcggcaacctcctccccattttttatataaataggccgaggggggctgttccaaaggaaaatccaagccaaggtgcttccataacgcttccgagacgtttccgtgagcaattttgtgaagattttccatcgttcttcaaccggctgccgtcccttgtgacggacgcgtggggtgtgtcataccctaatttcgtccggggacctttgcttgatgacatgcgacctttctttggtacttgtgaggtgcttggtacccatcattag

SEQ ID NO: 75681 - DNA, 657 bp, Glycine max
  Peptide Sequence Number=SeqID_192459
atgaaacgctccaccgcactcacctccctcctgctttcagtagggctgctcagcaccggcgcacagtccgccgaactggcgcccgccgatcgcgtgacgccgctcagaggcggagcaggccatcgcccgcaccgccggccagcacggcgccagctattaccgcatcctgcggatggaagaacaggcgcacccgcttggctggcgcgcctcggccatcttatacctttaatagctcatgcaagccgcattcaacacgccgccgctgacggagacgccccccaggaaaatcccggcggccaggtggttcgcttcgatcttgtcgctgatgcgtggcatgtagatcttcacggccgcgaacaacagcagttgcaccaccagcgccaccacgccccacagcaggtaatccagcaggctgatcgagttgatcgccgcgctggccaacgggatcacataccccaggcaagcgccgatgaaagcaaaggcggcggattggttatcggccttgatcaacgcccattcgtcgtgcggggtgatgcgggtatagacgaacagaaacaccaaaaccatggcgaaaccgctgaagaagtaagaggcgaacgccgccaacgcgctgagaatatccatgtgcattttcctgtcagagtgagactgaattaa

SEQ ID NO: 75682 - DNA, 1026 bp, Glycine max
  Peptide Sequence Number=SeqID_192460
accggtgagcgctacgaacaacgccgccacgacgtcgaacggccgctgctgccgccgtcggcgctgtacctgtcgccggagctgctgcgcgagcgcctgaacgatgccccgcgcatcgaggtgtggtcggctgaccacgcgcgcatcgccgatgcccatgcgctgggtgaccagccgctgccgccgctgccggtggccgcacgcgaggcccccgcaggcgacgcgctgaaatccttcctcggccactatccgggccgggtgctgatcgccgccgattcgcccgggcgtcgcgaggccctgctggaagtgctgcaggccgccgagctgaagccgccggtggtggccgacctgcccagcttcctcgccgacgatgcgcgctttgcgatcgccgtggcgccgctggaggatggcttcgcgctggacgatccgcgcatcgcggtgctgaccgagcgccagctgttccccgagcgcgccggcagcacccggcgcacgcgccgtgccggccgcgagccggaagcgatcatccgcgacctcggtgaactgaccgagggcgcgccgatcgtgcacgaggatcatggcgtcggccgctatcgtggcctgatcgcgatggacgtcggcggcatgcccggcgagttcctcgaaatcgaatatgccaagggcgaccgcctgtatgtgccggtcgcccagctgcacctgatcagccgctattctggtgcgtcggcggaaaccgcgccgctgcattcgctcggtggcgagcagtggagcaaggccaagcgcaaggccgccgagaaagtacgcgacgttgctgccgagctgctggagatccaggcccgccgccaggcgcgtgccggcctggcactgcaggtcgaccgcgcgatgtacgagccgttcgcggccggtttcccgttcgaggagaccccggaccagctggccgcgatcgatgcgaccctgcgcgacctggccagcagccagccgatggaccgcgtggtctgcggcgacgtcggcttcggcaagaccgaggtggcg

SEQ ID NO: 75683 - DNA, 417 bp, Glycine max
  Peptide Sequence Number=SeqID_192461
atgaggatgttttggcaaaagtaccttgatatccctccaatgttaacccaagcatacactacgttattctatctagtgtatgatgtcaccccatttttggatgatcatccaggaggtgatgaagttttagtgactgcaacagagaaggatgccaccactgattttgaagatattgggcacagtgattcagcaacagagatgatggaaaaatactttgttggtgaggttgacaccaacactcttccagcacaagttaccagcagcagcagtgtacgcccaccaacacaagcacctgtctataacaatcaatcttctggatttgttgtgaagatcttgcagtacatagtgccattgctgatattggcctttgcatttggcctgcagtactatggcaaaaaaagcaagtcagaaaattga

SEQ ID NO: 75684 - DNA, 360 bp, Glycine max
  Peptide Sequence Number=SeqID_192462
atgtacaaaacaaaaagcattataagtagtttaaggttgctgagaaagacaaaccacatcacggtggaagagactgagatgggttcaaaaaccaagacttttacctttgaggaggtggctaagcacaatcacaggaaggattgctggattatagtcaaagggaagcatgacatgtacggctgtaatgatggggttataggaatgcctgataaagatgaagatgagacagccattacggttggggagtgtaatttaaaaccatattctgagtttgacaaaatatgtgtctatgctagtccgcgtaggattacaaagttcaagactgatttcatagttacattggttttaaatagaatttaa

SEQ ID NO: 75685 - DNA, 324 bp, Glycine max
  Peptide Sequence Number=SeqID_192463
atggctccgaggaagctttccgcaaagagatctaggagggatgccgcggctgaaggaaccagtgccgctctcgagtttgacaatcatcgtttcaggagcgccgagcaccagcagcgtttcgaggccatcaaagggtggtcgttccacagggagagacgcgttcagctcaaggacgatgagtacacagattttcaggaagagatagctcgccggcgttggacgtcgctggtcactcccatggctaagtttgacccagatatagtcctagagttttacgcaaatgcttggcccacggaggagggcgtacgggacatgcggtcaggg

SEQ ID NO: 75686 - DNA, 858 bp, Glycine max
  Peptide Sequence Number=SeqID_192464
atggaggggttagccaatacagatggtgtggttgcaggctttagcacttttggaagtatggactataacgatggaacatttcttatgcaacctggttatgacagagggagaacaatgactcatgaagtgggacattttgtaggattaagacatatctggggcgattcagcgtgtggtacagattactgtgcagacaccccaacagcgcataatgccaactacacgtgtaatactacaattccaagctgtgatgacccagcagtgtttgaaatggtacaaaattatatggattatactaatgatacgtgtatgaacatctacaccaatgatcagaaaataagaatcagagcggtaatggataattctccaagaagaatggagctaaaaacatctactactgatcaagccatcccattatttcccaatgatgccgaaataaaatatgatggaggttgcttagttgggggcgccaattgtggggctggtgtattacgtctagttatctataacagaggaaccaataatttaacatctgctgttgtttcttactcatttaatggtggcgctgttcaaaattataactggaccgcacctgaatattttgctacgactactgtaaatttcaaattactgagagacaaatatggtagagaaacaaaatggaatttaaaaaatagcgccggacaggttattaaatccggagcttattccaatactctagccggtcaacctagccctactttaatcacccaaacatggacattacctctagactgttatgtatttacgatctctgacgattacggtgatggtttaagtgatggtggatatgtagatttgtctacaagcacaggacag

SEQ ID NO: 75687 - DNA, 457 bp, Glycine max
  Peptide Sequence Number=SeqID_192465
atggctaacccaattccaattcgtccatggtctcgcttggcctctctaagatcttctcctgctccagagtcacatcctaaacctcacactgcagaaccttctctcaaaacaacaaacattttttctaatgacaacaatgaaagtgccaccaaatctctatcaccaacaccaccagatgttcacatcccaattcaacaaaacctcaaacccactacccccatcacctttccacctaccaaactgaaggctcaggctcagcttcagactaagatatctgaagaagaagggaacattgaaaagcctaatggaaatggcaatggcatcggccaaaaaaatgaaaaagagatgacaaccacagaaaacgaattaaagaaagagaaaggtattcagacaaagatttcgggttctgggggccaatatggcataagggtcataacaatttcaggggaaaataaag

SEQ ID NO: 75688 - DNA, 730 bp, Glycine max
  Peptide Sequence Number=SeqID_192466
atggctaacccaattccaattcgtgcatggtctcgcttggcctctctaagatcttcatcagctcccaatccagagtcacatcctaaacctcacacttcagaaccttctcttaaagcaacaaacacttgctctcgtgacaataatgaaagtgccaccaaatctctaccaacatcaccaaatgttcacaacccaatgcactctcaaaagctcaaactaattacccctatgacctttccacccgccaaattgaaggttcaccctcagccaagggtagaagtgaccattgaaaagcctaatggcaatgcttcactgaagactgaaccaggagaaatccaaaagcaaggcaatggcccaaatgaaaaacaagtgacaaacatagaaaatgaaaccaaagggaatggtattcaatcaaagctttcgagttctgagggaaatggcataagggtcataacaatttcaggggaaaacagaggtgcacacatgcaaataaccaaatcccgaaagaaacaacaacaacccattcatcacaagatgggaaattctgatggtgagaaagtgagaacactatcttcgcctccaatgagaggtgtgtacgggaacagcaatgtgcagtgtgtcaacaactcaatgttgttccacactagtttaaccaaccatgatcctggaatgcaccttattatcccaaaaaagccaattggtcaaggattccatctcaaggaacgtgttggtg

SEQ ID NO: 75689 - DNA, 336 bp, Glycine max
  Peptide Sequence Number=SeqID_192467
atgacaatgatgagcatgaggaagatgatggaggataacattgctacagttgttgctgcgagtactgctactgagatggaccggattcacccgaccagtttcaataaagttcaaagcaagcatttcttcctaccatataggttacctcctaattatacaccacccactgttgtaaacgattctggtgagaatatcaacaattctgcacccttactcattgagaatcaacaaccccaatctgatcatgcacatgactctcaacccatgggggaaacacatgaagttccccaagatataccattgaagggcaggcattttctggcatccttgtgttga

SEQ ID NO: 75690 - DNA, 252 bp, Glycine max
  Peptide Sequence Number=SeqID_192468
atggctggccatatgggtagaggtgtcatagaggagcaggtatggaggaagggaccttggactgctgaagaggacaggttgcttgttgagtatgtcaggttgcatggtgaaggcagatggaactctgttactaggcttgcaacaaacaagaactctgagtacttcaacatccttaccttgacagtagcaaggtcgcgacaccactccaaagagcacgacttcagctacggcggtggtgggaacaataggtag

SEQ ID NO: 75691 - DNA, 213 bp, Glycine max
  Peptide Sequence Number=SeqID_192469
gagctagagcaagagaatgagactttgaagggaaagatagcccaacagagccgtgagctttttatccagaaccagaggatgattgagaaggacgacttgcttcgtcggaaagacgttttgctccaccaagatgctagaaggaagaggaagtttatggacttgttctcccgtgcacattcagattccgaggacccatttactccgggagtttga

SEQ ID NO: 75692 - DNA, 240 bp, Glycine max
  Peptide Sequence Number=SeqID_192470
atgatattgcacaagattagaaggcctaactttctaaaaacagtccccagtggagtcgccaactgttgcaacctatccttcggcgggagggaaacgcggggctcacgggtgcatcttccaagaaaggaaaatgcgcggagtcgccaccaatgtttattcgaggaaaacttcagaaaaaccagaaagttttttgtggtcgacaagggtgtttccctcgctcctacgtatcctcaattgtga

SEQ ID NO: 75693 - DNA, 270 bp, Glycine max
  Peptide Sequence Number=SeqID_192471
atgtctgggtgtatcatgaaacaaaaatatgaagtctttgagaagttcaagttgtggaaggttgaggtggagaaccagacaagcataaagatcagatacttgagtgttgcagagaggatgaatatgtctgttactgaaagggtctgttgtatgaggttgcaagctagcctttctaaagacttttgggcaaaaacggtgaatatggcgtgctatttgctcaatgaatcaccacgagcatcattggatgggaaagttgtagaagaagtgtga

SEQ ID NO: 75694 - DNA, 312 bp, Glycine max
  Peptide Sequence Number=SeqID_192472
atggagtgccgcaaatgcaaccagaatgggtactttaagaggaattgcccagagttgaagaaatttagtgaaggggcatcccgcacaacaaatgtgacaaagattgatgattcagactactacactgaaggggatgccaatggtttcacttacaaaactgatagagatcgaaatacccttagagtgtgtaaatggatgttgactctgatgaaagcacaacatattgtaagaaatattgacaggctgctggggagcacaattataggtcgagttgcatctgttgagtctgatgatgatgctactatattatga

SEQ ID NO: 75695 - DNA, 3210 bp, Glycine max
  Peptide Sequence Number=SeqID_192473
atgaaggttccaatggaggaaaaaccattccctgcatggtcctggtctattgaacagtgtttgaaagagtatggtgtgaaactggacaagggtctgagtacctatgaggttcagaagcggcacgagaagtatggtatgaatgagctagcaaaggagaagggaaaacccttgtgggaacttgtgttggaacaatttgatgacatgctggtgaagatacttttggctgcagccttcatatcatttctcttggcttactttcacggaagtgactcaggggagtctggattcgaggcatatgtggagccgctagtgataattctaattttggtccttaatgccattgttggggtttggcaagagaacaatgcagagaaggctcttgaagctctcaaagagttgcaaagtgagtctggaaaagtgttaagggacggctattttgtgcctgatttgcctgcaaaagagcttgttcctggtgatattgtggagctgcatgttggagataaggtaccggctgacatgagagttgcggctttgaaaacctccacgttgagggttgagcaaagttctttaaccggagaagcaatgccggttctcaaggggacaaatcctgttttcttggatgactgtgagttgcaggctaaagagaacatggtgtttgcaggcaccactgttgtcaatgggagttgtgtttgcattgttatcaccacaggaatggacactgaaattggaaagatacataagcagatacatgaggcttctcaggaggagagtgacacccctttgaggaagaagctggatgagtttggtaacaggcttaccactgcaattgggttagtttgtctcattgtttgggttattaactacaagaatttcatttcttgggaagttgtggatggatggccctcaaacatcaatttttcattccaaaagtgtacctactatttcaaaattgctgtctcccttgctgttgctgcaattcctgaaggccttcctgctgttatcacaacctgtttagcactcggaacgcggaaaatggctcaaaagaatgcaattgtgagaaagctgccaagtgtggaaactttgggatgtaccactgttatatgttcagacaaaactggtactttgacaacaaatcagatggctgtgacagagttctttactttgggagggaaaaccactgcttctagactcattagtgttgaaggcacaacttatgatcccaaggatgggggaattcttgattgggggtgctataacatggatgctaatttgcaagtcatggctgaaatatgtgctgtatgtaatgatgctgggatttacttcgatggtcgcctttttagagccactggtttgcctactgaagctgctctcaaagttttggttgaaaaaatgggagttccagatgcaaaggcaaggaacaaaattcgcaataatacagaacttgctgcaaacaacatgatgaatggcaacactatggtgaagttaggatgctgtgagtggtggaataaaagatccaaaaaggtagctacattggagtttgatcgaattcggaagtcaatgagtgtcattgttcgtgaaccaaatggtcaaaatcggcttcttgtcaagggtgctgttgagagtttactggagcgtagttcacatgtgcaacttgctgatggatccttggttccaatagatgatcaatgtagggaactacttcttcgaagactccaggagatgagttcaaagggattgcgttgcttgggtttcgcttataacgatgaattaggagaattttcagactactatgctgacactcaccctgctcacaagaaattgcttgatccaacatactactcatccattgaaagtgatctagtttttgttggcattgttggtttaagagaccctcctcgtgaggaagttcacaaagcaattgaggattgtaaggaagctggcattagagttatggtaataactggagataataagtcaacagcagaggctatttgtagggagattaaattgttctctaaagatgaggatctcacagggcaaagtttggctggtaaggaattcatctctctttctcattcagaacaagttaaaatattgttgaggcctggaggcaaggttttctctcgagctgagcctagacacaaacaagaaattgttagactactgaaggaaatgggggagattgtagcaatgactggagatggtgtgaatgatgcacctgcacttaagctagccgacataggaattgctatgggcataactgggacagagaattggagtttcatcttagtaattagtgtaactaaggttgcaaaagaagcttcagatatggtgctagcagatgacaattttagtaccatagttttagctgttgctgagggtcgctctatttataataacatgaaatcatttatcaggtacatgatatcatccaatattggggaagtaatatccatattcttgactgctgctctagggatcccagaatgcatgatatcagtgcaacttctgtgggtgaatttggttactgatggtccacctgctacagctcttggttttaaccctgccgatgttgatataatgcagaagccacctcgcagaagtgatgatcctctaataagttcttgggttcttttccgttatctggtaattggttcctatgtgggactagcaacagttggcatttttgtcttgtggtacactcaagcatcttttcttggcatcaatcttgtgagtgatggtcacacaatcatagaattgtcccagcttcgtaactggggggagtgtccctcatggtctaatttcactgttgctccatttgaggttgctgggggccgattgatcacattttcaaatccttgtgactatttctcagttggcaaactaaaggccatgactctgtctctctcagtcttggtggcaattgagatgtttaactctttgaatgccctctcagaagagaatagcttgaggaaactaccaccttggaggaacccttggcttttggtggccatgtcaatatcatttggactccattgcctcatactctataccccattccttgcagaagtctttggtgttattccacttagtttgaatgagtggtttatggtacttttgatatcagcacctgttattcttattgatgagattctaaagttagtggtgaggagtcaaagaaggttgttgactaaggagaaagaagcatga

SEQ ID NO: 75696 - DNA, 816 bp, Glycine max
  Peptide Sequence Number=SeqID_192474
atggacaaccatgatatcgggctactcgtggaacaaacacttgtgcaaacctttgagcactggagattgggcagagggttgaagcatacgcaaggaagaatgggttctttaagaatttacgcgagcaatgctgtgttggagatgtatgtaaagtgtggtaagattgatgctgcttggagggtgttcaatgagattggcagtttgagaaacttgtgctcttggaattcaatggtcgtgggtttggctgtccatggagaatgttgcaaggcccttgagctttatgatcaaatgctgtcgctatacaagaagactggagaaggaacttcacctgatgatgtgacatttgtggggctcctcttggcatgtactcaaggaggcatggttaaaaaaggcaggcatatcttcaagtcaaaaacaacatccttttacattattcccaaactagaacattatggatgcatggttgatctcctaggccgtgccgggcaattgagagaagcttatgaggtaatacaaagtatgtccatgaaaccagattcagtgatatggggagctctattgggagcttgcagcttccatgctggccaatgggatggagttgcaaagctcaggaaagtgatgaagggaagcaaaattacaaagtcagctggacatagtttcattgaagagggagctcaactgcataagttcattgtgaaagatagatcacatcctaaaagcaacgaaatttttgccttgcttgatggagtttatgaaatggtaaagcttactagaagtgcattcgaatgtcatctggatcttgatttgagaaactaa

SEQ ID NO: 75697 - DNA, 3021 bp, Glycine max
  Peptide Sequence Number=SeqID_192475
atgatggttctagatgtgttatctggtcctaccggaacagccatttctcaaactgtagagaccattgctgacttccttgttactgccaaggatgtccttgtgaaaaaggatagttttaaggaacttgctgcttacatggaaagaattaagcctgtcttagaagaattgaggaaaggaaaagtcagtgattctgagacattcaaccacgccattgagatcatgaataaagaaattaaagatgcaaaccaactacgtctagattgcagcaagaagagcaaggtttatctactaatgaactgcaggtccatagctaagagcttagaagaccacacaaaacagctgagtagggcacttggtcttcttcctttagccacaacaggtctttcttcaggaatagttgaagaaattgaaaagctatgtgaagatatgcagacagctggatttaaggcagctctagctgaagaagagattttagagaaaatcgagtcaggaataagagaacacaatgttgatcgttcctatgcgaataaattgctaattctcattgctgatgctgttgggattaggaatgagagattaacaataaagaaggaacttgaagagtttaaaagtgagattgaaaatgcacgtgttaggaaggacagggctgaagctatgcaactggatcaaatcattgctttgttggaaagggctgatgcagcttcatcacctaaggacaaggaacgcaaatactttgcgaaacgccaatctttgggtagtcaaatcttggagcctttgcagtcattctattgccccatcacccaggatgttatggtggatcctgtagagatttcatcagggcagacatttgagagaagtgctatagaaaagtggtttgctgaaggaaacaaattgtgccccttgaccttgattcctttagacacatcaattttgagacctaacaaaaagttgaaacaatccatacaagagtggaaggatagaaatataatgattacaattgccacattgaaagaaaaaatcctgtctggaaatgatgaagaagtactgcatgatctggaaactcttcagactttgtgtgaagaaaaagaccaacacagggaatgggtgattctggagagttacataccaactctcatccaaattttgtcaagaaaccgtgatataaggaaattatctcttgtcatccttggcatgctggcaaaggacaatgaagatgctaaggaaagaatttcagccattgaccatgcaattgaatcgattgtccggtctcttggacgtcgtcccgaggaaaggaagttagcagtggcattactgctcgagttatccaaatatgatttggcactagaacacattggacaagttcaaggttgcatactactattggtgaccatgtctagtggagatgacaatcaagctgctagagatgcaacagatctattggagaatctttcgtactctgatcagaatgttatacagatggcaaaagcaaattacttcaagcatttattgcagcgtctctccacaggaccagataacgtaaagatgactatggccacaaatttagcagaaatggagttaactgaccacaatagggagtccttatttgatggtggtgtactggttcctcttcttcacatgttctcacataatgatctacaggtgaaaacagttgctattaaagctcttaggaatttatccagttcaaagaaaaatggacaggaaatgataagacagggggctgcacgaccactacttaacctccttttcaatcaaagcatacacacagcaagtttgtgggaagatgtagcagccataattatgcaacttgctgcatcaactatctctcgggatgctcaaacacctgttttattgctagattctgatgatgatgtttttgatctgttcaatttagttagtgtcacgcatcttgttgtgcaagtgcaacagaacattatccagaccttttattccttatgtcaaacaccctcatcttcacttatcagatccaaactaattgagtgctcagcggttccaaaattggttcaactgtgtgagaatgaaaacccaaacctacgagcaagtgctgtaaagttgttttcttgcttggtagagaattgtgatgaaggcatcatacaggagcatgtcaatcagaaatgcattaatactctactccagatcataaaacctccatctaaatctgatgaagaggaaatactttctgccatgggaataatatgctatcttccagaaattgaccagataactcaatggcttctggatgctggtgcactgtcaataattaaaagttatgtccaagatgggaaagacagagatcatcaaaagaataacttattagagaatgccattggtgccctaagtcgttttacagttccaacaaacttggaatggcaaaaaagtgcagctggaactgggatcataactgttttagtgcagctgcttgaaaatggaacaaacttgacaaaacaacgtgtggcacagtctcttgctcaattttctaaaagctcatttaagctgagccggccaataccaaagcgcaaaggactgtggtgcttctcagctcccgctgatattgactgcatggttcatggaggaatatgctcagtcaaatcatcattttgccttttggaggctaatgcagttggaccactcacaaggattcttggggaatctgatcctggagtttgtgaggcttctttggatgctctattaacattaattgaaggtgaaagactgcagaatggtagcaaagtgctttcagaagcaaatgccataccacaaattataagataccttggttccccctcccctggcttgcaggagaagtccctacatgctttggaaaggatttttcggctagttgaatacaaacagatgtatggagcctcagctcaaatgcctctagttgacttaactcagaggggtaatggtagtgttaggtccatgtcagccagaatattggcacatttgaacgtgcttcacgatcaatcttcatatttctaa

SEQ ID NO: 75698 - DNA, 333 bp, Glycine max
  Peptide Sequence Number=SeqID_192476
atgtcgagagtggggcgggaaaaatctaacggggaggaaacggaggtaaatctataccttttgggttttggggtggaggcaggaaagaatggagagtttggagcgggatttacatatatcaccaataagggctatgctgcggaaggaccatataggagttatttcttggggggaacggagggtagattcttaaatgggagggcatctaagcttttacaaaggcttgggaacaacttgcgaaggtgcaatccctgcaagaatcatgaatgcaacagtcctagaaaagaaaaagtacacctctcacaagattatggaaaatgtttaaacatctga

SEQ ID NO: 75699 - DNA, 321 bp, Glycine max
  Peptide Sequence Number=SeqID_192477
atggcagagttgatggcatcacgggcatactgctgctttaagtgccagaaccttgttgctttccatgatgatattgtttctaaagatttccaggcaagcaatggcagagcttttttattctctcacgcaatgaacattattttgggtcctaaagaggataggcaacttatcactggtcttcacacagtggctgatgtgtattgctctgactgtggagaggaacttggttggaaatatattaaagcttatgaggaaacacagaagtacaaagaaggaaaatgcgtactagagaagttcaagataatcaagggcaatggatag

SEQ ID NO: 75700 - DNA, 141 bp, Glycine max
  Peptide Sequence Number=SeqID_192478
atgggagacccatttggttgggttttggatttaggttcattgcctccaaccattgtcatcgaatgccgattccagctgcggtcggcattcgattcctccttcgttcagtcccaacctttctccattccaaccacgaactag

SEQ ID NO: 75701 - DNA, 1920 bp, Glycine max
  Peptide Sequence Number=SeqID_192479
atgaaatcttggaacaatgaaatcttgggtagaggtgccttcaaaaccgtttatagggggtttgatgaagttgatggaatagaagttgcttggaaccaagttaagattgatggcctcatgcattcagtagatgatcttgcgaaattgtattctgaagttaatctattaaagtctttgaaacatgaaaatatcattaagttctatgattcttggattgatgataagaagaaaactgttaacatgattactgaactcttcacatcaggaaatttaaggcaatatcgcaagaagcataaatatgttgaaatgaaagctataaaaggttgggccaggcagattcttcatggcttagtatatcttcacagtcacaagccgcccattattcacagagatttgaaatgtgacaacatctttgtgaatggaaaccaaggtgaagttaagataggggaccttggtttagcaattgtcatgcaacaaccaaccgcccaaagtgttattgggactcctgagtttatggctccagaactatatgaagaggcatacactgaacttgttgacatctattcttttgggatgtgcatattggagatggttactcttgaatatccctatagtgaatgccaaaatcctgctcaaatctttaagaaagttacctcaggcatcaaacctgcttcccttaataaggtgagtgatccccaacttaaggactttattgagaaatgtctggttccagcatctgagagattgtcagcagatgagcttcttaaagacccatttctacaagttgagaatccaaaagatcccatcctttatcctttacaacctcctagcagaacactgagagcatattcattcaagtctggttctctatctatggacatggattctgactacaaaccgttttctatgagcatttattctgaaagcaaccaggaaaacccacattgtcctatttttgaagtgcagaggacatataagaacaacaagtttaggttgaaagggactaaaaatgatgttaattcagtatcattgaccttgcgaattgctgatacatgtggtcgagtccggaatatacattttctcttttaccctgatacagataccgcagtctctgtggccacagagatggttgaacatttggagctggcagatcatgatgtagatttcatagccgagcttattgattacttgataatgaaacttctaccttggtggaagccctcaccagatcattgctcatgtggagaattaagtccttattgtacaaatatagatggccaaacattaatggcatggccgtggggttctgtctcaactagtattccctctgaattggttattggtcaggatggcttctctgggtctgatacaactcccaaagaagattttgtggtgtctgagaatagcagtgtttccaaaattgctaataatgctacttttgagggtgattgtaattcttctagtctggttaaattggaagatcgatattcacaaggatctagagcttctgagatgattattgaaaatacttctatgaaaaatgacaattgtcatgattccaatgatgatttaagttctaaatgctttagtagttccatgtctgaacttagggatgtatattttgaggactgtaaattgcaacaaacagagtattgtgttggggaaggagttgtgataaatgaattcccaaagaactcggggtcagttcttggaacatccattaatgttgaaaatctggcaagtagctgttcttatgtgtcatcaacagaagaggacattgatcttgggctaaagtttaaacttgatgaaattgaggcacactatcagcattggattgatgaacttaatgaaatgatgctggaggcattggaatccaccagacggagatggatggccaagaagaaattggctgctcagtga

SEQ ID NO: 75702 - DNA, 375 bp, Glycine max
  Peptide Sequence Number=SeqID_192480
atgactaacttcctagccacaggagaattagaacaagaatattgcagagtaactaacttccaagacgtgagatataacatgagcaagattatagagcagacacaacaaattgctgaaagagagagatacagcaaagtgtgcgagattaacgatggtccaagcgatgccgggggagcaaccgaagacggagagaacgaggatccaagaaaagaaaaggatgaggatgtaagtggtccaaacgccagggtacgtgaaccactccgtgttcctgttcagatccgccggtggcaccgccttcacgtacagttttgccatgaattccgaagatacccttttaaccaaaaaaaaccccaattgcgcgatcccagatgctaa

SEQ ID NO: 75703 - DNA, 216 bp, Glycine max
  Peptide Sequence Number=SeqID_192481
atgctcactactgctagctggttgctgagtaaggatggtaataggtcggcgtacgacattgggattggggtgaattctacaggtttcctttctgggaaattcctccgtgggttggtgtttatgttaggattaggaattggatttggccaaggtgctcttggtcgaaggggcgttgggcaggggggaggatcgatattggccgagtattggtactag

SEQ ID NO: 75704 - DNA, 1230 bp, Glycine max
  Peptide Sequence Number=SeqID_192482
atgcctggaatgtggcttttggatcagaagaactgtgtgggggagccatttttgcggccttgtcatggtggtgatgtgaagggtgtggagtttgaacaagtgagagaggacgatggagaagatgtgcaggaacaagaggaggtggaggaggaggaagaagaggaggatggtgaagaggatgagcatgagggcgggttccatctctcgcccaagtgtattcctatggaggggatgtcttctgggaatgggggtctcattcaagttatggaagctgggcaaatgccttttggttctgggattgatctccgtgacaatccggtgggagattttctgtcgtccagggatgagccccagatgatttctggttcatcactttttggtaatggtcacaagagagacaaccttggcctggataatcatcattctctgaatggcagtaacaagcggctgagaggtgatagcccgtggaactccaagccaatggactttgaaacgtgcatagaacagatggaacattggatggggaaagctagaatgatgtttgcaacaaaagatcaggcttgcgaagaatctacaatgaatcagcaactcttgattaatgagctccagaagcgagataacatgattgagcatttgcataaggcaaagttagaagaggctcagaaaagacagattgaggtatatcggttcgagaaggaactttatatgatgcaaagtcttgttgatggctacagaaaagccttgaaagaaacacggaaggcttttgctgaatatagagcacaatgtcctcaaggtgataatgaaccactttataaagatcttcctgggtctgggggccttgttttgactgcggtggaggtggaaagggaacgtctgaagaaggaagcagaagaaagggcaaagttgagagatttcatgatagattttgaaaagaagactacagattttgagtccacttggtttgataaatttgaagctcataggagtgcagttgaatccctaagtgagaggttgctggttttggaggaccaagtaaaacatttgaatgaagtgaatgctaatcacaaggtttctgatcccattgaatgcagggtttctgatcccattgaatgcaaggtttctgatcacattgaatctgatcccattgaatgcaaggtttctgattccattgaatgtaaagtttctgatcctatcgaatgtgttccaacaactgaaggagaaactgcttag

SEQ ID NO: 75705 - DNA, 219 bp, Glycine max
  Peptide Sequence Number=SeqID_192483
atgtctttcaacatatgcgtatttgaggataggaaatggtcccaacgaagcttgcctcaaagagatccaggaaagacaaagcggctgaaggaaccagttccgctcccgaatatgacagccatcgttttaggagcgctgagcaccagcagtgcttcgaggccatcaaaggatggtcattcatccgggacgatgagtataccgacttccaggaagagatag

SEQ ID NO: 75706 - DNA, 192 bp, Glycine max
  Peptide Sequence Number=SeqID_192484
atggcggctcgtggcggccaccagtggtcgtgggaggtggaaaaggagcgagctcgtctcgctaagtgggagtccacttttcttgctcagcatgcaaattctcgctcagcgcaacttcctctgcactatggctcgctcagcgggctaattctcgctcagcgtaattccctcgcgggttggaattacacttag

SEQ ID NO: 75707 - DNA, 189 bp, Glycine max
  Peptide Sequence Number=SeqID_192485
atggcaatctcaaacggccataacttttggctcggatgtccgattcaggctaacaatctgtcgagaccctcgaaattgaacaacggaagctctcgagaaattgaaatggctcataatatatcgacaagctcgaaattaaacatcaaagtgcaattgaatgaaaggtcatttaaggcgttggaccattaa

SEQ ID NO: 75708 - DNA, 255 bp, Glycine max
  Peptide Sequence Number=SeqID_192486
atggccaaatctgcaacactaataagggcaccaccttcattagtaaccacaaaaactttcatggtcaacaagtttttacaacaacccaacactaccattcagaagttatttgccacaatttgcaacaacaataacccaccaaacaaccaacatgactcaacctccaatgttgaggacctattatatgaatacgagagttgttgggtcaaagaccatggtagtgatagtgactcctcttccaggccggaaggatga

SEQ ID NO: 75709 - DNA, 756 bp, Glycine max
  Peptide Sequence Number=SeqID_192487
atgaagacaattaccacattaacctacactatcttcaatcttcttatcttttgtaatgcatggataagtgcaagtgaatgtcctccaatgcactggtataattcatccaacctagaagccatgaggagtgcaaaaactctcaagaactcctacaatctcactgacaacaaatttgcagatcttactaatgaagagtttgttagtccttatctgggttttggaactaggttccttccacatacaggattcatgtatcatgaacatgaggatcttccagagagcaaggattggaggaaggaaggagcagtatctgacatcaaggatcaaggcaattgtgtggctgctgtggaaggaatcaacaaaataaaatcagggaagctggtttctctctctgaacaagaattcagagactgtgatgttgaagatggaaaccaaggctgtgaaggggtagatggcacatgcaacaaggaaaaagctttacatcatgcagccaatataagtgggcatgtaaaagtacctgctaatgatgaggctatgctcaaagctaaagctgctgctgctaatcaacgacaactcaatcatggtgtgactatagtagggtacggcaaaggaacttctgataagtattggattgtgaagaactcatggggtgctgactggggtgaatctggttatattaggatgaaacgtgatgcttttgataaagctggtacttgtggcattgccatgcaagctagttaccctctcaaggattaa

SEQ ID NO: 75710 - DNA, 306 bp, Glycine max
  Peptide Sequence Number=SeqID_192488
atggaagatgatgattttggtggtgaaggcagaggcataggcgcaggatctgcaattattgaagccttggacacaggaaccattggtgcaggaacctcaaagtcattgaaggatttaagcgatgattacaaggtgttcttgattagcagattggtctccatgtgttcagtaaggaaccttctttccatagtctcttctaggaaaccttacccaagtagtggcaatgtcattgcagctttaaagtacttgtgcaagtcaaagacaaaccaagagcaacaaggaggaatatcatggattaagcattga

SEQ ID NO: 75711 - DNA, 321 bp, Glycine max
  Peptide Sequence Number=SeqID_192489
atgactatccttgttgttgaagccacaatgaaggataaggaactaggagttcatatattgtgtggcatccacaacttcttcgaagaccccaagttgatggtgcttgaacttgtcagagagttttggaggactgccaaagtttacaggaatgaagacattggaggatactttggtggaaaagttcctggaatacaagtgaagctaacagctgagatgattgttcaagccattggctacgaacgtcacagaaccaagttcatgaataattgggaaaatgaacttaaaaaccacattgggtactccatgtggggacccaactag

SEQ ID NO: 75712 - DNA, 726 bp, Glycine max
  Peptide Sequence Number=SeqID_192490
atggcatttgggaccatggctgctcgcctaagcgagttgatgcttcatcctgaagtaactggctcgcccaggcaagctggtcctgatcaagaggctcgatctcctcaaaggaagaaatctatcacatttgccaagtctccttcgtcatcatctcctggggcctcggccgcgggtaagggttggggtcctggcactgctgctgcaatgtatactgatagaagctatcgttcaactgcacctggcccctatggtttgctgcttgctggtcagccaaatgctacatgtagagctccatcctctgcatgtgagttgagatggactctagagattgtagctactgtggaggtggaggtggtgcgtctgcggccgactactactggtcctgccccggtgtctcggaggtgcgatacctacaaactggtagatggcatccgagataagctaggctacatgaacactaatctgggtcaggatagcgtagaccaattgacatataggcaacgggagatcaaaattatgatcactgggaaggatcttgttgaggagaagcgtcatctagatttgggtcaaggtggtcatggtagtgcgcatgatccgcacttgcctccttgtcacaatgaagtaacagctcgcctgggcgagctaccttcatcccaaatgccttgttttgctataaataggtgtgaagggaggctgaggaagaggttccaaggtccagaggtctag

SEQ ID NO: 75713 - DNA, 225 bp, Glycine max
  Peptide Sequence Number=SeqID_192491
atggaaggtgtcgttgttgtgtattatgatggtgatatggtaccatcttctgagggggtattgtttggatgtcttaatggtcctaaattcgttaaaattagcgaggaaatgttgcttgattttatgaggaaagcaattacgaataggggtgggtatagggacttagaactgcggactgacctgttaagcccatggaccttgcgaataatgaacctctttttttaa

SEQ ID NO: 75714 - DNA, 255 bp, Glycine max
  Peptide Sequence Number=SeqID_192492
atgctacatgttggacaaaagtccgataatttcacctacacttttgtccccaaggcatgtggggaccttctgcttcggcaaattggtagaaagatctcaagcaagaagaggggtgatggaagtgagtttcagatctggtccattaaaaacgtccttgctggaatcttacttatactgtccaaaatcgacaacaccacgatgacggagacagagttctcaatgcagatggtgtcgttgatgctggttcttctttga

SEQ ID NO: 75715 - DNA, 129 bp, Glycine max
  Peptide Sequence Number=SeqID_192493
atgcataaaagtcaagtggcaagcgatagtgggttgtggtggccaccggtagtcatgggtggtggaaaaggtgttaagatctcacttagtgagctcatctggttaagagaaattcaactttgggtttga

SEQ ID NO: 75716 - DNA, 570 bp, Glycine max
  Peptide Sequence Number=SeqID_192494
atgtcgcgcgccatcatgcgctgcgagggtttccgaggtttcggcacttccttgatgggaacaatttccgcacaaacaaattctatctacttattaaaaaattgttacaggaatggttttgaggcattaaggaaaattctgggtgttgatgggccaagggggttttacagaggcttcggggtttcgattgtgacttatgttccctctaacgcggtttggtgggcttcgtattctatggtggttgtggtgattgtgggtgtgcaatggttgagtgcggttatggctagtggggtttcggctgttgtggctatgccacttgactcgatcaagacaatgtggatgcttcataagctgcaagtgttggattcagaagagattaagggacaaaggaggtcactgactcttgtgcaagtggttcggaattcggtgaagaaagggggaatcttgggttgttacaaaggattgggaccaaggtgggcttcgatgtccatgtctgcggcaaccatgattactacctacgagttcttgaaacgcgtgtctgctaagaatctagatagattgactgtgtag

SEQ ID NO: 75717 - DNA, 234 bp, Glycine max
  Peptide Sequence Number=SeqID_192495
atgacgacggtcaacaatcagtctcctccctttgatcttctcacacctcaacttcttttcacttccctccagtttcgattatatagatacaacaaagacgcggttggagcaacaacgaaggcagtggagtggcaacatggcattgggatcccttcttgtaactgtgaagatgtggttggagcaatgacaaaagcggtggcatggcatcgggaacgagatgaaaggagtaaatga

SEQ ID NO: 75718 - DNA, 502 bp, Glycine max
  Peptide Sequence Number=SeqID_192496
ttccatttttccattcaacaacacaacacctcagacagacatcatggaggcaggttacaatcctcgtaccgtcgaagaggtctttagggatttcaagggtcgcagagctgctttgattaaagccctcaccaccgatgttgaagagttctaccagcagtgcgatcccgagaaggaaaatctttgcctttatggatttccaagtgagcagtgggaagtcaatctgccagctgaggaggtgccccctgagcttccagagccagcattgggcattaactttgccagagacgggatgcaagaaaaggactggctgtctttggttgctgtacacagtgatgcttggttgcttgctgtggctttttattttggtgctaggtttggatttgacaaggctgatagccccgttatggtggcaccaaaggccacaatgccatatttatgtggtggaattttggccttcggccatattccaccatccgccattggtgacactgatcttaggtag

SEQ ID NO: 75719 - DNA, 462 bp, Glycine max
  Peptide Sequence Number=SeqID_192497
atggtggtgtggcctcgcttagatgagtggaaagcagttcctgatatttggagatcttctgtagagaagtatggtgataatgtagccttagtaggtccatatcatgatcctcctacaactatgacggaagctcggttgcatgggaagacaaaggccgattatgttggaaacgtgccttcttatcttgaggctagtgtaggaccttgtaacatcccaaaacccagtacatgggaacttgtggagcataacaaatgggttaggtcttgctattctagtcttctagcttaccctatatcgattggtgcaaaaagcttgtggacctgttgctctagttcgtatagaaggggtgttatccatacttctcttgcaatgctatcccctcatgaaaatgttatcaggcttcacactggacatagtgatcaatattgcctccattctgaagaatgttttgattgtaagtga

SEQ ID NO: 75720 - DNA, 168 bp, Glycine max
  Peptide Sequence Number=SeqID_192498
atgatgttcaatcaccattataatgatctcaagtcaaataatgcggaggatgtagattggcttaaacacatcccaaagcaaaaaagagctcaagcatttgctgaaggtgtggaagatgttgaagaaatggagttacacgctcagcatgtcagtgcatgcttagtgtga

SEQ ID NO: 75721 - DNA, 1869 bp, Glycine max
  Peptide Sequence Number=SeqID_192499
atgtcccatcttcccctcattttgcctgctttaaagccttttgggtttcacaatccacgaataagcactaagcgcgcaggttgcactaagcacgatgtcgatggtcattctgatcactttggtagtgcttatgataacaatccaattcaagcatcaatgtcttactatggagtaattgaagatatttgggagcttgattatagtgaattcagagttgcttacaacaacgacccattcatcatggtagcgcaagctagagaggtgttttatgtccaatattcgtgtgactcaaaatggttagtggttctacaagggagaacaacttgtattggtgaccatattgatggtctaacggttgatgtgagcgagatgccacctttttgtcaacaaatgcctttcataaatggggaaggtgaggaggatgatgtacatgcaaatcataatgatcatggtgaaggtttatgggagaatattcctatacttatggcaacacccccaaggtcccctccacattcagatattacttcagaggctacgtctaggaggactagacaattcacccggctgagaaggttgattatccgaactttggatcagccacgaccaacggtcaacgtcaatcctgccactaggaaaggctcgggaaaaattcctattctctacaacaattggaatgatgtaccagactctttaaagaacttagtatgggagtatattttgggtaaatttgacatccctgatggtaacaatgccaaaaagaaggggatgtcaatggtcgctactagatggaggcaatttaagtcctccctgacgataaagtatgtttatgctgacaatgatggtgtccaaaaagatcatccttttgttaagtatggtattgatgcaactacttgggtcaaatttgcaaaaagccgccaaacccctaactggcagggcatacggaaaaaggcccaggaaattcaaaaatataatgactgcccgcacttactgtctcgtgggggtatgacaatcagccagtattttggacacgcatcttttgactccgacacttcctttgcattaatcacacaacatcaattggttgaaatcaacaataacctgaaggaagagtggtggaaagaagtagaagaagaaaacaagaacctacaagaagcatggaggaagaaggcaccaaatatacaagtattagctgcacatgtgagcaccaagggtagctgtgctaaagctgacacaaatccattaggtaaagatccttctaatgtgcacgtggatacaatgggtttgtacttatttggtgaccagtgtactcaactagtgccattgggaaaactcccatttcgaacatctgagcttcaatttgtgaggcaggccattgggacatttgtgggttggccgacacatcttgtgaatgttgaggaatcacacaactatttgcctaaaccggttgcatctggtgaaatggacaatgcagtggctacagttgatccattaggagaattggtgaagaacttgtatgatgtttaccaaaggccaattcagttgatgtgggatggggcaaaatttgggatacctgatgtcaaagatggctttttcatcacacacacagatgtaactgagataattgtagacaatgttgttgtttggttttgttctttgcgaaagaagtctgatgttaacatcaaggctacagttaacagtgcaatgaaggcattaaccactactttggaaggaaagccaggtcaagttgtacatcggtggattgaaccaaaggctcatccttggttcaaaggtgtggagtgggacaaactgtatgaaatggaggccgcattaaacatcaagtcaacggggaactggggccacaaattttga

SEQ ID NO: 75722 - DNA, 339 bp, Glycine max
  Peptide Sequence Number=SeqID_192500
atggttggattggaactcatacccattctacacaatattgactgttatgttcatcaatcgtggccgcttctacctactgatgaggtgcagatacaccgtcaagaaagttcaacaagtcacaagggacatttgaatgtctctgcctatgctatatgtcacaaaatcgaagtcctatcaataattattgatcaagatagtaggttacaaaatgaaatgaaaacgatagagtttgaggcttcacaatctcaacttgctattattcacaggttgaaccatggaattagggagaaaaaactggatcaggcttttgcaaatgacatgcttgaggaattagtatag

SEQ ID NO: 75723 - DNA, 3804 bp, Glycine max
  Peptide Sequence Number=SeqID_192501
atggcagaagacagaccaccaagggtgactcttgaggactattctagttctaccatgccgcagtttttcactagcattgctcgtccaaaaatagcaggagttccaaaaaatgccataagactcaatctgttttcattttcgctagctggtgaagctaagagatggctgcagtcattcaaagggaatagcctgaaaacttgggaagagacaactgaagggaaggcaaagatttcttcattccatgagtttccagctgggggaaaaattgagttaaagactcctgatgaggccatggaattgattgagaacatagtagctagtgaccatgccatactgcgtgacatgactcacactcccacaaagagaattcaacctacccattccacaatcatgcaagttggagggtgcaacatatgtgggggagctcatgagtccggtgcatgcatgactcaggatgaaacctctaaggaggttcattatatggctaatcagagtagacaaggtttccatccaggtggctatgcaggatatcaacaagggggtaacttctctcataaccaagaccaaaggggtccatctaatcagcctcctaaccaaggacccaacttgtatgagcagaccaccaaacttgaggacacactgactcaatttatgttggtctctatgtctaaccataaaagcacagaatcgacgattaaaaatatggagatgcaagtggggcaattggccaagcagctagctaaaaaatcctttggaaattttgggtcaaacactaggaagaatccaaaggaggagtgtaaagttgttatcactaggagtcaagggagagtgttagtagaaagaaggaagaagaatagtgtagaaaatgaagaaaagaacaagaaaagagacacaaaagagattgagcgacaagagagtgatgaacgggctgtcaatccctattttggccaaggaagccccatatcctttgctgccttcaaggaaggacaaggagcggaccttctcactaaaaaagggaaatatatcaataatgagagtatagtggtggaaggaaattgtagtgttgttattcaaagaatattgccacagaaattcaaagatctcgggagtgtgaccattccttgttccataggagctgtatcagttggaaaggcgctgattgacttgggagcaagcatcaatctaatgccactttcgatgtataggagaatagggaacttgaggattgcgcccataaggatgacacttcaacttgtagatcgcttgatcctgaggccctatggtgtagttgaagatgttctagtcgaagtccgccaattcacatttcccgtggattttgtcattatggacattgaggaagattcatatattccactgattttaggtcgcccattcatgttgacagctaagtgtgtagttgacatgggcaatgcaaaagctaatatgggggtgcaaaacatggcctctcactctccacttgagaaggcattgatgaatgctattgattgtctcacaaaagaggaggagagagatcttaaggcctatttggaggtcctagataaactaaaggtaattcctttaggggaatgtgtctttgaagagctaaagaagaatcccacaatagagaaacccaaggtagacttgaaagtcctgctagcgcatttgaagtatgtattcttggaagagaatgaagcaaagtcggtggtgattagtaataccttatcctctgtgcaagtggtccccaagaaaggtgggatgactgtagtgagaaatgagaagaatagccttattcctacacgaacaatcttagggtggctaacgtgtattgattatcggaagctgaaagatgccaccaaaaaagatcacttctctcttccatttatggatcatatgctcgagcggttagccaatcaatcattttattgcttcttagatggctattcagggtgtatgatggcaatattcgctgatatggtggagaaatgcttcaaagtgtttatggatgatttttcagtgtttggctcatcgtttgactgttgtctgatcaatttggagttagtgttgcagtgttgtgaagaaacaaacttagtgttgaattgggagaaatgtcatttcatggttcaggaaggaattgtgttgggacataagatttctgtcaaaggcattgaagtagacaaagccaagatcgatgtcatagaaaaattgcctccaccagtcaatgtaaaaggcatcagaagtttcctaggacacgctgggttctataggcgtttcattaaggatttctcaaaaattgcaaagccattgagtaatatactcaacaaggatgttgtgtttcaatttgatgaagaatgcttgacagcatttgaaactttgaaggatagattggtgtctgccttagtgattacagctcccgactggagcaaagaatttgaattaatatgtgatgcaaatgactatctagttggttcagttttggggcagcggaaggaaaaagtgtttcactccatatactacgcaagcaaaatcgtacttggttggatcaagagtaattgtgtttacagatcatgcagccataaagtatcttctcacaaaggcatactccaaaccaaggctcatcagatggatcctcttgctttaggagaattggaaattcctgatgagttccttgatgagtcattgctagttgtgaacgagagaccatgggatgatccttatttgtttaaaattagagctaacaatttattgaggagatgtgtgaccaaggaggagtctagaagtatattatggcactgtcataactcttcttgtggaggtcagtacagtggtgataagacaactgcaaaaatcctacaatccaggaatgaaatgcctcttcagaatatcattgaagtggaagtttttgattgttggggtatcgacttctttgggcattttccttcatcttatgggaatgaatacttattgttggctatagattatgtgtccaaatgggtagaggctattgctgcaccaaagaatgatgcaaagactgtcatcaagttcctgaaaaagaatatatttgctcgctttggggtactacgagtcctgatcaacgatggaggtttgcacttctgcaatgcccaactgcagaaagtgctagggcaatacaatgttacacataaggtggcctcaccttatcattctcaaacaaatggtcaagttgaggtgtccaacagggagttaaagaagatctcggagaagactgtggcatctacaaggaaggactgggctgccaaattggatgatgctctgtgggcttaccggattgctttcaaaactcctataggactatcaccttttaagatggtctgtgggaaaggctgtcatttaccagtagagatggagtataaggcctattgggcactcaaatttctaaatttttatgaagtcttgtctggggaaaagcagaaacttcagctcttggagctagaagaaatgaggctcaatgcatatgaatcttccaagttgtacaagcagaagatgaaggcctaccatgacaagaagctgttaaagaagagttttcaaccaggccagaaggatttgctcttcaattcaaggctcaagctgtttccaggtaaacttaagtccaaatggtcgagatctttcattattaaggatgtgaaaccttatggagcagtggaattgatggatccaacttcagataatccagagagaagctgggtgataaatggtcagaggttaaaactgtatcatggcggcaacatcgagaggctaactaccatcctcatcctgcaagacccttag

SEQ ID NO: 75724 - DNA, 276 bp, Glycine max
  Peptide Sequence Number=SeqID_192502
atggactggtactatggatgtgaaagtagtgattttcttgttcccaaagatcaagaagatttattggaaaggcgtccttcaccagaaaattgggattctgtacttgaagattttccatgtgttgaaagtctatgcaaatctttcttttacactaaaaaccattgcagcaacacaactggtgagaactgcattttagtttctgaacaagtgaagggcagaaagatattgcagcttcagggtttgttccatgtaactcggactccaaggattgcctag

SEQ ID NO: 75725 - DNA, 783 bp, Glycine max
  Peptide Sequence Number=SeqID_192503
atgtcaacagcccctaacactgaccccgttaatgtagaaacatcagatcgtatggaagacatgatacgcgatcttgggcaagaggcttttcagcaagctcatgcaccttattatggcaaattacaaatagattcaaagatgtcattgtatttggaatgcacaaccttcactcagttatcagtggtgttaggtttagggaacttgaaggccagatttggaaatcagtttgcagaaatgcgtaattgcccgacatgtggggtcttatgctacaaactgaacaatggccaaagcagtgatgatgcaaccacaaataatagtcatccaacaaagacaattgatcagttgtatccggaatttggaaaggatccaagaaacctaaggcttggtcttgtttcagacggaatgaatccttttggtaacttgagcaccagccatacgggtccaagacagcaaggaaatgatatagatgtgtacttgactctgttgattgaagacttgagaaaattgtgggttgacggggtgtcgcttagcgcatggtgtgcgcttagcgtaattgccataaagattatgctagagacgtttttgggcttagcgagaaagatacgctcagcccaatttgcattaaaagccacccagagaagtttttgggctcagtgcactcttgtgcttagcgagaagtttgggcacttagcgcaaggagtttgcgcttatcacgcatgcaatgagccaacaccaacttctagaattcaattaccacctaactcttatgcactacatccataa

SEQ ID NO: 75726 - DNA, 417 bp, Glycine max
  Peptide Sequence Number=SeqID_192504
atggcgtgccatatcatgaaccagagtcacacttgcatggtaaaatgccatgaaaagttgaggaagatacctctcatgcaggaatggacagttgatttggagatagtttctttggcgggtaacatgatagaagaaatcccaaagggcatatcacctaattgcccaccgattgattttttcacacacgagtgctttagaggatcaaacgagtcttggattagtttcacaatacaccctgcatcaaactacattagaaaagtcctgcattttagtattgttccaccagctacttgggaccttatgattgccccagggacaaaagtcttgcaggtctcactcaagtttgaatctttcacgagattggtatatggaatatgtggaaggtgtcaaggccattggtttcttcttcttgcctaa

SEQ ID NO: 75727 - DNA, 3576 bp, Glycine max
  Peptide Sequence Number=SeqID_192505
atgtttacgccgccgagggtttggtcgggttggtccctgactccgaacaagagcggggttcggggaggaaccgggtcgggttcggaattgggtccgaattcgggagatggagcgagcgcgaagggaaaaggtgtcgtggttgttgagaatggtgggaacttggatcgcgaggttttggttgagagggtttccagcctcgagaaagagctttatgagtatcaattcaatatgggactgctcttgattgagaaaaaagagtggagttctaagtatactgaactaagtcaagatttagtagaagtgaaggatgctctagaacgagaaaaagctgctcatttaatttctctatctgaggctgagaagcgagaagagaatctgaggaaggccttgggtgttgagaaggagtgtgtgcttgatcttgagaaggctctgcgagaaatgcggtcagagcatgcaaaaattaaatttacagcagactcaaagttggctgaagcaaatgctttagtagctagcattgaagagaagtctttagaagtagaagccaaattgcattctgccgatgccaaatttgcagaaatcagcagaaagagttcagagtttgataggaaatcacaagagctggagtctcaagaatctacacttcgaagggatcgattatccttcattgcagagcaagaagtacatgagagcacattgtctaagcagagagaggacttgcgggaatgggagaagaaactacaggagggtgaagagaggctggccaagggtcaaagaattatcaatgaaagagagcaaagggctaatgagaatgacagactatgcagacagaaagagaaggaccttgaagaggcacagaagaagattgatgaaactaatataacactgagaaataaagaagatgatgttaacaataggattgtgaatattactctaaaagagaaggaatatgattctctgagaacaaacttggatctcaaagagaaggagttatctgcatgggaggaaaagctcaatgctagagaaaaagttgagatgcagaagcttcttgatgaacacaatgctattcttgatgtgaagaagcaggagtttgaggtggaattggatgagaaaagaaaatcctttgaagatggattgaagaataaattggtggaagtggaaaagaaagaagctgaaatcactcacatggaggagaaagttgcgaaacgggaacaagccttgggaaagaaagcagagaagcttaaagagaaagagatagagtatgaacaaaaagtcaaagctttgagggaaaaggagaagttaattaaatccgaggaaaaaagtttggtgactgagaaagggaaaatagaaagtgagagagaggaattgctcacacataaggctgaagttgagaaaataagagctaacaatgaagaagagtcgttgaggataaatgaagagattgatcgacttaaagtgactgaggaggagaggtctgaatatctgcgcttgcagtcacaattgaagcatgaagttgatcagtacagacaccagaaagaactacttctgaaggaagctgaagacttaaggcaacagaaagagacttttgaaagagaatgggatgagctagatctgaagagaacagatgttgagaaagagctgaaaagtgtgattcaacagaaggaagaaatattaaaactacaacaatatgaagaagaaaagttaaggaatgagaagcaggacacacaggcatatgtgcaaagggagttagaaactcttaagttggctaaagagtcatttgctgcagaaatggagttggagaagtcaagcctagctgaaaaagctcaaagtgagaggaaccaaatacttctggattttgagctgcagaaaaaggaacttgaagctgatatgcagaatcagttagagcagaaggaaaaagatttgatagagaggaagaagttatttgaggaaaaaagagagagtgaattaaacaatattaacttcttgagagaagtagctaatagagaaatggatgaaatgaagcttcaaagaagtaagttagagaaggagaaacaagaagctgatgagaataaaaaacatcttgaaaggcaaaggatggaaatgcaagaggacatagatgtacttgttgacctcaacaggaagctgaaaaatcagcgggaacaatttattgtggaaagacgacgctttattgagtttgttgagaaacttcggagttgccagaactgtggggaaatgatctctgaatttgtgctttctgatttacaatcctctgttgacattgagaacttggaagtgccatctctcccaaaattagcagctgatattgtacagggagtttctaatgaaaatttagcttcttcaaggcaaaatactggattgtctcctgcaactgatcccaagtcacctgtttctggtggcactgtctcttggctacgtaaatgcacctctaagatttttaaaatctccccgattagaaagattgaatctgaagattcgggtactttaagagatgttgtgactttgtctgttgagcaaactaatgtggaagattcaccaggaagaattcctgatgctgaaaatgaagcagagttgtcatttgctgttgtaaatgattcttttgatgctcggagggtacaatctggcaatgatatcatagaggttgaagctgaccatgatccttcagttgaaaacctgaacaatgttgacagtaaggcaccagaagatttgcaggctcctgattcaaaggttgggcagcagaaatcccgcaagggagggggaagacccagagtaaagcgtacacacactgtgaaagctgttatcaaagaggctagggatatacttggggaatctgctgaagcattacctggggaatctgtggatgatcatgagactgagtttccaaatggaaatgctgaggattctgccaatgtgaattctgaaagtcagaaaccatacaatagaagaataccagcgaatgtcaggaagcgtaaccgggttcaaacatcatctcaaatttctgtaagtgggcatgatggcgatgccaatgaaggacattctgatagtctaatacctgggcagcgcaagagaaggcgacagaaggctgctgctccccccgcacaaactgctggtgaatcaagatataatttgagacgactcaaaactggagcaacaacttcatctgctagagctatgtctggtggtggcaaagaaagtcagggagaggttgatcgtgtaaaagatacagaagagggaattattgactcaaaaacttctcattcacattcagtgggcattactaatgagaatggtgaaagcatacatcttgagcagtctctgaaaggtgtggagacaagggccggttatggtggtgataccacggagacctttgccaacaatatggccttgagtgaggaggtgaatggaacagcagatgatgtggaggagaatgatgctgagtataggagtgaatcccgtggggaagatgctggtggagttgacaatgaggatgatgaagaagattacctgcaacccggtgaagcttcaatagggaagaagctttggaatttttttacaacataa

SEQ ID NO: 75728 - DNA, 1182 bp, Glycine max
  Peptide Sequence Number=SeqID_192506
atgttcccttccactaattacacctcctcaggctcttaccctcgtttcccttcttcatcgtcttcttccacttcaccctacccttcttttactctccttcatcctgaaaattcttcttccagcaacacctttctttgtgacccacttgctcttacctacataccctctcattaccatgctccaataatcccagaaacactagccaattgggctgttgcagattgtgcaatactgaatcaggatctcggtggtgccctttatggcatcaccaataaaccagagaagaaagcaaccaaaaaagataggcacagcaagattcacacatctcagggtttgagggacagaagggtgaggttgtccattgagatcgcacgcaagttcttcgatcttcaagacatgttagggtttgacaaagccagcaacacccttgactggctcttcacaaagtccaagaaggcaatcaaggagcttactcgaagcaagcacagtgctgatagcttcgaattctcctcatcttcggatggtgaagtggtttctaccatccaccaagacctacaccaacaacaaggggtagatttggaagagggaaagttgaaagaacctgcagcttattgtgttaaagcaaagatgaaggaatctagggaaaaagcaagggcaagagcaaggcaaaggactagtagcaaggtattgtgcaacataagtagcgaagggaaggtgcaagacttgaagaaaaaatgccctgcaactgaaaaccctcaaatcctgaaccaattaaggtcaccccttcagcctcctcatcctcaagatgtgggtggagaagtgccaagagatgatgacttcaatgttattgaggaatccattgtcatcagaagaaagttgaaacacactttgatgtcttccattcatcaccaaaacgctgtgatccctaaggaagcaagtgtaaacaacagtgactaccactccttccccaatctgtctccaaattgggaagctaataataatggtgctaatggacgctccaccttttgtgcaatagccagcatgaatctatctacagcccatgaaaccgcttgtgatctttgtgatacttacagtcctatatatgtcttgaattttagggcttcaaatttttggaaaatcttgggaggagtgcaccaatcctcatccaagctaatatcttag

SEQ ID NO: 75729 - DNA, 618 bp, Glycine max
  Peptide Sequence Number=SeqID_192507
atgaatgaagttacccgagtctttctgggtgcttcatcagtgttgtctaatggaacaatttattcaggagttgggactgcttgtgttgcaatggttgcccttgcattctgtgtccctattttagtatgctgtgaggcttataaatttcatgaaagggtaccgcatgattctatatgcatcaatgaacttggtgatccagacatcacttctacggttcagagcaaagaggatgccaatcacttggaagcttgggccaatacggaaaatctacaacttctaaacctgattctgaccctgcattctcttattgatgccaactatgatgcaacaccttcagattacgtttccatgataataacagattatagcatggttccacccacaagtgtacctgtaattgtaagggaatataccagagaacaggcgcattctacattggttaaatcggtcattctacatcggttatggaccgatgttgtagaagacgatgtaaaaaggggttggtgttttacgacggttgtgggaaaccatgtagaatggtgtgaattctacaacggtcgcttggttggccgatgtagattggcttctatactactacggtcccttggcatggactga

SEQ ID NO: 75730 - DNA, 498 bp, Glycine max
  Peptide Sequence Number=SeqID_192508
atgcacaaatgccctaggtgtggggtatcacggtacaaagtgaagaatgataacgagtgtagtagtgacaaaaacaaagaagggcccccagcgaaggtgttgtggtatcttttgatcattccaaggtttaagcgtctgtttgctaatggagatgatgcaaaagaccttacatggcatgcaaatgggagaaactacgatggaatgctctgtcatccggttgattcctcccataatttacagcttgcctccttggttgtgcatgaagtgaaaatacatgatgttgtctataatgatattgagcccaagacaactaggatcgatgtttatagaaaaaattgtgatagtgtcattgggacccttcttaacattcaaggcaagacgaaagatggtttgaatactcgtcaagatctagctgagatgggtatacgagcccagttacattcaaggtctaatggtaaaaaaatattcttgatactttgtctagaaaggagaagatga

SEQ ID NO: 75731 - DNA, 405 bp, Glycine max
  Peptide Sequence Number=SeqID_192509
atgacccgcaccaagaaaactgacgaaatgacgtttgaggcagcaaagaaaattgatgacaagattgattccttggagggagcatgccttacagggttcctttgtcgcccatggacgtcaggatgtactgactgttgtcattgggtgaccagaacactctggtcgtgttcatgttgctggagccagtgtcacgatcaaacaatattttggaccggctctaaggacctctcgcacgtcttcgtttatggctcccaaagccctggagcagttgacgcaaaaaatcagggaccagctggaggagtcgatcacaagaaaagtgactcgaaaactaatgttgtccttcagccatatacaatcccaatttcaatcattgatacaatcatagggactcacagtgcctcctga

SEQ ID NO: 75732 - DNA, 753 bp, Glycine max
  Peptide Sequence Number=SeqID_192510
atggccagaccagggctgttctacaagcctcaaaggtcattatatggtttgaagcaagctagtagacaatggtatgccaaactctcatcctttatgttttcacatggatacaaacaacgtgcttctgatcactctttgtttattagacatggttccaacagaatttttgtcttgttagtctatgttgatgacattgtcttattaggcaatgaattatctaagattcaaaggattacttatttgttggatgatactttaagaataaaggactttggagatttaaggcatttcttggggtttgaggtagccagaagttctaatgattgggctggttgcattgatactaagcaatctatcattggctatgctgtctacattggtgatttattaatttcatggaagtctaagaaacaagctactatttccagaagctccacaaaggttgaatatcgcgctttagcaagtgctacttgtgagctacaacggcttacttacttgctcgaagaattgaagatccaatttcagaaccctattgtcctatattgtgataacaaatttgctcttcatatagtagttaatcatgtttttcatgagaggaccaaacacattgagattgactatcatattgctcatgagaaagtactgaatggtcttgtgaagcttcttcctatttcttctgcaaatcagctagcagacatttacactaaggctcttatgcctgatgcatttcagtttttgtattccaagctatga

SEQ ID NO: 75733 - DNA, 681 bp, Glycine max
  Peptide Sequence Number=SeqID_192511
atgattgctagtatcaaacccgccctagataaagtcaagtcaagtcaacaaaatcccgagcctcgaaaatcgaaagtgaacaccctctcatctcattcattctcccacaaagacatggactcgcattgcctcttacgtttccgcttcgcatgttttgttctcttcgcttccgtcgcatgttgcttttcacacccttctctcctcggtatacaccctctagatgagaaatattacaactctgaggtgatcaagtgcagggatggatcaaaatccttctccagagaccgtctcaatgacaatttctgtgattgtcctgatggcactgatgagcctggaacttcagcttgccccaacggaaaattttattgcagaaacctaggtagcaagccgcagtttatagtttcttctcatgttaatgatcatttttgtgattgttgtgatgggagtgatgaatatgatggaatcatttgttgcccaaacacatgtgtcatgggtgggaatgctgagtccacgtttagcaattgcaagtcagaagcaagtcaaaatggagtgaagtcagaggaatcagttcatactggtttgaagttggtgattattctacaagtggttctggttatttttctggtatttctctggagttttcgttgccgcaccagatctagaaggagacattaccgttga

SEQ ID NO: 75734 - DNA, 563 bp, Glycine max
  Peptide Sequence Number=SeqID_192512
tggaatgcatccggcatgtgcagcatgcaagcatcaaaggaagaaatgcagtgaaaactgtatattggaaccttactttccatcgaatagaagtcgtgagttctatgctgtgcacaaggtttttggtgttagcaacataaccaagttggtaaagaatgctaaagaggaagatagaagaaaagttgtggactcattgatatgggaagcatgttgtaggcaaagggaccctatacaaggtccttatggagagtacacaaaagtttacaatgagtataagaaagtgttggatgaaattaagagattcagaagccaaaaccaacttttgcaaattccctctctagggtttaagtctgtacaagatttgattgcttgcaatggaaccaaaggggaacacaaagcgtcagttaataatgcatcaaattatcttcatgggaaaaagaatggtattattgatactaatatttataatacttattgttcgaattatttgctagagtttcagaatataaggccagaagttgtcataccgtttcagcaacactctcaaccatactacattacag

SEQ ID NO: 75735 - DNA, 465 bp, Glycine max
  Peptide Sequence Number=SeqID_192513
atgagcacaacacggtttattaagtgtgtcacagttggtgatggggctgtgggaaagacttgcatgcttatctcttacactagcaacactttccccacggattatgttcctacagttttcgacaatttcagtgcaaatgttgtggttgatggcagcacagttaacctgggattgtgggacactgctggacaggaagattacaacaggcttaggccattgagttacagaggagcagatgtgttcttgctggccttttccctcatcagcaaagccagctatgaaaatatatctaaaaagggagaagaactgaagaaggcaattggtgctgctgtgtacatagagtgcagctcaaagactcagcagaatgtgaaggccgtgtttgatgctgcaatcaaggttgttttgcaaccacctaagtccaagaaaaaaggaaagaagaagaacacgccttgtgttttcctctga

SEQ ID NO: 75736 - DNA, 219 bp, Glycine max
  Peptide Sequence Number=SeqID_192514
atgaatggtgaaactcaatggaggggaggggacatgctcgcaacgcagcaaggaaggaaaggaagagttgtgtcgcgacgtagcaggaaagcaaaggaggacttgtgtcccatgaatgacgtcttccataaaaaagatgagacacaaggagcacctctacaaattcttacaccaaacatatctctcattaggggtgtgaaaaaaatcggtttggattga

SEQ ID NO: 75737 - DNA, 210 bp, Glycine max
  Peptide Sequence Number=SeqID_192515
atggaaaagactgacccctctctcaataaagacgaagggattgcacaggatgcagatgcactgagggaaatggaacaagagctggccttccatctagatccatggtctccaactagtaatggatacttggaggctgtggtgattaacaagaaacggaagaaaaatgaagaagacatagtgaattcgacaaaacagcataaaaaaaattag

SEQ ID NO: 75738 - DNA, 300 bp, Glycine max
  Peptide Sequence Number=SeqID_192516
atggttgatactcccggacacgctgattttggtggtgaggttgagcgtgttgttggtatggttgagggagcgattttggttgttgatgctggtgaaggtccacttgcacagacgaaatttgttcttgcaaaggccttgaagtacgggttgcggcctattcttcttttaaacaaagtagaccgtcctgcagttagtgaggagacatgtgatgaagttgagagcctggtgtttgatctatttgccaaccttggtgctactggtacagcaattgaaatatctgatagttatatttatgcttga

SEQ ID NO: 75739 - DNA, 279 bp, Glycine max
  Peptide Sequence Number=SeqID_192517
atgaatgcaaagagaagagaatatatggttggtatgcttccaaagagaataatattgatgcggcatgagaagttgcaagggaaccgggacacgataacatacaccaccacaccgatcacatcattcagtcaacaacaacacaagacatggcctaggccctccgcgccgttctacatgttctcctacgcttgcactcaatcgatgctctgtgagctcatacaatatttcttgaagaagaggatcatcggtgtgaggaaagagtcgcaagttcgagaatag

SEQ ID NO: 75740 - DNA, 120 bp, Glycine max
  Peptide Sequence Number=SeqID_192518
atggatgccatatccaaacagtttgaagagcttgatgtatgtggaaaagtgactctaaagagtaaacttcagaaaattgtctaccatgatcaaaattctatgtgtgctcttcctgaaaag

SEQ ID NO: 75741 - DNA, 855 bp, Glycine max
  Peptide Sequence Number=SeqID_192519
atggctgcaccccgctccaaccaagctctgccacttattttgatatcaacatttacagttacagtgtctgtgaaaaggctaatgattttcatgtctagatatcaatcatgtcctttatcaactgtttttggaagagggtctgtggtgaaactgatgaaaaagaagggtacaaacatggttctaactgattgtgctggagctggtgatataatatcaattgctggcctgtcaagtccagcaataggccatacagttgcaactgtggaggttatgtctgctttgcccacagttgaattggaccctcctacaatttccatgacttttggtgtaaacgactccccattggctggtcgtgatggctctcatttgactggggggagaattggtgaccgattgatggctgaagctgaaaccaacctcgccataaatgtgcttccaggcttatcagaatcatttgaagttcagggaagaggagagctacagctgggtattttaattgagaatatgagacgtgaagggtttgagttatctgtctcaccacccaaagtaatgtataaaactgaaaacggtcagaagcttgagcccgtagaagaagttacaattgaggtaaatgatgagcatgttggcttgataatggaggccttgtctcatagacgagcagaggttacagacatgggtcctgtctcaggaactgttggtcgaactagattgtgtttgacttgtccatcaagggggctggttgggtacaggagcgtgttcagcagtgacacacgtggaactggattcatgcatcgtgctttccatgcatatgaaaattttcgaggccctcttggcaatgtcaggaaaggagtactg

SEQ ID NO: 75742 - DNA, 408 bp, Glycine max
  Peptide Sequence Number=SeqID_192520
atgctccgttaccatatccacaagcttgtcactctctttttccgccattttcaaattcctctgaattctgaacctaacgttccaatcaagagatcctttttaattggtgctgctgtgattgcttcttttggttaccgcaaagagcatgatggctcttgggtaaaaaagggtgctccacccactaatgatgaaggcaacctaccagttgaagataattcctctcttcttcgaaagcttttggaaaaattcgatggtcttcagacttttgttggtgacaaatttgatgatatggaattgcaagtcgacatgcggtttaatgccatagaatcaaggatcaccaaagttgaagatgtctccttcatccgtacttgctttgatccaccaccatcgcctccatcatcctcttag

SEQ ID NO: 75743 - DNA, 203 bp, Glycine max
  Peptide Sequence Number=SeqID_192521
aaaaagcccacccagcaacacccttttcttctttttccgcgaatgctttttcttcttcttccgcgaatgcttcttcttcttctgcgaacgcttcttcttcttctccgctggtgctctcctctaggcttcatcttctcgagctttcggtgccattgacgacctgcattggtgcattttgttgctgctccgccgtcgagatgtag

SEQ ID NO: 75744 - DNA, 270 bp, Glycine max
  Peptide Sequence Number=SeqID_192522
atggtgaggctcaagtttagactaggtcaagaggttccaagacaacctagaaatctttataaactccacaagatcgatatgcaaggacatagtgacaaaaattggggacaaaagcatgcaagtcaagatgtggatgaattacatcaacaaattgttgacgatgggcacaatgcaacacaacaacaacaacaaaaacaaataactcaccaaaatcctccacgtaatgggagacgtcgaccttgtgaaactggacaccactatgagaactaa

SEQ ID NO: 75745 - DNA, 180 bp, Glycine max
  Peptide Sequence Number=SeqID_192523
atgactaagttgaaaagtcgggcatatttgggccccaaaaatcaacgcttttgcggctactgtattgcattctacacccctattattccgcaaatgacatggattcatggaccgctagagatcaaaagaggcgacagcggagaagataagggagttgagtttccaaaggacagatcttga

SEQ ID NO: 75746 - DNA, 729 bp, Glycine max
  Peptide Sequence Number=SeqID_192524
atggccacacttcaagcctcacttctctgcagaacttctctcccatttagctctcaccatcctcaactctacaaactccatcctcactctttcaacttcctatctccatgcaaaatgtttcagccgcgccttcactcttccgtctctcgcagcgtcgcttcccgctcccaatccaatccctccggcgccgattctagtgtaattgaaaacgaagcgactccgagtgtcgtcgacgctgagagttccgatccttcgatcggagaggaaaagagcgagagtgcaaaagaggaagagaggttgccgattgtggcgttgtacgagggagcgagagagagtgttgaaaaggctttcgccgatttcatgacctggttgcctctctggcagcaggagaggcgtttggctaggttaattgttgacgccgaggcgaatcccaatgatgtcgccaaacaaaccacactacttattgaacttaataaacacagtcctgagtctgtcatcaagcactttgaaggaagggagggtgctgtagacagtataggagttgtagaatatcttcgagctcttgtggtcactaatgctattgctgaatatctgccaaatgaggaatatgggaaaccttctagacttcctaccctgttgcaagagttgaagcagcgagcatcaggtaaatcagatgagcctattcttagccctggaacatctgagaggcagccattacatgttgctatg

SEQ ID NO: 75747 - DNA, 891 bp, Glycine max
  Peptide Sequence Number=SeqID_192525
atggtgaagctagcttcagctagagacttccgcacctacgggccgggcctcgccaagaaccgctgcgagtacatcaacgccgggctctatcttattgcctccgtcgtcctcgtgtcgggcctcgtggcccagctttcttccttagcccgatcgggccttgtgcttatcattgccgctctgggcatcatcctcctcgtcaacctccatgacttcttcgcccatctcgtcggcatcgatttccggttgcccttgatggccttcgaccttcaactcgctttcgttgagttcgccgttcctgtcattcagatgctcggaacgcttcttacctttctcggcgtcttcttcctttttattcaggaagagaaaggatatgggtacttcaaattggaaaagcatgctctgaacatgctggttgctggtcctgtattatgggtgataggatcaattcataattcgtgccaaatttatgagagagcggatggtcatgttcaaatcttgcagcagtgtgtgaatgttccgtttttgatggggagtttgtcattcatgcttagtgcaattctcaattatcacgagaaatctaaagatatccaccatggccttcacttactcagtggtacttggatctggctaggcattttcggaagcctaatgttctttattggtggcttaacaaacttaatcaaagtgttcaagatgcaacaaatgaatggaattaggctggagaaactgcgaggtggagcacacgaacgattgctgagtgcgagagaaagacagattcctctgataatggaacatcaaacgaatataagccatcaacctcaagagaccaaagttacttcacctcttcccactccttataaggatgtccttattggtcagactaagttatga

SEQ ID NO: 75748 - DNA, 251 bp, Glycine max
  Peptide Sequence Number=SeqID_192526
agtttgttccctgcaaactacaggagtctcaccctactgatcttggctcattaatgttgaatgttaaaacatttaaagatgtgaaaggttgtgacgatgcaaaacaagaacttgaggaagttgtggaatacctgaaaaatccagctaaatttacccgccttggaggaaagttgccgaaggggattctcttgactggaccacctggaactggaaaaactcttctagccaagctgtttattatgtctacctga

SEQ ID NO: 75749 - DNA, 250 bp, Glycine max
  Peptide Sequence Number=SeqID_192527
ccggtgatgaccgaaaagctttccagaaaaggagaaaaagactgtcgccaagcagaagcaagttgtcagaataaatgtgacgaccataaagatctcctagaaagcggaaacataggaaagaagttttccacaaaaggtgtggcaggtataaagatccaccggggacaacaggtccccgatgggttgtccccagtgcggaacgattttctttactccctcaacctagctctagagttggctttgataccat

SEQ ID NO: 75750 - DNA, 891 bp, Glycine max
  Peptide Sequence Number=SeqID_192528
atgccaataccaaagaaatttgtccctaatattagcaaagtttgcttagggtgtttaattggagttcaaagtgttggaactccattagtactgaaggctatcaaggagcatgcatcagagattgttgtaccaaatccagatttacgtggtcgacaagaaatattggagctttaccttcaagataaaccattggctgatgatatagatattaaatcaattgctcgtggaaccccaggattcaatggggcagatcttgcaaacctggtaaacattgctgccattaaagctgctgtcgaaggtgcagagaatttagcagctgcacagttagagtttgccaaagatagaataattatgggtacagaacggaaaacaatgtccatatccgaagagtcaaaaaagcttactgcttatcatgagagtggccatgcaattgttgctattaacactgagggtgctcaaccaattcacaaggcaacaatcatgcctcgtggatctgctttaggaatggtcactcagcttccctctggtgatgagacatcaatcagcaagaagcagttactagctcgtcttgatgtttgtatgggaggaagagtggcagaagaaattatctttggtcaggatcatatcacaacaggagcaagtagtgatctccatacagctactgagcttgcccagtatatggttgtgaaacttcttagagaagcatatgatcgagtaaaagcccttctaaggaagcatgagaaggcattacatgctctagcaaatgcattattggagtatgagacgcttaatgcagaagaaatcaggcggatactacgaccatatcgggaaggaagactgccaaaggaccaggaacaagaagcagcagaagaggagctcgtgttggtctaa

SEQ ID NO: 75751 - DNA, 144 bp, Glycine max
  Peptide Sequence Number=SeqID_192529
atgtcgatccatacgagggacgttcaatatcttactcgcgctcgtactcgaggaggtaatagtttctctaggagggctaaggataattccaaggctgtagcatttgaaagcctttacatcagtcccaggctctttgactattaa

SEQ ID NO: 75752 - DNA, 510 bp, Glycine max
  Peptide Sequence Number=SeqID_192530
atggaggcttccacaatttctcgtagtctgaatcctttcttgaatccttcaactacaaaactaaaggagtccggtgccgatctcgagtgcggccttggggagatgcgtgggcttgcgagggcgcaggttgcccgtggttctggatttgaggcagtgggggtaggagtcagggttggaggagttgggttcagaggcgtgatcggaggggcgacggaagcggtagtggtgagcggtggtggtggtgagaatgagagagagagtgaagaagctgcgcagcttaaggtggaggaaggaatgtggtatggtatggaaattagagagagttggtttgattttattctttctttctctcttcgtgttctgctgcttaaattgggggagaagggaaaggaggtgttcgcggagcgcgccattgcgactcttgggaagctcgaagcttggattctagggtttgcgacgatacgtgcaaattgtaacgatgaagggcttcaatgcaaggtgggagttgag

SEQ ID NO: 75753 - DNA, 330 bp, Glycine max
  Peptide Sequence Number=SeqID_192531
atgcccgtcttcgtacccatgcccttcaaagacagtcgttcaaccgatgttgaagggcctatggttttcaacgacactggctaccaccactgggtgctacatgcccaccagcttatgcctagctcgtcctcaaaccacactgtattgggagagagtctcatacctgcacaacctttggatccctctcattctgatgtgattcgtctagggtgttacatgtccaccagcttctgttgcgcccttgattatcaactttttaccagtttacactacaacacttcacacgataacacttcactcaattcctcgttggtcagaaccttccactag

SEQ ID NO: 75754 - DNA, 675 bp, Glycine max
  Peptide Sequence Number=SeqID_192532
atggttgcttcacttataggttctggagcatctgctggagctgtgacagatccaaatgcacaagatccaattggtaaaactgctgcatctattgcagtcggcagtgggcacaagggattggcagggtatctttcagagatagctgtaacaagtcatctgtcatctcttacactggaagaaagtgaattatctaaaagttttgttgagcttcaggcagatataactgttaacagtgtctccaaggaaaatcttactgccagtgaggatcaggcatcactcaaagataccttggctgctatcagaaatgtaactcaggcagctgcgcggatacaatttgcttttcgttcacattcttttagaaaacgaagagcaagagaagcagctgctaatgcaggtggcattggtaccatttcagagatttctgctatgttaaaacttgcctttcggaactcacgtgaatataattcagctgctttatcgattcagaagaaatatcgaggttggaaaggtcgcaaagatttcttagcgttgcgcaaaaaagtagtgaagctacaagctcatgtgaggggctaccaggttaggaagcattacaaggtaatatgggcagttggaatcttggacaaggttgtcttacgatggaggagaaaaggagctggtttacgaggtttccgataa

SEQ ID NO: 75755 - DNA, 234 bp, Glycine max
  Peptide Sequence Number=SeqID_192533
atgaagagacaggctgctttttgtccaagaaagagcaagggattactgatttccttgaaccctattctcacttgtggagtcaatataaatttctgtgacatcaatgggtggactgcccttcattgggctgcacgttttggaaggtatagagcactaaaatgcaaggaaaaagataaatgtttcagatattcaagtctgaaaattaaatttctggagatgcagactgcaggatag

SEQ ID NO: 75756 - DNA, 501 bp, Glycine max
  Peptide Sequence Number=SeqID_192534
atggagaggtcaagatttgaagattcaaaagaccacacggagtggttgcaaaaatgctatattgcgacgcttcatgaaccagaaaattttagtaaggcaaaaaagatgcttattttacaaggggtggaagcgatgagagtaagatatctaggaggaaataagggattgaggcaaggtgacccgcttgccctttttctcttcttgatggtggtagaaggacttgagggacttatgaggcaaactatgttagctaacaaattttccggtgtcaaagtgggacaagaggaagtggttgtatctgtattgcaatttgtggatgacactctaatgtttacggatgtcacttttgagaatgtgctttgcatgaagagaactgttagatgctttgaggtcattctttatttgggaattcctataggaacaaactctatgaaaatgactacttggcaacctataattgaaaaaataatcaagactaagcttgcaacttggaagcaatga

SEQ ID NO: 75757 - DNA, 1218 bp, Glycine max
  Peptide Sequence Number=SeqID_192535
atgtaccatttagagaagccacaaagagatgataaacagtttctaactccctctttttcttccacactcctcgatcaaatttaccgttcgatcgacgagggtgaaagaaaaaacggcgaaattaagttctacagacacaccacaatgagcactagcaagagacagagcaggagcaattctaaatcgatggacgctggagacagaaaaattgtccgcgcaaaaaacggcagaaaaaaactgcactgcgacgaggacatcatgttcttcagctccacttcgatttcgtccacggattcctccagcctcggattctcctcctccgacactgaatccatctcacgggcctcgtgttttgcgccaagggtggggcgtagaggaggagggagcgcgtcgttccggtcggagaaacagggaatgcgcgtgttagacggtttctgtcggaactcctcccacaggtccaaacacgcgcattccccgttacccgtctcgagccgtcaccacgtgtccgtgtcggaacagcaacgacatgaacacgtgacggcttgcgacgaggaggcgctgatgatcaaatccaagtcgcgagcgttgcggatttacaacaaccttaaaaaggtgaaacagcctctttcccccggcggcagggtcacgagtttcctcaactcgctcttcgccaacacaaagaaaactacttctacaacttcccgctcgtgcggtgaagggaatgctccttcttcttcatcttcatgttattattcttccacgtgttcctctgcttcttcgttttcacggtcttgcttgagcaagaccatgtcttcagaaagggacaggttgcgcaatggggtgaagcgaacggtgcgtttttaccccgtgagtgtgatcgtggatgaggatagcaggccctgtggggacaaacgcttgtgtgaagaggaagaagcttctggagagttcttaagagagtacaaccgacacaactccaagattaagagcaatgataatttggtcttgaaggacttgcctttaaggaaaactaaccttgtggaggatggtgatgacaatgatgatcatgacgacgatgcatcgagttatgcgagctcggatctcttcgagcttgatcatttggctgtgtttggaagtggaaggtatagtgaggagcttccggtgtatgaaactactcatgttagtactaaccgcgccattgctaatggcctcatagtgtaa

SEQ ID NO: 75758 - DNA, 252 bp, Glycine max
  Peptide Sequence Number=SeqID_192536
atatattgtgctgtcatcccaagagaaggatcaaacattgatgatgcagaggtgctaagatattgcaagaagaatcttgcatctttcaaagtccctgaaaaggtcttaaataccaatagcagacaagatcatgcttatgcttttttgctatcgtgctcctgttccttgccactggtcttgatgaagccaagcattgcctctttgccttttaagttgtacatagttgcaaaacgggtacatgtgaaagaataa

SEQ ID NO: 75759 - DNA, 548 bp, Glycine max
  Peptide Sequence Number=SeqID_192537
gggtcgcgtccacaagacacctagtggacccggagaagtccgatagggccctggggttttcagctctggttacgggcctctatcagtcctatagggtgcccgtccccacagcaaggtcatgccatcgtgacataggtaagggtcgcgtccacaagacacctagtggacccgaagaagtccaacagggccctggggtttccagctctgattacgggcctctatcagacctacaggtgcccgccatccccaacaaggtcatcaggcctcctgctaaccgagctttcatcaagaagtattgtgaccccagacaggcagacggcgagacaccacaacagcctagggatggtcggcaacaggcaacagatgcaccaccaccacctctagagttcacctcagctcagtcacaaaaaggcgaccaagtccaaagccaaaggaaagtaaagtacttggtccgtgaccgacaagtcataaggcgtccagctcaagacgttaaagaagcgctactaggaggcaacctagtaccttttaaatctctgcttgttatttga

SEQ ID NO: 75760 - DNA, 1472 bp, Glycine max
  Peptide Sequence Number=SeqID_192538
atggttttatcaaaagtggttaagaaggttaccggaaggcttgaacagatgcagcctgaggcgcccaaaaacactatgcaagttgtgttcatgttagcagaagccatgaggtacggttacaccgagacactgggtacatggaacctcttcgacttgcccacagccatcattcacgctgtcacggacaaggataagaaaacagttgcaagtgaatgcgatgaaagaagtgattgtgtgcagctgaaagccccaggagtcttggatgagttatatgaggtgaagaaattgttgacacgggccatgcttttcagtagcagaaaacggtttggagcatttttatttgctgctggattcgccaaggaggatgtcctcctaagaaagagaacagctcggattctaaagccggcattcacagtgatacgtgataaagaatcaaaatgtttgtttgtgttcatccgtggaactcgtagcataaaagacactctcacagatgcaattgctgctcccatccccttcagtcatagattcattagcagtgatggtaagctgagaaggaacaacacggtttctggacatgcacaccgtggtatggttactgcagctcgttggattagaagacactgcacctctacactacttgatgctcttcaagaaaatcccgacttcaaaatcaagatcattgggcattcacttggtggtggtactgctgcactgttgacatttatgcttagagaaatgaagcagttctcttcatctgcgtgtatgacattggagttagccgaattcgggaagccctttatcacttccattataaatggttatgacatagtgcctacattgtcagcttcttctgttcacgatgtcatttacaagggtcggattaaggataaaaacatcctaactgcagttggatctcgcttatcatttgcgaaagccatcacaggacatgcagtaactcgttgcacccaggttgtgaagaagcatcaacaaagaactcaatctttgttaccctgctcccaacgtgagaatattgaaacatcagatgacttggttaaggcttctcaatcatgggagacaagttgtgaaactcttttgactgaagaacacgtaatcatagagtctgtgtcggatgatgaagaatataattcttctagtgaaggatctgacggtgatgatgatgactcagatgatgataaagacaaattgtctaacattcatgctaaggacaaagaagcaaccacaacaaaaaacatcactgaagaagagagtgtttgtcctgttccaacatcagtcaacttggatagacatcctctttatcctccaggaaaaatcatgcacattgtccctgaaaataataattcaaaccgcaagtatcctgataagaaacgcatctacttatatgaaacacctacacaattttatggaaagctcagattttcaagagggattattctggatcatctcacgaagaa

SEQ ID NO: 75761 - DNA, 2015 bp, Glycine max
  Peptide Sequence Number=SeqID_192539
tccaccccaaagctctgaattgaatgcaaagttcaatgagcagggatggttgtctttgctcaagagatgcaagagcatggaagaattcaagcaagtacatgcccatattctaaaattgggtctcttctatgattctttctgtggcagcaatcttgttgcctcttgtgctctatctagatggggcagcatggagtatgcttgctcaatcttcagtcagattgaggaacctggtagctttgagtacaataccatgattagaggaaatgtcaatagcatggatctagaagaagctttgttgctttatgttgagatgcttgaaagaggaattgaacctgacaacttcacctacccgtttgtgctcaaggcatgctctctattagttgctctcaaggaaggagtgcaaattcatgctcatgtttttaaggctggtcttgaggttgatgtctttgtgcaaaatggcttgattagcatgtatggcaagtgtggggcaatagagcatgctggtgttgtgtttgagcaaatggatgaaaagagtgtggcttcgtggagttccatcattggtgctcatgctagtgtggagatgtggcatgagtgcttgatgcttcttggggacatgagcggcgagggacgccatagggctgaagagagcattctggttagtgcactttctgcttgcactcatttggggtctcctaatcttggaaggtgcatacatgggatcttgttgaggaacatcagtgaactcaatgttgttgtgaagacttcattaattgatatgtatgtcaagtgtgggagccttgagaaagggctttgtgtgttccaaaatatggctcataagaatagatactcttacactgtaatgatcgcggggcttgccattcatgggcgcggtagggaagctgtaagagttttctctgacatgctggaggaaggtttgacaccagatgatgttgtctatgtgggtgtgttaagtgcttgcagtcatgctggtcttgtcaatgagggtcttcaatgtttcaaccgcatgcaatttgagcatatgattaaaccaacaattcagcactatggttgtatggtggatcttatggggagagctgggatgctaaaggaagcctatgacctcataaaaagcatgccaattaagcctaatgatgtggtttggaggagccttcttagtgcttgtaaggttcaccataacttggaaataggggagattgcagctgagaatattttcaggttgaataaacacaatcccggggactatttggtgctagcaaatatgtatgcaagggctaaaaaatgggctaatgtagccaggatcagaacagaaatggctgaaaaacacttggtgcaaacacctgggttcagtttggttgaagcaaataggaatgtatacaagtttgtttcgcaggacaagtctcaaccaatatgtgaaaccatctatgatatgattcaacaaatggaatggcagttgaaatttgaaggctatacaccagacatgtcacaggtgttgcttgatgtggatgaagatgaaaagaggcagagactgaaacatcatagtcagaagttggcaattgcttttgcactaatacagacatcggagggatctcccataagaatatcaagaaatcttaggatgtgtaatgactgtcatacttacactaagttcatttccgtgatctatgaacgggaaattactgtgagagaccgtaatcgcttccaccatttcaaagatggaacttgctcattggtgattgtgccggtgaccttggcttctacctttcagtttgcagccaggtctcttactcatgaagccagagaagctttcctttctgcattagtgtctgaaggacgtgcagaatggatggataaaggacataggaaatgtcttattctctggtatcggcttcaagattgggctgacattttaatacagtttgcaaaaaataatgggctggaagatggtgttgtcacagtagaagaaatacgaacagggaccgaatctcaaggaacag

SEQ ID NO: 75762 - DNA, 309 bp, Glycine max
  Peptide Sequence Number=SeqID_192540
atgaccaactcctccttccatgttgtggttggtttggtcgaggttcattgtcgcggtgattcattcgtagttcgcattgagtttatgattatcgtcatggtggatgtttcggaagaaagtccttccgaaggattatttgggttgccacaaaccaggctatttaatgatctattgggttgttacttctgctctcctcatgttgccttatgcactcctcagattggtcattccagaatgtatttacattctggattgagaattccgaaaggcaaaaagggagtaccggggcacatttggttccagaaatga

SEQ ID NO: 75763 - DNA, 1146 bp, Glycine max
  Peptide Sequence Number=SeqID_192541
atggaggtggcagatttggaaaaggaagtgcaaaagcaaacagagctaggagtgatgtacaggaaaagaatggaaaggacccaagactacttgaggtactgccttcagatagcacaagcaaatggaatattagatctcattgtgaactgcaaaggtgaatttcaacaatctccggtctctgtccccaccatcagctccattaccagccctcaaattcatattcccactccaccaaaccatggccaccaccccaatctagcagccattattgatcaagctaaaatcaatggatggtatattgatccaaatgagattcaattggaagagaaaatcgggcagggaagcaccgcagagattcacagaggaacatggcgtggatttgaggtagcagtgaagtgcatatccgaagacttcttccgcacaaaccaaaacggcgtcgcatacttttcccaggagctcgaaaccctatcgcggcagcggcacaggtttgtgcttcatctcatgggcgcgtgcatccaccctccccggcgcgcgtgggtggtcacggagcatctcagcaccacactgaaggagtggctgcacgggcccgggaccaggcgcagggagcgaatggtgccacttccacctttcaaagacagagtcattagggcccttgaaatagcccaagccatgcagtatctgcacgagcaaaagcccaaacttgttcaccgtgacttgaagcccagcaacatttttctagatgatgccatgcatgttagagttgctgattttggtcacgcacgcttcttgggtgatgaggaaatggccctcactggagaaacgggaacatacgtgtatatggcaccagaggtgatccgatgtgaaccttataatgaaaagtgtgatgtgtacagttttgggattatattgaacgagcttttaactggaaattatccatacgttgagacggaatatggtcccaccaagattgccatggaagttgtggagggtaagctgcgacctaagcttccgtgtgatgatgttggccaactgggagagcttattgaccttatatgcctttgctgggacaaaaatccatctactcgcccatccttcgctacaatcaccctttgcctcaaaagttatgtcaagaagaatctcctttaa

SEQ ID NO: 75764 - DNA, 237 bp, Glycine max
  Peptide Sequence Number=SeqID_192542
atggcccatcaagcagccgcaatcaaactgagagaaaggaggtgggggagagttgagagagagagagagaacggggacgatgagaatgtacctgagaaaagggacagaatgaaagcgaatccgatcttaaaatctaaggtgctcttgcttttgagctccaagagacaaaagacagagctttctcaaaagccaccaccaccattgatgaaggaaaaaagagagaaagggaaaggttag

SEQ ID NO: 75765 - DNA, 489 bp, Glycine max
  Peptide Sequence Number=SeqID_192543
gatgagagggaagtgatgcccccaaacccagaggctgttgctgcagtggcaagtgctgcaactgccacttctcatggaattgaagtggctgtggagtttaagccagttgaacatccgattgaaccacttgacaatgataggccaattcagtgcccgttgccagaaccatctattcttaactgtctgctaggtaaaataccacaaacagtttctccttacatggtacactattcaatggattacctttcagaagcattttcagaacacaaaaatccaaaggatggaagaatatggaaagaacgagtatctgctactgtggggagaagaggggacctgccagtgatgaaggaagggggaacacttgaatctgaagatgctggagctagaccacgaacatcccggtctaaccgaatgatcttaccatctgttagtgctccggagcataatattttaaaacttcttgacgagtgtaatgcttcaggcatctaa

SEQ ID NO: 75766 - DNA, 204 bp, Glycine max
  Peptide Sequence Number=SeqID_192544
atgttaaatgcgaaatggtgttgcactactctttatgcatcttcagctaattttgaaagtactctaactcctaatgctgaaagtgctccaactctaactaccactcaaagtgctccaactccttgtgttgaaataagcttcatacctgcattactgtcaactatgtttagaccacctccagttaggttttcagtaccaatttga

SEQ ID NO: 75767 - DNA, 2130 bp, Glycine max
  Peptide Sequence Number=SeqID_192545
atggagaagatgagcgatgacatactgttggacgattgggaagacgcgttgctggagcagttaatccaaaccgaagagcagtttgtcctcacttccagttccagcgcaccaaaaccacttcctccgccaccgcctccgcctccttccgccgtcgtttccttctcgcccccgcgagagctctctcagaggcccaccacaagtatcactgtcgactcgccctctccctctcccactcccaatccaatctccgataataaagacctcgaaatcgaccgcttaaagggagctggaacaagcggcgaagcagattgcaaatctggtatgcttgtgcaactatacatactcgttgctgttgattggttgagaacaagattctgccttatttgttctcattttgcagctgctgggaattttgattttgaaaaggagcgtgtcaagttaaagaaagaaagagacaagaaagaagatcagctcaaatccatatcttcgaggaatgaagaaaatgcttgtactaagttttcaaagtcaaagagttcagacacgggccaaaacgacagggattttggaactcatgctcccaactctcataaaatctcttccaaatttcaaaatggagtatcttcaaatgatccaattgttgaaactacttttaaagctaagggagttgaaatagccactgttagtcatcaggaagctcaaggtgctctacctctacatgatgatctgtctgcttatcttgatctctcacagaagttgctggcaatatggggatctccaactgacaacaagatgggaactaatgtgatatcaaagttgcttgtgggagtagcttttcattacctcaaggatcgttttcatactccagaagcagcaaagttgtctaatttctaccttgcattgacaaagatagctgatgggacaggtgttttggaaactctgattgagccattgcttgatctctctggtatggaaaatctctctatgtgtactgcatatggttctgaagctcctactggaattggaaaagaatgttggaaggaggttgatgtctggtctgggtttgataactatgatgaaaacacgagaaaatggaatgtcttctcaagggcattgatgacttgggaggggatgaagaacaatgtcttcattgaaggactttgcgttgggaagggctatgtggattctggtgtaaaagatggaaatatcttcaatgaagaaatagtaagcagacaagagtgccagagccagcaaaattccttacaacctcgtgtaaattggatttatctttttgagataatgcatcaaattgccatgaagatcacagaagaaagagtgagggtggaggtggtatctattatgaagttgcatttcctgcgtagtaatgcttactttgagagggagcggtttagccagaaaatagtttttgaaactatttcagaattgctaaagaaggatgctgggttatctgtgaagaaacatgctctgagacttctatatctagttctaaattgtccaaaactgttggctgctttctgctgtggttgcaaagagggggatgatagcagtgctatggatgtcaatggtttggctttacatttccaaaattttaaaatcatccttcaaggattgtctgattgtgtagcaacttgtagaggtggtttactggagttgaaagtgagcagaaatgcgattcttgtactggctttccttgcatcatctggacaactgggttttgaaatttttgttggtcataagctctcttgtagaggggtaaactatcttatgttgattttgcaattactggtatcagagatggatcttgaagctggagcacatgagcagcagccagaaatttttagggagaggacatttctgatacgggagatactgatattacttaacagactagtatctaatccttcctattctgccactgtcttgcgcggtttaatgaccactagggatatggctggtttgaccattgatgttgcaagcagattatctcggaaagaaaagaaaaccgagcagcaggacagcatggtgaagcatataagagaaaccgaaattgttgaccttgctcgcctattcaagaaaagggtaggagttggtgctgaaatggtgggaagctga

SEQ ID NO: 75768 - DNA, 180 bp, Glycine max
  Peptide Sequence Number=SeqID_192546
atggaaggaaccgcaaggcattgggtgacgttgggaatttggttaatggatattggtccacaattacttaccaatgcacaagccacaacaactcctcagaaggtaggattggtttatttggtggtaggaggcaatggtgttgtgggaagcataaaggtacatggagaatggaggaattga

SEQ ID NO: 75769 - DNA, 2411 bp, Glycine max
  Peptide Sequence Number=SeqID_192547
gtaacgcatggcacgatcaacggggagatgcccttcttctggacaacactgatctagttggcatagacaggcctaagaagaagttgatcgggtggttgattaacggttgtcctgcacgaaaagtgatttctgttactggaatgggagggatgggaaaaactactttggtgaagaaagtatttgatgatccagaagtaagaaaactcttcaaagcctgtgtttgggttactgtttctcaatcttgtaaaattgaggagcttctcagagacttggcccggaagcttttttccgaaataaggcgaccgattccagagggaatggaaagcatgtgtagtgataagctgaagatgattatcaaagacttgttgcagaggaagaggtatctagtagtatttgatgatgtgtggcatttgtatgaatgggaagctgtcaaatatgcattgcctaataataactgtggcagcaggatcatgatcaccacacgaagatccgatttagcctttacttccagcatagaatccaatggtaaggtgtataacttgcaacccttgaaagaagatgaggcttgggatctattttgtaggaacacttttcagggtcattcatgcccctcacatttgattgagatatgtaaatatatcttaagaaaatgtgggggtcttccccttgcaattgtggcaataagtggtgtcctggctacaaaagacaagcgcaggatagatgaatgggacatgatttgccgtagtcttggagctgaaattcaaggcaatggtaaacttgataattttaaaacagtactcaacctaagtttcaatgatttaccttaccatttgaaatactgtttcttgtacttgagcatctttcctgaggactatctgattcagcgcatgagactgattcgcttgtggatagcagaaggattcattgaagccagagaaggaaaaacaaaggaagatgttgcagataattacctcaaggagctcctgaacagaaacttaatacaagtagcagagataacatttgatggaagtgtgaaaactttgcgaatccatgatcttctaagggagatcatcattttgaagtccaaggaccaaaactttgtatccattgtcaaagaacaaagcatggcatggcctgaaaagattcggcggctttcggtgcacggcacattaccatatcatcggcagcaacataggtcaggctctcaactccgttctctcttaatgtttggggttggagaaaatttatctcttggcaaactgtttccaggtggttgtaaactgctaggtgttttagattatcaagatgcacctttgaataagtttccagtagcagttgttgatctatatcatttaagatatctaagcttaaggaacacaaaggtgacaatggttccaggttacataatagggaagttgcataatctagaaacactggatcttaagaagacttgtgtcagagaattgccggtagatatactaaagcttcaaaagcttcgccatctcctcgtgtatcagtttaaagtcaaaggctatccacagttctactccaagcatggttttaaggcccccactgaaataggaaatttgaagtcactacaaaaactttgttttgtggaggcaaaccaagattgtggaatcataacaaggcagttaggggagctaagtcaactaagaaggttaggaatcttgaaacttagagaggaagatggaaaggctttctgtttgtccattgagaaattaaccaatctccatgccctttctgttgcttctgagggtgagaataaagtcattgatctagcattcctttgttcaccccctccgtttcttcaacgcttgtatttgtcagggcgtttacaagagttacccagttggatacagtctctccatagccttgctaggctatttctcaaatggagctgcttaaaatatgatccactagtatatctgcaggatctgccaagccttgcacatcttgaactacttcaagtatatgatggtgacacattgcattttgtgtgtggaaagttcaagaagctcaaggttttaggccttgacaaatttgatggactcaaacaggtgacagtgggggaggatgcaatgccttgcctagaaaggctgagcattggacgttgccaattgttgaagaaggttccatcaggaattgagcacttgaataagctcaaagtgcttgagttttttgatatgccagatgaattgatgaagacaatatgtccacatggtccaggaaaagattactgtaaagtttcacacataccaaatgtttattctacctactggagagatgatggttgggatgtttatgctctagacagtttcagcagaaattgttctccccggtctggcacagtcatgagaagtcatgaacctcgcactctgtggaaggtgtag

SEQ ID NO: 75770 - DNA, 231 bp, Glycine max
  Peptide Sequence Number=SeqID_192548
atgggggagacacatgaaatttcccaccacaatctagccgacttcgagccttgcctcggatatgccagtgaagggcaagtagttggtggtatactcctgcaaaacactttggagggccctcaatttcgcccccaatcacaacccttgcattccacaataggtaaaatccctcctattatggaaggaatgggaaaagttggatcatctagaggaaaggctcagggtcgttga

SEQ ID NO: 75771 - DNA, 420 bp, Glycine max
  Peptide Sequence Number=SeqID_192549
atgacgaagaaggggaagaagcaattgatgtcatcggcgccgtggagaggcgaggagagtgaagaatccttcaaagagggaaagctgaaagtgacgaggcagggtgatggcacttccaccatgcacgtccctgcctccaagtccaagcatcatcaccatgacctccacgacgacctcggaatcgagattgatcctgaactacgctacagcttccagcgcaattttcaggtaccaattgctcgcaaattgggtcctccaagtattgcaattgtgggattttggttcctccaatttcttcagcgtgtttttagcattgacactatggtgaaacctcttcctcctgtcatggcatacaatgtctctcgcaacttgaacttcttcactcgcattttcacacaattctttgctgaggttgaatag

SEQ ID NO: 75772 - DNA, 174 bp, Glycine max
  Peptide Sequence Number=SeqID_192550
atgactgtggaggagggagcaatgcctggtcttaaaaagctcatcatccagcgctgtgattcattgaagcagcactgcgtccaaatggaggtgaggattattggagagtacaacatgtcccagcagtttatatctcctattggagggatgggggttgggatgtctactcattag

SEQ ID NO: 75773 - DNA, 468 bp, Glycine max
  Peptide Sequence Number=SeqID_192551
atggagataaagccatctcatgatctttggaacaaaatagaagcaggtttggatgaagcagatatttcagttgaaaatctagctgtttcatcgccttataagtggtggaaatatgcagcaattattttgttcttattatcttcaggaattcttgtttattttaatatagacaggataaaaactgcacatataattgcccatgacaagtcaaacgaaaaaactgagactttagataataacccagagttagcattccggaatgagcatctggatcattctgctatatcctcggatattgttgatcgtagtattgcaacaaatggtaaagagaaggaaagagtagatagtatcacatccaatcgtgatcataatagggctattacaaaggatattaaagtgtcaaattatgaagcagatcacgatcttcatcctatagcatctggcgttcaaataaagcctgttgatctt

SEQ ID NO: 75774 - DNA, 690 bp, Glycine max
  Peptide Sequence Number=SeqID_192552
atgcgtagtgattgcttagtgcaagtctccattctcaccctttttcggaaccccatgaattgtggtttttttcatgtgtcctccaccatcgagttcggagctatgcgtattgattgcttagtgcaattctccattctcaccctttttcggagccccatcaattgcgttttcgttcatgtgtcctccacactcgagtttggagctatgcgtagtgattgcttagttcaattctccattctcactctttttcggagccccatgaattgcgttatcgttcatgtgtcctccaccttcgagttcggagctattcgtggtgattgcttagtgcaattctccattctcaccctttttcggagccccataaattgtgttttcgttcatgtgtcctccaccttcgagtttggagctattcgtagtgattgcttagtgcaattctccattctcaccctttttcggagccccataaatttcgttttcgttcatgtgtcctccaccttcgagtttggagctattcgtagtgattgcttagtgcaatcctccattctcaccctttttcggagccccatgaattgccttttcgttcatgtgtcctccaccttcgagtttggagctatgcgtagtgattgcttagtgcaattctccattctcaccctttttcggagccccatgaattgcgttttcgatcattag

SEQ ID NO: 75775 - DNA, 579 bp, Glycine max
  Peptide Sequence Number=SeqID_192553
atgaaccttgagatgagcattgtgacgcttgccctccttccagcgcctgatgttcccatcattcattgttctgaatctggacttgaaagacctgctccaccaatagacgagaaatgcggaaattggaagcggagtgaagcggttgcggcggcggcgagtggtggaggagacggcgagaagagggagatgaagatgtgggataattgggctttgttagtgaaggccaatacgttggactacgtagcccgcccatggcgtcacaccaaaagaaaattctgcttcttcttcctcgaacctttatgcttcttcttcgcgtttctgcttcttcttcattcttcttcttcttcttcgcctcctaagtcaacctcagagcatttcttcttcttcttggttgaggagattgtcgccattgccgccattgttgccgtgattagaaggaagatgtcgtggtgcatttttggaggcttccgcaaagagcaacgctgttgtccatcgtcgagggagctttgtcaccgtccacaatcgagtaagcgccgtgaaccttttctttttccaccagtgttgccggcgatggcgtaa

SEQ ID NO: 75776 - DNA, 2094 bp, Glycine max
  Peptide Sequence Number=SeqID_192554
atggcaacccttgcagacattggggtctcagctgccatcaacattctctcagcctttgccttcttgctggcttttgctcttctgagaatccaacccatcaatgatagaatctactttccaaagtggtatatcagtggagatagaagcagtccaaggaggtctggtgggaattttgtgggaaaatttgtgaacctcaatttcagaacttacctcactttcctgaactggatgccacaagctctcagaatgagtgagtctgagattattagccatgctggccttgactctgctgctttccttagaatctatactctcgggaatatccctcatatgtctggccatacaatatcagataccgtggatagcttctttcaaacaaaccacccagaacattatataggacaccaggctgtctacaatgcaaataaatttgctaaatttgcaaaaagaagagatagactccaaaattggctggactattaccagcttaagtttgagagacatcctgacaagaggccaactgtcaagaatggatttttaggattttggggtgggaaagttgatgctatcgagtactacaaacattcaattaaggaacttgatacgatgatgacaatggaacgtcagaaaattataaaagatcccaaatctattttgccagttgcttttctttcattcaaatcccgatggggagcatcagtttgtgcgcaaacccaacaaagcaagaatcctacactctggctgactgattgggccccagagccacgtgacgtatattggcagaacttggccataccatttgtttctttaaacattcgaaagcttataatatcattgtctgtgtttgccttggtattcttctacatgattcccattgcttttgtgcaatctcttgccaatttggagggtcttgaaagagttgctcctttcctcagaccagttatagaattgaaattcatcaagtcctttctacaaggttttcttcctggtttggcccttaaaatatttttgtacattctacccacagttctaatgatcatgtcaaaaattgagggatatattgcattgtcaacacttgagcggaagacagcagcaaaatattattattttatgctggtgaatgttttcttgggaagcatagtgactgggactgcatttcagcaactgcatgctttccttcaccagtcacctactcagattcctagaacgattggagtttccattccaatgaaggctaccttctttatgacatacataatggttgatggatgggctggaattgctggtgagattctcagattaaagccattggttatataccatctcaaaaacatgttcttagttaaaaccgaaagagatagagggaaggccatggaccctgggagtgtggactttccagagactattccaagtcttcaactatacttccttcttggaattgtgtatgctgtggtgacaccaatccttcttcccttcgtactagtcttctttgcctttgcatatttggtttaccgtcatcagataatcaatgtctacaaccaacagtatgaaagtgctgctgcattttggccacttgttcacagccgcattatcgcaagcttgctaatatcccagcttcttctgttgggtcttcttagcaccaaaaaggcagctaaatccacacctttactcgtcatattaccaatattgacatttgcattccacaagttctgccagagacgttttgagccagcatttaggaagtaccctcttgaggaagcaatgtcaaaggatttattagagaagagcacagaacctgacttgaacatagaggcttatttggctgatgcttacttgcacccaatcttcaggtcatttgaggtagacgacgaattggttgaagtcagagtagataatcaccaaactaatgtagctgattcccaaccaagtgagcctagttcaccatctccaccacatcatgtgcaacaaccatccccaccccatcatatccatgaaccatctccacctcaatatagtgagtatcaaacttcaccaccaagttattactaccaataccatcctccatccccaccccattatgtttatcaatactaa

SEQ ID NO: 75777 - DNA, 1815 bp, Glycine max
  Peptide Sequence Number=SeqID_192555
atggcaacaaacgcaaactgcgaaatgcccctcacacaccaccctcattggttctctccaaaatccggaatttaccacagcaaacacgcccccgtggaccttcccaacgacccttttctcgaccttgtttccttcattttttcccaccgccacaatggggtttcggccctcgttgattcttcatctgggtgttccatttcctacccaaagttgctacctttggtaaaatccgttgcttctggtcttcacagaatgggtgtttcacaaggtgacgtggttctgcttcttctccctaattccatttactatcccattgtgttcttggctgttctctatataggtgctattgttacacccttgaatcctcttagtagtgtctatgaaatacgcaggcaggttagtgagtgtggtgtgagtctggctttcactgtgcctgaaaatgagaagaaacttgagccattgggaatttctgttattgctgtgccagaaaatgagaagggtttgaaggatggttgtttttcatgcttttgtgatttgatttcttgtgactttgatttgcctaagagacctgttattaagcaggatgacactgctgggatactgtattcttcagggactactggtgtgagcaaaggggttgttctgtcccacaagaatcttgttgctatggttgagctttttgtgaggtttgaagcttctcaatatgaaggctcttgcttgaggaatgtgtatctggctgttttgccgatgtttcatgtgtatggtttgtcgctgtttgctgtgggattgctgtctttgggttctactgttgttgtgatgaggaaatttgacattgatgaggttgtcagggtaattgatgaatataaagttacacactttcctgttgttccgccgatgttgacagcattgataaagagggcaaagggtgtcaatggcggtgagtttcagagtttggtacaagtctccagcggtgcagcacctttgagcatgggagttattaatgagttcatccgagctttccctaatgttgattttatacagctgaatgctgatgccatttcatttaataagttataccagattgtggtaaatgaaaagaaacactggaaatacttgaatgaacttttacggtttagtttgaaagtgatacaagcaaaaagcatgttggatggttatggaatgactgagtcaactgcagtaggaacacgtggattcaatactgaaaagtttcgcaattattcttcaatagggttattggctccaaacatggaggcaaaagtggtagactggaatactggtgcatttttgcccccaggcagcagtggtgagcttcggttgagagggccttcaattatgacgggatacttgaataatgaggaagttacaatgtcaacaattgataaagatggttggttacatactggagatgttgtttattttgatcatgatgggtatttacacatatctgaccgcttgaaagatatcatcaaatacaaaggctttcagattgctcctgccgatttagaagctgtgttaattttgcatcctgaagtagttgatgttgctgttacacgtgcaatggatgaagaaactggggagatcccagtggcatttgtggtcagaaaggttggaagtgtgctgtctccaaagcatattatggattttgttgctgagcagaagcatttatgcatcatgatcaaggttgctccatataagaaggttaggaaagtgttcttcactgacaagataccaaggtctgccactgggaagatcctacgaaagcagctgaggaattacttgacttctaatctatag

SEQ ID NO: 75778 - DNA, 795 bp, Glycine max
  Peptide Sequence Number=SeqID_192556
atgaatggcactactgctcctgcatcaaagtcacgtattccaccattagcatctgagtcactgggctttggtcaaaggcatgatgctacagttgatattcctttggatactacaaatgtaatgtcatcgctaattcagggacttcctcttaagactgactccaagaaaaaaggtcaagagctagcagcttgggaagcagatttaaaacggagagagaaggaaataaaaagaagagaagaggctgtttctagagctggtgttcctgttgatgataagaattggcctccatttttcccaatcattcaccatgatattgccaatgagataccagttcatgctcagaggcttcaatatttggcctttgcaagttggttaggaattgttctttgcctaggttttaatgtagttgctgtgactgtctgttggattagaggcggcggtgttaaaatttttttccttgcggttatatatgctctacttggtgttcccctttcatatgttctttggtacagacccctctatcgtgctatgaggacggacagtgcactgaagtttggttggtttttcatgctctacttgcttcatattggattttgtatctttgctgcaattgcacctcccattgtttttcatggaaaatcattaacgggcatccttgctgcaattgatgtcttctcagaccatgtattggttgggatattctatttgattggatttggcatgttttgcttggaggctcttctaagcttttgggtgcttcagaaaatatacatgtatttccgggggcataagtga

SEQ ID NO: 75779 - DNA, 1614 bp, Glycine max
  Peptide Sequence Number=SeqID_192557
atgaaagaggtgacggttgaagctgaaggaggagcaccaggagtggtgcaagagggtggaaaaggaaccacggttaggccagacatacacaacagtgccatgaaaattttgagggctagagagccttataatgggtacactgaggaagtgggagagaagccctcagggtttgaggttatggggtggtacctttatgagttttgcttctactttgttcaaactgtgcttgttcctgttgtgttccctctcattatcagtcagctacagcctctccctgctgcagattcacttcaggaatggaacaaaaaccacccaaccaagcactgctcacaaaaggaatttcatctgtatagcaaactgacaaatcacaccataagaaccagtggtggatcaaacttctctgctctggagtggacatcaattgcttgggccacaggactagccctggctgctccaattcttggcttcatttcctttcaccttgatggccacttcccaaagctcatcacagcagcagccacaggcattggagtgttcttctgccttcctgcaggcttcttcaaggtcacagccatcttcattccctacattgccggcattgtcgcggccagcacggtggccagcgctgctcacacccaccacctaggcctcatgatccgctgcttcacaggaccaaccctaaaaagaagcgaattctccatcaggcaagcagtctccagcaggctctccctccatgccacggcggctggatgcctcggagcagccttaatttcatcattcacataccatatgctccgggaactcaactacaacgaccgtgacgtgatgagtctctgggttgtttcaatctttagtggcctaatttggcttgttggggttttgcacattgtcacagccataggaagaaccactgattccatctcattctcctcaaggctccaccctttctccatcttcaagtaccctcatgcaattggaggccttgcaggggttttcctctcctcattcaccaccatgtcaattttcactggaggagttattttcatagtgggacaactctgcattaagccactgcacttgctctatctctggctaacctacttcctttttcctcttgtttctttgtcactgctacaacccttgttgcacgtgatcaagatgaattctgtgaagatgcaaattgtggggtttcttttgtcactcttgtcatcagggtttggattctactacggccacagtcactggaaatggggccacttggtgctatttggtgcagttcaaagcacagccacagggattttatacgcttttggaaggctcttggtgttggactgtgctccctctggcaaagaaggtgcgttctccatttggtatgcttggatgagagctgcagggctgtgcgtggggttcacggtggggtcggtcgcgccgggacgagttaggacctcgtttggagttgcgttttgcactgccattgctggaattgtggtactgcttttcgggaacatcagtgatgttggtggtgctgttgctgcggggcacgttagagatgaatgcgagagaagttcggctgtgctgcctggcttggattctaaggaatctgcacgcgtttga

SEQ ID NO: 75780 - DNA, 2436 bp, Glycine max
  Peptide Sequence Number=SeqID_192558
atggcagatagttcagtatcgtttttactggacaagctgactttgttacttcaagcagaagtgaatctgcagagaggggtccgtgaagatgttcagcacatcaaatatgaactagaacgccacaggggcatcttgagggtggctgatgctctggaagacaaagaccctgaactcaaagcatgggttaaacgagtaagagatgttgctcatgacatggaagatgctatagatgaatttagccttcgccttgttgatcaacatggacaaggcaacagttcttcttttcatgtgaattttttcatccggcataggattgcttcaaatatacaaaatatcaaatccagagtggacattatctcccagggacgtccaaacatagctgggattggctcaggctcaagtcaacggttaaggcttgatagccaaggagatgcacttctgctagaagaagctgatttggtgggtattgacaaacccaaaaggcagctcagtgacttgcttttcaatgaagaagcaggtagggctgtgattcccatttatgggatgggagggttggggaaaaccaccttggcaaaacaagtctatgatgatccaaaagtgaagaagcgtttcaggattcatgcttggattaatgtttctcagtcttttcaactagaagtgctcctgaaagacctggttcaacagctccataatgtcattggcaaaccatctccggaagcagttggacaaatgaagagtgaccagctcaaagagttgatcaagaacttgcttcagcaaagcaggtatctcattgtgctggatgatgtgtggcatgtaaaggtatgggattctgtcaaacttgctttgcctaataacaaccgtggcagtagagtgatgcttaccacacgcaagaaagatatagctttgtattcctgtgctgaattgggtaaggattttaaccttgaattcttacctgaggaagaaagttggtatcttttctgcaagaaaacatttcagggtaacccatgccctccttatctggaggcagtttgcaggaatatcttaaaaatgtgtggggggttgccactggcaattgtggcaattggtggtgcattggctacaaaaaacagggcaaacatagaagagtggcagatggtttacagaagttttgggtctgaaattgaaggcaatgacaaactggaggatatgaagaaagtgctttccctgagtttcaatgagttgccttactatctcaagtcctgtttgctgtacctaagcatatttcccgagtttcatgctattgagcacatgcgattgattcgcttgtggatagctgaagggtttgtgaacggagaagatggaaagacactggaggaagttgcagacagttacctcaaggagctcttggacagaagtctgctgcaagtggtagcaaaaaccagtgatggcaggatgaagacttgtcgcatgcatgatcttctaagggagattgtcaatttgaagtcaaaggatcagaactttgcaacaatagccaaagaccaagatataatctggccagacaaagttcgacgcttatcaatcataaacacattgaataatgtgcaacaaaataggaccacattccaacttcggtctctgctgatgtttgcctcatcagattcactcgagcatttttctatacgtgcattatgttcctctggttataagttactcagggtgttagatttgcaggatgcacctttggaggtttttcctgctgaaattgtcagcctataccttctcaagtatctgagtttgaagaatacaaaggtgaaaagcataccaggttccattaagaagctgcagcagttggagacattagatcttaaacacacttatgtcactgtattgccagttgaaattgtggagctccaacgattacgccatctcttggtgtatcgttatgagattgaatcctatgcttatttacattcaaggcatggcttcatggtggctgcccctataggacttatgcaatctttgcaaaagctttgttttatagaggcgaatcaggctttgatgattgagctaggaaaactcactcaactcaggaggcttggcatcagaaagatgagaaaacaagatggtgctgctttgtgttcatccattgagaagatgatcaatctccgctcattgtccataactgcaattgaagatgatgagataattgatattcacaacatcttcaggcctcctcagtatctccagcagttatacttgggtgggcgtctagacaattttccccaatggataagttctctcaagaatttggtccgagtgtttctaaaatggagccggttagaagaggatcctctggtacatcttcaagatttgccaaatctaagacatcttgagtttcttcaagtttatgttggtgagacattgcatttcaaggcaaaagggtttcctagtctgaag

SEQ ID NO: 75781 - DNA, 810 bp, Glycine max
  Peptide Sequence Number=SeqID_192559
atggacccgaaatctaccctaaggctcatgagaatcctagggccttctcttgcatctctgacccaatcttcttggagtcttctatccaatgtcctttgggggggccacttggtttcccttctattggaccatttccctaacaaggttattcgaaaactggttccgtatatgtctcattttgatcaagaagatatgacaatactttataggtttctaaaagtgattacgaccaagtttgactacaaattcttcaagaaggctcaagtcgagaaggttgaaagggctaaggctatcgaggctcaagctgagaaggccaagggcaagcacaaagcccaagttgaagataaatgggttcctcatccttctcctcccattaactcaggtgtcattaagagggtgaagttgggtcctcaagacgaagggccttcaaaaaggcaaaggccacctcgctttcctatcgatgaaggaaaatgtctcttctttatggggattgtcgaattctgggttgacgaattcgagaaagctaacattgaatctcaaaattctcttattaattgcgtcaaggatgaacaagctctagccaaggctaccaaggctaatgaaacattgttgtcaagttggctattgcagaggattcaaccaaagttctccaagaagagattaagcgtctctaaaaggattttgttctcttcaagggatgttgactattccctttttgctgttgacaagggtgtgaatcatcaaggggaattggtcaataaagctagaatgtctgcagatgaagtgttaaccatgtcgactctagtttaa

SEQ ID NO: 75782 - DNA, 132 bp, Glycine max
  Peptide Sequence Number=SeqID_192560
atgaagcaattcgtcttcttcatgcctaatgttggtgagtgccacgactgtcagatgggcgatgatcaacaagtgatcatcaagctcttgacgcgagggactcaccacatgttgggttcctatttacgatag

SEQ ID NO: 75783 - DNA, 261 bp, Glycine max
  Peptide Sequence Number=SeqID_192561
atgggaagcatgcgtctcttcaagggggtttcgatgaaagctgcgcacctggtctgcctgctggtttgtctgctgttcgccgcgtttgtccatgcgcaggaaaaggacgatctggtgaaagaggcccagataaaacagcagatccttaaggatgtgaagaaaacctgtacgccgcagaaaaaacagagcgataaagcctggcaggagatgattttgtcgtctgaggccaatcaattgctgattaagaatgccatcaccgcc

SEQ ID NO: 75784 - DNA, 558 bp, Glycine max
  Peptide Sequence Number=SeqID_192562
atgcaactgagcatcaccaatacggttacgcagcaggaaaaagaagagttattcgtggggctgcgtgcctacaacgcgcaatttttggatatggcaaactttagcggcgatattggcgtttacgtgcgtgacgaaaaaggggtcatgctgggcgggttaatcggcgtgcgcaaaggcgactggctgaatattgattacctctgggtaagcgacaccgtacgaggaactggtgtaggcagccagctcatcaaagcggctgaagaggaagccagacgcaaaggctgcaagcacgcgctggtggatacggccagcttccaggcacgtccgttttatgaaaaacaggggtatcagctgcagatgtctttgcaggactatccctatcagggcattctgctatttattgcgagtcgctttccgaatttaaagcgcgttgcttgtcttcttttcaggcccaggcgcatgctttggcctggtcaagaaaaccatggagatggcaatggaacgtacagcaaaactcttcaaaaaggggcgaaatcaggcagtgatgctgcctgctga

SEQ ID NO: 75785 - DNA, 480 bp, Glycine max
  Peptide Sequence Number=SeqID_192563
atgacagatcttgtgagcgcggaagatgacgtaaatcttcgtgtgtcaacgggcttgttggccgcgattgacgaagggcgcaggagacgacatagcaaaaaggtttatacggatgaccactcgggtatcttcgcccgtcagcgtgactcaaaagtcagtatgacagatcttgtgagcgcggaagatgacgtaaatctccgcgtgtcaacgggcttgtcggccgcgattgacgaagggcgcaggagacgacatagcaaaaaggtttatacggatgaccactcgggtatctccgcccgtcagcgtgactcaaaagcttggttcgagcaaaataggggaggtggttgccgcccagctcgcccaggcgagctcagctcgcccaggcgagcagggttgcttcctccagaagcaaccgccttctggaggaatattccagagggcccaagtgggcctgggtgctatttgcacccccatttttactaa

SEQ ID NO: 75786 - DNA, 129 bp, Glycine max
  Peptide Sequence Number=SeqID_192564
gatttggctcctccgaggtgatccttttcgcggaggcaggggttaggattcgcgcttcgcgtccagagatgaagttttcacgagttgttctcaactcaaacggcccgtggtgtcttcacgaggagaagc

SEQ ID NO: 75787 - DNA, 309 bp, Glycine max
  Peptide Sequence Number=SeqID_192565
atgtccaacgccgacgagctactcttcctaaaaatctgtgcactcatcgtccctgagctggatgcgtctctctcggtggaacgaccatcctttgatggccttgaaacgctactggtgttcagcgctcctgaaacgatggctgtcaaactcgggagcggcactggtcccttcaggcgcggcgtccctcctagatctctttttggaaagctttctcgaagccatttcctacgaggacaaacatttggaaacatgaaaatcaagggaatgggggcaatgtggcatgccccattatctcagaatgcaccctag

SEQ ID NO: 75788 - DNA, 702 bp, Glycine max
  Peptide Sequence Number=SeqID_192566
atggctaagtttgacccagatatagtcctagagttttacgctaatgcttggcccacggaggagggcgagggccaggagtacgagtttactcagacaaggaaccgggccgatggatttgacgaggaggccattgcccagctgttatgcataccgggtcaggatttttcccggaccgttgccgggaggcaggtgcagatcatgcgcactagcatgaccaccttgacccagatgtggatgacgttgctgctcagcaacgtcctgcccagcgatcataactccgacctccctctgccgaagtgtatgccacctaccatgcaccctctaaacctagatacgtctaacagggccctggggtttccagtgttgatcacgggtctctgccagtcattcggggttcccgtcacacctagtaaggtgattcgaccgccgatcacccgggcctttattgagaagtattgcacgcctagacaggcgcagggtgatgcaccacaggccgcagacgcagcgccaccacctcatcaggctgatccggctgggtcatttggcacggagcggtatttacagcacttggttcgccagcaggcggccaaccacagggggcaggtgcagatacatgagtgtctctaccagctcagcctcaatcagcagagccagggtttcactccttttgcgtgccctactctagatcagttcagggctgag

SEQ ID NO: 75789 - DNA, 558 bp, Glycine max
  Peptide Sequence Number=SeqID_192567
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgcatcttgctctcagtccaagcgattttgaaattttcaaaattccacttcgatggtggcgaccagacgtttggattcataaatatatcatccatactcttgaaagcggttaaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 75790 - DNA, 111 bp, Glycine max
  Peptide Sequence Number=SeqID_192568
atgggagcactttacgtccccccgctcgccttcagctcacctggtcctttacttgaccaagggaaaatcccgaagaaatgtggcgagcagaatagcagcatcatgctttaa

SEQ ID NO: 75791 - DNA, 834 bp, Glycine max
  Peptide Sequence Number=SeqID_192569
atggcaaggaagttgttgagagcaggttactactggatgtcgatggagacagattgttgcaaacacgcaaggaaatgccacaaatgccagatttatgctgatagaattcatgtaccaccaactacacttaatgttctttcttctccgtggcccttctctatgtggggcatcgatatgattggtagaatcgaaccgaaggcttcaaacgggcatcatttcattctagtggctattgattacttcaccaagtgggttgaagcagcatcttatgcaaatgtgactaagcaagttgtggtccgctttatcaagaatcagatcatctgccgttatggtgtgcccaacagaatcattacagataatggaacgaacttgaataacaagatgatgaaagatttgtgtgaagagttcaagattgagcatcacaattcttctccttacagacctcagatgaatggcgcagttgaggctgcaaacaagaatatcaagaagatagtgcaaaagatggtggtcacatacaaagactggcatgagatgttaccgtatgctttgcatgggtatcgcacttcagtgcgtacttcaacaggggcaacccccttctctttggtgtatggtatggaagcagtactccctgtggaggttgagattccatcaatgagagttctaatggaggcccagttatcagaagctgaatggggcaagtggacgcctaattacgaaggcccatatgtcgtcaagagaactttctctggtggtgcgctgattcttacgactatggatggggatgagctccctcgtcccgtgaatgcggatgcagtcaagaaatactttgtctaa

SEQ ID NO: 75792 - DNA, 516 bp, Glycine max
  Peptide Sequence Number=SeqID_192570
atgggggcatacacaaaggatgaaaaactcttgatgcatttcttccaagaaagtcttactggggtagccgtcacctggtacaccaatctggaatcttcccgggagtatgaatctttcaaagaatacgcccaaaggtggagggatctgacagctcaagtagcacccccaatgatggagagggaaatgttaacaatgatagtagacacattacctatgttttactatgagaagatggtgggatacatgccttcgagttttatagacctagtgtttgcaggcgagaggattgaggtaggtctaaagagaggaaaatttgattatgttgcttcgacgagttctggaaataggaggcttgggacagatgaagagaacaagaaggagggagaaacccatgttgtgattgttgttcctacatggccaaatttcccattagctcaacaatatcaatactcagccaatatcagtccttcttattacccacctccctaccagccaagaacacccaatcatccataa

SEQ ID NO: 75793 - DNA, 147 bp, Glycine max
  Peptide Sequence Number=SeqID_192571
atggagcatgaaacattccatgcaacttggttggcagagattgatttctctcccaatggcttgagattctcaaatttgcaaccacagcctaggttgatcaaccatgaaaaacctatgctatgtaggtggcaccggctaaatccctag

SEQ ID NO: 75794 - DNA, 759 bp, Glycine max
  Peptide Sequence Number=SeqID_192572
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgccctcgccttcagaggactatacgtcgtcaccttcagatggctgcatgtccttaccttcagagggctacaggccctcaccttcagaggactacacgtcctcaccttcagagggctacacgcccttgccttcaaaggactacacgtcctcgccttcaaagggctgcacgtcctcacttttagagggctccatatctactcctttagaggacttaagtcccttggtcacccccctgatcttggaggaggaccaactatgcgagcacaaccagagggaggctatcgtgcaactactgtgcatactgggacaagatttcacccgtgccgctacaaagacatgagtgcggatcatgcacaccaacatgaccactcctacacagatatggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 75795 - DNA, 534 bp, Glycine max
  Peptide Sequence Number=SeqID_192573
atgactgagacaaatatgcgagcggggaattccgatgtgcatggattcctcgagccacagtccatacagagatctgggcaatcacaatttgaaccaaaaaattatattaagaattggatgcaaaaatcaaagagggatgtgtacctagcagcctacttgaatggtgcacattggcaaatggtcatcattttgtctaaggaaaatgttgtcatatggttttgttcgttgcataataggctagataactacctcaaaggaataattaacagtgctttgaaaggacttgatccatacagtaaatccaaggctactgctaggtggattgttgttaaaagtaatagaaaaaaaggaagcactgagtatgggtattacgtgatgcagtggatgtcaactataatcttaggaagtttcaagaataattgggaaatgtatttcaatgatgctagatcattggaaccagagagattgaaggcgcttcgcatccaatgggcaacctattatttgaaagttaaaaataaaacaattagtgtttag

SEQ ID NO: 75796 - DNA, 240 bp, Glycine max
  Peptide Sequence Number=SeqID_192574
atggatgattttagtgaggatgaggatcaacagttctttgatcacatcaatcaccaaagcgatgaccaaaccgatgacgagggtattggcagaccaatgacacctctgtcgcctccattgcaatatcagcaacctaggtgtctagtagacttgaactttgaccacctaccacactacattgatcgacaccatttttttcatcaacaacacaatgtacaaccaccagtcggtatactcaag

SEQ ID NO: 75797 - DNA, 174 bp, Glycine max
  Peptide Sequence Number=SeqID_192575
atgcattcaggaattgttcaggaagtattttggacttcaccacatgattttgtaaatgtgtcgcttgaatgtcgacccagggaggcgaggtcttttccgagcaagataatgttggatggagtttggaagaaccatgaaacctctaattgtcaaacccgagaaggagatgcttaa

SEQ ID NO: 75798 - DNA, 345 bp, Glycine max
  Peptide Sequence Number=SeqID_192576
atggattacgggtcgggtcagcgtcaggttgagataatgagcgggaaaagctacggctgtagtcagagctacatggcggcgattccgagtgaggtgactcgggcgagtcacagcggggcagccacggcggcgaagccttggagtttcggtgacccggagtcaaagcggagaaagaggattgcgaagtacaacgtttacgcggttgagggaaaggttaaggccacgctccgggatgggatccgatggatcaagcacacgtgttctcggatcttttttttaatttggggcttgttttctgtggttatatgcattgggcttgattgtggtatcaaggggcatccatga

SEQ ID NO: 75799 - DNA, 636 bp, Glycine max
  Peptide Sequence Number=SeqID_192577
atggaggcaaaggctgaaaactctatgatcgttagcattgaccaaaaagcaattattacccctcacgaagaacctaataataacatcactcgttcttccctcaagaagggtaagaggcagaagaacttcttcaaggtggcgctgttcatgatgcgagggcgttctcgtaaatccaaaatgctcgccgtggatgacgagtccaagagcatatggaggaagctggtggggtccatgaggccattgcacctacaaagcaaccaatctccatcgcatgatattgataataataataataataataacattcctcctcatcaatctaaaatgatgaagattacctcggcaccgtctgaaaacggcgacgatgggtttgattctgcatcggagttcacatactcgccgtctccggctagtagtcgttacgcctcagccgtggggctaaacgaaatggtgcaggaggaggaggaagaggttgcgaaggagaagattaataatgatgatggggatggggatgagatgattgatgccaaggctgaggagttcattgctcaattttaccatcaaatgaggttgcagagtttggatgtcacggatgatcattaccaagagataagcatgaggtcattaggcttatga

SEQ ID NO: 75800 - DNA, 450 bp, Glycine max
  Peptide Sequence Number=SeqID_192578
atgtaccagcgtcctgtgtacataagaaaaaaggagtgtagtgtcaattctcctgactatggacccttgcctccagatccacctggatggtgccttgcaccatttgacccagatgggccacaagcagagggtattctttggtcggtgttttccttctctctattgctcgtaggatacattctggagattttaggaatgcctttatcaaaagcactgtacacattaagctacatgtgtatcactgcaggggcatcaggcttagtcgtgactgctatctattacattgttgacatagaacatctcagaaagcctacagttttactgcaatggatgggaatgaatgctcttgttgtatatgcattggcagcttgtgacattttcccagcagttatccagggtttctattggcactctcctgaaaataatttggtaatgtttgtttcccaatga

SEQ ID NO: 75801 - DNA, 393 bp, Glycine max
  Peptide Sequence Number=SeqID_192579
atgtcatcaagatctagcgttcctggcgacggaaggcccggtggcgatagtagcaagcagtcaacacctccgcctccgcacggtggttttggcggcggtggacattcaacaaccacgggtggtggtggcggcagtggtagtggttttggcggcggaggacatttaataaccggaggtggaggtgatggcggcaatggtggtggaggcgatggtggtatcggtggtggaggggacggtggcggtggacactctattggtttaggaggaggaggtggaggtggaagcttgcactcatcgcacattatgcgtggaacttggtgtttttccagtgttgaggtggatgaaacagtggagggtagtactgttgttacgagaaaaataatggaggacaag

SEQ ID NO: 75802 - DNA, 156 bp, Glycine max
  Peptide Sequence Number=SeqID_192580
atggttttcaacttttcgtggagagttctccgtgtcaattcgcttgggctcgatgtcgttccagtcaaagaaggtgaacgaggcgcaaaactcgctggttttgttgttgctgaagacaaagtagaaggatttgtgggtgacggcaaaacgtcgtga

SEQ ID NO: 75803 - DNA, 540 bp, Glycine max
  Peptide Sequence Number=SeqID_192581
atgggggtagcggtggtggtggtggtgcaagtggtggtaatggtggtggtggagccagtggtggtggtgatggtagatttggcggcgaaggagatggcgggtggcggaggagatagcggtataggtggcggtaagggtggcggaggtgatggtggtaacggtggtggaggtgatggtggtaacggtggtggaggtgatggtggtaacggtggtggaggtgctagtggtatcggcggcggaggacactctttagggggtgggggtggaagctcgcactccttgcacattatgtgtggaacttggtcgagttttcccactgttaaggttgtttgggtggcggtggctgtgactgaaacagtggaggataggagcaaaataacgaagcacataagaggaaaaggagccatgttttttgagttggaaatggcttttggttacgagggagaccgatatattatatgcttgtgtattggtggcccgtggccgcaccatttattgctattttatcttctacgatatcgtctcataatcatcgaataa

SEQ ID NO: 75804 - DNA, 1314 bp, Glycine max
  Peptide Sequence Number=SeqID_192582
atgctgctcgacaaactctctcgcatccgtatgcaactctatgaaagtctgggtgcagggcaggtgactgctaggttgttgacggatattgaaaccctggacaagtttttaggcgaaaccattgcccagtcaaggcttggaaacagcgtgaaaaacagtgcgtttgaaatgctatcgcagtcggtgactgaaaccctcgaagtcatgcagcaattacgcgcaagtaacagtgataagcgttttctggataaagccaagcaagcggcggaagcagtcagggtagcggcaaccgcttctggctggaagtcagatgccttgtcacgtttgtcttttggtgtattcctgtttggatttgaagtcttccgggcagtggccatgctgatggtggttttttccaacctgtcagtcgggcagatgatcgccgtctttggctacctgtggtttatgatggggccggtacaggaattgctgtcggtacaggtttcctattacgcggctaaagccgctctcggaagaattaaccaggtgctcgccgcggaagaagagcctcattatcccgccgcagtatacgcgttttctggtcaggcacccgcagccatcagtctgcaacaggtcacttttgcgtatggtgaaggtgacgctatcctggctgatgtctcattgaatatcgcaccaggcgagcaggtggctctggtgggggtctccggcgcaggtaaatctacgctagtacagttactgttggggttatatgcgcccaatcaaggccaaattttgtttaatggtcaggcgatagagcaattgggttacgcgcaggtacgcgaacacattggggtagtattgcagcatcccatgctgttcaacgatagtgtgcggcaaaacctgagtctggacctgccgtatgcagacgcagatttatggcaggtgttggaagtcgcgcagctcgcacagtttgtaagggacttgccacaaggcctggacacaccgcttggccgcagtggtgtacgtctgtcaggtgggcagcgccagcggttggcgattgcacgtatgatgcttaaaaagccacaggtcgtgattctggatgaggcaacttccatgctggatacacacacggaagctttgctgcatcaagcgatgcgcaagtttttacgtggacggacgacgattattatcgcgcaccgtttgtctgctgtgaaagaagcggatcgcgtgctggtgttcgatggcggccacattattgaggaaggccagcacgaaacactggtgaagcgcactggcagtgtttaccaacgtttgtacgggcagcaaacagcctaa

SEQ ID NO: 75805 - DNA, 549 bp, Glycine max
  Peptide Sequence Number=SeqID_192583
atgcctggcatgtacgggcatgcagtagtaattgatggacgaccggaggaagctattcaaagcagactgccagtgaaatggatgcctccttcgaaggggaggatgaagtgtaacattgatgcggcatttcgggaaggtggtagaaggatgggtattggtgcttgtttgcgagatgatagaggacactgtgtgcatgcattcacgactttgaagccttacttaccaacaatgaaagaagatgaggcgctggcaattcttcacactttagaataccttaagaataatggttttcatgacactttaatttggtggaaattgccagtcaggtggtggttagaaaccttcagtgttggaacaatgacgatttggaatttggcagcatcattaattaacaagtgtcgtaggttccttctagatatactaaatgtctctattggttttattaggcgacaagcaaattctgttgctcatagcttggctaaggctcaagatgatgatccctcgagatgttcgagcaaaaatcaaaactattgttccttgtcttcatag

SEQ ID NO: 75806 - DNA, 489 bp, Glycine max
  Peptide Sequence Number=SeqID_192584
atggttagtgcagaggcctttgaaacactagaactggtgtccagctttgatattactagccaaagaaaatatccagtgcattttgacgctttctttgttctgaccgcattttgtcaagaaaatattgacaaagtcaatgctagtctgagaatggatttccacaacaatggtgctaatgaatggctttgttttcgcttggactacatgggagtggttttcctttgcattgccactagttttatgatctttctgccaagtgctattattaagccagaatatgttggtttgtctttgtcctatggcctggctctcagtagtctcttggcatttaccataagcatgacttgttctgttgagaacaaaatggtttcagttgagagaataaagcagttcaccaaccttccctcagaagctccatggaaaattgctgataaaactccacctcagaattggcccagtcaaggcactattgtgttaagcaatttgcag

SEQ ID NO: 75807 - DNA, 1694 bp, Glycine max
  Peptide Sequence Number=SeqID_192585
ctcttcaaggcaggctcatggtactggccagattgtgaaccacatgtctgttgacgcgcaacagctcgcggatttgatgatgcagtttcaccccatatggctgatgccactgcaagtgactgcagctctggtccttatttacagcaacatcggggtgtctgcgttcgcggcgcttcttggatcgagtattgtgtttgttttcactctcattcggacaaagagaaccaacagctatcagttcatgataatgaagagtcgtgacttgagaatgaaggcaactaatgagttgttaaacaacatgcgtgtcatcaagttccaagcgtgggaggaatactttggcaacaagattggcaagtttcgtgaagcggagcacggttggattgggaaattcttgtactattttgctgttaacatgggggttctgggctctgctccattgttggtcactgttctcacatttggaagtgctactcttctaggggttcctctgaatgctggcagtgtgttcacaatcacttcagtgatcaagattctgcaggagccggtgaggaccttccctcaagctctcatcgtgatttcacaagcgatgatttctctcgggaggctgaacgagttcttgacgagcaaggaaatggatgagggagcagtggagagagtggagggctgcgacggtgacacggcggtggagatcaaggacggagaattctcctgggatgatgcagatgggaatgtggctctgagagttgaagagatgaaaatcaagaaaggggaccatgctgctgttgtgggaacagttggctcaggcaagtcttctttgttggcttctgtgttgggggaaatgttcaagatatcaggaaaggtcagagtttgtgggtcaatagcctatgtagcccagacatcatggattcagaatgcaaccatccaagacaacatattgtttggtttaccaatgaacagagagaagtacagggaagcaataagagtgtgctgcttggaaaaggatcttgaaatgatggaacatggagaccagactgagattggagaaaggggtattaacctcagtggtggccagaagcaacgtgtacaacttgctagagctgtataccaagactgtgacatctatctccttgatgatgtgctcagtgctgttgatgcccaaactggatcatttatttttaaggcaagtacagaactacaaacattgatgactagctccatttccttaaacgtaatgcgagaagggaaaatcgtgcaaagtggcaagtatgatgaacttctcaaagcaggcttggattttggtgcacttgtggctgctcatgaatcctctatggggattgcagagtctagtgatacaggtggtgaaaattctgctcagtctccaaaactggctcgcatcccttcaaaagaaaaggaaaacgcagatgaaaagcaacctcaagaacaatccaagtcagataaggcttcagcaaagctcattgaagacgaggaaagggaaaccggccgtgtaaacctcaaagtgtataaacactatttcactgaagcatttgggtggtggggtgttgtactgatgctggcaatgtctcttgcatggattttatccttcttggccagtgactactggctagcaattggaactgcagaagatagtgcctttcctccttctacattcatcattgtctatgcttgcatagcag

SEQ ID NO: 75808 - DNA, 273 bp, Glycine max
  Peptide Sequence Number=SeqID_192586
atgagtaaagcagtaggagaagatgaatctatgtccaaagtggaacatgaaggagaagttagccaagaaggtgaaaaggaaggagacatgtttcaaatgatgtcaatggagtttagttgtgacgttacaagtagtgaaggttgcaagtgtaacatgctactaacaaggtttcgtttcatacatgatgatgaaggaggaggaagaggcggtgagaaatatgaagatggtggaaagaacaaagaagaacaaaaggaaataaagaaatgggaatga

SEQ ID NO: 75809 - DNA, 396 bp, Glycine max
  Peptide Sequence Number=SeqID_192587
atgcttacattcccagaaatagaatttagagaagaatgcattgtaacttgtaaggaaaaatcggagagagagaggagaattgatgagtggcttccaattacttctaaaaggaatggaaaatggtggtattcagctttccacaatgttactgccatggttggagctggtgttctcggtcttccctatgccatgtcagagcttggatggggtccaggtgtaactatacttatcctctcatggatcatcaccctgtacacactatggcaaatggttgagatgcatgaaatggttccaggaaaacggtttgatagataccacgaactgggccagtatgcctttggtgaaaagctaggcctttatatttgtggtgcctcaacagcttgttgtgaaatttgg

SEQ ID NO: 75810 - DNA, 210 bp, Glycine max
  Peptide Sequence Number=SeqID_192588
atggatatgtatggtcagtggtcacactggcactgtcccaagaaaaattctagagtactgcattctgtgaatctggttttcagtatgtgggaatctgagagtgagtcggctgcaacacacaaatatgggggtggacttctcacttcaactaacgatggtgtcaagacagaaggatttgtgcaaagaggccactcttggtatgttagttaa

SEQ ID NO: 75811 - DNA, 150 bp, Glycine max
  Peptide Sequence Number=SeqID_192589
atggtctcagttgatttccttgctgtcataagctttgcagatctgggttccaatgttgccgccaggaacatgctgtcggaggccaccgcagaggcattggcggcggtggtgcctttgaacgcgacgggtttgagagagagggagagatag

SEQ ID NO: 75812 - DNA, 432 bp, Glycine max
  Peptide Sequence Number=SeqID_192590
atgaaatttgggagaggagaggaagaacggattgtcctttacaaactgcagttactccttggccccaccaaccaacactctccacctgacctctccctcgccgttgagaatgtttcctccctggcgaacaccgtgcattttcttaacctgagttgcaacaacttgaacggtcgtttctttacaatctccaccattggcctgtttcataatttgcaggttttggacttgagtgataacttcatcactgggcagcttccttcttttggttccgtgccggaggagctgttgcagacttcaatgccactggaagaattggatcttagcttcaatgggtttactagtaactgttggagaattgatccctttttatctctttcaagttttgtgggggcagaattgccactgtataaagctctggttatggggaattga

SEQ ID NO: 75813 - DNA, 144 bp, Glycine max
  Peptide Sequence Number=SeqID_192591
atgtcggcgatgttcattattcaaagaattaatgttggcggtgatgacatcgacaacaataacgacaacggtcatgttggtacatggcaacatgtagtgggcatggcggtggaccggtggtcatggtggggaggtttggaataa

SEQ ID NO: 75814 - DNA, 330 bp, Glycine max
  Peptide Sequence Number=SeqID_192592
atgggcgtcatcaagtacctgaccatgaatgaattaaagatcctacgcatcccctcagaaatgcttaaactctttgagcactctattttcccccacaaaggacattcgacaaggtcagcacaccccgaacatacacaacatacaacgtatgtcaagtacatgaccatggatgaattaaagctcctaagcatcccctcagaaatgcttaaattctttaaccactctagtttcccacgcaagggacatccgacaaggaaaatcagcatgcaacagggacatgcatatattctcgtagctaggttccctgaccctaactatggtgtcaaaacg

SEQ ID NO: 75815 - DNA, 651 bp, Glycine max
  Peptide Sequence Number=SeqID_192593
atggatttcttaaaccaggagatgagcatgcttagccctgaagcgagaggtatgccttgcaatgaaatacacagaacaagcagcttctcttgcttgtcgggtgctgccttaagtgcaaatgctacacttgccaacacaaacatctgcaatggtgtaataggagaagacaaatccttccgattttggactctcctaaatcatttcgtaggcccatccactccaagtaatatgcttgaatatgacccttgtacgttcacgtccatgagtgctccttccagaagtgaaggttttcttaatggcatggaagttccagttgctggaggagctgctggtgaagatagagttcaagcagtttgttctgaagatgagtggcttttctgtgaaatttatgatgattccataaaagcttctaacattgcgagtatgggtggatcctttcaatataattttgatgatagtcttaatcttcaggagcatcaatctctgtcatcatttaagggaagcgattccagtcttgactgtttcacagacagtactccacattccaattcagaagcatctcctaaatcattttcacaaactacagtacttaatggcctccaacatgttcttagtcaggttgagaatgatttcctgtacatggttgagtag

SEQ ID NO: 75816 - DNA, 1203 bp, Glycine max
  Peptide Sequence Number=SeqID_192594
atgcaagaaggggaaggtagaaaaaatcatgctctaatattgcaaaataatgcagtaggagaagtgtgtccttctgtcattgtcacattatactttgatagccatccatccttgcctgcacagtttgctccccaacagagtgcacacccccaagtacattcttggcattttctccctttttttttattgtatgccccacactcacttcttctttctctccttccaagtctcaaatcccttcaatccttcaattcaagtttcaacttccctctctcaatggatgcaaaacgtcctcaacttgctacacaacctttgaactatcagacatggttcttgaaagtttccatccactgtgaaggttgcaggaggaaagtaaagaaggttctgaagagcattgacgaaatatcagtggaagtgtatgtaaacaagggcaactcttataccatccatgagttaagttttgtaattgaattaggttcaaacccgaattttaagagtgaatgttacacctttgtaggtgttttcactgcaacaatagaccaacagcagcagaaagtaacagtcactggaagtgttggcgtagagattcttctcaggaaactcgtcagagcaggaaaacacgccgagatgtggccggagaatctcaaccgtgacaaaaaaatctccggcaaagggcacaagaagaatgaagcaagagaaccacagagcttggaaaacaagggaactgaaaatgctactactgccaattgtaacagtggcaacaagagcagcaacaactcgccggaaaagtccccctccggtgaccatgttccggcggagagtggtggtggtggttctggcaagaagaagaaaaagaaagttcagagtggtgatggcaatgggagaagtagtttgagttcagaagcagcagcatctactggtgcacctgcaaacactggattgcagtttgaggatcttgtgggccaggtgaatgttagcccgccacgtcagcaatcgttgtcgtacccagaaactgcttattatccttcgatggtttatgtttcagtttatgacagattttatccttcttattactatgttccatcttcaccctacatccgtgctggtctagaccaagacggttattatcacgttcaatcagcaccgttggtttcctttgagatcttcagtgatgaaaatgctaatggctgttctgttatgtga

SEQ ID NO: 75817 - DNA, 216 bp, Glycine max
  Peptide Sequence Number=SeqID_192595
atgtcagcgaaaaacctcgtcgggcgcctaggagtatatgacaagacaaatcacgcactaagaccagtcggggtcacgctattttgtaagaatgcaccaatcatgtgggatcggcacatacttaaaggagcactcaaaccgggtgtatttaccctcaaggcctacacttcgaagagtccgttagggtctttccctcctgattcaggtctaacctag

SEQ ID NO: 75818 - DNA, 348 bp, Glycine max
  Peptide Sequence Number=SeqID_192596
atgtcaactgagtacctatatggatggcgttttgagccaaaggatagtggaacaccttatctaacctacaactttggagtcttgaccataagtccacatggaacacttaaattggtagatttttttaacaaaaagatatttctggagcttgaggtggatcaaaataagtctgacctttatgggacatctgttttgaggggtttgagaccagaaatccagaggaatggaaccgggaaaattggaggggttgatctcttcattcatgtgccagcaaatcttctagttgtagattggaagatacttgccagcaacaaaagcaacttcaaatacaagcagatctctcagtaa

SEQ ID NO: 75819 - DNA, 1268 bp, Glycine max
  Peptide Sequence Number=SeqID_192597
atggacatgtatggtcagtggtcacactggcactgtcccaagaaaaattctagagtactgcattctgtgaatctggttttcagcatgtgggaatctgagagtgagtcggctgcaacacacaaatatgggggtggacttctcacttcaactaaccatggtgtcaagacagaaggatttgtgcaaagaggccactcttggtatgttgctactgatattccaagtgactttcttgttcaaattggagaagctaactttcacttgcacaagtatcccttggtatctcgaagtggaaagctgagtagagtcatatacgaatcccacgacccagatttgaataagatagttatggatgatatccctggtggggaagaggcttttgagcttgcggccaagttctgctatggaattgctgttgatttaacagcaggcaacatctcaggtctaagatgtgcggcagagtaccttgaaatgactgaggaccttgaggaagggaatcttatattcaaggcagaagcattccttagctatgttgttttgtcttcatggagagactccatagtagtgttgaaaagctgcgagaagctgtcaccttgggcggaaaaccttcaaattgttcgcagatgcagcgagtccatcgcttggaaagcttgcgccaatcccaaagggataaggtggtcctacactggaagaactgcaaaaatttctagcccaaaatggaatgatatgaaggactcaagcccaagtaggaaccagcaggttcctccagattggtggtttgaagatgcctcaatccttaggattgatcactttgttagagtcatcactgccatcaaggtaaagggcatgagatttgaattggttggtgcttcaataatgcattatgcaactaagtggctaccgggattgattagtgacacagcaacccctggtgatgaagcaagcaactgcagcttgagtaacagtagtagtagtggcggcggtagctggaaaagtggacttcatatggttgtgactagaacaaaagatgacaacacttcaagtcttcaagctaaagagcaaaggatgatcatagagagccttgtcagcattattccacctcagaaggacagtgtctcatgcagcttccttcttaggctgctgagaatggcaatcatgttaaaggttgcacctgcactggtcactgagttagagaaaagggtgggaatgcagtttgagcaggctacactggctgatcttttgattccttcttataataaaggagagactat

SEQ ID NO: 75820 - DNA, 354 bp, Glycine max
  Peptide Sequence Number=SeqID_192598
atgtacaaggagttttccaaaaacacgttcttaagctcttttgacgcatttatgcagactgggaggctgcagcaaaccctagcggattgcgtggagcggcaaggcaaggcgttgcattcgggaaaggtttcgacggtgagactgtgtcccgaacgcgcttcccgaggcaggcgggttccgaattcgaatgtggaagaagttggtttgacggtggccactgatcttgatggcaaaagtgttgagaaaatggcaccacatgtgaatgaaccagtgtatgcttggagaaatgattcttttgttgctgcatttccttccgaagtggttcgaataacttatggcgttaacttttcgcag

SEQ ID NO: 75821 - DNA, 288 bp, Glycine max
  Peptide Sequence Number=SeqID_192599
atgggagctgccaccaatgtttattcgaggaaaacggtagaagaaaccaaaaaagggtctatagattttaagaataagggttcaggagttgtttacgctcggggaagtaaccatgctcgcccaagcgagctggttacttcacccctaagctatttgagggctcaggcgagccagaggctagcctgggcaagccaagcctatggatttcttataggagtgattggcaaccttagaagatgctgtgagtgcatatgctgtatgaagattttgatgatgacaaaagattga

SEQ ID NO: 75822 - DNA, 294 bp, Glycine max
  Peptide Sequence Number=SeqID_192600
atggaaagggaagcaagagagagggtgatagaatcattgcacggggaagctatgaaatggatggatagattcactctcactctgaataggagtcaagagcttccaaggttgttagccagagccaagtgtttccaagacatccaaggctttggtaatcgattaccaggcaatgtgtcgcaacctacccttcggcaggagggcgacgcgagactcgcgactgcatcttccaagaaaggaaaatgcgcggagtcgccaccaacgtttattcgaggaaaacgtcggaaaaccggaaag

SEQ ID NO: 75823 - DNA, 639 bp, Glycine max
  Peptide Sequence Number=SeqID_192601
gcctgctttatgcgctaatcggctttgaccctggcccacagttgactcagtttggtaaagaatatggtcttctgttacgcactattcagggccaattacgtgcttttggtctgctcaccgggccattcagcctcagtgaatatctgttttttgcactggagaatgcttacgcggagaacagcattttacttcgtacggtcaatatagaagccgtgcgagctgacagtgagtattcgccatttatcggtgctgggtacgctgtgaatggcaacgcggtggttggtgatgacaatacgaactcaatcccgcttgatagtatgtatatctacatgttgtcgaattacggtaatgtcggaattatccttctggttattgtcgctacgataattcttggcattctttatcagcgtactcgtcttggccttaatcccagtgtttacctatactggatgatctcgctttcgatgaatttcaacgccggagacgggttccgtgagtcgctcaagaaagaatgggttcagcggttcgctcaggaaatatgccttgcgctgagtaagattaggcatgatatcgtttttgtctcgccacctaacattattcaccacgatatcgcgtcgcaattgaatgttcaggtggtgg

SEQ ID NO: 75824 - DNA, 549 bp, Glycine max
  misc_feature (542)..(542): n is a, c, g, or t
  Peptide Sequence Number=SeqID_192602
atggatggcgctaagcgcgcgactatacccggccgtcggggcaaggaccaagccccgatgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtntaattaa

SEQ ID NO: 75825 - DNA, 207 bp, Glycine max
  Peptide Sequence Number=SeqID_192603
atgaagcggaaatatttggttgaggttagtcttggagggatgggtaaggaagatcacttcacggaaatatgttcagatgagttgaatgcagcagtggtatggaatatggaggacaaatggatcctaaccttactcgtcaattctattcagttacaacagaattacacaatggtttatatagagcattctaactgcagaagcagttag

SEQ ID NO: 75826 - DNA, 366 bp, Glycine max
  Peptide Sequence Number=SeqID_192604
atgaccaagagcaagggcaaggatccacttgaaggacttggaggacctatgacaagggctagagcaaggaaagccaaggaagctcttcaacaagtgctgtccatactgtttgaatacaagcccaagtttcaaggagaaaagtccaaggttgttagtgggtcattactaaaatctgctgtaaagcttctatataagctgaaccattttatcaataaacacaagttgagttttattcagaaaattagagtttatctcttttatcttagtgagagtgattctcctaaattcttgagtgattcaagaacaccttggctgtatcaaaggactttcacaacctttgtgtgttgccctcgctggaaagagtga

SEQ ID NO: 75827 - DNA, 489 bp, Glycine max
  Peptide Sequence Number=SeqID_192605
atgggacactctggctataacatacaaaggcacgtcatagcgttaaagaatcttgattctatatctcttgaggaacttgttggtaccctcaaggttcatgaacaagaggtccagcaagacgaagcacttaaagtcaatgatgaatctgaagaggaatcagatgaagatgagctcacctttatctctcaaaaaatccataagatgtggagaagaaaaaatgatcccaagtggagaagcttttcaagaagaatgccccgagacaagaaagataaaaacaaaagcttcatagtttgctatgagtgcaaaaatcctaggcacttcaagtgcgaatgtccaaatcttgagaaaattcaagataagaagaaattctttgagcctaaagaaaagaaggggcttatgagcatgtggaaagacttagatgaagatgacaaagaagccaacatgtgcctaatggcagacacaacttctaaagaatctaaatcagattag

SEQ ID NO: 75828 - DNA, 371 bp, Glycine max
  Peptide Sequence Number=SeqID_192606
gattatgtggaaacaagcggttggagttatctggccagttaatatctttgctttttgaggatctctttaagtcaatgacaactgaagttaagaacttgacagacaaaatgttagaaaagccggacaaggctaagaattttgacatatgtactcttcttactcggactcggagtatcatcactctaggtctggaaaggactctctccactggtaattttgaaattaaaaggttcagaatggaaaggaaaggaatgacacaggtgttacaaaggttatcatttattggtgctttgggtcacatgacaagagtttcaccacagtttgagaagtccaggaaagtaagtggacctagagctttgcagcctagccag

SEQ ID NO: 75829 - DNA, 441 bp, Glycine max
  Peptide Sequence Number=SeqID_192607
atgacttttttctccaaaagacgtacgatagctgttgctgctgcaatagaacttcactatagttttcagatgcacgaaattgtcaaatttgtttactttatggatacatgcagtggtggaatgaatggttacatatccttatatggtggagaaccttgccctcctatttttaggtctcttattgcaagcatggaagatatcatggacaatcatgttatatgtgcaatatatagactcccagatgcacataaacatattagccgaccaccacaaggagttaaatttctaaaaaagattgttgaaattggggatctaaaacctgaacctgttttgtggcatgaagattcaggcaggagacaccattctgaaaatgggaggaaaaaccctccaggatctatttctagtcaggagcttggggatgcaacacacagactcatgtga

SEQ ID NO: 75830 - DNA, 270 bp, Glycine max
  Peptide Sequence Number=SeqID_192608
atgtctatgcgcatttggatttgggttcatggtggaggttggttgtgtggtggtgtttgtttgaggttggatttggttccatggaggaggttggtggcacaacagtgcacagagcacaatggtgacaatgcatggtggcttgtggtgatggtgcatgtttgggttgagttcatggagatcctagaagagggttttatcacccttggtacaagtgttgttattctatcttctctcattccgcgcgctggtggaatactagagcttaattag

SEQ ID NO: 75831 - DNA, 605 bp, Glycine max
  Peptide Sequence Number=SeqID_192609
gtggccttacactccatgctattgaacctcctagtagcatgaatgagctacgcaagcaagctaaaggttccattcagatggaagaaatgttgaggttcaaaaacaaagtccgacagatcggacgaaagaaggagaaaggtgaaagtaacgcaaaggttgactcacacaagtcggatacgttgcacaaatcggacaaatgccagcctcttctgaagagaccaaggtacaagcgctacacacccttgacaacaaataatgtgaacatcaatcacttcaagagcaagaggacgaatctacccagtagattagaggagtcatcaataccattgtgggaaaattttcatatggcgggttgtctagccagtctcaaaagtgcaatctctatgccatcagagatattgacaccaactatgtcgacatacacgattaggggagatcaagatgatgtattcgatgtagatccacgtgacaacactgtcgacaaaggcccaaaaccaatagaagaacttgtcaagctagagcttggacccaaacttaggcaatgcactcagctcagcagggacctctccaaccacgagtacagacatatagatgaagtcctatga

SEQ ID NO: 75832 - DNA, 375 bp, Glycine max
  Peptide Sequence Number=SeqID_192610
atggcagaaagaggaggagaaggaaatagatcaccaagaaggactcttggtgactatgcttatcaacaaggaccaaagcatcacaacaacatagtcattcctccttttagcaacaaggttgtggagctaaatacaagattactcaatttgattggtaaggcaaagacatggctccaatcaaatccaaacaaaagccttaacacttgggaagaggtggaggaaaaattcatggaaaggttctttcctctgtctagattcattagtgcgaaatcaaccatcgctattttttccaaagggtatgatgaacctgatgtagctccattggagcttgtaggccatgaatcttcttcattaatggataactttgcttcttga

SEQ ID NO: 75833 - DNA, 402 bp, Glycine max
  Peptide Sequence Number=SeqID_192611
atggaaaagatgaatagcacaattttcaagatttggaaaccagagactttagaacctttgacaaaggaagaagaagaagaagaagatgaagaagttcaaagagattcaaaggttgtaaaagaatatgtggaaaagttgtttgtaaaggttgtcgacccgcccttaggttggaaacctctcaaactggagcgcaatgacaaaactactgattcatatgaacatttagatgcattcgtcaccgaagccaatctctacaccaatgatgatgtgattctatgtcaagtctttccaacgtcccttaaaggggcaacattgacgtggtatggaggactccctccccggtccattgacaacttaaacaccattattaaatgccttagttccaagtacgcgacaagctag

SEQ ID NO: 75834 - DNA, 813 bp, Glycine max
  Peptide Sequence Number=SeqID_192612
atgggacaagaatcagattacaaaacccagttggtgttggaggtttgctccatttccacacgttctgttgtgtgtgttcatagacatgtctcaaaccatcatgttaagccacctttcatagattggtattgcattcttggagtggaagaaaatgcaggggtgagcaccattcgcaagcaataccataaacttgccttgcaacttcatccggacaagaatacacacccgaaggctgaaattgcattcaagcttgtctctgaggcttgtatatgtctgtctgatgctgcaaaaaggaaagcttttgacttaaagagacacaagaatttctgctttgagtgcaatagaatcccttatacatccaaacgtgtccctaacaattccaatggttcaagtttcaagacatggaatatcatttgggactcaagatcttacaaagtttggagaaatattagggacatgaaagatagactgaaggaggaggccaaggtgatagagaactgtcttaggaaaaattcaatggcaaagaaagaatctcccctctacaatccagatgactatagacatggaagcagtttcaagcataaagttgagagagaaatccctgtttttaatccattaaaaaacttgcacaaagggtaccctcatttgaggggcaatgtttacaagaattctgagacatgttggtggtacttgcatacacaaaatcttgtgcacaatgacaagggggaagccaagtatgcatccccggtttttgaggtcagatcacaaaggagcatgctctcaacaagtaaatttgcttatgtcccatcataa

SEQ ID NO: 75835 - DNA, 306 bp, Glycine max
  Peptide Sequence Number=SeqID_192613
atggcggtgctgattacttataatgagcatggtgggttttatgatcatgtggcgacaccgatgaaaggggtgcctaaccccgatgggattgttgggccccacccttattacttttggtttgataggttggggacggatgggaaaatcgttgggttaaatcagattggaaaaaaagatgagaacctggttggggagtggaaccacacctctggtcaatggaatagagacactaatgacaaagctgagtaccctgaattcagcaacaaggataagacactagtcttcaaattttctgtcaagcaatga

SEQ ID NO: 75836 - DNA, 375 bp, Glycine max
  Peptide Sequence Number=SeqID_192614
atgtggagcatttggaacgcaagaaataatcgcgcttttcgtcaacaagctgtcaaggtaccgatcaagctaaagggaaagttttatcggactgcggtaagaccggcgattttgtacggaacagaatgttgggcggtcaagagccaacatgagaataaagtaggtgtagcggagatgaggatgttgcggtggatgtgtggtaagactcgacaggataaaattagaaacgaagctattagagagagggtgggagtagcgcctattgtagagaagatggtggaaaatagacttaggtggtttgggcatgtagagagaagaccggtagactctgtagtgaggagagtagaccagatggagagaagacaaacaatttga

SEQ ID NO: 75837 - DNA, 348 bp, Glycine max
  Peptide Sequence Number=SeqID_192615
atgggaatgggtcagttagttgaagggttattgttaaaaaaattcgtaagaggaggagtagggtttgcacttggcggaagagccttagggaaacaagttagtggtgatgcggaagaagcccctcagtgtcgaaggccgacaacatctacatgtagacaacgggcaactgcaattgttgctgaggatgttaaccatgtggatcatgttgctgacgaggttcatgagcagcctcaagagctagttacagatcatgtcggtgttgatacaaagggttttccagacgaatctcatgatacattagtgttaacgtcatatgctgatcatgtggcagccaaagtttgggcatga

SEQ ID NO: 75838 - DNA, 114 bp, Glycine max
  Peptide Sequence Number=SeqID_192616
atggagatgaaacctaagacctcatatatactactcaaccccgccactagacaaggtcgacccctagcctatccaaagttcatcatatcatatcgacatataattgatctatga

SEQ ID NO: 75839 - DNA, 189 bp, Glycine max
  Peptide Sequence Number=SeqID_192617
atggcaactggaggagacctgacaatggatctagaatctaggataggctatgatacaatcttagtaactggtcttaggcttgacccaacttcaaaaaaccagcttgtaaggctgcaattaaggcagtcccccaaaaaagctgcaactaaggtggctatccaacaacacatcataccttcatccaattag

SEQ ID NO: 75840 - DNA, 402 bp, Glycine max
  Peptide Sequence Number=SeqID_192618
atgtcgtggcaaacttacgtagatgatcacttgatgtgcgatatcgatggcacaggacaccacctctcctcctctgccatcatcggccaggacggctccgtttgggctcagagttcttccttccctcagattaagtctgatgagatcaacggtattatgaaagattttgatgaacctggtcatcttgctcctactggcctccaccttgcaggcaccaaatacatggtaatccagggagagccgggagccgtcatccgtggaaagaagggatctggaggtatcaccataaagaaaactggtcaagcattagttttcggcatctatgatgaacctgtcactcctggacaatgcaacatggttgttgagaggttgggagattaccttgttgatcagggtctgtag

SEQ ID NO: 75841 - DNA, 156 bp, Glycine max
  Peptide Sequence Number=SeqID_192619
atgacattcaacacaagtacaaacctatggagaatgagatacatctcaagtgtgcggcataattttccattccatgcaccttaccgcatagaagtttctcccatcgttcttatccgattcgcaacttcccaatcgcattccaacacgcacccatag

SEQ ID NO: 75842 - DNA, 180 bp, Glycine max
  Peptide Sequence Number=SeqID_192620
atggcgtatgttgaagtagattgtccggctagtgttaagaagcagttggcgaaggtgtttgaggagtctctccggacaaccgtgcctgatgaacccgatgttgtgccttctattgatccttgcgctgccaacaaagctggtgtaaaatttgcggattatcaatggttagttgcgaaatga

SEQ ID NO: 75843 - DNA, 417 bp, Glycine max
  Peptide Sequence Number=SeqID_192621
atgaaggatattgtagtcctcgctggtggtggtgaagggagtgtcctcgctggtagtgctctttggatcaccttctggagtttgggttctatgctacagaaggctcgtttgaagaaccaatgggaagggaggaccttcaatatctctaacagaagtataaggttgacataccaatgtatggacatgtccataactatgaaaggacttaccctgtgtatcagaaaatcaaattggttacatcatttagaaacaacatggggaatgggttcaacatacaaaaccatacctaacctagataataattccattatcaatattatgttgcgttcatgcaattggtttgattgggatcaaaacatgagttctgaaattcataagttgagtctcaaattgtcggagaaagtgctcaccagttag

SEQ ID NO: 75844 - DNA, 2124 bp, Glycine max
  Peptide Sequence Number=SeqID_192622
atgcagcaagcaacaattcatcgaattctaggccttcatgtacctattgtgggaaagataatcactattgatagatgttataggaagaatggtccacctcagaattatccttcaaaagggggaaatagaactcaaagaaattttggcaaaggaaactttggagcaaaaggaaacaaggtctgcacacactgtggtctttctaaccatactatagatgactgctacaagaagcatgggtacccacctagacataaattttacaaggtacaaaatccaaacatgaacaatgtcaatactataaaggaagaaggtgatggttcacccttagatcgaaatcaagatacacaaaatgaagatgatatgaaccagcagaagattggtacagttgagatggtggaacgactctacagacttgagatgattcttatcaagtctaagtacaagtctgattttgctggttctagcatttccaatttttatgccttttcatggtccttgcaatgtaacttcattaaatggttacaatcaaaagctgagacacaatctcatctaaagaattttgttgctaatgttgaaaggcagtttgagacaaaagtaaaagtgattaggtcagataatggggcagagtttatcatgagacaattttttgatgatactgctaatagaaagaaactagatcctaaggctgtcacttctgtatttttgagttttaaactaaacaccaaaggattcattatgtttgatcttaaaaccaaggccatatctgcctttaggaatgtgatcttctataaggatttttttcctttcattggtcaagataaacctgatgttgttattgtccttcctattccttcttctcatgccattgatcaacctgatggtgtctcatcaaaattaccagttgatcatatcatgcatgtaccaaataatgttgattccgatcccttaactttagagcagtcctctaatacaactagaagatctctaagacagaaacatagaccaagtaagtataaggacttccatgtttcatacctatcttcaactgtagctagtcattctacagcttctaaggatgtatggatagaggcaatgaatgctgagattaaggctttagaacttaatgatacttggatttcaactgatatgcctcaacataagaatgttattggttataagtgggtgtataagatcaagcacagatcagatgggtcagtggagagacataaggccaggttagtggccaagggctacactcaagtggaagggcaagattacctagacaccttttctccaattgccaagctaaccacagtgagacttctattggccttagctacaatcaataaatggcatctcaagcaattagatgtgaataatgctttcttgcatggtgatttaaatgaagaggtgtacatgatgcttcctcaaggtatgcaagtagccaagcctggacaagtttgtaagttgcaaaggtccctatatggactgaaacaagccagtagacaatggtatgccgagctctcttcctttttgatctctcatgggtacaagcagtgtgattcagatcattctttgtttctcaagcatggattcaatactgccattgctctgttagtttatgtggatgatattgttttgtcaggaaattatttgattgaaatacaagctattacacagttgctggacaatgcttttaagataaaagatttaggtgacttgagatacttcttaggttttgaagtagccagaaaacctactgttatcaatctttgtcagaggaaatatgtcttagacattctcagtgatgctggtatgcttggatgtaaaccagtatctactccattagattatgctactaagctgcatcaacaatcaatgactcctctttcattggaaaatgcttcctcttttagaaggttaattggaaggttgatctacttgaccaatacaaggccagatatcacttatgttatgcaacatttgagccaatttgttgttgctcctaccttatctcatcaacaagttgttgttcaaattcttaggtatatcaagggatccctaggagcaaggattttcctttctgctgcaagtaaaatacatttaaaggggtttagtgattaa

SEQ ID NO: 75845 - DNA, 678 bp, Glycine max
  Peptide Sequence Number=SeqID_192623
atgtccaagaagtctttaccctcagattttgctaaaaaccccagtagatggagaagaaccttgaaaggtgttagagagcgtcatgggagggagagaaagggctggatgataataatccacgatctctctggctcaccggttgctgcagcctccatgataaccccatttgtcccttcccctggttcagacagagtatcaagatcaaacccaggtgcatggctcattcttcgccccaatggtgcctgtgtgagtagctggaagccatggggtcgtctagaagcgtggcgagagagaggccccgtcgatggcttgggctacaaatttgagctcgtcattgagaatggacctaccaatggaataccaattgctgaggccacaatgaatgtgaaaaagggtggccaattctgcattgactacaaagtgatgagggattctggattattgggttcgaggttgcaagggaaagggtttgtgatgggttccactgtggaaggtgaaggcaaagttagcaaacctgttgtgcaagttggggcacagcatgtgacatgcatggctgatgctgctttgttcattgcactttctgctgccgttgatcttagcatggatgcatgccagctcttctcgcataaactaaggaaagagctttgtcatcatgaagaacaagtttcctttccctaa

SEQ ID NO: 75846 - DNA, 291 bp, Glycine max
  Peptide Sequence Number=SeqID_192624
atgataggcggaaccatgatggctgcatatttgtgtgtacccatgcccacttccccacagtcccccacaactatgaggaatagctgcaaaaatctgaaaacttcttgctctgttaataaagccaaaattacaatgccccctttcaacccgaaagatctatttctatccaagctttctattgtcgctgcttcttcccctaaaatgctactcaacactcccaaaatctcttacacccctccttatctcgacttctttgactcccccaaactcatggcactcccgctcaagtaa

SEQ ID NO: 75847 - DNA, 1238 bp, Glycine max
  Peptide Sequence Number=SeqID_192625
ctgccttcagtgttggtggtggagttggtgtaggtgtaggtgtaggtataggtgttggtgttggtgttggcaatggaaatggtggcagtggtggagtggtttgggttggtggagggattaacagcccagagccacctagatcttcagtgccaaagcttgaaggagcatacacagcacttcaggcatggaaatctgcagtcactgaggaccctcttaagattttatcaagttggattggtcccaatgtgtgtgcttacaaaggagtcttctgtgctgcaaaccctcaagatgaaacggttggtgcatcagcagcattcccagttgtagtagcaggcatagatctcaaccatgcaaatctgaaaggaactcttgtgaaggagctctctctactcagtgatttgtcccttctccacctcaacagtaacagattcactggcactgttcctgaaacattcagtgaccttgtgtttctggaagagttagacctcagcaacaaccaactctcaggtcctttcccttctgctactttgtacatgccaggcctcatctacttggacctcagattcaactacttctccgggtccctccctcaggaacttttcagcaagaaccttgatgcattgttcctcaataataaccaatttgaaggtgaaattcctcaaaacttgggcagttccccagcctcagtgataaacttagccaacaacaagttaagtggaagcatcccagcaagtttgggcttcatgggttctaaaataaaggagattctgttcctcaataaccagttaactggatgcattcctgagggagttggactattcacagagatgcaagttctggatgtgagcttcaactcactcatgggtcatttgccagacacactatcatgcctgcaagacatagaagttctcaatttggctcataacaagctctctggggagttatcagatgtggtgtgctctttgagaagccttgcaaatctaactgttgcttacaatttcttttctgggttcagccaggaatgctcaaggcttttctttaggaatgttggttttgatttctcactaaactgcattcctgatagggacatgcagagacctccacctgagtgctctggcataccaggtggaagtcttagttgtctcagaatccccacaccaaggcctcttgtttgtggttcaatggctgtaagtaagtctaagaacattattgatcccacttcatcatctcctccttga

SEQ ID NO: 75848 - DNA, 570 bp, Glycine max
  Peptide Sequence Number=SeqID_192626
atggctctcacatctatggaaatcggaggattaatgaatagattctattatgcggttgttattactagtaggaaatctgagatcttcaatgagacttcctttgataattgggtggacttagctgctgccccagctttgccagccattttgagtttgtataacgagcttaaggaattgggcttcaagatattcttcttaactgggagaagtgagtttcaaaggaatgccacagaaacaaaccttctgctttcagggtacagagattgggagaggctcatcttaagagggtcttctgatcaaggcaagccagccactacatacaagtctgagaagagagcagagttggagaatgaaggctacaggatccatgggaactctggggatcagtggagtgatttgtggggttatgcagtgtccgcacgtattgccaagcctcagtggcaatctcatgctatcctcacttgcataattgaagttgaattgggacaggtggacctttcgaaggccttgtcgaatgcagttagtgaagttgttgaaggaataattggagaacccgtgataaagcagtag

SEQ ID NO: 75849 - DNA, 801 bp, Glycine max
  Peptide Sequence Number=SeqID_192627
atggctggtgttggtctcaacaatgagttacatttctttggaatcggtcctgagactcccgtcatcatcggaaacctacatacagcgaaggtactgtacagcttgaggctggcggtggagacgaacaacgctggggcatgggactgcgtaccgcggagatgcatgggtttcgtggagcggtacattagaggagtccggtacctgagggacagcaaggttatcgccaaattttcctcagacttcgtgaagagcgtgctgccactggtcggagacgtaagagacgcatcattggtgttcgacatcgccgagacgctgctctgcaacgcagatttgttctttaacatggcaaacaatgatattattaatagtggtgatgataatgatggtggtgacattaatagtggtagtggttataacaatgtcaatgataataatggtggtgccctattgacaatgatattggtggtggcaccaagtggtggtggtgatagttgctacgacattggtgatgattgtagtaatggtaatggaggtggtggtgatgatattggtgataacaatagtagtgatgattgtgttagtggagtcgttgggtcttgtgtatctgctgcggtcaatgttgaacgagagcgtgccagcaaggaacaagcctttagaatgaatagagaacaagaaggaaaatctgactccttccgtttcagttccaatacatggattttcttggaggcttccaatttagttccaaattcatgctgcatattgctattcaaagcgtcaatgatcaataaaactttcccctag

SEQ ID NO: 75850 - DNA, 1149 bp, Glycine max
  Peptide Sequence Number=SeqID_192628
atggcattcaattttgatcaatgggtagaccgcagtcacagtgacagcgttaagtgggataaatatcgcggcagcgacatcatcccgctttgggtcgccgacagcgatttcacctcaccgccggcggtgatcgaagccttgcagcggcgcgtggcgcacggcgtattcggctacactcacccatcccctgatcttattgaggtttttacccgccgcatggtagagcgctacggctggcacatcaagcctgaatggatcattttcctgcctgggctggtgtgcggcctgaatttgtgcgtgcgcgcctgcaccgaagaacaccagagcacgctggccccctctcccatttatccgccgtttcgcaaagcggccaaattcgccgggcgcgagcacctcgcggtgccgctgaaggcgaccggtcaacgctgggtgctggatttttcctcgctgcatgatcggctgagtggcaacgagaaactcctgttgctgtgcaacccgcagaaccccggtggcaccgtttatcgccgggatgagctgttgcagcaccatcagttcgctcgcgaacacgatttaatcgtctgttccgatgagatccactgcgaactgctgcttgagcccggcgtgcggcatatccctttcgccaccctgaatgacgacgcggcccaacgcagcgtgacgctgatgtcgccgtcaaaaacgtttaatctcgccggactgggcgcttcactggcgatcgttcccaacgaagcgttgcgacaaaagctgaaacgcgcgcgcagcggtattgtcccggaggtcaatctgttggcgctggtggcggcgcaggcggcttatcaatacgggcaaccctggctggatgagcagttgatttatctgcgcgccaatcgcgatcggctgataaagcgtatcaacgccatgccgggtttgacgttgctgcctgtcgaggccacttacctggcctggatagactgcagcgcgttgccggtggataacccgcatcagttcttcgaacgtgcgggcgttgggctaagcgccggtttggatttcggcgatcggcgctttgtgcggcttaactttggttgccgatgggccctgctcgatgaagcgctcgatcgcatggcgcgagcctgtgcggcactgcctggctaa

SEQ ID NO: 75851 - DNA, 1794 bp, Glycine max
  Peptide Sequence Number=SeqID_192629
atgtctaagcacaattcttttccagttgttggactagtagtcagaggcaacactagctatggaatactgtccggagcagaaaaatataatgatggaatcgcaaccaatcagggagatattgttgaatcagatgtgggagttgttgcaaccgatgatgctcggtgttctgcaattggtgtttcaatgcttaggcagggtggacatgctgttgatgctgcagtggcagcagcattatgcattggtgttgttttctcggcatcaagtggtataggaggtggcgctttcatggttgttcgatcttcttcatcctctcaaactcaagcttttgacatgagagaaactgctcctttagctgcttcacagaatatgtatcagaacaatcccaaaggtaagaccttaggtccattgtcaatgggagtacctggtgaattagctggccttcatgcagcctggttgaagcatggacgattgccatggaaaaccttattccaaccagctatagaacttgctggaaagggttttgttgttactcctactcttggagagtacatggctgctgatgcaaataagatattggatgatcctgggttaagaaaactatatgcacccaatggaactttgttgaaagctggggatgtgtgtagaaatgttgaacttggtagcaccttggaggtagtggctgagcaagggccacaagctttctacaatggaaccattggtgaaaatttagtcaaggatgtcagagatgctggtgggattttaacaatggaggatttacacaattacaagttggaagtaacagatgcaacgactgtgaatgtgatgggatacaccatatatggaatgccacctccttcatctggaacacttgctctttctctggttctgaacatcttgggcagttatggaggttctaatgctgcaaggggaaatcttggtctacatcgactaatagaagctctgaaacacatgtgggctgttcgaatgaacttgggtgaccccaactttgtaaacattgatgatactatatccaaaatgctttccccatcttttgcaaaagatattcagcacatgatacttgataacactactttccctccagagtactatatgaacaggtggagtcaacttagcgatcacgggacaagccatatgtgcattgtcgatgctgatagaaatgctgtatcactaacaacaactgttaactatcattttggagccgggtttcgttctacttctactggtatcttggtcaacaatgagatggatgacttctctactcccactgatatatccccggataaactacctcccgctccagcaaattttattgaaccaaacaaaagaccattgtcttccatgactcctcttattgtcacaaaggatgatcagttggttggggtacttggagggagcggtggaatgaacattattgcagctgtagttcaagtctttcttaatcatttcatcttgggaatgaaacccttggatgcagttgtgagcccaaggatctatcacaagctaataccaaatgtagttcgttatgagaacttgactgctcataatggcgatcacattgagctttcaaaagaaagtaggcttttcctagaagagagaggtcatcaactgagaggttctgaagcactagctgtgactcagcttattgtgcaaactcttaaaacgcctatgaacttcaataggaaagttggtgaaaacaccaaatcacttacaaagcatggcactctaacagcagtaagtgaccctagaaagggtggatgtccagctgctgtttaa

SEQ ID NO: 75852 - DNA, 324 bp, Glycine max
  Peptide Sequence Number=SeqID_192630
atggggatggagaccttggggatgtcaggtggggagctattgcccaaaaccaagcttgaccaatcccgacccaacccgggcatagcttgtgtggcggctggccagctatgtatcttgggtggtatctggaaattagcctctggtaatcgattaccaaggatcgcgatggcagcgcagttgatccatgatcgtgttgtgatggagtgcctagagggtgttttggagaccctcgaaggcaatgaaaggtgccgattccgtggcacaattcgactcattgctacttcattagtacatccggaggaacccgcacgcacacttcagtag

SEQ ID NO: 75853 - DNA, 495 bp, Glycine max
  Peptide Sequence Number=SeqID_192631
tttctgccagtttcccagtatgcaggtgaccacaacctcatatcagttagagttaaaaacaggtaaagattccacttgtgacagaatagctgaagtcaaggactttgataaaacaaaaattggtgtgaaaggcctcttagattctgggatcacagagataccacgcatgttccaccatgccaaggtggaggaccacactgaaaccacaccaaatggctcaaacttcagtgtccccatcatagatctccaagatatagacacaaactcatcccttcgtgtcgaagcacttgacaagattcgaagtgcatgcaaggagtttcatgaacaagatgctgaggtgagaaaaagcttttactcaagggatatgaataagaaagttagatatttctccaataatagtctttatagagaccctgctgctaactggagggactcaattggtttttttcttactcctgatcctcctaatccagaagaaataccagcagtatgcag

SEQ ID NO: 75854 - DNA, 282 bp, Glycine max
  Peptide Sequence Number=SeqID_192632
atggaatatgttgatcatgagtgggtcatggtaggagaacaatcgacaacaacacacgttgatctggtggaagaagaagctcaacaagagctaactcctcaatggaacccttttgagtcccttatgattcaaaggatggatgtccaatctcaagactcttcaaatgcactcaatgtcgtattcaagtttggcatcatcaaagccaaaatgggagagattgttagagataagggagtagcaacatggaaaaacctaaggctaaagcttgaagctcaaggctaa

SEQ ID NO: 75855 - DNA, 135 bp, Glycine max
  Peptide Sequence Number=SeqID_192633
atggtgaaagagaagcttaaaaatgatagaaagaaagcaataataccctcatccctgctgcaagtgcaaggtgatcgtgaagccagcactgtagcttttgcctccgagaaccatcgatttagaatgagttcataa

SEQ ID NO: 75856 - DNA, 642 bp, Glycine max
  Peptide Sequence Number=SeqID_192634
atggaagaagaaaaaaccgaaattgaacgaaataaaggtgaaagccaaaaaacaagaaatgaattaaaagtctcgaatttggaaacttacccgctgaagaacgaagaacggaggaaaatcttcatggatttgcttacagaaacctctcgaaagcgttacggaagcacctcggcttggattttcttcacggaaacaagaaaaaagggggaggagattgccgcccagctcgcccaggcgagctgggttgcttcctccagaagcaatccagcttcgaaaaacactttggaaggcccaattcaaaatttcaaaatcgctatttccaccccccattttgataagttcaccccttctttcgtaatttacgaaaaaggctatgggaattttacgaaagcattatgtgatgtaagctccattggagcttgtaggcctaggatcttcttcatcaatggattcctttgcttcttggaagatgaatggcagcggaatggagaaagggagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 75857 - DNA, 216 bp, Glycine max
  Peptide Sequence Number=SeqID_192635
atgggctcaaaaatctaccctaaggttcatgagaaccctaaggccttctttatcaactctagcccaatcctcttggagcctcttgctcatggctctgcgcgtgaaaggaccttgcacaacatgactacacatgcagatatgatgcaagctaaagcatgtcacgacattggtgtagttgacaacacatacagaaagcatgtgcatgcgtattgttaa

SEQ ID NO: 75858 - DNA, 318 bp, Glycine max
  Peptide Sequence Number=SeqID_192636
atgctagttacccacgtctgggccatccgacaaggtcagtgcactctaccccccatgacatacactccatacgatgtatgttcgtggccaaaagctagtgccaaagaccctggaaggtcagtgcacagtgccccccacgaacatacacatcatccaacgtatgaacgtggccaaaagctagtgccaaagaccctggaaggtcagtgcacagtgccctccacgaacatacacaacatgcacatgccaatgcatttccaacatcaatcaacattccatttccatgtcattcacaacataaatatcatctcatctcaatga

SEQ ID NO: 75859 - DNA, 219 bp, Glycine max
  Peptide Sequence Number=SeqID_192637
atgaagaatggacgaagaacgatgaagaatgatcatgaaatcgatcacggaaattatcaagtgttgagcccctctcctcagcccccctcatgcctatttataggaaatgaggggaggaggttgcacagcagctcgcccaggcgagctggttacttcaagcctaagctttctggtggcctaggcgagccaaaggctagcctgggcgagccaggggcttga

SEQ ID NO: 75860 - DNA, 222 bp, Glycine max
  Peptide Sequence Number=SeqID_192638
atgatgggagcagtacttgaacatcaattggagctaagaaggtctttgaaatatgaaaggaggtgcaaggtagcaacaactattatgaaattgcattcccggcagttttgtaaaaaccttctatggtataatggaagaaccctaaccaaacaagaaaccaatggttgcggagttagggcaacaaatggtggagctctccaccctcgtcacatgcgccactaa

SEQ ID NO: 75861 - DNA, 414 bp, Glycine max
  Peptide Sequence Number=SeqID_192639
atgcaatctcaggtactcacactacctcctgagcctgtagatggtcgttcagctactcatgtcagcacaaaggaaaatgttgttatctggttttgttcgttgcataataggctagacttcctgaaaggaattattatcaggtcagatatatttttcaatacatttacattagcattatttgggaacatcaatattttaattgtgcaattcacatccatgtttgtattgaacaatgctttgaaaggatttgacgatactccacaaagtaaatccaaggctactgctaggtggattgttgttaaatgtaatagacaaaaaggaagtactgcgtgcgagtattacgtcatgcaccggatgtcaactataatcttaggaagtttcaagaataattggaaaatggttaatttggggtaa

SEQ ID NO: 75862 - DNA, 564 bp, Glycine max
  Peptide Sequence Number=SeqID_192640
atgaagcacttcactgacaccctcatcagtgccaacatacgcatcgcgctgtcggagctggccgaggaatcgctgatcctgtaccgccgccacagcggccccggcctgtacgacgccatcatctcgggctgccgcgccgccggcttcagcccgcgggtggcgcaggaggcgccgcgcgtgctgtccaccctgagcctggtggcggccggcctgggcgtatcgctggtgccggcctcgctgcgccgggtcaacatcgagggcgtggttgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 75863 - DNA, 378 bp, Glycine max
  Peptide Sequence Number=SeqID_192641
atggaatcccgaaaaggaaaaagtcagaaccgaagaatcatagatcaatcaacaaacgaatcaatcgaggcggatttccgatctggcctcgaaaaacaaatagaacagtgctcttccttgagtttcattgatagtgatataaccaccatattgttgaacttcaccggaggcagcgcagcacctgtagcagatgacgagagtgatgagcaaaatgacggcgacaacgatgaagtctatttcgttgaagcctttgggaagagacggcactgtgaggcgccatttggtggaggagattccgattgtggtgccaaggtacgccgtcaagcctctggcgacggtgacattggaaagcacggaccaaaggtgacacggaggtag

SEQ ID NO: 75864 - DNA, 189 bp, Glycine max
  Peptide Sequence Number=SeqID_192642
atgtcagtgaaaaacctcatcgagcgcctaggagtacatgacaggaaacaccacatgggttgtctgctagggtttcaagcattagagagtagcagaagggatttgagcctccatttctctgtctctatgcaagggacgtttctctctccacatacaattttgactaatcccaacggtggagatatgtga

SEQ ID NO: 75865 - DNA, 333 bp, Glycine max
  Peptide Sequence Number=SeqID_192643
gttcatgagctctcagaagtcgtggatgagctggatatccctgtattgtgctacggcttgcgtacagatttccgcggtgagttattcagcggtagccagtatttgttagcatggtcggataaactggttgagttaaaaacgatttgcttctgtggccgtaaggcaagcatggtgttacgtcttgatcaggaagggcggccatacaatgaaggagaacaggtagtgattggcggtaatgagcggtacgtttccgtatgccgtaagcattataaagaggcgttaagcaccggttcattaactcaggtgcaaagtaagctgcgtcacggcgaataa

SEQ ID NO: 75866 - DNA, 540 bp, Glycine max
  Peptide Sequence Number=SeqID_192644
atggctgcacaaaattcggatttttattcagagtatcctccaatgccttctgatattttgacagtgcaaaaaagtaattgtcctctttccttgaaacacaaggctttaggtgaactggacaacaattattatcaagaagttccttctcatcctgcatcagagagcaatatattcttaaacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 75867 - DNA, 314 bp, Glycine max
  Peptide Sequence Number=SeqID_192645
acactcatcctgagcaatctcttccggttcagcagtgtccagctcccccccctttgccattgtcactactggtacctgaccccgtcggctcgacatttttgcaaacaccgacccttactcaactcaatagggcaatgaaaagaggagaacgaggacagctgactaccgctaaaagtcagactacgagtacactttgtatgattgaaaactgccgctgcgtactacccggtgcttgcaggtctgactggtgtcttctctccaacagctgcttcaatcttaagtctgactactcggcttgcttaacacaagtgtga

SEQ ID NO: 75868 - DNA, 567 bp, Glycine max
  Peptide Sequence Number=SeqID_192646
atgttgactcgcttagcgagtccatgcgctaagcgagtcattcgaaactgccaacaaataaggcaattgcctcaggccggttatgatggatcaagatttgtatcacaggaagcctgggaccgttactcaaataatgtgcttgccaggaacattttgcgagaaagaaatgtcaagctacatatcaatgagtttgatgatttcagaagacaattgattcgaagaaattggcataaacaactgaccaacttgacagagggaagcattgaggtggcaattgtgaaggaattctatgcaaatctatatgtccctgaggacaagtttcccaaacaagttagggttcgatggcacttgataaaatttgatgctgattccttcaacacctttttagagactctagtggtcatggagcaaggggagagcttgccctcttactccaggtttgctagactgaggcatgatcctcaggagcttgcagctcggttgtgtatccttgggaggggatttgttcttaatgccgagggtctgtcgtggaagctcttgatgaaagatcttaccactctggcctaa

SEQ ID NO: 75869 - DNA, 354 bp, Glycine max
  Peptide Sequence Number=SeqID_192647
atgaaaaaatgggatgtgatagccatcgtctctacacctcatctcaagatgaaatttccaaccttgatgggagaaatcataagtgtcaaggcagaccaaaagcattcccgacagtgctatgctggaagcttaaaggtggttccttatcctcccaatagagagtcaggaaaccctcatcccacctctcatggcagtgaaaatcaagtcatgagcatggatgaagaatccacaatccaaaccctgaccgtatacaaagcaattatgggagatcaagattatttattcgatgtagacccacacgacgacattgtcgataaaggcccaaaaccaatcaaagaacttgtcaagttatag

SEQ ID NO: 75870 - DNA, 839 bp, Glycine max
  Peptide Sequence Number=SeqID_192648
aaaacaacgagactttttcaagtctcacaagttatccagaactacgtaggtctgaattcctcatgggaggatacgtaggagcaaaagcctcgcttttgtcgaccacaccgccttttgttgccatgactcaagagctggtagcccgcggagataccttacggttatccgcaccctttttgtcatccagaggcggcgggcccgatgacaagcagagaccaaagaccaagtttggtcattctgcacccatgatacgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaaaggcggcgggcccgatgacaagcagagaccaagtttggtcattctgcacccttgtatcatccagaggcggcgggcccatgatacgcggagataccttacggttattcgcaccctttttgtcatccagaggcggcgggcccgatgacaagcagagaccaaagaccaagtttggtcattctgcacccttgtatcatccagaggcggcgggcccgatgatactcggagataccttacggttattcgcacccttttgtcatccagaggcggcgggcccgattgacaagcagagaccaagtttggtcattctgtaccctttgtatcatccagaggcggcgggtccgatgatacgcggcaatacccgagtggttatccgtataaacattcttttgctatctgttagacagaacgcttga

SEQ ID NO: 75871 - DNA, 321 bp, Glycine max
  Peptide Sequence Number=SeqID_192649
atggcttgtacaagtggagatcctactcaaccatccccaaaaactgcaaggcttatggcagagattattaaacttggtgatcaaatgagaagaatgagttgtgaaaataaagaaaggatggagagaatgagaaaggagaatgaggagaaatatgaggggtatgaagatgatgagggaggaaggataaatgagaggtataaggagagaagaaatcatagaagatatggagagatgaaggtcgagcaagtctatgcttgctacaactacaatgaagagaaaaagatcaaattggcctccctagagtttgaggatatgccttag

SEQ ID NO: 75872 - DNA, 216 bp, Glycine max
  Peptide Sequence Number=SeqID_192650
atgacacacgtgcatgcatgtgatcgcgcgagcagtttggaaggagttagagaaggagaacaaggagttcttcgaggcatacacgaggagcagagcagagagagcttcggagagagagacaaggcaaaggatccagagcgtggtttcagattcttccaaagaacgaatttagatttcagacgcaaccaaatcaaggctaatcgtcaaataaattaa

SEQ ID NO: 75873 - DNA, 663 bp, Glycine max
  Peptide Sequence Number=SeqID_192651
atggatatggcatgtgattcgaagaaacctttgtatctggggtgcaacaagtcattgacgctgctgtcatcggtattaagtcaggttaatgtgaaagccagatatgggtggagtgacaaaaacttcagttcactgcttcaggtagtgcgtgatatgcttccagaggaaaacaagttgccaaagagttactatcaggaaaaaaagatattgtgtcctatgggtatggagtaccagaagaaggatgatgacgagtgtaacaatgacgaaaactcagagaaaggccccccaacaaatgtttctaaaatgttaagaaagtattcgttcaacacaaaatcacaaggcgacaatgttacaatgcaaaacggtggggcacatggctacaccacccaactccctcctcctcctgagtcagaaacacattccccatctaccttgaagaggacaaaaaaagaaactcgggttagatcattggctactagaccaatttgggtagagagaccactagttcatgtggatcctgccacaaggaaagccaatggtccccacagaaagaagttaagaacatatatggggattgtcgctcgcgataaggtggatgtcacgtatgataattggaaacaagtccctgcaattcaaaaggatttgatctgggaggatatttag

SEQ ID NO: 75874 - DNA, 273 bp, Glycine max
  Peptide Sequence Number=SeqID_192652
atggggggtttaggaagaaggggaggccgagttgttgggtcgcaagggagtgctcggagcgggagtggaccaggatggtatggccctagcgaacaagggtttgggcctaatgatgtggagaggcctgagcttacatgcctaacggctggtactaaaatgaaacgtaaaaattttccagtggaagatatgagagttaatggactttctaatgcaagaccagtttctcttcatgattccatgacaaagatacagagattcttaagggctaaataa

SEQ ID NO: 75875 - DNA, 555 bp, Glycine max
  Peptide Sequence Number=SeqID_192653
atggttgaacctagaactatagttcctttatcctctattgttcatcaccactatcttgcatctccactagcaaagaaaaaagttggtaggcccctaggctcaaagaacaagccaaagctatcccatgtgattagccaagccaatgtgcaagtccaaaaacccatttacattgaagtccctaataacttggatgtgattgaggcaatggtccaatttgctcatcaccacaaagtcagtatcacagtgctaagcgcatcaggaactattgccagtgtcactcttaattacactgattcttatgcttctactttcactctttatggacctttctcattaatttcccttactggaacctatattaataataccgctatctctagttcttcatcgtcatgtcaaagcattattgggtttgttagaggaaagcttgtggcagctaatggggttattgtgatggctactattgtcaacaaccttgaggttcacaaggatgtgatcaataacaatagtaaagaatgggatgatgataacaataaccctaacacatatatatga

SEQ ID NO: 75876 - DNA, 810 bp, Glycine max
  Peptide Sequence Number=SeqID_192654
atgacccaaatccaagctataatagacccagcagctagaccaaaacctaagaataatacactcataatccctgtagtttctgcatgctgcaattttacaattttaggaatcaaaataatcaatacactggaatacaattctttggtgaacccaaaacaacctctggccaaaaaccaaataaataccagagccagtagtgccagcgatgatagcttgcatatacctctctggcaactcgtcggcacaacccacaatggagccctgcaccaacgcatcggccatggtggaaagtccaacggtaccttcggcactctgatcgaggaaattagttgtaccttcggcacctctgccggggagggttgcggcttcgagaggaagaggaagaggagggggaagaggatttggagcgcgagggagaacgggaccaagaaagggagcgtgagcgagaggaggaatgggagtcggagggggaagaggagcgagaggaggagccaaaaatggaactggagggagagcgacgacctcgcccagcttttggagagcaagatacaggaggcaaagtcaaataaagataccctcaaagcaagagctcagtctgcaaagacttcaaccatagttagcgagatggtgggcaatatcaacacaagcaatgcccttgcagcttttgataagatggaggaaaagggggcatatgatgatgaagaaaccgcagcacgtgcctatgacttggcggcattaaattatcaaattatgaggagaagctcaaggagatggaaggcccgtcaaaagaagaatacattggatccttga

SEQ ID NO: 75877 - DNA, 447 bp, Glycine max
  Peptide Sequence Number=SeqID_192655
atgtacaaagataagtgggctcatacttatcacatgggcccaaaatctaccctaaggctcatgagtaccttagggccttctcttgcaattcccttggagggtaagattgcattaagtggtcgctggtatctggcagacggtgggtctgtgcctggagatcttttacttttaataggcaaggcacttatccatgctactgttggcctatgtcctactgcatcatatatagcttctcctgattattttttgagtcctaatggtggaggaaggtactttcttgagcttcgtaactgtaggacttctcttgcatatagactcatgccacagggcaatgctatattagattattccccaattgcagcagctggccatggtagaactctgaaagtgttacttcatgctcaaaataagtgcccgataatgtttgatagtgccagctacatataa

SEQ ID NO: 75878 - DNA, 1128 bp, Glycine max
  Peptide Sequence Number=SeqID_192656
atgattgcaaattttgctcagaacaggcttgagtatgaagctgtagaattagtgaggcaaatgcaagccaagggagaaacccccaacaatgtaaccttcacaaatgttcttccagtttgtgcaaggtcaggtttcctgaatgttggaaaagaaattcatgcccagattattcgggttggatcctccttggatttgtttgtctctaatgctctgacaaaatgtggatgcataaaccttgctcagaatgttttgaatatttctgtcagggaagaagtttcctacaatatactaattataggctattctcgaacaaatgacagctcagagtctctaagtttgttttcagaaatgagactcttgggcatgaggcctgatattgtttcattcatgggtgttatatcagcttgtgcaaatctagcttccataaaacaaggcaaagaggtccatggtctgctggtgagaaagctttttcacattcatctttttgcagtgaactcactctttgatttgtataccaggtgtggacgaatagatctcgctactaaggtctttgatcatattcaaaacaaggatgcggcctcttggaacactatgattttgggctatggtatgcaaggtgagttgaacactgcaatcaacctttttgaagcaatgaaggaagacagtgtggaatataattcagtttcatttattgcggttttgtctgcgtgtagccatggagggctaattgggaagggaagaaaatactttaagatgatgcgcgatctaaatattgaaccaacacatacacactatgcttgtatggttgatctccttggaagggccgatctaatggaagaagctgcagaccttattagaggcctctctattgtactggatactaatatatggggtgcattgcttggagcatgccgaatacatgggaacatagaattggggatgtgggcagccgaacatttgtttgaattaaagcctcagcactgtggatactatatactcctttcaaatatgtatgcagaagctgtaagatgggatgaggcaaacaaggttaggaaattgatgaagtcaaggggagctaagaaaaatccaggttgcagttgggttcaaattggagatcagaagccttga

SEQ ID NO: 75879 - DNA, 108 bp, Glycine max
  Peptide Sequence Number=SeqID_192657
atggctaagagactccaggaagataagaccaaggatgcaggagaaggccctaggattttcatgagcgttaggggctccatagtgttaggagggtacccacaagtttag

SEQ ID NO: 75880 - DNA, 691 bp, Glycine max
  Peptide Sequence Number=SeqID_192658
atggttcgtgctggtgttaagcctgatgagtgcacctacacttttgtcccgaaggttcgcaagggtagggaggttcatggggttgcgtttaagcttggctttgatggggatgtctttgttgggaatacccttttgtccatttatgggaattgtgggctttttggtgatgcgatgaaggtgtttgatgaaattcctgagggggataaggtgtcgtggaatactgttattgggctgtgttctcttcatgggttttacgaggaggcacttgggtttttaagaaaaatggttgcggtcaaaccggggattcaaccagacttggttactgttgctagtgtgttgccggtgtgtgcagagactgaggacgaggtgatggtgaggatcgtgcactgttatgctatgaaggttggcttgttgggccatgtaaaggttggaaatgcgttggttgatgtttatgggaaatgtgggagtgagaaggcttccaagaaagtttttgatgatattgatgagaggaatgtggtttcctggaatcctattattactagtttttcttttagagggaagtatatggatgctttggatgtatttaggttgatgattgatgtgggaatgggaccaaactttgtcaccatttctagtatgctacatgtgttaggagaattaggacttttcaagttgggagcggaagtccatg

SEQ ID NO: 75881 - DNA, 429 bp, Glycine max
  Peptide Sequence Number=SeqID_192659
atgaagagaacacagcccaataacagtattccacgacaccttatccccctcaggaatttcatcaaacaccttcatcgcatcaccaaaaagcccacaattcccataaatggacaaaagggtattcccaacaaagacatccccatcaaagccaagcttaaacgcaaccccatgaacctccctacccttgcgaacctccacaaaatcagaacaccttcgggacaaaagtgtgccaaatccatcaaacacaccagcaatggaattggctcgtataagggtgttcgacaagaaggcacttcgggaatatgcaacgctgtgttggaagagaagaatggaatttatggggtttccaaaggaggcatattgaagaatgagagaggcgcagagagagacatgcgggggaggaagccatggaggagggaaaaggggtga

SEQ ID NO: 75882 - DNA, 195 bp, Glycine max
  Peptide Sequence Number=SeqID_192660
gctaagctagatgcggatgattatggtgcaaagcgcaaagcaataacacctcctgtagttgatgaaagtgagagcatggaaaagaaaccaaaacaagagtggagctgctctttatgtcaaattactgcttcaagagagaaacaattgaatggtcatcgtcaggggaaaaagtacaaggctaagaaacatccttga

SEQ ID NO: 75883 - DNA, 438 bp, Glycine max
  Peptide Sequence Number=SeqID_192661
atggaagcaagggcttgtggaaagagcttgcgacaaatatgtctctatgttggcaataagagatggtcacgttgtctctgttctcaagtaacaagactagttgatgttgaaaggtttattcaagagtatacaaacaagatagatgtgcttttcaaggacaaaagtgaagcacaaaatgaggagaaagctaaggaaaaggaggataaggaattgctaccgcttgctttgccgacacctcttatgcaaggaatggggggaggttatgccccttccccaccaccacctatgggtggaatagggatgctgatgcaagctccattggagcttgtaggcctaggatcttcttcatcaatggattcctttgcttcttggaagatgaatggcagcggaatggagaaagggagagagagaggagacgccacttcaaggagaagatga

SEQ ID NO: 75884 - DNA, 527 bp, Glycine max
  Peptide Sequence Number=SeqID_192662
atgtgtaatggaaaacatctccaagagatctgcaccgaagaagcaataacaatcttctccctctgccaaaggaaaaggagaaaagttgcaccaccactttcagataagatccttgtgcctcaaacgaagaaggtgagacaaactcaacaggctcctcctcctcttactcacactcgttcgagcaaacgtgaaaagagaggaactcagcgacctaagcatttagagtgtgaaaaatcctccattcaagatgatgttgctaatgatcccctctacctacaacgaactgagacaatttgcctcacgaagaagaaacaaactgagtccactgctgatatggacgatgaggttcaacataaagatattaaagcacctctatctcatatctaccttgatagatttcaacatcaaggacctcctactagagaccccaatctttctaatgacaccattgcaaggcttctaagaaggattcaccaacaaggatcaaagttcttcctcttccaaagtggaagtgacttcaccccaag

SEQ ID NO: 75885 - DNA, 567 bp, Glycine max
  Peptide Sequence Number=SeqID_192663
atggctgctgaagaggataagaatcttgttgaaattttggaaaaccagaatccaatagatgttgcgaaatacatgaattttgtcagtgccccccaagctggtgctatagctacattttcaggcacaacacgagacacctttgaaggaaaaacagtcatggagttgagatacgaagcttatgttccaatggcaatacgctgtatcaagtcaatctgctcatctgctagagcatcctggaacctacattccattgctgccgctcatcgtctaggcacagtgcctgttggtgaaacaagtgtctttgtcgctgtctcatctgtccacagggccgatgcactggaggcttgtagattttttatagatgagataaaagcacaagttcctatttggaaaaaggaggtctattcaaatggggaggtttggaaggagaacagtgaattcctagagaggaggtctgagcttggtaacaaggatgcaggttgctgcgagaaaaaggtagaaattaaagaacacagcaaaaaatcttgctgtgggactaaggttcgggttgataatgaaggtatctag

SEQ ID NO: 75886 - DNA, 426 bp, Glycine max
  Peptide Sequence Number=SeqID_192664
atggactacatttctcctgcatcttgtgccgatgtggcattcagaactatgtgggctgagtttgagtgggaaaacaagggatatatgccacaattgatatcgctcctaggtgttggtgaagaatttggttactttgttgccgtaaatacagtattacaagatgagagggacttcctgaaccacattatcaagtctacaaatatgaagtgcctgactccaccatcggcattggaaggggattgtggattccttgctgcaaacctttatgctaagagtgtttttggggaagatgctttggtgaatgtgagcattgaaaagcaatcagatggtaagttgagtggatacatcagaataagaagtaaaactcagggaattgccctcagtcttggggataagataactttgaaacagaagggagccgcttaa

SEQ ID NO: 75887 - DNA, 2232 bp, Glycine max
  Peptide Sequence Number=SeqID_192665
atggagaagtcgtgcactctggtggtccacttcgacaagggcacgccggcgctggccaatgagatcaaggaggccctggaaggaaacgacgtcgctgcgaagatcgacgcgctcaagaaggccatcatgatcctcctgaacggcgagaccattccgcagctcttcatcaccattatccgctacgtgctcccctccgaggaccacaccatccagaagctcctcctcctctatctcgagatcatcgacaagaccgattcgcgcggcaaggtcctccctgagatgatcctcatctgccagaacctccgtaacaacctccagcaccccaacgagtacatccgcggcgtcactctccgtttcctctgccgcctcaacgagtccgagatcatcgagcctctcattccctccattctcgccaacctcgaacaccgccaccccttcgttcgccgcaacgccgtcctcgccgtcatgtccgtctacaagctcccccagggtgagcagctcctcgacagcgcgccggagatcgtggacaagttcttgtccaccgagcaggatccttctagtaagcgcaatgcctttcttatgctcttttcttgcgcgcaggatcgcgccatcaattatctgtttacgaatatcgatagaattattgactggggtgaacagcttcagatggtggtgttggagctgattaggaaggtttgtaggagcaataagggggagaaggggaagtacattaagatcattatatcccttttgaatgctccttccactgctgttatttatgaatgtgctagcacccttgtgtcactctcttctgcacccactgccattagggctgctgctagtacttactgtcagcttttactttctcagagtgataacaatgttaaactcattgtgcttgatcgtttgaatgagctcaagacttccagtagggaaatcatggtggagatggtcatggatgtccttcgggcactttccactcccaatcatgatattaggcggaagactcttgatattgctctcgagctcataactcccaggaacattgatgaggttgttatgatgctcaagaaagaggttgtcaaaactcagagtggggagcatgagaagaatggggagtacaggcagatgctggtgcaggctattcatacttgtgccattaagttcccggaggtggctagcactgtcgtgcatctgttgatggacttcttgggggataccaatgtggcttctgccatggatgtggttgtttttgtgcgcgagatcatcgagaccaaccccaagttgcggatttctatcatcaccaggcttttggatactttctaccaaatccgtgctgcgagggtgtgctcatgtgcgctctggataattggtgagtattgcctgtcactttcggaggttgagagtggcattgcaaccattaagcagtgtcttggtgacctcccgttttatactgttactgaggaaggagacggtcaggaggcatcgaaacccatacagcaggtgaactcaaccactgtgtcttctaggaggcctgctattcttgcagatgggacctatgccacccagagtgctgctctggaaactgccatgtcaccacccacccttgtacagggttctctgtcctcaattgggaacttgagatcactcattctttcaggtgatttctttcttggggctgtagttgcatgtacactgacaaaacttgtgttaaggttggaagaggttcagacttcaaaagccgaagttaacaaggcaactacacaggccttgttgatcattgtttcaatgctgcagctgggtcaatcttcaattcttccacatccaattgataatgattcttatgacaggattgtcctctgcattagattgttgtgcaatactggtgatgaaataaggaagatatggctgcaatcttgcagacagagctttgtgaaaatgcttgcagataagcagcgtcgtgagactgaggagattaaagctaaggctcaaatttctaatgcacagcctgatgatcttattgatttttaccatctgaagagcaggaagggtatgagccaacttgagctggaagatgaggttcaagacgatctcaaacgtgctactggggagtttacaaaggatgcagatgatgcaaataagctcaatcgcattcttcagctcactggattcagtgatcctgtttatgctgaagcatatgtcacagtgcatcactatgacattgtccttgat

SEQ ID NO: 75888 - DNA, 1287 bp, Glycine max
  Peptide Sequence Number=SeqID_192666
atggattttgatgttataagatcaaattcaacagttctccatgtcttccccttcaattctgagaaaaagagagttggtgttgctttgaagctgggggattctggagtacatatacattggaagggagctgcagagatagttctaggaacatgtactcaatatcttgattcagatggtcaattgcaatccattgaagaagagaagggttttttcaaggatgctattgatgacatggctgctcgcagcttgcgttgtgtagccattgcatacagatcctatgaattagacaaagttccatctagtgagcaggatttagaccaatggtccttaccagaacatgagcttgttttgcttgctattgttggaataaaggatccttgtcgccctggtgtcaaagatgctgtaaaagtatgcactgatgctggtgttaaggtacgcatggttactggagacaaccttcaaacagcaaaggcaatagctttggagtgtggcatactggcttcaattgaagatgctgttgagccaaatataattgaaggaaagaaattccgtgaactatctgaaaaggaaagagaagatattgccaagaaaataactgtgatggggaggtcttctcctaatgacaagcttttgcttgtgcaagctctacgtaaaggaggggaagttgttgcggtcacaggagacggcaccaatgatgctcctgccctacatgagcaacagattgttgcaattaacatagagatacctacggctgatattggtctttctatgggcatccaaggaactgaagttgcaaaagaaagctcagatattataatcctagacgataactttgcatcagtggtaaaggttgtccgatggggccgctctgtatatgcaaatattcagaaatttatccagtttcagctcacggttaatgttgctgctcttgtaataaatgttgtggcagcaataacttctggtgatgttcctttaaatgcagtgcagcttttgtgggtcaaccttatcatggatacacttggggcgcttgcactggctactgaaccgccaacagaccgcctaatgcacagatcaccagttggccgaagagaatctcttataacaaatatcatgtggagaaacttgatcgtacaggctgtctatcaaatcgcagttcttctcgttcttaacttttgtggtgaaagtattctaccaaaacaagataccaaagctgatgcctttcaagtgaagaatactttaatattcaacgcgttcgtcctgtgccaattactatggggtctctcataa

SEQ ID NO: 75889 - DNA, 618 bp, Glycine max
  Peptide Sequence Number=SeqID_192667
gtaactggtgttggtataaatactgaatggggattgttgatggcaagtatctcagaggacactggagaagagactccgttacaggtacgtttgaatggagtagcaacttttattggtgtagttgggcttactgtagctgttttagtgcttgctgtcctcttgggcagatacttttccggccataccaaagatatagatggaaatgttgaatttgttgctggaaagactagtgttagcaatgcagtagatgatgtcatcaaaatttttaccatcgcagtcacaattgtggtcgtggcagtccctgaaggtctacctttggctgttaccttaaccttggcatactcaatgcggaaaatgatggcagacaaggccttgatgactgtagttgaggcatatgttgggagcacgaaagtatattcaccagatgactcatcaaagttgcatccaaaagcattgtctctgataaatgagggcattgcacagaatacaaccggaaatgtttttgtacctaagacagctgcatgcagcattgatatgctcacaagtactgacaaagttcatatgtgttatgttcatttatcttttggaagatctgaagcaaacacagtattgtgttaa

SEQ ID NO: 75890 - DNA, 762 bp, Glycine max
  Peptide Sequence Number=SeqID_192668
atggaaagcatgaaaattctaagatgcttctgtggtgcgggccgaagggccagtgtaattttgacgaggtgcattagtgtagcggcagcactgcttttcagattggccggtgaacgcgagctagtgataagtacagcagtgtcacccccaactccagttggtgactatgatattgggctcgaacaacttgtttcaatgtctaaggatcagaatatttctgctttacaacaatatggaggggcaagtcttcaacatattagaggcttatcaaatttaataaaatctaatccggataaaggtattagtggagatgatgctgatctgttaaaaaggaaaaatgcatttggaactaatacatatcctcggaaaaaaggaagaagtttctggaggtttttatgggaagcttggcaggatctgactctcataatattgataatagctgctgcggtgtcattggcacttggaataaaaacagagggtttggctgaaggatggtatgatgggggaagcattgcttttgcagttcttcttgtcattgtagttactgctgtcagtgattatcggcagtctctgcagtttcagaatttgaatgcagaaaaacaaaatatacaattggaggttattagaggtgggagaacaattaaaatttcaatatttgatattgttgttggtgatgttataccccttaaaataggagatcagtattttttgttcaccgattactctatgggcatactcaggttcctgctgatggagtattaa

SEQ ID NO: 75891 - DNA, 390 bp, Glycine max
  Peptide Sequence Number=SeqID_192669
atggttggtagtttgggaactccaactatggctcgcaaggttggttgtgacaagaagaagacaaaaatggatcattatatggataaatttcttgatgagttgcaacgatatattataagcattaaagatgtcacatcagatggaaaccgtggttacagaggaattgcaactttgctaggccatgcaaagtggatgaccattcctgacatgggttatttcattgctagttggtacaatgttgtattggtacacttattcaggctgcaaagttggaccttctttccacttaggagtctagcacccgtttcgtcccatcttatttttgttggaccttgtggcctcaataatcttaagaaggatatgcttcgaatgcagaagaagcaacaataa

SEQ ID NO: 75892 - DNA, 384 bp, Glycine max
  Peptide Sequence Number=SeqID_192670
gattttgcacaagtgcagaaaaatactaggcatttgctggttgtggaaagagcagtgcagaatgagttctggatgtttgctagtagatcccaacggtcaaatcttgggaggattgatggggacccggtgttgagagaaacgaggagatgggctacgtgggagtacgtgagctcagttggaggtgggcaacaggggatgagtggtacctggagatatgtcgcgggggtcaggagaccttggggacgtcaggcgagctcctggcagtcaacagataaaaggaaaacaagaccacaaagcaaggaggcttgtggtggctggccagctgaggctaagatggtctctggtaatcgattaccaaggggtgtaatcgattaccaggcttga

SEQ ID NO: 75893 - DNA, 144 bp, Glycine max
  Peptide Sequence Number=SeqID_192671
atgggtgcaaaggatatgtcattcattcacaagggaaataaaaatcctgtcagtgatcctggtcatgtggtggtggtgggtccagatccatggcctccttgttcaaagtccagtgcaggagtgcctgctgagtaccctctatga

SEQ ID NO: 75894 - DNA, 1146 bp, Glycine max
  Peptide Sequence Number=SeqID_192672
atggaaaaaccaacggccacaattgcacgtttgactgagggtttgggttgttgggtcgtgagtggaatcagcaactatgaatatgatgcggaggttgaagagcattgcttctgggaggacttccatttcttcagatcctttggttcttatgtgattttattatcttacatgtatcctttattccgagtactgggaggggattctaactcaaaaagggccaagtttgaaccagaaactgaagggaaggccgatgagaaaacaaataccattgaaacaatctgcacagatcaggaacaacctatagacacatcaaaagaaacttccaatgtaggcacatccgatgtatctacagtagctagaactgagaagtcaggtttcgatgagcttcctaaagaattaaatgaaatgaaaattagagatgagaaaagcaaaaacaacaatgaaaaggatatagaagctactgtagtgagtggtaatggaacagaaacaggacaaataattacaactgccattggtggtcgagatggacaaccaaagcagacaatctcttacatggctgaacgtgtggttgggactggttcttttggtgttgtttttcaggctaagtgccttgaaactggtgaatctgttgccataaagaaggtgttgcaagacaggagatataagaatagggaactccaggttatgcgcacagttgaccatcctaatgttgtcaaactaaagcactacttcttttcaactaccgataaagatgaattgtaccttaacctggttttggagtatgtacctgaaactgtctacaaagtttcaaaacactatgttaggatgcaccaacacatgcctatcatttatgtgcaactttatacctaccagatatgtcgtgcgttaaattatttacatcaagtgattggtgtttgtcatcgtgacatcaaaccccagaacctattggtaaatccgcagacacatcagttaaagatatgtgattttgggagcgcaaaggtgttggttcctggtgaacccaacatatcgtacatttgctctcgatattatagagctccagaacttatatttggggctactgaatacacaattgctattgatatgtggtctgttggttgtgttttagctgaactactcctaggacag

SEQ ID NO: 75895 - DNA, 288 bp, Glycine max
  Peptide Sequence Number=SeqID_192673
atgcattatctctttttggaggaatttgtcatccttaaatcttttaaggttgttggtcattccagcaaggcttccaacatcaaggaggttcgttgggatcttcctctttcaggttgggttaaatgtaacacgatggtgtggcgagcagctccctcggtgttgcagctggtggaggtatgtttggagactcaaggtgtaaccatgattttctgtacggtacaagcggctatggaggcactagaaattgctaaaggaagaggatgggatcaattatggttggaatgttga

SEQ ID NO: 75896 - DNA, 433 bp, Glycine max
  Peptide Sequence Number=SeqID_192674
actatcactcgatgcctacaccgctgcttacaacgacttggctgtctttgaagcatcgacggcggacgaaggtggcgatggcagacgaaggcaactgcagaatgtcaagggtttaggctcgggtatagtacttgagatcacagttatatcatgcgaaaaccttcgtgtgatggaggatccgtacgttgtcgttagggcagagtcgttaaactgttgcaccacgaagatggcgaaggatagtgggagcaacaaaacgagtttgttttcgtggaacgagaaaatcgccgtgtcggattttctcggcggcggcgtgtcgggaaatttcatgcacgtggagttaccggttgaaggactgggaagggaaagaaaacggggtgattcatttcgcggtgagggtggaggtggcgccggtgaaggggacggtggtcagtaa

SEQ ID NO: 75897 - DNA, 402 bp, Glycine max
  Peptide Sequence Number=SeqID_192675
atgacgatccgttttttggcttcctcgacgaggtctctcacagccacctggttcggcttcggcggcatattcatctcagaatcgccgcgcaattcggaaaagcaaaactcgattcaaatcaatctcatcggaaagggaattcggttgaagatgttgatgaagaattggagagagagaggctctttccatacaaaaaattcgcccccgttattccctccccgaagcatctcagatcctaagttccgtgcgtgtccgtgtatcgttatcgagctaaataaccaggagtcgaggagtgatggaagcaaaacgagggaggataccacgaaacaaaaaatacgcataaacagtgatagtgcagaatgtggcatgtgtatgaagttagtacctttttttttggattaa

SEQ ID NO: 75898 - DNA, 1479 bp, Glycine max
  Peptide Sequence Number=SeqID_192676
atgtctccagctgacatagctggtggcacacttcagaattggcaggacagtgttcctccaacaacagatggtaaagtgggcttctcacccaagcctcctcctgggggtttagtgaatcagcaacagtcatccgctgctctcctcacacttgttgtcaattcttcgaacaccagcagcagtttggggtccgagaaggcgaagtcatacatttctccatctcctggcacttccttggcactatctcaaagcacttttacgtatgacgaattatctatggcgacagatggattctccagatcaaatcttcttggtcaaggtggttttggctatgtccataaaggagttctcccaaatgggaaaattgtcgcagtcaagcagttgaaatctgagagtagacaaggggagcgtgagttccatgcagaagttgatgtcattagccgtgtgcatcacagacaccttgtttccctagttggatactgcgtctcagacagccaaaagatgcttgtctacgagtatgtggaaaatgatacactagaatttcacttgcatggaaaggacagactacctatggattggtcaacaaggatgaagattgctataggatctgcaaaaggattggcatatttgcatgaagactgtaatcccaaaatcatacaccgagacatcaaggcatctaacattcttcttgatgaaagttttgaggctaaggtcgcagattttggacttgcaaaattttcatcagacacagacacccatgtttctacccgagtgatgggaacttttggatacatggctccagaatatgctgctagtgggaaactcactgaaaagtcagatgttttctcctttggtgttgtgcttttggagttgattactggacgaaaacctgttgataaaactcaaaccttcatagatgacagcatggttgaatgggcgaggcctttactatcccaagctttggaaaatggcaacttaaatggacttgtcgatccaaggttgcagacaaattacaatcttgacgagatgatccgaatgactacttgtgctgcaacttgtgtgcgctattcagccaggctccggcctcgaatgagccaggttgttcgagctctggaaggaaatatttctctagaagatctaaatgatgggattgcacctggacacagcagagtttttggttcctttgagagttctagttatgacagtgtccaatacagagaagacctaaagaactttaagaagctggcactggaaagccaagagcaaggcattagtgagtacagtggtcccagcagcgagtatggccgacatccatctgtctcaactagttcggaccagcaaaatacgcaggaaatggaaatggggaacaagaagggtagcaaccatgattctgggatacaaatatcagtttgcaagtgcacctatgagagtggtactggtacagtggtccaatgtacgaattggcttgcacacgatgaatag

SEQ ID NO: 75899 - DNA, 570 bp, Glycine max
  Peptide Sequence Number=SeqID_192677
atgcccccaatgataagcatacccaccgaacctaacacggcccctataactattccgctcactgtacccgtcgacaacccgctgttaacggtactggtcggaggggaggccgcctccggcggcggaggagaaacggtggcattgatggtggagggaggcggaggagagagggcagtggagttaggtgagggagtagtctctgacggaggagaggcagtgaaggaaggagcctccgccggcgccgacattgccggggaagattccggcgcgacggtgagagcgagggttttgaaaaagaaagagagaagctacttcttctattctacgtactcacagttcataacgtgtggaaacaaacgacgtgggcctcctcattccgtcgtttcactcgcttcctcttgcgttttgctgcaacttcccacaccggtcgcttttttcagcgggaaagttggggccaggccaatcgtcgcccactttaaacttgtccgtgatcagctagctttagcagaggaaccctctcaggttcatgcacttcagaactcttcaattctaccaatcaatttaggttaa

SEQ ID NO: 75900 - DNA, 219 bp, Glycine max
  Peptide Sequence Number=SeqID_192678
atgggtagtttagcctctcattgtcatgagagacttacaattacaaaatggaatgaagatggtggaaaagaatggagaggaagtgaaaggatagcttccaatggtgcgccttcacgtgatgtctggcttccccatggtttcttcgcgttgagcgagggttgcacactaaacggccgtgtcgcactgagcgagtgtggcgccttgagtgagactttctag

SEQ ID NO: 75901 - DNA, 1404 bp, Glycine max
  Peptide Sequence Number=SeqID_192679
atggctggtggcacacttcagcttcagccacagcaacaatcacccgctgttctcaccagaatcgttattagttgcatagaattttcacgtgaggaattatatgtggcaacagatggattctacgacgttcttggtgaaggtggttttggccatgtctacaaaggacgtctcccaaatgggaaatttgttgcagttaagaaattgaagtctgggagtcaacagggtgatcgtgagttccaggcagaagtcgaggccattagccgtgtgaatcacagatatctcgtaaccctagttgggtactgcacctcagacgatgagaggatgcttgtctacgagtttgtgccaaataatacactaaaatttcatttgcatgaaaaggacaaaccatcgatggactggtcaacaaggatgaagattgctctaggatctgcaaaaggatttgaatatctgcatgtgtactgtgatcccataatcatacaccgtgacatcaaggcatccaacatccttcttgataaagattttgagcccaaggttgcagactttggacttgcaaaatttttatcagacacagaaagccatgtttctactcgagtgatgggaactaatggatacgtggatccagaatatcgtgatagtgggagactcactgcaaaatcagatgtttactcctttggtgttgtgcttttggagttgattactggacgaaaacctattgatgaaaagaaacccttcaaagagcgcgacttggttaaatgggcaagtcccttcctgctccaagctttgagaaatatcaccgttgtacctcttgattcaaggttgcaggaaacttacaatcctgaggagttcctctgccaagctttgaaaaatggcaggtttgatggacttattgattcaaggttgcaggaaactaattacaatcctgaggagatgatccgaatgatcacttgtgctgcagcttgtgtgcttaactcagccaagctccggcctcgaatgagcctggttgttctagctctgggaggatttattcctctaaaatttctaaagccggagatcacacctggaaccagcaatgtttctgaatacttaagtgatagtatccaatcctatgaagacctaaagaagatattcatgaatatggcacagaaaggcagagagaatgtcattgatgagaatgagtacagtgatcccagaagcaagtacggtcaagatcaatgtgcgtcgtctatggctggacccagcaatgtttctgattcctttaataatggtgtccaatccatgaatatggaacagaaagacaaagagaaggttattaatgagaacattgatcccagcagcaagtatgattctgtgtctactcacggccagcaaaatacaaaagaaatggggaaggtgaacggttcgtag

SEQ ID NO: 75902 - DNA, 693 bp, Glycine max
  Peptide Sequence Number=SeqID_192680
atgaagagaaaagctgcagcatacaacaataaagcaggctccaccaatgttcagtcttcaaagaagcctgttgaaaatcctaaagttattgcaaagtttgagtggagaacaaaagtgaattctcctgttgttgaggatgcaattgataacttcaccagacatttaatttctgaatgggtgacagatctatggtattctcgcttaacaccagacaaagagggtcccgaggaggatcttattaatctcatttgctcacacttggagctgtttcgtgctgcccactcaaaaattgaaaaacgacatacaggttcattaacaatcgaaagtcgagacatggaactaaaaaatgttttggctgctgagaacaaattgcatcctgctttattttctgcagaagctgagcataaggttttgcagcatctgatgacaggtcttatgcatgttactttcaagtctgaggatttgcagtgttctttctttcgatatactgtcagggagcttcttgcatgtgctgtaatacggcctgtcctaaacttagcaaatccaagatttattaatgaaagaattgaatctgtggtagttaacaagacaaaggttaacaagggggttgctgcagctcaagaggcatctcacactaaagcagatgagatacaaatttcatctgatgatttcttcaagtcttcagatccttct

SEQ ID NO: 75903 - DNA, 2025 bp, Glycine max
  Peptide Sequence Number=SeqID_192681
atgagccggcaggggcagagatccggtgcgacgggggtgcaccataaccgccagtactccgaacactatctcgacgcctcttccaagtggtttaataactcttcctccaatcacattcctcctcttcaggactacaatttgtacggcggcggaggaagaatgtatcggagcaacgcgcagaggagcttcaatgaatattgtttggatccgtccacgcctcctcggagttacgccgttaagaaaaacggcaacggttacggtgaggaagacgattctcctcgcgatttcagccccggcctcttggatctccattcgtttgatacggagcttcttcctcagattacgtcctcgaatttgtatgattccgagccttacattttcggcaaacaacctgtcagagctcgcgcttctgaaaacaatgtctccaatagtgttgctgctgcggacaatgtgaaatctagcaatgtggctaagattaaagttgtggttcgcaagagaccgcttaataagaaggagacagctaagcacgaggaagatatcatagatacagtttcgaattctttgacagtgcatgagactaaacttaaggttgacctaactcagtatgtagagaagcacgaatttgtttttgatgccgtcttgaatgaagaggttacaaatgatgaggtgtatcgtgaaactgtggagcccatagttccaataatattccaacgcactaaggcaacttgctttgcatatggtcaaacaggaagtggaaaaacttacacaatgaagccactgcctcttaaagcatcaagggacatcttgagattgatgcaccatacctacaggaatcagggatttcagttgtttgtgagtttctttgaaatatatggtgggaagctttttgatctccttaatgatcgaaaaaaactgtgcatgagagaggatggtaagcaacaagtttgcattgttggtttgcaagagtaccgagtatcggatgtagagaccatcaaggaactgattgagcaaggaaatgcaacaagaagtactggcaccacaggtgcaaatgaggagtcttcacggtcacatgcaatacttcagcttgctatcaagagatcagttgatggaaatgtatccaagcctcctcgtgttgttgggaagctctccttcatagatcttgctggaagtgaacgtggagcggataccacagataatgacaaacagacaagaatagaaggtgctgagatcaataagagcttgcttgccttaaaggaatgcataagagctttagataatgaccaaggacacatcccattcagaggcagtaaattgactgaagttctgagggattcatttgttggtaattcccgcactgttatgatatcatgcatatcaccaagttcgggttcatgcgaacatactctgaatacattaagatatgctgacagggtaaaaagcttatcaaaagggaacaattctaagaaggatgttctatcttcaaattttaaccttaaagaatcaactactattcctttgtcttccattaatacatatacctacgaggatcgtgcagctgatacatggcccgaagaaaatgatggggatgaatttagttctcctgaagattactgtgaaccagtgaaaccatcatggaagaaaaatggaaaggtagagccatatggtgcaacagatgataaatttaagaaacccaatggtcagatcaaatggaaggacatcccaaaagttgaacctaaaacagtacattcagatgatgatgatttgactgccctcttacaggaagaagacgaccttgtaaatgctcaccggaaacaagtagaggagaccatgaatattgttagagaggaaatgaacctcttggttgaagcagataaaccaggtaatcagttggatgattatatagcaaaactaaatgccattctgtctcagaaggcttctggcatcatgcagttacaaacccgtttagctcatttccagaaacgtttaaaggagcataacgttttggcttcatctgctggttactaa

SEQ ID NO: 75904 - DNA, 2739 bp, Glycine max
  Peptide Sequence Number=SeqID_192682
atggaagcgaaggaaggaacgccaaaattcccagggtttcctttcgaaccctattcgattcagattgatttcatgaacagcttgtatgagtctctcaatcaaggtggcgtgtctatgttagaaagcccaactgggactgggaagaccatgagtgtgatttgcagtgccttgcaatgggtgcttgatcggaggctacaacaggacgaagcagcgtgtggtgaggatagagggaatggcggtgacggtggggtaggttcggatgatgaacctgattggatgagggacttcgtcatcgacaaagaggagaagaagaaggaagagaaatgtgggtctgtgtggggaaagcctcatagtaagaagaagagcaaggaaattcctaaggattttagggttatgggcgttggagaggaaaagggtcgtgagagtttgcaaaagaaaattgatgcagtggaaattggtgataaggagtttttgctagaggaatatgagagtgaagatgagaaaggcttagggagtgtggtgtccaagaggaaggctgttaaaacttcttttagttcctctagcgaagatgagtctggtgaggaagaagaggaagaggagaagaagttgaaggtgtatttttgtagtagaactcattcacagctttcacagttcataaaagaattgcggaggacagtttttgccaacgagatgaatgttgtgagtttaggttcgaggaaaaatctttgcattaatgaagaagtagttgcacttggaaactccacgcgcataaatgagcgatgcttggaactccagaagaaaaagaaaaatgaagctacaaaagttaagaacttgaaagtaggtgcaggggtatgcagaacaaaggcctcctctggctgcccaatgcttagaaaacatagagttcaacaagaatttaggaatgaggtatctcaacaagggccattggatattgaagatcttgctaatcttggaagaactatgggagcatgcccatactatggttctagaagcttggttcagggagctgatcttgtggtcctaccatatcaatctcttctgtctaaatcatctcgtgaaacacttggtctgaatttgaaatccaatattattataatagatgaggctcataatttagctgattcactcatcaacatgtatgactccaagattacttcatcacagttggagattgtgcacagacatgtggaacggtactttgagagattccggaatcttttgggacctgctaatcggagatatattcaaactctgatggtcctcatgcgagcttttctccgagcactacttgatgataaagatggaaatcttaaagattcttgccgtgatacagctcaagcttctgaagaaagtggagcctgtgattttactatggccatcaatgattttttatttgaactaaatatagacaatatcaacttggtcaaactgttaaagtatataaaggaaagtaatatcatgcacaaggttaacggttatggagaaaaggtggctaccttggcgaaaatacctgcaatccatataattggggaacaagcagaggagggaagctgcatatctgctttccaagccttagctgacatattgctatcactgacaaacaatgatggtgatggaaggataataatttctaggtctaggtcaacaagcttcaagaagcaaggaggacatattaagtatgttatgctcagtggagagaagattttttcagagattgtagacgaagcacatgctgttgtattagtagggggaacacttcaacctatagaagagacaagggagcgactctttccgtggttaccaccaaatcagttgcatttcttttcatgtggtcatattgtccctcctgatagcattatgccaattgcagttacacgtggtcctactggacgctcctttgattttagcttcagctccaggagctcaccagacatgatgcgagaacttggtcttttgctatgtaatttggtgactgtggttcatgaaggaattgtggttttcttcccttcttttgattatgaaaatagagtctatgaacattggaaatcatctggcatccttgaaaggattattaagaggaagcgtgtatttagggagcctagaaataacatggatgttgaatctgttctcaaggaatataaagacaccattgatacaatatcagttatgaattcagaagtaaaccaagcatctcataatggtgcaatactccttgctgttgttggtgcgaagttatctgaagggatcaacttaagtgatgggatgggccgatgtatagtcatggttggactgccatatcctagcccatctgacattgagttgttggagaggataaaacacattgaaggttttcgaaatttaaagcttcctgagaatcctagtgtttcttccagttatgatctatacagtggagatgtacaaggtggttttgacattttaagaagttgcagtcacagaggaaaagagtactacgagaatctctgcatgaaagctgtaaatcaatcaataggtagagcaatccgtcacattaatgactatgctgcaattttgttggttgacacaaggtatgcatctgattcttcaaaacgaagcttttcccacccagtaactaagctcccccagtggataaaagatcgttttgtttcttctaccattaactacggagaggtacataggttgttgcatcagtttttcaaactcaagaaaacatgctgccattag

SEQ ID NO: 75905 - DNA, 2478 bp, Glycine max
  Peptide Sequence Number=SeqID_192683
atgcctgcaaactccctaactaatgataacctaggtcttcaacgacatcgctcaggaggagagtggggagatattttagatgtcatctctcacagaaagacccaagctcttgctccagaacattttgaaaatatgtggactaaagggaaaaattacaagaaaaaggatggcgagaaccagtcaaatgagcatgtttcacagcattcccaggtaggaaaactgtcgatggtagatcatatgaaggaaatatctggaccaaacgaaagagatactaattccaagcttatgcttccgcctaagggacgccacattaattctgggcacaacagtcaattctctgtagaaaatacctccattcatgcagacaagaatggatcaacttcagttacctcatacaaagatgataagtcagttacctcgtataaagatgatgagcacagccacatttatgggcagatgagtgattcagcgagcagtacttcttattcctctgaagataacgaaagtagtactgtcactggtcttgattcccctgtcactaaggtttgggatggaaaaagtaatagaaaccaggctgtttcttatgttcatcacccacttgaaaattttgacaatcacagtgcaaagaaaaggaataagagccattctcggtatccaagattatccagagcccaatctggcagtaaaaggtcttggccaggtggtcaaaaaatacaaacgtggcaggaagttgagagaacaagctttttatctggagatggtcaagacatacttaattcttcaaaatcacatataaattctgaggagtccagtgatgatgctgatatggaaagtttgggtagactttatagtggagcagctgcctcctcttctgcctactctatttctaaatcagaatcttgtagtttgtctgttggtcccctgaaaaattcctctgctgtagattccttttacaagttgagatgtgaggtcttgggtgcaaatattgtgaagagtggctcaaaaacctttgctgtttactccatatctgttacagatgtaaatcacaacagttggtcaattaaaagaaggtttcgccattttgaggagctacatcgacgcctgaaagagttcgccgagtataatcttcatttgccaccaaagcattttctgtcaactggtttagatgtaccagtcattcaagagcggtgtgaattactggataaatatttgaagaggaaaaaattatctgcttttggtactgtgatagaaccacgatcaccaatactctgttaccagcaggatagatattggatattaaaacttatgcaattaccaacagtttcggaatcaattgaagtatgggactttctcagtgttgattctcagacatacatattctcaaattctttttctatcatggaaacattatcagttggcttgaattcaaaaccatttgagaagactaaaaacacttccaacttgtctgcacctgcaagcgatcctgtttccttttggagagaaaactgtagtgctgaaagtaaagaggctgttttgggagcaagaaataatgttgtggccaatggaatgaggtcaaaagtaaacagcacacctctttctctaccaaaaaagagtacacacgaacctagaaagtcatttgacaattctagcagcaatacaaacattctagcacggaagagtgtaccttctcccaagacagtgaaaggaagaaataattcagatgaggtttctgaagtgcaccatgatacttccgatgcttttccaacagagtgggtgccaccaaatttgagtgtacccatattggatctggttgatgttatcttccaggttcaagatggtggatggattaggcggaaggctttttgggttgctaaacaaatcttacaactaggaatgggtgatgcctttgatgactggttgatagagaaaattcagcttctccgtaagggatcagtggttgcttcaggggtccagcgagttgagcaaatactatggcctgatggaatattcataaccaagcatccaaatcgacgaccaccgccacctactagtccatctcagaattctcctcatggcaatcaacctacacaagtgtcttctccaaggttggatgatgagcagcaacaggaggcagatcggcgtgcaaaatttgtatacgagctaatgatcgatcatgcaccgccagcaattgtaggtcttgttggtcggaaggagtatgagcaatgtgcaagggatctatattttttccttcagactctatgctcaagcaagactcacttccgtcattctctctgtctctccataatttggtcgtgtaaatacttcctattgacttccttgcagtcatccgttatcttgaagcagctggtttttgacatcttggagctgctgctgacatcggcatttcccgaacttgataatgtgttcaagcagctgcatgaagaaaagcataaatttggagagttcagaacagagtaa

SEQ ID NO: 75906 - DNA, 156 bp, Glycine max
  Peptide Sequence Number=SeqID_192684
atgtggcttttggagattttcctgcggattcaaatccgctggaaattaattacagattttatgcaggaaattttcctgccaaaaaaaattgcacgaaaatctgcaggtcacaagagacccccggcagaagaaaacaacacgaaaatcacaaattag

SEQ ID NO: 75907 - DNA, 543 bp, Glycine max
  Peptide Sequence Number=SeqID_192685
atggaggcaaaatcacattcacgaatcctagaaatcacggttatgtcgggagaaaacattagcgtggatcgaagttcagtggcggcgaacgtgtacgttgttgttcgtgctgaatctcttaattcttgcacaaccaaaatggtgaatggagatgggggagtgcatgcatggaacgagaaattcttgttaggcattccttcgtatgcaaggtcagttacatttgaggtgcaatgcatgaattataaaggggttcgccctattggggtagcaaggatagcactttcggatttacttagtaacaatactaagattgtgtccgaaagtgtgcctcaaatgttgtgttacgggttgaggaattgggaaggtcgacgaaatggggttattcatttctccgtgagaatggtggcaccaggtgataatttgtgttcagaaacaaaacaagaaaaggaaataacgacggtgaattatagaggaattgagcatgaggtcatggggattcaagtggaagcaaaaaattcaactcatgttgccattggcattcca

SEQ ID NO: 75908 - DNA, 645 bp, Glycine max
  Peptide Sequence Number=SeqID_192686
atgctgctaagagaaacctttcgcaagaccaaggctttctttaacaaaagcttccgaaatttctggtctttcttctttggagagtaccaaaagcttcccagaactctttcctttaatccattcctctgtagagttggcaatgcaagaactcacacaagcgaccaactttacagtgagttttatgatatgctgcagtctgaccttggcagaataaagatgcatggtaactacaacatgtccatgtcagcaatggaagatgatgctgcatgttctagaagcttcatgtgttgtgccaagcaaagtccacaaaagagtatccatgaggagagagcacaagagaagaagaacaaagggagctcacagctcagtataaaagaggacttaaagtcacaaaacatgatgaacaagaaagctcatgttttagaacaaaagatgaaggcaatggatatgatgaatgcgggtgatctggagcatgtgctagacatagaagaggctctccactattattcgcgcctccagagccctgtctatttagacattgtggacaagtttttcaaagacatgcaatcagagttatctgttcctcagccctgtgtcagcctcaaaccatcgaaggaaagacttggcccgatccggttgagataa

SEQ ID NO: 75909 - DNA, 108 bp, Glycine max
  Peptide Sequence Number=SeqID_192687
atggcgaggaggattacaatggtggtggtgttcacaatagttatagttgttggtgagattagtactggtaggagtgtcaatgattacatagattttaaaaaagattag

SEQ ID NO: 75910 - DNA, 909 bp, Glycine max
  Peptide Sequence Number=SeqID_192688
ggtgttgctttaggaggagttttattttttgtgacactagctagcatcccgacaggcacttccagcaatgattttccattttccatgatgtcaaatcttgagatgcttgaaaacaatacttatagtttgtgggtgccattgggccatatctataggccactcaaggctaccgaaacttcaaaggaatcatttgaattgttttatgtgaatggtgtgttagaatataagcctaatgcgatggttttccaaacgtacgcagttctgtcaagggcatttgactcatctgtttctgctaaagaccctccttcctacaagggtgttgctttaggaggaactggtaccggggccatccaaagtctattaatatcccctgtggagttgaccaaagttcgacttcagctgcaaaacgcaggtcagatgacagaaaccgcaaaaggtcctctaatgctcgctaagaacatatggagaaaagaaggccttcgaggaatctatcgaggtctaggtgtcactgtgatgagggatggaccttctcatggtttatacttctggacatatgaatacatgagggaacaacttcacccaggttgcagaaaaagtggtgaagagagtttgaatactatgttaatagcaggaggattagcaggggtgacgagttggattagttgctacccttttgatgttgtaaagacaagactacaggctcaaacaccctcttctataaagtacaaaggcattatagattgtttcaaaaagagtgttaacgaagaaggatacggtgtgctatggcggggtttaggaactacagttgccagagctttcctagtaaatggtgccatattttctgcatatgagatttcactaagattactgtttaacaatgggaatattcaaatgcaggaaacactatag

SEQ ID NO: 75911 - DNA, 207 bp, Glycine max
  Peptide Sequence Number=SeqID_192689
atggaggccggaaatcacggcagcgccgcatatggaggccggaaatcacggcagcgtcgcatttggaggtcggaaatcgcggcggcgccgcttcacggaggttcccgacaactgatgtgtgttaatgttgcaagagtgattttgagttctgacagagaaggttggagcatgagggcagtgtcggagatcgataaatttcagatctga

SEQ ID NO: 75912 - DNA, 171 bp, Glycine max
  Peptide Sequence Number=SeqID_192690
atggatttctggccagaatttcttgcaagcagttcgggaagagagtttgtagcaggtggctttggaggcctcgctgaactcgaaaaatggctctgccttcacaatcctttagaccaatggtgtctagggaaggacctgcttctttgtaccgtggcatgggcgcaccattag

SEQ ID NO: 75913 - DNA, 288 bp, Glycine max
  Peptide Sequence Number=SeqID_192691
atggccatggctttggtgagcctcaacaccattcatacatcgccttcttctttttcgttttcatctcccaaaccttattcttcctccaactatgcaccacctctcaccctccttccacgatttcggaggcacctcgttcgtatggctcccgacgaggagaagatgactcgccgttcccctctcgatttccccatcgtatgtaagtgctgcgaatttggattcggattcgccgtcaccctgctatgtttattgcctgattacctcaattctttgttgaaggataattga

SEQ ID NO: 75914 - DNA, 496 bp, Glycine max
  Peptide Sequence Number=SeqID_192692
atggcaactgtaagtggctatattccggttggtgtgttgacttttgaaattcttggtgtgattagaatgtcttctaattatggaaggataatgctttggtcgagtggttacatgtctctagagtatgcaatcaatggtgttgtgccggtcaaaacagatgtatatggctctggcgagggtaaggtcgcgttgtgttgcgtcgtgtcgtgcgctgttcctctgtttctcgtttttgtgttcagaccgaaccctagctccgcatcgcaaccatgtcgaccaagcaagactaagattctttggtttgcaatttatctgatcgatttcttttttccctctttgggacttttaggtggaaaagctaagcctttgaagaaacccaagtctgataagaaggattacgacgagattgatgtggctaacattcagaagaaaaaggaagaggagaaggcgctaaaggagttgaaagccaaggcgcaacagaagggaagctttggag

SEQ ID NO: 75915 - DNA, 684 bp, Glycine max
  Peptide Sequence Number=SeqID_192693
atggcctcaactacactaacaaccctctccctccgcaacctctcttatcctacaccctcctcctcttcttaccctacgcacctctccgccaacccctcctccctccaattccccaacttctcccaccgcgccaccaccacgcgccgcgcccgcgtcgtcgtcgtctccgccgtcgaggcaccggagaaaatcaccaagctcggcgacgaaatcgcgggactcacgctcgaggaagccaagaacctcgtcgacttcctccaggacaagctcggcgtctccgcggcagcgttcgcccccgtagccgtcgccgcgggtgccgtcggcgccgtggcggacgctccggcggcggtggaggagaagacggagttcgacgtgttgatcgaggaggtgccgagcaacgcgagaatcgcggtgattaaggcggtgagggcgctgactaacctggcgctgaaagaggcgaaggagttgatagaagggttgccgaagaagttcaaggaagggatttcgaaggacgaagctgaagatgcgaagaagcaacttgaagaagccggtgccaaggtgaagggttttaaattgctgaattggaaattggaaattggaaacatggtacttaactacttgctgaatacctggagtgacaagacttcatctgtctggactatgatgtttggctacgctccatag

SEQ ID NO: 75916 - DNA, 1089 bp, Glycine max
  Peptide Sequence Number=SeqID_192694
atgaagactcggctagagattatacagaataggaagaaagcggagcagaagttaatgaagagtgacattgccgagcttcttaagagtggccttgactacgatgcatatataagggctgaacggcttctgttcgagcaaaacatgttgtcctgctatgaactcgttgaaaagtttgtaggatgcatatcagatcatgttgaagacctaactaagcagaaggattgccctgatgaatgcaaggaagctgtgccatcattgatgtatgctgcagcaagattcggtgatctgccagaattgcgtaacctcagaacattatttactgagaaatttgggaattctcttgaaccttgtattaataaagagtttgttgagaagctgaggcgagatccgcctacgagagaaatgaagattggactactatatgatatagcacaagagttctctgtagagtggaatgacaatgctctgaggcaaatactttatacacaatcgtcattatgtgaagagaggcctaatcccgggggagacttcaatacatctaaagggaaagaaaaagacacagacaccctacctcttggaaggaaagatttcaatgatgactcattgatacaccaaaatagtagtgatgatgaaacaagtacagagctgtcatcccatgatggcagaaagggtagtagttcaagttcattgggaagcttttctgaggatgaagctgaaactaagaggccaatttcttcctattggatcattccacccccatacctcaaacaaaagaccaacacaggtgaaagcaattcaaagaaaacaacacattctgaggctggtggaatgaaatcaggcaaaggaaaaccttatccttctcaacaaccagatcatgatactggccaaaacagaaggcgtacaacatcacatgtcagaggaaaatctctttcttctgagccaacaactgcagtggaaacatcaaaggggcatacacgaacaatttccttagaatcaggaattcgcggtggtggttcatggcgtgtgcatccaaatctacccgattatgatgatttgagagctcgtcttttagctctcagacaaagataa

SEQ ID NO: 75917 - DNA, 982 bp, Glycine max
  Peptide Sequence Number=SeqID_192695
atgactcagttcctcaactccgtcctctcccagcgcggcccctccgcggtcccttattccgaggacaccaagtggctcatccgccagcacctcgtggcgctcaccaccgccttcccttccctcgagcccaaaacggcgtcgttcacccacaacgacggccgttccgtcaacctcctccaggccgacggcaccatcccgatgacgttccaaggcgtcacctacaacatccccgtcgtcatctggctcatggaatcctacccccgccacccgccctgcgtctacgtgaatcccacgcgcgacatgatcatcaagcgccctcaccctcacgttaacccctctggtttggtttccgtgccttatttgcagaattggacttaccctagttccaacctcgtcgatctcattctcaatctcagcctccacttcggccgcgaccctcctctttattcccaacgcagacctaaccctaaccccaaccccaatccccatcctcctcccaattacggaaattctccctctaatttatcatcttcatcttcatcttcatctggctatccccatgcccatgcccatgcccaccctcctccgaggacttaccctccttctccttaccctgcctcttcttctagggttcagtcctctgaggatccttctgaggttttcaagcgcaacgcgattaacaagcttgtggagatggttcatggagatgttgccgcgttgaggaagacccgggagggtgaaatggaggagctgtttagtttgcagggtgtgctgaaacaacgcgaggagagtctcaacaagggtgtgaaggagatgcaggaggagatggaggctttggagcagcagttgcagatggtgttgatgaatactgatgttttggaggggtggctgagggataatcaggggaagaagatggccggtttggagaatcccgaggacgcttttgagtgtgcggatgtgctctcgaagcagatgcttgact

SEQ ID NO: 75918 - DNA, 938 bp, Glycine max
  Peptide Sequence Number=SeqID_192696
atgagcgtggttggtttcgatttcggtaacgagagttgcgttgttgcggttgcgaggcagagagggattgacgttgtgctcaatgatgagtccaagcgtgaaacgcccgccattgtgtgcttcggtgacaagcaacgcttcattggcactgccggtgctgcctccactatgatgaaccctaagaattcaatctcacagattaagagactcattggtaggaaattcgctgatcccgaattgcagcgggatcttaagtcattgccgtttctcgtcactgaggggagtgatgggtacccgttgattcatgcgcgatacatgggtgaggccaagacatttacgcctacccaagtgtttggaatgatgctgtcgaatcttaaggaaattgcggagaagaatctcactacggcagttgttgattgttgcattggaatcccggtttatttcactgatctgcagagaagggcggtgttggatgcggccacaattgctggtctgcacccgcttcggttgattcacgaaatgactgccactgccttggcctatgggatttataaaacggaccttccggaaaatgatcagctgaatgttgcgtttgttgatgttggacatgctagcttgcaagtatgcattgctggattcaagaaggggcagctgaaagtgttggctcattcgtatgataggtctttcggcggtagggattttgatgaggttttgttccatcactttgctgagaagtttaaggacgagtacaagattgatgtttttcaaaatgccagggcttgcataaggctcagggctgcctgtgagaagatcaagaagatgcttagtgcaaatcctgaggcacctctcaacattgagtgcttgatggatgagaaggatgtccggggcttcatcaagcgagatgaatttgagcaactaagtcttccaattttggaacc

SEQ ID NO: 75919 - DNA, 866 bp, Glycine max
  Peptide Sequence Number=SeqID_192697
ttctacgccgccaacttgctgtacggcatcagtttcaaagaagcgcaaggacatcccggtctatcagctggacgtcaaggtgtacgaagtgttcgacaaggacggcagtcgctggcgctgttctacaccgactacttcaagcgcgacaacaagggcggcggcgcctggatgagcaacttcgtcgatcagtcgaagctcaacggcaccaagccggtgatttacaacgtcgccaacttcaccaaaccggcgccgggccagccggcgctgctgtcgtatgacgacgtaatcaccatgttccacgagttcggccacgcgctgcacggcatgttcgccgatcaggaatacccgagcctgtcgggcaccaacaccgcgcgcgacttcgtcgagttcccgtcgcagttcaacgagcactgggtcagcgatccgaaagtgttcagccacttcgccaagcactaccagaccggcgaggcgatgccgcaggaactggtcgacaagatcaagaaggccgacaagttcaacaagggctacagcatgaccgagctgctgtccgccgcgctgctggacatgcactggcacatgctgaccgccgatcagccgcagcaggacgtggacaagttcgaggccgagtcgctgcaaaaagacaaggtcgatctcagctacgtgccgccgcgctaccgttccagctacttccagcacatctggggtaacggctatgccgcgggctactatgcctatctgtggacggaaatgctggcggacgacgccttccagtggttcaccgaacacggcggcctgaccgccgaaaacggccagcgcttccgcgacatgatcctgtcgcgcggcaacagccaggatctggagaagct

SEQ ID NO: 75920 - DNA, 282 bp, Glycine max
  Peptide Sequence Number=SeqID_192698
cttgagaggattgatggggacccggtgttgagagaaacgaggatatgggctacgtgggagtacgtgagctcagatggaggtgggcaacaggggatgagtggtacctggagatatgtcgcgggggtcaggagaccttggggacgtcaggcgagctcctggcagtcaacagataaaaggaaaacaagaccacaaagcaaggaggcttgtggtggctggccagctgaggctaagatggtctctggtaatcgattaccagggggtgtaatcgattaccaggcttga

SEQ ID NO: 75921 - DNA, 1452 bp, Glycine max
  Peptide Sequence Number=SeqID_192699
atggtccttgatgatggaatcagctatgctaagcttgcaaacttgccacctattcttggattatattccagttttgtgcccccgttgatatattccctgcttggaagttctagacatcttggtgttggtccagtttcaattgcatctttggtcatgggatcaatgttaagcgagaccgtttcttatagtcaagatccaattctctatcttaaaatggccttcactgccactttctttgccgcctttgatgatccatacaggttaggctttgtaattgattttctctcaaaggcaacactggtgggttttatggctggtgcagcgattattgtgtcactgcaacagctgaaagggttgcttggaatagttcatttcaccaacaagatgcaaataacacctgtactgatttctgttttcaagcaaagagacgagattggtggattgccaaagggacttaatccaccatcatcaaacatgttatacttcaatggtccttatttggctcttgctattaaaacaggacttgtcactgggatcttgtctctgactgaaggaatcgcagtaggaagaacatttgctgcacttaagaattaccagctggctcttgttcttcatgctatgtcacaacaggcaatgactcttccctcatttgaccatgtgactagtggatccttttctcgatcagctgttaactacaatgccggggcacagactgcggtctcaaatataatcatggcatcagcagttcttgtgacccttttgtttctgatgccactgttctattacacaccgaatgtagtcttagcagccattatcatcactgctgtttcagggctaatagattatcaagctgcatataaattgtggaaggttgacaagcttgatttcttggcctgcttgtgctcctttttcggtgttctgttcatttcagtgcctttaggccttggaatagcggtggcaatatcagtcttcaagatcttgcttcatgtctctaggccaaacacactggttttggggaatataccagggacgccaatattccacaacctaaaccaatatagagaagctttgaggatcccttcatttatcattttggctgttgagtctcccatctactttgctaattcaacgtacctacaagaaaggatactgagatgggttcgagaagaggaagagcgagtaaaagcaaacaatgagagtactttgaagtgcataattttggacatgacagctgttactgccatagacacaagtggaattgatactctatgtgaactcagaaaggtgctggaaaaaagatcacttcagcttgtgttgacaaatcctgttggaaatgtgatggaaaagttgcatcagtcaaatattttggattcctttgggttgaaaggagtctatctctcagtaggagaagctgtggctgacatttcatcttcttggaaagctcagccttga

SEQ ID NO: 75922 - DNA, 1388 bp, Glycine max
  Peptide Sequence Number=SeqID_192700
gttctggtccagatgcacaggacaatggaccagaaaatcagcagagttcccttgtttttcccaagggtaatcccataccaagtatcaaggcactgacattctacaggtcaggaacattctctgttgatgtacaatttggtgatgtgagtgggctgcaaacacctgctaagatcagcacctatacttgctgtgactcttttgagtgtaatcagattggtcctttccaaactacaaatggtgaaaaggcaaaagttaaagtgaaagttcgtctgaatctgcatggaattgtatcccttgagtctgcaacgctcctggaagaggaagaagttgatgttccagttagcaaagaagcagcaggggaaaatactaagatggacatcgatgaagtcccagctgaggccgctgcacctccttcctccaatgacactggtgctaatatggaaaatggaaaggctagtattgatgcctctggggttgaagatggcatccctgagagtggaggtaagcctttgcaaacagatactgataccaaggttcaggctccaaagaaaaaggttaagaaaacaaacattcctgtagtagagttaatttatggagcaatggtgcctgtggatgtccagaaagcactagagaaggagtttgaaatggctttgcaagatcgtgtgatggaagaaacaaaagacaagaaaaacgcagttgaggcttatgtttatgacatgagaaacaagcttaatgacaaataccaagagtttgtcactgcttcagagagagatgattttactgctaaacttcaggaagtggaagattggctttatggtgagggtgaagatgaaactaaaggtgtatatactgccaagcttgaggaactcaaaaagcatggtgatccaattgatgagcgttacaaagaattcatggagaggggtactataatcgaacagtttgtctattgtataaatagttacagacaagttgcaatgtcgaatgatcccagatttgagcacattgacattaacgagaaacagaaggtcataaatgaatgtgttgaagctgaaaagtggtttaatgagaagcagcagcagcagaactcacttccaaaatatgccaaccctgtactcttgtcagctgaaataagaaagaaagctgaagctgtcgataggttctgcaagccgattatggcaacaccaaggccaaccaaggcgactactccaccaggaccagcaacacatccatcttctcagagtgatgaacagcagcagcagcagcaacctcctcagggggatgctgatgccaacagtaatgagaatggtgggaatagcagtagtcaggctgcaccagcgtctactgaaccaatggaaactgataagtctgagaaaacagcctctgcctaa

SEQ ID NO: 75923 - DNA, 250 bp, Glycine max
  Peptide Sequence Number=SeqID_192701
atggtcatgtcgaagaagaccttagggttaggcatagttgcagagaagagaatcgaaaatcgcactactgaggaagaggaagaaagagggattagggttttgcttggggttgcggatgacgagagagagatatttatagtggcgcgtgatgcagaagtgaccgttcgattggaacacgtggcgggggttagtggagcggatccgaggtcactcacggatatgctcgtcattatgccaatgactttcacga

SEQ ID NO: 75924 - DNA, 531 bp, Glycine max
  Peptide Sequence Number=SeqID_192702
atggaactgtcatggttgagtgccattctggtgggggctggttatctcgctttgggctacttcattggttctcagtatccccctcgtttcctcttctcacataaattatcgactaaacaaaaagatgcttcacttctcaatgacagcgacaataagaagaggaatactaagtccaaactcgaagacccccttgagattgaacaactcgctgaaattctcgatgattttaagatgatacttgttgtcaggaatgatcttaaaatgggtaaagggaagattgctgctcaatgcagtcatgcaacgttaggtctctataaaaagatccttcgtcgagcaccaaaggctttgaataggtgggagatgtctgcacagcctaaggtggttgtcaaaattgaatgtgaagaagatatgctggctttgcaagaaagagctaaatctctgaagttacctacccatatcacaattgatgctgggagaacacagattgcaccaagtgcgtatttgaaacttcccttgagtagttgcttatag

SEQ ID NO: 75925 - DNA, 2910 bp, Glycine max
  Peptide Sequence Number=SeqID_192703
atgccgattccgataagcagcggagagagggattatgtgaatgagctatctgagattgcttgcaaagggaattggtttgctcccgcccactacccaccaccgctccttctcttcacagacacttctccgcatccaacccggacgaagaaaacgactgtcgtttttgtgtcactcctctgcgacatcgtccgaggaaagcagagttggaaggtggctttcaacgacgcttcaatttcatccacattaagaccccattacgtggagcaagtgttgatgaacaccctcgatgatgccaagttagctttgaggttcttcaactttctaggtctgcacaaaaacatgaaccactccacaacctcctacgccattatggtccacgcgctcgttcactccaggctcttctggcccgcgaattccctcttgcatacccttctccttcgtgagtcccacccaaaatgcgttttttctcactttctagactcttacaagcgatgtaagttttcgtccactttgggtttcaatttgttggttcagaattacgtgttgagttcaagaattttcgatgccgtcgtcattgtgaaactcatgtttgccaacaatttgttgcctgaagttagaacattgagtgccttattgaacgggcttttgaaagttagaaaatttatcactgtttgggaattatttgatgagtctgtgaacgcgggtgttcgtcctgatccttatacttgctccgctgtggttcggagcatgtgtgaattgaaagattttcttagagcgaaagagaagattcggtggatggaagctaatgggtttgatcttagtattgtgacttataatgtcttgattcatgggctgtgcaagggtgatcgagtttcagaagctgttgaggttaaaagatctttggggggaaagggtttggcagctgatgtggttacatactgtacattggtacttggtttttgtaggttgcaacaatttgaggctggaattcagcttatggatgaaatggttgaattagggttttctccaaccgaggctgctgtgtcggggttagtagatggattgagaaagcagggaaagattgacgatgcttatgagttggtagttaaggtggggagatttggttttgtgccgaatttgtttgtctataatgcattgatcaactctttgtgcaaaggtggagatttggataaggcggagctgctttatagtaatatgagtttgatgaacttgcgtcctaatggcattacttattctattctgattgattccttctgcagaagcggaaggttggatgttgcaatatcttattttgatagaatgatacaagatggtataggagaaactgtatacgcctataactctttgataaatggtcaatgcaagtttggggatttgagtgcagctgagtctctgtttattgagatgaccaataaaggggtggagccaactgctacaaccttcacatcattgattagtgggtattgcaaagacctacaagtgcaaaaagcatttaagctatataacaagatgattgataatggaattactccaaatgtttatacttttactgctcttatttctgggctttgcagcacaaataagatggctgaagcatccgaactttttgatgaattggttgaaaggaaaatcaagccaacagaggtgacatataatgtattgattgaagggtattgtagggatggcaaaattgataaagcctttgaattgcttgaagacatgcatcaaaagggccttgttcctgacacatatacctacagacctcttatcagtggcctttgttctactggtagggtttctaaagccaaagattttattgatgatctccacaagcagaacgtaaagctaaatgagatgtgctatagtgcacttctacatggttattgccaggaaggaagattgatggaggcactgagtgcttcttgtgaaatgattcaaagaggaatcaacatggatctggtttgccatgctgttcttattgatggggctctaaagcagccagacaggaaaactttttttgatctcttaaaagatatgcatgatcagggattgagacctgataacgtaatatatacaagtatgattgacacatacagcaaagaaggatcttttaaaaaagcttttgagtgctgggatttgatggttactgaggaatgctttcccaatgttgtgacctacactgctttgatgaatggtttatgcaaagcaggtgaaatggacagagcaggtcttctttttaaaagaatgcaggctgcaaatgtccctcccaattctatcacatatggctgttttcttgacaatcttacaaaggagggaaatatgaaggaagctatagggcttcaccatgcaatgcttaaagggcttttagcaaacactgtaacacataacattattatccgtggcttctgcaaactgggtagatttcatgaagccaccaaagttctttctgaaatgactgaaaatggtattttccctgactgtgttacctattcaactttaatttatgagtattgcagaagtggcaatgtaggagcatctgttaaattatgggataccatgttaaacagaggtctcgagccagatttggttgcatataacttgctaatatatggctgttgtgttaatggagagctcgacaaggcatttgaattgcgtgatgatatgttgaggagaggggtgaagccaagacaaaatttacatgcatttctgaaggggtgggtgaagccaaggcaaaatatacagaatctcttgaggctgagttatcttgaaaagaggtcagtgcttgaagttttgcgtattatgatcgattacctctctagtctggccgaaaacaagtcattcatgccgagattagagaatctacatggatgtcttgaagcttggtgttaa

SEQ ID NO: 75926 - DNA, 825 bp, Glycine max
  Peptide Sequence Number=SeqID_192704
atggaactggggagcgcaaggaatgagacagagtttatgattatgatgtttacaatgatttgggctatccccacagtaatgaaagattccaacagcgaaagacccggcaaagtttatgttccaagagatgaaaatttcggtgacttccttatttatgggataaaatctttatctcgaaaagtcctacctgcactcaaatctgtgtttgatataaaattcacaccgaatgagtttgatatcttcgaagaagtgcaattaagctgcctgcagaaatactcagcaaaattagtcccttacctgtgctcaaggaaatcttccgtactgatggtgaaatcaatgtcctcacagttttcaatacctcatttaattaaagttaataaatctgcatggatgactgatgaggaatttgcaagagaaatgattgctggtgtaaacccttgcgtgattcgccttctacaagagttcccgccacaaagcaagttggatccctcagtctatggtgatcaaacaagtaaactgactgaagaacacttggagattaaccttgaagggctcatggcaattgaaggtcagagactattcatattagatcaccatgacgtatttatgccatttttgacaaggttaaacgaatccaaatcaacaaaggcttatgccacgaggacaatccttttcttgaaagatgatgggaccttaaagccattggccattgaattaagtttgccatattcaggtggacaacagcttggtgctgatagcagagtcatcttgcctgcaaaccaaggtgttgaaagtacaatttggctattggctaaagcttatgtt

SEQ ID NO: 75927 - DNA, 774 bp, Glycine max
  Peptide Sequence Number=SeqID_192705
atggcctgcatcgacaaattttgggttttcgccctcgctcttctcctcctcgcttcccctctcctccaagttgctaggtgccagtcagactctgatgatgtagtggaggctgctgaagaatcaggtgatattggcattgttggtgatgatgtccaagactttggtgatgggactttcccttctgctccaggaattgaaacaataagtgtatttccgaaaaatagtgcaagattgataacagctggagaagagtcagagctgcttgttggtgttaaaaatgatggggattcaagcttgaatgttattgcgatcaaggctagtgttcaccttccttttgatcaccgtatgctggttcaaaatcttactgcacagggttttaacaatggttctgtaccagcctcagcacaagctactttcccttatttatttgcagtcatgagtaaagcatctcaagggaagggactattatactcattatgcctaatgatagatgaacatccattccaaagcaccttttttaatggcactgttgaagttgttgaatctggtgcttttctaagcatggaatctgtttttcttgttactcttggggttgcactccttgtcctcctggggctatggattcatggtcaaatacaacacctatctaaggtattaaaatctttattttttcatataatgtgctatcaaggattgccttcactgttagagtttgctaatggtactcctcataatatgtgtcccaatttatactcagactttgcacttgtttga

SEQ ID NO: 75928 - DNA, 2436 bp, Glycine max
  Peptide Sequence Number=SeqID_192706
atggattggtgtcaaaatcaaaacggaagttttaaaagtacagatgcactatgtattgcggcagaagctgatgaggaggaacttgatttcacaaaggtagacaagccaaggcctatagaaagatgcaaatcatgcgaagtaagatcactaagtgaactgtccaaagtttctgagaactcttcttactcaatagaccatcttgataaggcagcttctcttcagccaaaatcgggtatgaataccccaggatcattggtattggatccacaatcacatccaatagtatctgaaggctgggaagctctgatgcgttccttggtgtattttcgtggtcagcgtgttggtacaattgctgctatggatagttctgatgagaaaatcaattacgaccaggtgtttgtaagagactttgtccctagtgctttggcttttctgatgaagggggaacctgaaattgttagaaattttatcttgaagacccttcgccttcaatcatgggagaaaatgattgataagtttcacctagcagaaggagtaatgccagcaagttttaaagtacttcatgatccagtcagaaaccatgagaccttgatagcagactttggtgaaagtgcaataggccgggttgctcctattgattcgggattttggtggattatattacttcgtgcatacacaaagtctacaggagacaattccttggctgaactgcctgaatgtcagaagggcatgcgcttgattttgaatttatgcctttcagagggatttgacaccttccccactctactatgtgcggatggatgctgcatgatagatcgtagaatgggtgtttatggttatccaattgagattcaagcacttttcttcatggctttaaggtgtgccttgatattgctaaaggaagatgctgaaggcgaggagttcagagaaagaattaccaaacgattgcatgccttaagctatcacctgagaagctatttttggttggatttgaagcaacttaacaatgtatatcgcttcaaaacagaagaatactcacatactgcagtcaacaagtttaatgtcattcctgattctctacctgattggatttttgatttcatgccacttaaaggtggttactttattgggaatgtcagtcctgctaggatggatttccgttggttttgccttggtaattgcatagctattttgtccagcttggctactcctgagcaatccattgcaatcatggatctcattgaatctcggtggcaggaactgattggggagatgccactaaaagtttgttatccagcccttgaaaaccatgagtggcgaatcataactggatgtgacccaaaaaacactagatggagttaccacaatggaggatcttggccagttctattatggcttcttgctgctgcctctatcaagacaggacgaccccaaattgcaaaacgtgcccttgaaattgttgaaactaggttgttcaaggacaactggcccgaatattatgatggaaagcttggtcgttatattgggaagcaagcccgcaaatgccaaacttggtccattgctggttacttggtggctaagatgttgttggacgatccatcacatttaggtatggtggcactagaggaagacaaacaccaaaaacctgtgctcagaagatcaaattcattgattgggattgggattggaatcagcgaccccatgagacctcagagaacgtcgatccacgccgtcacgacatgggtgaggcgacagcccccaaaggtgaaggcttttctcgccgtcgtttccggcatggcggccctcgtcctccttcgcttcatcgtccacgatcacgacaacctcttcgtcgctgccgaggctgtccactccctcggaatttccgtcctcatctacaagctcatgaaggagaggacatgtgctgggttatcactcaaatcccaggaattaacggctatctttttagctgttaggctgtactgcagttttgtcatggaatatgatatccacaccttacttgatttcgctactttcgtaacaacgctctgggttatatacatgattcgttttaagctgaaggctagctacatggaagagaaggataactttgcaatatactatgtggatttcctgggcattctgtgtatatctagaagctgtctcagtcctgccccaactgcgggtcatgcagaacaccaagctcattatgtatttgcattgggtgttgcaagattcttgagctgcgctcattgggttcttcaggtgttagatagccgtgggcatttgctggtggccttggggtatggtttatggccatcaatggttcttatctcggaaattgtccagaccttcatcttagcagatttctgttactattatgtcaaaagtgtcttcgggggacaacttgttctacgtcttccctctggagtggtgtga

SEQ ID NO: 75929 - DNA, 336 bp, Glycine max
  Peptide Sequence Number=SeqID_192707
atgggttactattattgtaaacccaggccttgtgatactcatactcccaatgttgttctgatcttggccgtggccttgattcttctatgtgccccaaagttcttctcaggtgaagcagaggaagaagaagatgaaacgaataacacctcaccttttcaggttcaagaagaagggtttgtgtcaagccaccatattgtcagtgtacgtatgcctgctactgttacagatagtgttattgatgtgatcatagcttcaatctctatgttcagtacccatgataccggtgcaccacatttattgagtgcatggtggaagccaggaagagaaataaactaa

SEQ ID NO: 75930 - DNA, 1137 bp, Glycine max
  Peptide Sequence Number=SeqID_192708
atgggaaacgaaggtataatgaatggtgttataaagcagcgagtcaaccccgggaaggctaccatattagctcttggcaaggctttccctcaccagcttgtcatgcaagagtatttggttgatggatattcacaaactgtgacaatcctgaactcaagcagaagctcactagactttgtaagcaagacaaccacagtgaaaacaaggtacgtggttatgtcagaggagatactgaaaaagtatccagaacttgcagctgaaggcatccccacagtgaagcaacggctagagatatgcaacgaggcagtgacagaaatggcaattgaagcttcccaaacttgcatcaagaactggggtggatctttatcagacgtaacacacttggtgtatgtgtcattcagtgaagctagactacctggtggtgacctttacctagagaaaggactaggactgagccctgatactcaacgagtcatgctctattttgctgacatagctgagaacaaccctggaagccgagtgcttcttgctacctcagaaactactattattgggtccaaaccaccaagtgtagatagaccctatgatcttgttggggtggcactctttggggatggtgctggtgccatgataattggctcagacccaatattggaatctgagaggcctctctttgagcttcacactgcagttcaggagtttttgcgacacactgagaagaaaatagatgggaggctgacagaagaaggaataagcttcaagttagctagggaacttcctcaaataattgaagacaatgttgaaggattctgtgacaaattaatgagtgttgttgggtttgagaacaaggagtacaacaagctgttttgggctgtacatccaggggggccagccatcttgaaccgcattgagaagagacttgatttgttgccagagaagctgagtgcaagtagacgggctctcatggattatggcaatgctagcagtaacaccattgtgtatgtgctggagtttatgatagaggaaagtctcaagattagaaaggatggcagaggagatcttgaatggggcttgatacttgcttttggacccgggattacatttgagggaattctggccaggaacttgtgtgcttga

SEQ ID NO: 75931 - DNA, 668 bp, Glycine max
  Peptide Sequence Number=SeqID_192709
agatatggaatgctatcaagacatgggtccatgactatgtctccttgtactatgccaccgatgatgcaattgaagaagaccatgaacttcaagcatggtggaaagaagttgttgagaagggtcatggtgacttaaaagatgagccatggcggccaaaattattacatactcgtgaagagttgattcaatcttgtagaactattatatggattgcttcggcccttcatgcagcagttaattttggacaatatccttatggtggttttatcctcaatcgtccaactcttagcagaagattgattccagaaaaagggactgcagaatacgatgagatggtgaatagtcatcaaaaggcttatttgaaaacaattacgccaaacctttcagtgatagagatattgtcaaggcatgcttctgatgagttctaccttggacagagggacaatccaaattggacccctaatccaagggcaatagaagcctttaaaaagtttggaaataaactagcagagattgagacgaaaatctcagaaaggaaccatgatccaaatcttagaaatcgaactggaccagccaaattgccctacactgtgcttcttcctaccagtgaaccagggttgacttttagaggaattcctaacagtatctctatcaaaaggtgggcatga

SEQ ID NO: 75932 - DNA, 660 bp, Glycine max
  Peptide Sequence Number=SeqID_192710
atgagtcccgttttcacattcattgctgctttaaagggtgttgtgactctcacccgcgccctcatttacgtgttagcacaattatgcattggctcaataattggtttctttatactaaagtgtgtcatggacccaaaattagcttacacatattccttgggaggttgtgccatcgatggccaaggagcgaattctggttttaagccacaagatgctttgttagtggaattcacttgcacatttgtggtactctttggggcggtaacattggcatttgacaagaaaaggtctagggatttgggcttgctaatggtgtgcttactggtggcaggagccatggcattggcagcatttgtgtccataactttaactgggcaggccagttatgcaggtgtgggcctgaacccagcaagatgcctaggcccagcattgcttcatggaggatcactttgggaagggcattgggttttgtggcttgggtctttcttggcatgtgtagtctattatgctgtgtctatcaaccttgcaaaggagggtttggtttgggtagatggagaatatgatatgttggctctcggttcttgtgggaatgtctataatacttccgttttaaaggatcaactagaagaacgaagtgctgggttccaagtccaagtatga

SEQ ID NO: 75933 - DNA, 360 bp, Glycine max
  Peptide Sequence Number=SeqID_192711
atggggtggttctatacaaagaagaaaagtgcagaatggaagcagggatgcacattgcaagagcagaccatagacactgcttctctttctccaactcttcacttgcttgtgatattaggcattgtccttagcttgttgtggctctcccgttacaccacctacaaggctcagcagaatcacacagtcatctactatcagttattcctctttctttcgcctgtcatcttcatattcctcttgctctcatattacacctgtggaaggctcaacttttgcttcatgtcttcgaggcacgagtcattccaacgagctgttgtgtctcccttgaagctggaacgtactcatcttgctgctctgtag

SEQ ID NO: 75934 - DNA, 324 bp, Glycine max
  Peptide Sequence Number=SeqID_192712
atggcaacaacatatactccagctgaagggagccaagccaattctgctttcaactacttgccttcatcttcctttagcaatatcaaggcacaccttaaagccatgaagaaaagcaatatcaaggcacacctttcagtattgctagaggaagatgctgaaggcaaagagttgaaagcaaaaattgtcaaacattttttggctactcctgagcagtccattgcaataatggatctcattgaatctcggtggcaagaactgattggggagatgcctctcaaagtttgttatccagcccttgaaaaccatgagtggaattggatgtga

SEQ ID NO: 75935 - DNA, 480 bp, Glycine max
  Peptide Sequence Number=SeqID_192713
atggagagaagagggaaggtgggggccacagtatccagtattagatcccatacattcccaatcaaatatgatcgcaccacacacatccaaggagatgcagttactgatttaaaaaacatgctcaagctaccgagggatcgaagcaagaccgcgtttggctccaacgatttcgcggtggaggagaacgtgcggtccaaggcgatccaagtgcagggcgtggaagacgcgcttttgttgaagatcatgggaagtagggtttctcctttaagagaaggtgactttttgaggaaggataagatgctgaggtctaatatggaaggtttgaatcctctgcgtaatcccattcttcaagatcctgatgctgttggtctcactcggatcaccaaagctgataaaattattaggaattatctcttacgtgatcttaagaggcttccctttccttctaggaagatcactcaataccacaacaacttgtaa

SEQ ID NO: 75936 - DNA, 894 bp, Glycine max
  Peptide Sequence Number=SeqID_192714
atgcctaggggcttagttcatgagaagtcttcagagcccaaatttcttgcctacattggtgcccacgaatttttcacaatagagacgtggaaagcagctttggtagagttaattgcaactgctgcactaatgttcaccctaacgagttgcaatattgcatgtttggagtcacaagatgtcaatccaaagcttattcttccctttgcagtcttcatcatagtattcttgtttctaattgtgatagttcctctatccgggggtcatatgaaccctatttttacattcattgcggctttaaagggtgttgtgaccctttctcgtgctctcctttacgtgtcagctcaatgcattggctcaataattggtttctttgtactcaagagtgtgatggagccaaaattagcagacacatattctttgggaggttgtgcccttggtgacaaaggacaaagttctggcctaaggccacaagatgctttgttgttggaattctcttgcacattcttagtactctttgtgggtctaacgttggcatttgataagaaaaggtgcaaggaattgggcttgccaatggtttgtttggtggttgcagcatccttggcactggcagtgtttgtgtccataactgtaactggcaggcctggctatgcaggtgctgggctgagccctgcaagatgcctaggtccagcgttgcttcatggaggcccactatggaatgggcattgggttttctggcttgggcctttcttggcctgcataatctattatagtgtctccattaatctaccaaagaaaggtttgaattgggttgatggagaatatgatgtcttaagattggctctgggttcttgtaggactatttctaataatacggatttaaatgatctttcttga

SEQ ID NO: 75937 - DNA, 288 bp, Glycine max
  Peptide Sequence Number=SeqID_192715
atggcgtttcttccccttccttttatccgagtgttgagtgaagtttgctatccagaaagttggattgatattgcaccattatcagcaacaccaggatcaaagcagccacaccccatggagagctcccttctgaaaggccttggtgagttcgcccccgcctttcccccggaaaagtaccatgaaacgccaaggaagatgaagatcagcgataagattaacagaacaggatacggcaggggattcagagtgaagccatccaaaacagaggaggctctgcttctaccataa

SEQ ID NO: 75938 - DNA, 1854 bp, Glycine max
  Peptide Sequence Number=SeqID_192716
atgttagggctatttgacaagagccacaagatcaagggcaccgtggtgttgatgcccaagaatgtcttggacgttaacgagttgaattcagtaagaagtggaggagttggtggtgttgtctccggcctcttcggcgctgtcgccgacgtaaccggtcaggtagttgatactgcaactgccatcctttcccggaacgtctccttcaagttgatcagtgctacctccactgatgcaaagggaaatgggaaagttggaaaggaaacttatctggagaagcatcttccgacgttaccaaccttgggagataggagagatgcatacggtattcattttgaatgggatgctaactttggaattccaggagcaatttacatcagaaactatacgtatgatgagttcttccttgtcagtgtcactcttgaggacattccaaatcaaggaaccattcactttgtttgtaactcatgggtttacaactttaaagactacgacaaaaaggatcgcattttctttgccaataagacatatcttccaagtgcaacaccaggtccattagttaagtacagggaagaagagttggagattttaagaggaaatggaaccggagagcgcaaggaacatgaaaggatctatgattatgatgtctataatgatttgggtaacccagataaagatgtaaagcttgcacgcccagtccttggaggttccagcacctatccttatcctcgtagggttagaactggcagaaaagccaccaagaaagatcctaaaagcgagagacctgcaagcgagctttacatgccaagagatgaaaaattcggtcacttaaagtcatcagatttcctcacatatggaataaaatcattatctcaaacactcttaccttcgctggaaaacatttttgactcagacctcacatggaatgaatttgatagctttgaagaagtgagagacctgtatgaaggtggaattaaggtgccaacagatgttcttagcgacattagccccatacctgtcttcaaggaaatcttccgcagtgatggggaaagtgtccttcaatttccaccacctcatgtagtccaagttagtaaatctgcatggatgactgatgatgaatttgcaagagagatgattgctggtgtaaacccaaatgtaatccgccttcttaaagagatcccaccacaaagcaagctggaccccactctctatggtgatcaatctagtacaatatccaaagaacatttggagattaacatgggtggggttacagtagaagaggcacttaatggtcagagattattcatattagattatcacgacgcattcatgccatatttgacaaggataaacgccctacccactgcaaaggcttatgcaacaaggacaatcctgttcttgaaagatgatgggactttgaagccacttgctatcgaattgagcaagccacatccaagtggagataatttgggtgccgagagcaaagtggtcttgcctgcagaccaaggtgttgaaagcacaatttggcttttggccaaggctcatgttattgtaaatgactccggctatcatcagctcatgagccactggttaaatactcatgcagtgacggagccattcatcatagcaactaacaggcgtctcagtgtgcttcaccccatttataaacttctttatcctcactatcgtgacaccataaatatcaatggacttgctaggaatgccctaattaatgctggtggcattatagaggaatcatttttgcctggacgatactctcttgagatgtcttcagctgtttacaagaactgggttttcactgaccaagcattaccagccgatctcatcaagaggtaa

SEQ ID NO: 75939 - DNA, 852 bp, Glycine max
  Peptide Sequence Number=SeqID_192717
atgggttttgtacgtaatggaagaggaaaagttgggaaggagacctacttggaaagtcatcttccgaccttaccaaccttgggagcaaggcacgatgcattcagtgtttactttgaatgggatgacaaatttggatttccaggagcattttacatccaaaactttattaagactgatgagtttttccttgtgagtgtaactctagaggacattccaaaccatggaaccattcactttgtttgcaactcatgggtttatataactttaggaaatgcagaaaggatcgcattttctttgtcatcatattaccatgatgcattcttcccatatttgacgaggataaacagcctaccttctgcaaaaacttatgccacaagaacaatcctattcttgaaagatgatggatccttaaagccacttgctatcgaattaagcaagccacatcctggtggagataatttaggtcctgtgtgtgaagttgtgttgcctgcagctgaaggtgttgaaactcataagccattgctgagaattgtgaagagtagtttatattcacttggactatggtgccttcctgtctctacctattcactcatttgctcgtcccagttggctttcaatgctttcttctcctacttcctcaactcattcaagttcacaccttacataatcaactccctagtccttctcaccatttcctcaaccctcctggtgtttcaaaatgagtcatcatcagatgatgatgatgattcagattccacaaaaatctccacgaaaaagtatgcgattgaattcatatgcacagttggtgcatctgcagggtatggactactttcaaagtggtcttggatatga

SEQ ID NO: 75940 - DNA, 888 bp, Glycine max
  Peptide Sequence Number=SeqID_192718
atggaggagccttcagcatatgggaagttaggcctcgccaatctcttggaaatgagggaagagtgcttgagggaatttcagtttgctgatgcctatagaagtataaagcagagtgcaaattgtccaaaagcaatttacttagctcagaagaaattagctgcatttgttctcgccatgggatctggggaaaatgaggcatcgcttgctgttttacctgacttgctggtggaacttgatagtatggatgaggaatcaaggttgcttacgctaattgaaggtgttcttgcagcaaatatttttgattggggatctcgtgcatgtgtggatctctatcataaaggaactattatcgaaatttatagaatgagtcgcaataaaatgcgtagaccttggcgggtggatgattttgatgagtttaaagagagaatgaaaatgccctgtcataagagggctttactttttgtagataactcaggtgctgacattgttctagggatgcttccactggctagggagctcctccgtcgtggaactgaagtagttctggttgcaaactcacttcctgccttaaatgatgtcactgcaatggagcttccagatattgtagctgaggctgccaagcattgtgacattctaaggcgagctgctgaagctggaggcttgcttgtggatgcaatgattaatacttcagacagctctaagaaaaattcatcttcagtccccttgatggttgttgagaacgggtgtggcagtccatgtatagacctaagacaggtcagctctgagctagctgctgctgcaaaagatgctgatctgataattttggaagggatggggagagcacttcatactaacctaaatgctctgtttaagcaggatgctttaaag

SEQ ID NO: 75941 - DNA, 1326 bp, Glycine max
  Peptide Sequence Number=SeqID_192719
atggctggttctgttcaaaaccaacaacaacaacaacaacttcttcttggaattatcgaagaagagaaattgcagaaacagaaagaagagactgaggggaacaacaataacaacaacaacacgcggacacaattggggagtgacatggctcccacggcaggcaattcgatccaccggtcgggttcgaggcctcaacttgatgtgagcaaagctgagattcaagggaatgtggaggagaagtatcccaccattttgttgcctaatcaatctgatgatttgtctcatcttgctcttgacattggaggatctctgataaagttggtttacttttcaagacatgaagaccaatcagcggatgataaaaggaagagaagtgtgaaggagcgattggggctttctaatggtaacaggagaagcttccctattcttggtggaaggcttcactttgtgaagtttgaaacgagaaagattaatgagtgcttggatttcatttattctaagcagcttcactgtggtgggttggagtcacattactctgatggtgtgactgaccagaatggcataattaaggctactggaggtggagcatacaagtatgctgaccttttgaaagaaagacttggggttagtcttgacaaagaagatgaaatgaattgtctcgtggcaggagcaaatttcttgcttaaggcaattcgtcatgaagctttcacacacatggagggccacaaagagtttgttcaaattgatcctaatgatttattcccttatcttctggttaatattggatctggtgttagtatgatcaaggttgatggggatggaaaatttgagagggttagtgggacaaatgttggtggtggtacttattggggtttgggaagactgttaacaaagtgcaagagttttgatgagttgcttgagctgagtcagaaaggagataatagaactatggacatgctagttggggacatttatgggggtttggactattctaagcgaatcttttttggaggattttttataaggggtcatgcctataccatggacactatttcttttgctgtacatttctggtctaatggggaagcacaagcaatgttcttgcgacatgaaggatttctgggagctttaggtgcatttatgagttacgagaagcatggtttagatgacctcatggtgcatcagttggtggaaaggtttccaatgggagctccatatacaggaggcaagattcatggcccaccacttggagatttaaatgagaaggcaagtgatagggatggcaaatatctaatttatgttcgttgtctgctgactctgccttag

SEQ ID NO: 75942 - DNA, 229 bp, Glycine max
  Peptide Sequence Number=SeqID_192720
atggatcttcaacaaggagtgattgatcatgcctccaaggtcgccgatccagcaaaaatcacacaaatcaacgatctccttactcaacctcgagtccctttgcctatcctaggcatgtctctagtgctggatcttggaagaatagatcttgagcttaagatccttcttcaagatccagtagtaaagatgctcttatggacacttccaataacatctacaagtgggacgg

SEQ ID NO: 75943 - DNA, 249 bp, Glycine max
  Peptide Sequence Number=SeqID_192721
atggatccaattgttggtgatggtcaagcaagaggccatttttggatgagagtaatagaaaattacaacaactttcgtggcaatctcgatgagagaacattgaatcaattcaagggtcattacaagcaagttgttggtttgaagaaaaacgggtacacaaagaatgatgtaatggttcatgcatattccatttggaaggaagatgaaggaaatgattttactttggagcatgcatggagtgaaaaatga

SEQ ID NO: 75944 - DNA, 186 bp, Glycine max
  Peptide Sequence Number=SeqID_192722
atgaaaaaagggatcttggagcaacaggcaaagggactcgaggttgaatccataaccctagaggcacgaagaagaagatttggcagaaaagagaggtggtcgcataggagagggggtcgtggtggtttggggcgaagaaggggaaggggcgtaatggttgggggaggaggagaaaaggaaacatga

SEQ ID NO: 75945 - DNA, 444 bp, Glycine max
  Peptide Sequence Number=SeqID_192723
atgttgggaattttcaaggagaagttggttaaagcacccaaagaactgaacagtccagcttctttgaattcatgcactaagcctaagccaagtcatgaaatcctgaaggatttcatgccctgtaattcctccaatgctttctccatgtgctttgggaatgatgctttgctagcctattccccttcaaacaagccctccattcatcataggggtccataccctgctgatcaggtcctcaaggaactcgaaggcagttttggatttgtaatctatgacaacaaggatggaacaatttttgtagcatctggttctaatggccagattgggctctactggggtgttgcaattgatagttccatagttatttctgaaaatatggagcatataaaagcaagttgtgctaaatcatttgcaccatttccatctggctctgttcttctatag

SEQ ID NO: 75946 - DNA, 318 bp, Glycine max
  Peptide Sequence Number=SeqID_192724
atggatcaagctggtgaggaaagaaagttgcaactgagtgagttagatgagatccgcctagaagcatatgagaatgccaagttctacaaagaaaagaccaagaagttccacgatagcatcataattaagaaggacttcatggttgggcaaaaagtgttattgtataattctaagcttggactcatgagtgttgagatcaaaagcgactccacaaacaagagcttcaaggtcaatggacatcgacttaagccattcctcacaaacccttatggatatgttcaagtaatgggtaattgttctgaaaataaagtctcttga

SEQ ID NO: 75947 - DNA, 1974 bp, Glycine max
  Peptide Sequence Number=SeqID_192725
atgtctcaaatcttggcaccgttccagttactggaactgaacgtgatttcagcccaagacctggccccagtgagtcgcaacatgcgaacctatgcggtctcatgggttcacccagaacggaagctctcaacgcgcgttgacacggagggccacacccatccaacgtggaacgacaagttcgttttccgcgttgatgaagagtttctttattcagacacctctgctatcatgatcgagatctacgcgctacattggttcaaggacatccatgttggtaccgtccgcgtactcgttggaaacctcgccccaccaccgtcaaaacccttccacaacaaccgcaccccgctaggcatgcgctttgttgcgctccagatgcgccgcccctccggcaggccgcaggggattctaaacatcggcttcaccgtcctcgacagctccatgcgcagcatgccgctctacactcacaatgcctccgcagtagggtatcgccacttgatgggagagaaggatgcttatgacagccacaaccacctcagcccccgtgtccgtgccgccgccgctggcgccacgccgatgcctgagctgcgtcgaaccaagagcgagaccagctccatgctcggtgccactgaagttgtggcgcgccaccaccaagctgtggcaggagccaactcttccatttcgggatccgaggttagcgtcaagaggaagaaggggaagaataagaaaacgaaaaccaagaagagtagctctgttgtgagtagcgtgaatgaaataaattcggttctcagcgagaccattttgccatggaaggttaaaagcggaaaagctagtcccgatgatattgtccacaaccacaacgacgtcgttgaggaggttcactatgatgataacgagaacgcacattcaaccattaactccatctacgataaggaggaagaagaacacattcatgttaataacaacgttcaatatgaagtttgcgcctccccaaaatcacagtttcaaaacccaccggcatcacaatataagaattctccgacaccacagtatatgaacttgtcgaaaccacaatttaagaactctccgacaccgcagtatatgaattctccgacaccgcattataagaattctcctgcatcacaatttaagaattctcccacgccgcaatttaagaattctcttccaccacagtttaagaattctccaatgccgcagtataagagttctccggtgccacaatttaataattctccagcaccacaatttaaaaactcaccagcaccgcagtacatgaattcgccgaagctgcaatttaagaattctccgatgtcgcagtatatgtcaactccaaagcctcaatttcggaactcaccggcagtgggggtgctacagtatcgtgcctcgccggtggtaacgaagttcaacccgatggtggggttcaacgggtcgcaaagggggacgccaatgcatccatttgggaaggttaacaacggtgggggttttgagtacatgacgccacggaggtcaaacttggcgaacatgggacatgtggtgataacggagtcggagttggggccgtcagcgtcagaggtggcggcggtgatcgcacaaaagccagtgatcgatgaggcagagaattcaacagtgggaggatggagcttggacgcagagagcatggaggggctggagtcaaagttggagaggtggcagacaaagctgccaccggtgatcgaccacggtgagctctcgagctacccaacgacgagcaccaccaagacgagccgccactcgcggaggcacaccgacggcgggagtattgggagtgggagtgggagtggtttgttctcatgctttagtaacatttgtggtgttgagtgctatgttggttgcggcggtgaccctaaaggaaagaagaaccgcatccgcagccgccgccgcactccttccgccgatgacagttctagccttctctga

SEQ ID NO: 75948 - DNA, 195 bp, Glycine max
  Peptide Sequence Number=SeqID_192726
atgatgagtaatgatgcaaaaagcatgacgagaactcaaatccactgtgttgtggatggaaaaggtgaagttagccttgaacttcaacaagaacaacatggttgtcgcggtcatggtggtggaaaagacgaagttagaattaccaacaaatcagttactaaactaaccattaagctaacacgtaccttgcgttga

SEQ ID NO: 75949 - DNA, 252 bp, Glycine max
  Peptide Sequence Number=SeqID_192727
atggaagagatgcggttgcggttgcgagtgcgggaaggggtggcactcgcggtggtcgtggaggagggagggcttgacatgaagcggagggggaaaggaagaggcagaaacctaagcccaaacaacaccaaattagagaggccattcatttgttttcaaaggttggttcttaccgttgttttcgctaaactatcttccaagccagattgtattacagggcctcaccttccattttggaatatgtttcactaa

SEQ ID NO: 75950 - DNA, 219 bp, Glycine max
  Peptide Sequence Number=SeqID_192728
atggtgatgaaaggagtctctttgggggttcatgttcaacctctcaatagcttggtattaaatgcaaatccgttgagtctaaatgaagaagaaagctcattggtttcaaagacaacaatgaagcaagaaaatgatcaaactcatgtgcttataagaagtttacatagtggcaccaaactacaacagatggtgaggaatgatgaggattctctttggtag

SEQ ID NO: 75951 - DNA, 441 bp, Glycine max
  Peptide Sequence Number=SeqID_192729
atggatggtattctgtggagaattgatggtagctccatcaatatttggagccaaccttgggtgcaagcatcaacaagctcatatatcacttcatctaccccgctcggccttgaggatcttaaagtcagtccactcatcaaacaccaacaacaatgttggcatcaagttgtggtacgacaaatttctaatgacaatgaccagagaaatgttgcttcccaccccctgttgaacagtgaagtcgatgataaaatcatatggagattaactgcaaatggtgagtacaacatcaaatcaagttaccacaatgtcatggaaacaatgatgcaatcctaccccgcaagggcattggatagaagactccaagaagattgggccagagatgcaagagaaggccctagggttctcatgagccttagggtagatttcgcgccgatcggctaa

SEQ ID NO: 75952 - DNA, 135 bp, Glycine max
  Peptide Sequence Number=SeqID_192730
atgaagtaccgaaagatcaatatagatgcaacatttttcattaatgagaacaaagttggtattggtcactgtttacacagaagaccacaagcaaaggaagcgaaagcatgggccttgctccatgctataaaatag

SEQ ID NO: 75953 - DNA, 1485 bp, Glycine max
  Peptide Sequence Number=SeqID_192731
atggacacaaattgggatggctcagaaacttcagtcatttcaaagtcactggtcatccaaactgtcggtaaaattgaagactgtaccaattacttcaaagtgtttatctccacaaaacaaaagtatcaacgattacataaattaatttttgaagaggatggattgcctaatggagctgaagtagcttattatgcacgtggacagaaattgcttgagggtatcaaaacacgctgtggaattgtctgtcgatgctgcaacactgaggtcagcccctcacagtttgaggtccatgcaggctgggcttctcgcaggaaaccttatgcatacatctacacgtcaaatggggtgtcactccatgagttagcaatatttctctcaaaagatcacaaatgcactacaaagcagaatgactatgtatgtgttgtttgttgggatggtggaaacctgttgctttgtgatggatgtccaagggcatttcataaagaatgtgcatctgtatcaagtattcctcggggtgagtggtactgtcaaatttgtcaacacacattcctcagagaaaggcctgtgttatacaatgccgatgctgtggcagctggaagggtagaaggtgttgatcctattgagcagatcgccaagagatgcattcgcatagtaaaagacataggagctgagatgggtggatgtgttttatgcaggagttctgacttcagcagatcaggatttggtcctcgtacaattataatttgtgatcagtgcgaaaaggaatatcatgttggctgcttgagggatcataagaaggcatatttgaaggagttgccggaaggggattggttttgttgcaatgattgcacaataatacattctactttggagaatctcttgattagggtggctgagagactccctgaagctcttttggatgttataaagaagaagcaagtggaaagatgtttagaaccccttaatgagattgatgtacgatggaaacttcttaatggaaaaattgcatctcctgaaactaggccattgcttttggaggcagtgtccatgtttcatgaatgctttgatcctatagttgatccagctgctggacgtgaccttattcctgccatgaaggaatttgcagactcaggattttggaggaatgtattgtgcattattgattgtcaaggctacttccaaacacttttcgcatgcattgagaggctgctggcttttttgaatgtgaaaaatcttgtgctaccagctgctgaagaagcagaatcaatatggacagaaaaattcgggtttagcaagatgaaacttgaccagctagctgcattatttgtcacaaagactcaccccagctcaaaaaatgatcggagtttaattgtgttgcagctcaccaactatagaatgaactgccatcaaatcatggcattcaaagggacaaacatgcttcataaaacggtgcctcgatgtcgggtcaccaattctcaagcatga

SEQ ID NO: 75954 - DNA, 600 bp, Glycine max
  Peptide Sequence Number=SeqID_192732
atggaggaaaagggagcaactgtggtggcagaggctttgagatggaggtacaatgtagtagaggttaaaattatggaggtgcagagcgccagtgtggcgatccccgtgacatacacaatgtccaatccaacggttcacatcctcaaatacttccttgacgcggatcgcgaaacaatccaacggcaaagaaccctccccctcatcctatataatcagaaacctcaacagcacgaagtccaaaacaagtgtacaagagtacaaccttttcaactccgaaggcgagccacgatgtcaggaagaggaaagggaggcaagggtttgggaaagggaggagcgaagaggcaccgtaaggttctgagggacaacatccaggggatcaccaagcctgcgattcggcgcttggcgaggcgtggcggcgtcaagcgtatcagcggtctcatctacgaagagacacgtggcgttctcaagatcttcctcgaaaacgtcattcgcgacgctgttacttacaccgagcacgctcgccgcaaaaccgtcactgccatggacgttgtttatgccctcaaaagacagggcaggaccctttacggtttcggtggttag

SEQ ID NO: 75955 - DNA, 831 bp, Glycine max
  Peptide Sequence Number=SeqID_192733
atggagaaaacaccaggatgcagccttcactttgtgttcatccccttgatggttccatgtcacattcctccaatggtagacatgaccaagttgatagcacgtcgtaatgtgaaagtgaccatagtcaccacaccccgcggcgaaacccaattcagagccatcatcgatagagatatccaatctaagtcaccaatccaaactcaactagttacattacataatgaaaactaccagagagaatatgttgaagagtactatagggttacagggcataacgtatggtgtgttggccctttatcactgtcaaacaaggatgattgggacaaagcttggagagttagcaaaaacataaatgctagtgaaatagaaaccaaccaatatgtgaagtggctaaactcatggcctcaaagctcggaaatttatgttgtgtcgatattttcacataaagaagttggagcgttcttcacacacggtggatggatgtccacattggatgccatttgtgctgctgtgcctttggtggcattacctgtgtctgttgttgaaatgctttacaatgaaaagcttcttgctcatgtggctgagattggtgtggcgatgagagctgaaattgctatgcattgtggagaggatgagtatggagaatgtgttgatgaatatggacagtgttttaaagaggttatagagaaagtgatgcgtgaaggtacaaaagaagacaaagctaaaaagtacgcagacatggcaacgaaagccatagaaggtggttcttaccgcaacatgtctatgctgattgatgacataatacatgcccaattgctgaatcaaaactaa

SEQ ID NO: 75956 - DNA, 4212 bp, Glycine max
  Peptide Sequence Number=SeqID_192734
atgtttaggttgcataagcacaggattgcgaagtcaggggacaaaattgagttcagaatttctcatctcaaggcgcttcagcttagctgcaatagctctgtggcttctgttctcgtggaatgcagaacaactatacgttataaggccataaaagaaactcaggttctgtcaaaaatgaatgctgattcaaatctgtttgtttctgttgtctcggtagaaactggtaaaacaattgcaaagtcgagcaaagtgtcagtgcgtaatggaggttgtcaatggtcagatacattttcagaatctatattggtttcgagagataattcttcaaaggagattgatgattatgtcctcaagcttattgttgccatggggtcatcaagatctggcatcctgggagaggccactgttagtttgactagctataggagttcaggtgctgctattccactttcaatcccactgaataagtgcaaccatgggacagttttacatgtaactgtgcagtgccttacaccaagaacgaaactcagggatcaagaatcaagtgagacaaagttccatttgaaggccatcaatgaaagtgattatgatctggctgtcaagtccaatgaatcagattgttcaaatgtacagagtattgaatcttcctctgttgaagatttcgactctatcttatctcccggagaaattgagacaatggcaacaagcttctccggatctgtatcaaactgcagccataactcaactgagggttccacaggaaggggaaatatctccccatctatcagtgacgggcagagcccgactgcaagacaagattcaaccagttcccagaaaagtgtatcccatcacgattaccctgtgaatgattcttctcagtcaaataattcatcatttaattcccagaatatgcaagacattagtacattatcttctaagaagaccaatgcttctaataaccatctggaagctgcagaggacacaagtgaagagctgcgggcagaagcaaagatgtgggagatgaacgcccggaagctaatgggtgatttagacatgttgaggacagaattctcagatcaatccaaaaaaatggctggtatggaaatggacctttcagcagcacaggtagagcgtgatagtttgaaaaaagaagcggaacagttaaaattgtcgtttgaggatccaatagtgagacagaaagcattggaagattcaatgtctcaagttgaaggtattccagaaattgaaaatgcactaaaagaggaattgaagtttgaaaaagaattcaatgccaacttatctttgcaactgaagaggagccaagaagcaaatatagagcttgtttctgttctccaggagctggaagacaccatagaacaacagaaagttgagatagaaaatctttcatcattaccctcaaaattcagtgatcttgagaaatctttccaacaaagtatagaaggaaacaagcacttaatgcaacaactagaacaattagaggaatcgaagaaaaatctgctgatcaaggtgcaagagctggaagggaccttggaggacaaaatgcgaggcgctgaacatgcaaagattcaaaacaacaaaacactttcagatattgaaatggagtctgaaagcaaaatatattctaaagataaagaaattttaagtttgaaagcaaagctacttgaatctatcccagaaagttataataatgcggagactgtgtccagaaacttagacgatgcagatcttttgagagaaatcaaagtactgaaacagaaagttcaggaacttgagatggactgcaatgagctgacagaggaaaaccttgagctcgtattcaagctaaaagaagcaaagaaaaattcgaaagatggtggtgcatctgaagaccttttgtcagacaagcttaaagatcaaacttctactagctttgggtctgaggtaagaaacaatttatttcgaatattccattcagaagacatgctccaggggaaaaaggacatcaagatttgtaatgatgatcatttttcaattcaagagcttgagacttcaaagttagctctagaagttcgaatcacagatttgaataaggaactgactaataaaacatctgtgataggaaatcttgaggctaatttatcaggtaaagaaaaggagattggggttctgcagaagctgctgagtgagttggaagccaatgtttatcatcttgaacaggaaaaaagtcaactagagaaacacatggaggccttgataaaagaaaataagcatgaactggagcttcacatattagacatagaacaggaaaaacaacaattgtcaattcgtgtttctgttttagaagctcagttaagagatttgacaaatgaacaagagttccgtttatcagaactagagagctctagatctcaagctgcaagacttcaagagaagattacggagctgcagtctgagacagattcttcaacagaagacttgaaacaaaaattaagggtggcacaaattcactggtcagaagcacaagaagaatgtgaatatctaagaggagcaaatcagaagttacaaattaccgttgagaatcttgcagaagaatgcagttatttcgagaagctaaatggagatttgaagcagcaaaacttgaagctagaggaatattgctcccatatggaagccaggttgagggaatcagatgaaagatttgccaagtgctctgaaggagtggaactcttggaaaagaaatttgatttaaagctagaagatattgcatcaaaagaaaagcatctaacttcagattttgatggtattttttatgaaaataggaaacatatggagcaggctcatttcttattgaatcagatgcaaatggagatgatggtagaaactcagaaccttgaattagaagttgagaaactttcagcagcgtatgatgagaaagaaagaatagcttccaatgccatgcttgaagtatccacattacgtgctgataaagccaaactggaatctgcttttgaagaagctcaatctaaagtgattttggctaagaacgaggttgatatgatgcagtctcaatatgaacaaaagctgaaagacctaacaacgcagctttccaaatacaaaattaaaatagaaatgctgatgactgaacatgaaaagttgttgaagctggtggaggactacaaatcaagagagctaaaattcaaaagtactataaatgcccttgaattaaagctaacagtcactgaatatgaaagacagcaagtcatggatgaatctggaaatttaaaggttcagttgcagcagacccagcaatttgaaaatgagattatagctctaaagaatgagctcaatgcttctaattctaagaaagagagactggaagcctcattgcgcctaacatctgaactatgtgaagatctgaaggaagagaagacatcatctgaactaaagatattagccttggagacggctgagtctgaattggaggactgcaagagaactagaacttccctggaagaaaaacttcttctgttggagaatgacttgaaggcaagagaatcaagatgtgtccaggatactgagctcagtcacagcaagagaataaacaggcagcatcaacagaccatacaactgcttgaacaagaaaaagctgagttccagacaaaagcccaagtccttgaagaagaattgaagctgattaaggaacaaaggagaaatcaacagaaccctgtggtgaaaaataccaatcaacatcgcagtaataggaaaaagtcgttaaagaatgacagagaaatcatgaaagatcaacaagaccctggttacagcatcaaacatcagagtgaggtagaaactgaacttggacttcttgatgaaaatgttcatgctgttgaagtagatccactaccaaagactcaattgcttgagaatgaactagcaaaagaaaaagaagtcaagaacatttatgaagttcaacttgacaggtcaccatctcaagaccgaaacaaccaagcaaatggcccagtaaaatcaatggctgaagaactagtgactaaagaaaaatttgaacgtacaaaatcaatgctagaggcagagttaagagatattcaggagcgctacttccacatgagccttaaatatgctgaggttgaagctatgcgtgaagaacttgtgatgaagctcaaggcgaccaggaaacaaaaaggatggctttcatag

SEQ ID NO: 75957 - DNA, 201 bp, Glycine max
  Peptide Sequence Number=SeqID_192735
atgtcacactctcgtgcgtcgtcatcacgttggaccaacctcaacaaggaactggaacaacttctggcgaatgtgcctaaattaaccattgaagagcatagagagtggagggaaatggaaaacatgatgcagaatgtcgcggctccaccagaggctttttccagaccattcacgccaaggactaggtcatgttcattttga

SEQ ID NO: 75958 - DNA, 489 bp, Glycine max
  Peptide Sequence Number=SeqID_192736
atggcacaatcacggaggcacgaaacggaggaaggaggaagagcacaaaaaaaaaagaagttgaatagtgactcgtatggacaagtcactatttggcttttatatgaaagggtgaagggcattttcgccctttcacccgggttgctgagtatcccaacaaaaaacgctgggcgtcccaagcaacaaccttttaaaaaatatggaattggaaaagggaaagttggaaagcaaacatttttggaaggtcttgttacctcccttccaaccttgggagcaggccaatctgcattcaatgttcattttgaatgggacagtgacatgggaattcctggagcattttacattgagaactttaagcaagttgaattcttccttgtcagtttgactcttgaagacattcctaaccatggatccatccacttcctttgcaactcatgggtttacaattccaaaaaatacaaaagtggccgcattttctttgcaaacaag

SEQ ID NO: 75959 - DNA, 357 bp, Glycine max
  Peptide Sequence Number=SeqID_192737
atggaggaccaatgttcatttttgtttacactgttcgcgcctctttggctgcgctcactcatttttacttcgaaggttctagatcgaagagtacaaaggaaaagccatacaaaggttgaacttctttctccgatcctaaagccacccgcggaggaggagaaaaaaccccaaaaggaagaaaagcccaaatcagaggagaagaaactactcaacaaggttttcacaaagctacttgacaaggtcctcctggagctcctcgaccgtgtcgtcaagtccctcaacgtctgtaatcccgacacccttagcctcgacgccgtcaagaacccttggaggtgctcttgttcctaccgagtctaa

SEQ ID NO: 75960 - DNA, 1069 bp, Glycine max
  Peptide Sequence Number=SeqID_192738
tgaaaaaccgggtccactagtgaagtatagagaagaagaactgaagactttaagaggagatggaacaggagagcgcaaagaacatgaaaggatctatgactatgatgtctacaatgatttaggtgatcctgactccaatgccagattggctcgtccagttcttggaggatccaccaccttgccttaccctcgaaggggaagaactggtagaaaaaaatccaggaaagatgaatcatttggtcacctgaagtcatcagactttcttgtatatatactcaagtctgcatctcaaaatgtcatacctcaattacaatctgcacttagcctgcaattcaatcagcctgagtttaatagcttctatgacgtgcgcggactcgatgatggtggaattaagttgcctactaatacacttagccagcttagccctataccattgttcaaagaactcttcagaactgatggtgaacaggcccttaagttcccaacgcctaaagtgattcaagcagtggagcagtctgcatggatgactgatgaagaattcgcaagagagatgactgctggtgtgaatccacacattattaaaagacttcagttcccaccaaagagcaagctagatagccagctctacggtgataataccagtacaataaccaaacaacacttggagccaaacttaggtggactcactgtagaacaggatccagcttccccgcatgggcttcgccttctgataaaggactatccttatgctgctgatggactagagatatgggctgctatcaaatcctgggtccaagaatatgtgtctttctactacaagtcagatgctgctgttgcacaagatgctgaactccaagccttttggaaagagcttgtagaggttggtcatggtgacaagaaaaatgagccatggcggggaaagatgaaaactcgccaagagttgattgattcttgcacaatcctcatatggactgcttcagccctccatgcagctgttaattttggacagtatccatatggaggttacatccttaaccgcccaactcttagcaggcgattcatgccttag

SEQ ID NO: 75961 - DNA, 3675 bp, Glycine max
  Peptide Sequence Number=SeqID_192739
atgacgcgggggaggataagggcaaagctccggaggagccatctttacacatttggttgccttaagccttctaccactgaggaggcacctcatccacttcaaggtcccgggttctcgcgaactgtgtattgcaaccagcctctactccatgataagaggcctctattgtactgcaaaaatgatatatccacgaccaagtacaatgttattacctttttccccaaggcactctttgaacaatttcgtagggttgctaatatatacttccttttggctgcatgtctgtcagcctctcccatttcacctttcagcccactgagcatgattgcccctttggcatttgttgtggggcttagtatggcgaaggaagcattggaagattcacgcaggtttgttcaggatgtcaaagttaatcgccgcaaggttaatcgccataaaggcgatggtatttttggtcccaggtcgtggcagaacattatggttggggatgtggtaaaagtgaataaggatcaattttttccagctgatttgcttctcctgtcatcgagttacgaggatgggatttgctatgtggagactatgaatttagatggtgagaccaacttgaaggtgaaaagatcattggaggccaccatgactctagataatgatgaagtttttaaagatttcactggaacaatacaatgtgaagacccaaaccccaatctttatacgtttgtcggaaacttagattatgagtgccagatttatcctcttgatcctagtcaaattcttctccgagattctaagctcaggaacactgattacatctatggggtggccattttcactggtcatgacagcaaagtcatgcagaattccacaaaatccccttcaaaaagaagcacaatagaaaagaagatggattatatcatatacaccctcttcactgtccttattttgatatctgttattagttccataggatttatcttcaagacaaagtaccaagccccaaagtggtggtacttacggcccgacaatattgaatatcagtatgatcccaacaaggttggagtggctggaatgagtcatctgattactgcacttattctttatggatatttgatacccatctcactttatgtttccattgaggttgtaaaggttttacaggcaaccttcatcaaccaagacattcaaatgtatgatgaagaaactgggactccagccgatgcgcggacatcaaatttgaatgaagagttgggtcaggtagatactatcttgtcagataaaactggaactttgacctgtaaccagatggactttttgaagtgctccattgccggtactgcatatggcgtgcgctccagtgaaattgaagttgctgcagcaaagcagatggcttctgatcacgaggaccaggagtcagatctctcgaatttccccatgcctaagagtaaagcgcgcatttcatgggataatgttagaaaagctgaagaaattgaactggagactgttgttacttccaaaggagatgaggatcaaaagcatgccataaaaggatttggttttgaagatgaccgcctcatgaattgtaattggttgcaagagcctaatgcagatgaccttttgatgttctttcgaatattagcagtttgccacactgccattcctgagctgaatgaggagactggcgtttatacatatgaagctgagtcacctgatgaaggggcttttcttgtagcagcaagagaatttggctttgagttttgcagaaggactcagtctagtattttcatacatgaaagattttctgcttctaggaaagtggttgaaagagagtacaaacttttgaatctgctggatttcactagcaaaagaaagcgtatgtcagtgattgtgcgtgatgaggagggcagtctttttcttttttgcaaaggggctgacagtatcatatttgatcgattgtcaaagaatggaaaacattatttggaggctactaccagacatctaaatgaatatggagaagctggtttgagaacactagccctggcttatagaaagcttgatgagcaagaatacactgcttggaacaatgaatttcagaaagccaaagctgctgttggggctgacagagattcaatgcttgagcgggtatcagatatgatggagaaagggttgattcttgttggggctacagctgtggaagacaaactgcagaaaggggttccccaatgtattgataatcttgctcaagctggtctcaagatctgggtgttgacaggggataagatggaaactgcaatcaacattggatttgcttgcagtttacttcgacagggtatgaagcagatctgtataactactcctgtttcagattctgtagccactgatgttaaacagggcatcaaggacaacattttaaatcaaatcaccaacggttcccaaatgataaaactggagaaggatcctcatgctgcatttgcattaattattgatgggaaaactctgacatatgctctagaagatgatatgaagctcctatttttgggattggctgttgattgtgcatctgtcatctgctgtcgtgtgtctcccaagcaaaaggcattggtaaccaggttagtgaaacaaggttctgggaagactactctagcaataggtgatggtgcaaatgatgttggcatgattcaagaagcagatattggtgttggaatcagtggggttgaaggtatgcaggcagtgatggctagtgactttgcaattgcccaatttcgatatttggagaggctcctggtagtccatggacattggtgttacaagagaattgcacaaatgatatgttatttcttctacaagaatattacatttggcctcactatcttctattttgaggccttcacaggcttctctggtcaatcggtttatgatgactggtacatgattttgttcaatgttgttctgacatcattacccgtcatttcactcggtgtttttgagcaagatgttccatcagaagtttgtttacagtttcctgcactttatcaacaaggacccaagaatttgttctttgactggtatagaatattgggatggatgggcaatggtctctattcctccctcatcatcttcttgctcatcgtcaccatcttctacgaccaagcattccgtgcagatggccaggtagctgacatggctgctgttgggaccactatgttcacttgcatcatctggactgtcaactgtcagattgcgcttacgatgagccactttacatggattcagcacctgtttgtatggggtagcatagccacttggtacgtctttctctccttgtatggaatgctttctccagaatattccaggagtgcctaccaaatactggttgaatctcttggtcctgcgcccatttactgggtaacaacccttttagttacagttacatgcaatcttccttattttgcccacatatccttccaaagatgtttcaatcccatggaccatcacattatccaagaaatcaagtactacaaaaaggatattgaagatcaacacatgtggacaagggagcgttctaaggccagacaggaaaccaagattgggttcactgcaagagtggaagcaaagatcaggcaacttaagggaagattgcagaagaagcaatctaccttggctatttcggccccatcgtga

SEQ ID NO: 75962 - DNA, 104 bp, Glycine max
  Peptide Sequence Number=SeqID_192740
atgggggaggaaatcaggcaagcgatggcagaggagtttcaagaagtccctccaacagaatacagtgtctttggtttggctaaagcttgttccatatctgactg

SEQ ID NO: 75963 - DNA, 1674 bp, Glycine max
  Peptide Sequence Number=SeqID_192741
atgccttcctcactctccctctcactcacacccctctctgtgttccctccccgcagagtccccactccttctccaaaaccctatcgcctctccgtcaaatcctccatcaacaaaccccctgacgccggcaccaccaagcccagctcctggctcagccccgactggctcacttccctctcccgctccctcaccgccggcaacgacgtctccggcatccccgtcgcctccgccaagctcgacgacgtctccgatctcctcggcggcgccctcttcctcccgctcttcaagtggatgcaggactacggccccatctaccgcctggccgccggcccccgaaacttcgttgtggttagcgaccctgccattgccaagcacgtgctcaggaactacggtaaatatgctaaaggtctcgttgctgaggtctcggagttcctgttcgggtccggtttcgccatcgccgaaggtcctctctggacggcaaggcgcagggctgtggttccatctcttcataaacggtacttgtctgttatagtggatagggtgttttgtagatgtgctgagagattagtggagaagctacaacctgatgcacttaatggaactgctgttaacatggaggcgaagttttcgcagttgactcttgatgttattggtttatctgtatttaactataactttgactcgctcaacacggacagtcctgttattgaggctgtttacactgcattaaaagaggcagaggctcgatcaaccgatcttttaccctattggaaggcaagttttttccaatcttactttcatgacatggattttctttccttgtttgttatgtcatgtgtacattttaaatttctttgtaagataattccgagacaaataaaggctgaagaggctgttagcgttatcaggaaaactgttgaagatcttattgaaaaatgtagagagattgtagaatctgagggtgaaagaattgatgtcgaggaatatgtgaatgacagtgaccctagtatcctccggttcttgcttgccagcagagaagaggtttccagtgtgcaattaagggatgatcttttgtcactattagttgctggtcatgagaccaccggttcagtgctgacctggacactttatcttctaagcaaggattcttcgtcattggcaaaagcacaagaagaggtagacagagttttacagggaaggcgtcctacctatgaagatattaaagatcttaagttcttgacacgctgcattattgagtcactccgtctctatcctcatcctccggtattgataagaagagctcaagttcctgatgagcttccaggtggttacaaactcgatgctggtcaagatattatgatctctgtatacaacatacatcgttcttctgaggtctgggatagggctgaagagtttgtgccagaaagatttgatttggatggtccagttccaaatgaaacaaatacagatttcagattcattccattcagtggaggcccccgcaaatgtgttggtgatcagtttgctttaatggaagctatagttgctcttgcaatctttctacaacacatgaacttcgaacttgttcctgatcagaatatcagtatgacaacaggagcaacaatacatacgacgaatggcttgtacatgaaactgagtcgacggttgaaatag

SEQ ID NO: 75964 - DNA, 4512 bp, Glycine max
  Peptide Sequence Number=SeqID_192742
atgtcttcttccttcctcagcaagttcgaagtatttgtgagctacagaggagcggacacccgaactaacttcactagccatctttacagtgctctgactcaaaaatcaataaaaacattcatagatcagcagctcaacagaggagactatatttggccaacacttgccaaagcaatcaaggagtcgcacgtggtgcttgagagagctggtgaagatactagaatgcagaagagagacataagaaatcaaagaaaaagttatgaagaggcattcgcaaagcatgagcgggacaccaacaacagaaaacatgtttctaggtggagagctgctctcaaagaagcagctaatatatctcccgcacacacaggtcgtccaaatatggatgaatctcacgtcatcgagaatgttgtcaatgatgtattgcaaaagctacacctgagataccctactgaactaaaaagccttgtcggaactgaaaaaatttgtgagaatgtagaattattattgaaaaaatttcgagtcattggaatttggggtatggggggaattggtaagtcaaccattgctaaattcttgtttgccaaactcttcatccaatacgataatgtctgcttcgtggacagttcaaaagaatattcactcgataagcttttctctgcgctattgaaggaggaagtttccacatcaacggttgtaggatccacatttgatatgaggagactcagtaataaaaaggttttgattgtacttgatggtatgtgtaacgtcgacaatcaggggcgttatcgtttagacttattggagtatttatgtaaagagtttggtgacctacatcacgaaagcagactcatcataacaacaagagataagcaattgcttgtcggaaaagttgaatgtatacacaaggttaagaaattgaaaagtccagaatctctagagcttttttgcttagaagccttcaagagaaagcatccccacaagggttatgagagtctctcagaaagtgcagttaaatatgctgatggggttccattagctcttaaagttctgggttcatatcttcatacaaaaaatatcaatttttggaaatgtactttagagaaactcagcgagtatcctaacgagaagattcagaacgtgttaaaagagagctatactggattagatgatctagaaaagaatatatttctagacattgcattttttttcaaagaaaaaaagaaagatcatgtcataaggatattagatgcctgtgattttgcggcaactagtggaatagaagttcttgaagacaaagctttgataactgtttcaaatagcaatataatacaaatgcacgacttgatgcaaaaaatgggtctggagatagtacgtgaagaatgtaaaggagatcctggacagcgtactcgattgaaggataaggaagctcgtgaagtgattgaaaaaaacaagcgttctagtagtacatacctcgaccttcctgcaactcttgagccattttctgataaactgagatatctggagtggatcggataccctttcgagtctcttccatcatgtttctgtgctaagttgcttgctgagattcacatgccacacagtaaacttaaacgactctggcaggggatgcaggaacttgacaatttggagggaattgagctaagagaatgcaaacagtttgaagaagttccagatttgtctaaggccccaagacttaaatgggtgaatctctcctgttgtgaaagtttgcagtatcttcatccatctgttctgtcctccgacacgcttgttactttgatattggatgggtgtacaaaccttaagagagttaaaggtgagaagcatttaaaatctctggagaagatcagtgtcaaaggttgctcaagtcttgaggaatttgccctgtcatcagatttaattgaaaacttggatttgagcaataccggaatccaaactttggacacatcaatagggcgtatgcataagcttaaatggctcaatctagagggtttaagactagggcatcttttaaaggagctatcttgcttgacatctctccaggagctgaagctttctgatagtggactagtaattgacaaacagcaactacataccctgtttgatgggttaaggtccctacaaatactgcatatgaaggatatgagtaacttagttgaactccccgataacatcagtggcttatcacaattacaagaactaaggctagatggaagcaatgtgaaaagattgcctgaaagcattaagatacttgaagagttgcaaattctgtcggtggagaattgcaaggaacttctgtgcctgccaacgcttccatcccgcatcaaatacttaggtgccactaactgcatttcattggtgtcagtgtcaaacttaaacactttggcgacaaagatgttgggaatgaccaaacacattacattcaagaacaacttgaatttggatggaccttcactcaagcttataatggaaagcctccatttaacaatgatgagtgctgcatttgacaatgttttagtaagaatccgtggggctgtcaacggccataactataacagtgttgagctttgtttaccaggaagcagggtgccatggaagattcaagatcgaaccactaagtcttccatttccattgaacttcccaaacgttccaactttttgggcttcatttactgggtggttctttctccagctggtggaatgaagaagcatggcactaagataaaatgtatatgccacttgccaggaaaaggtacaaaggcaacatggttatgtagtgatatcaggggattgaactcggatcatgtttatgtatggtatgatccattccactgtgacagcattctcaaatattatgaaccaaaggtttcttttgagttctgtgttgcaaatgaaaatgatgaggcggaagttgatggctccatttgtattaaagagtgtgggataaaccttataagagtttcagatgtgctgagtgttttagaagaattggacttggattcgaataagaaaaaggaccttgagaagggagtgaagtgggaaacagaacgatatgcagaggaggaaagcaatggcataagaaaccagatagcgaatcaacaatggaaaatgagtgaacacagcacctctgatggtatagtcggaatatttcaagagggaagaaattgggaaagtgatgatgaagaatctcttaagacctcgagaaaaagaaaaggtagggctaaatccaagagtttggtcacaagcaaaaagtcttcagattattcaactgttcatccagaaacaggttttgaacaagaatctaccactacagcaaatggtagcgaaccaacacaatttgaagcaaaatttgcttcaagttcgggtgctaagggaactataaaacaacccaaggaatctcataaaagaatgaaagtgaaagttaagattccaagccctttaccatcagctttcgagaaagtggacatggaatctgtttctgaaccagcacaggaaaaaagtcaaccccaagaggaagagtctatattgaaccaagagactgaagagtcatattcttcaagttcatctgaagaagaaagcaaggatgcattaagggtactgtacaagacatcttcctttgacttcaaccaacaagaaaaatggtcaaactctccaaatcgaggtaaagctcagaattcaagcgaatctttctcttcaaaagatcaactagaggttggaagcagtaaggtggtttctgaatacacccctatggagattgacgattatctaaacaaactcaatgatgatccctttgcactcttcgatttcctatcaagcaatgtttcactttcatcgaaactgtcagaaacaacaattcaacagtccagatcgactgaaaaagtttccaacattcttgaagaacttcggtctttggccttctctcagtcactgttgtgcaacattcaacgagttgaatacagagaacaagttgaggtaactttgaagaaacttgataattatattcgagatctatctgagagccaaagcaaaggactcaataaatttaatgatttctacaacaaagtagtgacaatttgcaaggacaaatccttgaatgaagagaaggcaaaaaagattgaagccgagaaaaaacaagcttttgataaacttaaagattacaaatccaaagttcaaaagctcgatgatgtggttgcaacgaataagggtaaaattgagactgtggaaaaacgccaaaggatgatccaagagaccatcaagaaacttcaacaagaaaacgagggcttaaacaaagagaagactaaactccaaactgccaactcgaagcaattggccaataaacaagaaattcttgaatctgtcaagtatgtttctacttcattgagcaaggcaatgaaacatcatgctgaacttgacaaggagagatcgggtttaaatgcagattttgagaatctgaaggagctttataaaaagatgaagagaagccctccattttaa

SEQ ID NO: 75965 - DNA, 567 bp, Glycine max
  Peptide Sequence Number=SeqID_192743
atggaggagaagcttctgatatttgtgcaaggtattggtgataaatacagtgctcctttaacaacttgtgtctatgttgttatgcctcgtgtggcagtcaagtattactcagatgactggccaacaaacaatgcaaagttagcttttgagaagtttgtatttaccaagactgttaagacaaatgctcgtacagaagctgaggtaacactacttgagaacaatatcattatttacaaatttgtacaagacctgcatttttttgtcactggtggtgaagatgaaaatgagctcattctagcatcagttcttcaaggtttctttgatgcagtcactcttctgttgaggagcaatgttgacaaaagagaggcacttgagaacttggatctcattctcttgtgtcttgacgagattgttgatggagggatgatacttgaaacaaatggacctcttattgctgaaaaagtgacctctcatagcttggatgctgatgcccccttgtcagagcagacattaactcaagcctgggctacggccagagaacatttgacaagaacccttttaaaatga

SEQ ID NO: 75966 - DNA, 372 bp, Glycine max
  Peptide Sequence Number=SeqID_192744
atgataggaagattattctgttttctgctagctctgcaaatagtgagtttggtttctgcagtaaggaagccgtttcttccagccaaagaagaggctctacagtctccaccaccacatactatagaaccaaaaaagggtttaatgggtatagaaggtacatcagagacaatgaaggaagcatatgaaggaggagtgagcaaaataggatcaagtccaccaagttgtgagcacaagtgctatggctgtgttccatgtgaagccatccaagttcccagcacgagcaccaggcgcagccatttgggaatccagtatgcaaattatgagcccgagagctggaaatgcaagtgtggtctttccttctatagcccatga

SEQ ID NO: 75967 - DNA, 306 bp, Glycine max
  Peptide Sequence Number=SeqID_192745
atgggggaggtttttgatttcttatgttggaattttgggttccagaaaaaaaaagtgaaaactccaaacatttttgagcgagctaaggaggagattgaggcagtgtttcatcgcgacaaatcgccacaccatcacaaagaaactcatgggacaagtgatgacattgatgagggaacttcacctgatgaaatcaaagcgcctggtgtgtttgaacgggtgaaggaggagattgaagctgttgctgaggccattcatcccaagaaagaatctgaatctggcactcgtgatgtgtcgtcaccaaagtga

SEQ ID NO: 75968 - DNA, 309 bp, Glycine max
  Peptide Sequence Number=SeqID_192746
atgggtggcaacggtgcagtctggggagaagtgaacggtgcggcacggtctaaggcaagaagtgaagtgaacgaagcagggactcgttgggcagaggaaatgatcctcgtccccatccttgccgtgcctgtggcgaaatatttatcctcgtccccgcgagaaaatattccctgtctacggggccttgaacaggatagtcccttcagggatccccatttatggtacaaattgatacccctattgcagagtgggaatcaaatgttgatcaccgaaggtcaatttcaggtgttgccatatgtttgggtctaa

SEQ ID NO: 75969 - DNA, 873 bp, Glycine max
  Peptide Sequence Number=SeqID_192747
atgtccgcccgtatcctcagcctgcatatctaccccgtcaaatcctgtgccggtatcgacctgtccgagtcgccggtggaccgcgccgggttggcccacgaccgccgctggatgctggtgggggcggacggccatttcatgacgcagcgccagtgggcggccatggccctgatccgcacggcgctcacggccgatgccttgcggctttcggcgcccggcatgccggacctggacgtgccgctggacggctcggcgctgcaacccggcgtcgaaagcgtgggtgtctggaaggacacgctcgacgcgcgccgcgagagcgaggcggcggcgcagtggtgttcggatttcctcaagacgccttgccgcctgtacaaggtcgacgccggcgcgacgcggcccgccaagccggaatgggtggacaagtgggccgaaagccatccagatctggcgcagacgttcgggggagatcacttcttcggctttgccgacggcttccccctgctggtggcgaaccaggcatcgctcgatgacctgaacgcgcgcctgcgggccaagggcgtggcgccggtgccgatggaccggttccggcccaatatcgtggtgcagggcgagtgggaggccttcgaggaagaccataccgccatgatcaccacgggcgcggtcagcatggcgttcgtcaagccgtgcacgcgctgctcgattcccgacatcgatcagcgcaccgccgtgcagcacgacgagccgggccgcacgctggcgggctaccgcaacctggagatcggggtggtgtttggccagaatgccatcgtcgatgcgccggccggcgcccgcctgaaggtgggcgacgcggtcgacatcgaactggatttctag

SEQ ID NO: 75970 - DNA, 283 bp, Glycine max
  Peptide Sequence Number=SeqID_192748
gtattcactaagacctatggtatagactactcagagacctttgccccgatcgcatacacggaagaggtatacatggatagtcctcctggctctgaacacagatttgggacaaaggagaatgataagcttatccagcgcaagttgttgcagcccagatacgtacactgctatataaacatgaaggctgcacggtgttttgtgagccaccttgatgttaccctaacatcaagtgttggacctgagtgtgcagagttgatctctattgttcagagagcaatctctg

SEQ ID NO: 75971 - DNA, 201 bp, Glycine max
  Peptide Sequence Number=SeqID_192749
atggcaatgacacccgtacccgtgggttggggagtcggggccggggactggggaggcaatacccgtccccgcctcgcgccattgccatgtctacttctaactcatattgaaccaaagaatgtgaaacataccttgacttctcgaaactggttgtcagttatgcaactagaatatgaagcattgatgaagaataatacttag

SEQ ID NO: 75972 - DNA, 540 bp, Glycine max
  Peptide Sequence Number=SeqID_192750
gagaatgataagcttatccagcgcaagttgttgcagcccagatacgtacactgctatataaacatgaaggctgcacggtgttttgtgagccaccttgatgttaccctaacatcaagtgttggacctgagtgtgcagagttgatctctattgttcagagagcaatctctgagcaatgtcgtgacatcctatacgacatctgtcctcagtatcagaatttcaccactgaaccatcctcatcccccacttttatttttccttccataccaatcataaataatcagcctcctcatcaagctaacttctcttatagttcttcatctcaatctcctcaaaataatcaggttaaaactactactgacactgcttttaagtcaaattctgatattgttggtcagtcagcttctattgttgtgtctcttcagtctcttgacactacacatacatctctattaatagctgacaataatactgctcattctcctaataccactgatatttcatcttcttacacttcttctttttctctttctccttcttga

SEQ ID NO: 75973 - DNA, 579 bp, Glycine max
  Peptide Sequence Number=SeqID_192751
atgtcaatggggtgtttaaaatatctgggtgctcaagtattcactaagacctatggtatagactactcagagacctttgccccggtcacaaacacagttagaattctcctatcacttgatgcaaacttggattggtttttgcaccaattagatgttaaaaatgcattcctcgacaatggcttggaggaagaggtatacatggatagtcatcctggctccaaacacaaagttgggacaaagttaaaaaaacaaggatattcccatggccaatcagatcataccttatttacaaaattttcttctaaaggaaaatttgctgcactaatagtctatgttgacgacatcatcctcactagagatgatgaagttgaattggctaggctaaaaaagaacttggcagaaaaatttgagatcaaggacttgggatccttgaggtactttcttggaatggaggttgcttgctcaaaaagaggaattgttgtttcccaacagaagtatattctagaccacttgaaagaaactggaatgagcggttgtagaccagcggatactcccatggatctcaatgggaaactttag

SEQ ID NO: 75974 - DNA, 393 bp, Glycine max
  Peptide Sequence Number=SeqID_192752
atgactcttcattcattttccgatttgcaggatcccttgatgataagatgcagatgcatgcatgtttatgatcaaacattaaacataataactaacgggtgttgttgtgttcaattatacttaacgcttatggaacccttactgaatatgccgaatggctctagaatatcagtcatacatgaagatcctaatgagtccttgaggaggcctatacatggagccttcgaattgccccaagcattacgggtaataccgctggacgatgttagaattcacaggcgaaggcagctcttcatcattcatgatcataagcagcaatgctcctccggagaaatccttcttcacaacaaacgacccttcatagttgatcgaggccgaacccgaatcaaataa

SEQ ID NO: 75975 - DNA, 168 bp, Glycine max
  Peptide Sequence Number=SeqID_192753
atggaagttattctcaaaattgtcataacattaacaacaagtagaagagcacgtgactcccttggtctgaagcctaacacgaggggtgggaagcaacatttctctggtcattgtcattggaaatttgttgtaccacaacttgatgccaacattgttgttggtggttga

SEQ ID NO: 75976 - DNA, 996 bp, Glycine max
  Peptide Sequence Number=SeqID_192754
atgtgctgtttgccgcacatcgcgcgcactgtcaccggactgtcacgcatcaaaccaatactgcgtttattttttgcggagctgtttgatgtctctcctgtctgtaatctccctgccgctgcggctgcgacctcgtttaccctgcgtctgcccgtctggctctccagcctgcgcagccagttcatgctgtttattgtgctgttttgtctgctgcagtttgccggggtgctgttgctcaaccagcacgtgaatcagacgcaacactccttgcagcaggccagccagctgcgcgaacggctggccctgctggataaagcacgtattgagttactcaccgccagcgacaacagccatcgtgccggcatttatctgatgcaggaccagcaaagcggttcggtcgacagctggaaaagcctggcggcggcagccactacctcattgcagcaggcgcagcagctgtttgctgcctatcaggcgaaaagcgatagcccgctggcacagggcttcgtgctgctggctggcgggctgcaggagcagctgaaagggctggcagccaatgatatcaacgcattttttatggtgccgatgcaggctttccagcagcagttcaacgatgcctggtttagcgaaatcgaacaggccaatcagcagctcggcagcgtcaaccagcattcgctcagcacgctcaagcagagccgcaatctggcgctggcgatcgccgcgttattaatggcgctgctgctgctggccgccgcgctgctgatgcgcggcgtgttgctgccgctgcgtcacgccaacgcccagctggcacaaatcgcgacgggcgatctggtcgccagcccggcaccgacgcgtcgtcagtcgctggaaacgcgccagctgctcctgtccatcgataccatgcgtcagggtttgcagcagatcgtcagcgacatcacgacggtagcaacccgggtggcggccggcgctgacgagatgcagcagcataatcagcag

SEQ ID NO: 75977 - DNA, 1302 bp, Glycine max
  Peptide Sequence Number=SeqID_192755
atgggtggttcaggaagatggctcaagtccctcatttctctcagaaagccctccactattgatcaagagaagggtggtgacaagagtaagagaaagtggaagttatggaagagcacttcagaagggtttgggattggatcatcaatgcagaaggggcatggtggtggtggatcctttgtggtggacgatggagcatttgctgctgctttggctgctgtggtcagaactccactcaaagactttatggtcattaagcaggaatgggctgccattcgaatccaagcagtgtttcgaggtttcttggcaagacgagctttgagggccctgaaggcagtggtgaggttgcaagctatatttcgtggttggcaagttagaaagcaagcagctgttactctaaggtgcatgcaggctcttgtgcgagttcaagcacgcgtcaaggcaaggaatgtggggaactctcaagaagggaaatctgcgggtgagcattgcaatgaagctgatcctgttaagcaagctgagcaagggtggtgtgacattccaggaactgtagaagaagttaaggaaaaattacaaatgaggcaggaaggagcaattaagagggatagaacaaaggcatactctcagtctaagaagaaatcaacagagagagcgagtccaaattcaagagctgctaagtcagtaattcctctcaagaaccgcaacctagacagcaagagctcgggatggaacatgttagatctctggatggctgcaaagccatgggagagcaggtcaatggtagaaatgtatttggactcacctgacatgactccagtgaccagtaaaagtgatcatcttgttcttccctttaattcggatcaacaaaatggctcagtcaaatcaagaagcaatggtgtgacaaccaggatttcaactaattctcttacaactagtcaatcaactccatcatcttcagccataagctctgaatgcatgcatgatgatagtcctatgtcaacctcatgcacatctggatcaccatctcgaccatctaacaacaatgttacggtggaagcaacagaggaaagaaatgcctgtaaaccaagctacatgaatctgacagcatctaccaaagctaaactgaaaccctataggtgtttttctcagaatgcgaagagaatctttatggatgattgtgtgtcactaagtggagttactagaagcagttctggtttctatccttctgctaatacatggaagaatctctatgcaacacctctaagaacaagttatcaaaaacgatatacaatggaatataagtag

SEQ ID NO: 75978 - DNA, 105 bp, Glycine max
  Peptide Sequence Number=SeqID_192756
atgtggtgttatgagtggaaaaagattgagactttgagggttggaaggctaagtctgaatgctgtggaattgatttgcgcaagattggatgagaggaacgtgtga

SEQ ID NO: 75979 - DNA, 135 bp, Glycine max
  Peptide Sequence Number=SeqID_192757
atggatattgaggttccacaagtggtacttccaggaccagaacttcttgttttagaaggtgaatctatcaaacctgataagccgttaacaagtaatccaaatgtgagtggatttgttctggggatgcaaaagtag

SEQ ID NO: 75980 - DNA, 282 bp, Glycine max
  Peptide Sequence Number=SeqID_192758
atgccctcttacttcgcggatttagtgttcacgggtgagaggattgaagtgtgcttgaagagagggaagtttgattatgtctctcccgccggcacaaataatagaaggattggagcagttggggcaaaaagaaaggaaggggacgcctatgctgtcacctcagcacctgcttggccaaagcctcagcaagcctcgcatggtcacttctggtggaagcaacctagctcgcttggtcgagctgggcgagctgggtggcaaccacctccctttttccccctataa

SEQ ID NO: 75981 - DNA, 236 bp, Glycine max
  Peptide Sequence Number=SeqID_192759
atggaagtagagcagagtaatgtaggaggagatagggttttaggcgttgagagatgtggcgggaaaagaaaacgaagggttttagagagtgcggaaaagctgggtcacgcgtttcagtggtgtactggactatttgtatttgacacaaggcgactcggaatggacgatgctttggcaggattcctaatagcttgtgttgatcccttacatgctgctcctcttagtgccctttgcac

SEQ ID NO: 75982 - DNA, 1110 bp, Glycine max
  Peptide Sequence Number=SeqID_192760
atggcgaaagtcacttccagagacgtgcaagagatcgtggaaaaactctcctccgataaagccaaagctcgcgaagaagggatcaagttgttaaacacttggttagaaggagaaagatcatataacttctgcaaatttattggatcaaatactgcaaagcttaggccagatgaagttcctcattctgaaacatggccttttcttatttctttactaattaaatctgcatcggcggagatatcctcaagtaagcggagaaatccaaaaatgatatatgcaaagactcttagaattgttgtgcaacgtgcggaggatgccaagtgttcaggaaaaatgttaccattgtcatctgtagttaaaccacttttcaatcatgtttgggatgttctgagcaatgttccaagctttcagtctgaatatgggattatccttcggcatctattgtcagttagagattatagtttccagatgaggaagcgcatatactgcaacctggtgtttctgtacattgagaaagtggaagcaagcttgaatggaaaaaatattagcaattgtacttccaaggaggaggtcttccgctatatcttgacacttcattctcttttaaagtatcctcctggagactaccctgataatgcaagagaagacattgtgaaggggtttgttagaatatgttcattcatcagggaagaggggaagatatcacgtaaacttgttgagtgtattaatacatatttattaaatgatggtccaaatttgggctttcagttgtttgagattcataatgccatgcaacagtttgtgttccgcagttggctgacaacacatgatcgagttctcaaggattcacttgtgttctatgcaaggattcagttgaatttaatcagtggtgctgctgataggtgtttattggtagaacagcttttggatgtgatttgtaaggatcttgatcaaggtagcatgtctagtacttcaatgctgcggggtgatgggaataaagatgacaaattaggagctttgagtagctcacaatgtggattggtggaacttgcagctgttctattttatagggtagttactaaaaactcagctgccgattcctggatttaa

SEQ ID NO: 75983 - DNA, 480 bp, Glycine max
  Peptide Sequence Number=SeqID_192761
atggaaagtttattcccttttactgcaaaccctaatgtgatcctaaactttcatcatcacacagaccagctctaccttcccaccacaccatcttcaatcccacaaggttttgatcatattaataatgatgttaagttagacattaacaattacaatgccaacaatttccttcatattcagaatattccaacaccagaaatacaatatgaaggtccattagtagaaccaattgtcccaaaagtcagtaagagcattgaggattatgtttgtagcatcccatactcatctacttcccaggaacaacatgaggctactacaacaaaatttcagtgttatccagaagatctaactgtggcagcaaatcaattagagtacgttgaggccttcatgtcatcgttgccttcttcaacaacttcatcatcagcatcaagcaaccaaatagtttcaaaccttattattccttcaggatgggagccttga

SEQ ID NO: 75984 - DNA, 330 bp, Glycine max
  Peptide Sequence Number=SeqID_192762
atggctcaaatgtatagtcacattcaaccaaacaatctgttcataactaaggttttagaatattcttggctatttctatgttatctattcacctatgccaacaagctaagtgaaagcaatagaagtcatagagtatgctgcagaatggtgacattctccgcaagagttttaaaatttactaagtttgacactcatgtagaggaaaaggaagggttaactactaacaagccatcttttctacttctttttctcatgataaatgagcatataaccaaaaaagataagggattaaccgagcaaaaaatccatggttcctctttcgtcgaataa

SEQ ID NO: 75985 - DNA, 843 bp, Glycine max
  Peptide Sequence Number=SeqID_192763
atggagcctcctactgtgtttgaaactgaagcttgctgctctgttcatttccaacataattttttaataaatagggtttttgctattgatttgttcatgcagtgctttctgtcactaggaaatgtggtgcataaactttcagaagttgatctcaattggtttggacgggttaagctgattgattgcatctgcaatcttgttttactccatcctcaaattggtcagactatgatagaacggttacttttgatgctaaaagatatggactatcgggttcggttattcctagcaaggaggattggtgttcttttccagacatgggatggtcatgaagagcttttccaggacatttgtttgaattttggtgttcagatggttgtttattccaaaggaaaagtcatcaatgcaatggaggtgctagctgctggtcctcagcctcaacctataatggaaacagttgtgattactctcatgcatcttgctttacacagtgagaagattgagttagaggctgttttcatgatatgtgtggtttccgccattgatccttaccatagggagttggtctgtgcggtacttgacaatctttctagagagcttcagtataggactagaatgaagtacttagaacagcttttgggatcaattctcttttgttgggtagcttgtggtgtaagcttagctgcacttgttgagatcttgaatgaggtgaagtgcaaggtaccttggttttgccttatgaacaatgtcaaaaagcctgtcgtcaatggaaaaggctgtttgtgttacctatatacagaacatcaacctgctaggcattatattttaaattccagtttttga

SEQ ID NO: 75986 - DNA, 489 bp, Glycine max
  Peptide Sequence Number=SeqID_192764
atggttttgttcattcctcgtgctgtgtatgcactttgtgtaggtcatgttccatttacacgatgctttaaagaacttcctctggttcacaactattttgatgtcgctgatgctcaagatgactctcacaagtttgaagagcctaaacaccaatgtctacttgagtttttggattgctctgtggaagttctcacagaaattgaaaagatttctaaagttgaggcttctcaagtgaaaatttgtccacatgtccgggttccccgcgaaataagtgatcagcttttgcatgaaatggagacctctattctcggagctttggtggaagaggagattaatgagaggcgtttgccagatactttcttaatatgttctctcttgtctaacctactttatggttcttttttcacaagggtgagagttcgccactcatggaatcctgaatctggtagtggaatggaatgtgctttagtgagaaaatttgcatgctga

SEQ ID NO: 75987 - DNA, 957 bp, Glycine max
  Peptide Sequence Number=SeqID_192765
atgggcttttgctccaaatggatcaattggattgacggctgccttaaatcagcttccatatttgtactggttaacgggagcccgtcagctgaattcattccacaaaaaggactcaggcaagcggatccactagtcccattccttttcaacattgttgcagagggattaattggcctgatgagagaagctttgcacaaaaatcagtttaaaactttctcaattggtagaaatttggtggatatcagcattttgcagtatgcagatgatacgatattctttggggaagcgtcaatggagaatgtgagagcaattaaggtgatgctgagaagttttgagttggtctcaggattgagaataaattttgcaaagagcaatttcagggccattgggatgtcagagcagtggacggctaagcagaagaagattgtctggattagctggggatcagcttgcctatcagaggagaaagaagggaaactggttcaaaaggggaataagatggattttggggtgtgggtcaaaggtgaggtttttggaggacgggacgaaggaagacggtattccgttgatggacaaatacctagactttatctaatctcgaaccaacagaacaaacctatccagcaaatggggacattatcagatacagcatgggagtggaacttgcagtggaggaggtttctattggaatctgaaacaatcatgggtgccaactttctggaggatttgcaggatctctccattgatcctaaccatcaagaccagtggatctggaaaggtgatgcatcagggagatatattgtaggttctgcatataagctgcttgactcggacgcaagagatgaaaatcaagatggagcatttagagaactgtggaaactaaaaatcccagccaaagctgctttctttgcatggagattattaagggacagattgcctactaagaacaacttatga

SEQ ID NO: 75988 - DNA, 285 bp, Glycine max
  Peptide Sequence Number=SeqID_192766
atggcgtggcagattttttgccaaccgccatgggcagtttgtgaaggcagacccgccttaatgctcaatggcgtgtttatatggtggaatttcgtccttccgccatctgccattgaaaacactgtttgctgcataccaaatagcctaacgaacggggatggtgttgttagcagggtgatagcagtggcaggaagtagaggtggttggagccttggggagtggcacagggcaagtggggacaagattgagagggaaaaaattatatcctatccaactaattactaa

SEQ ID NO: 75989 - DNA, 240 bp, Glycine max
  Peptide Sequence Number=SeqID_192767
atgcagaacctgataatttccttcaatattgttgtccatggctacttcctgctcttcttatcaatgaaaacagtaccgatctcaattgggttgccaagtaagaaaccaggatcagagaagggaacactagtgcttcagagttccattttgcattttgctcagatatctgagaaagaacgagacaaactcataaagagacatatgtctgatccacgtccagttcaaagctcctctcaatag

SEQ ID NO: 75990 - DNA, 1494 bp, Glycine max
  Peptide Sequence Number=SeqID_192768
atggagctcaatgaagatcctggaccaattgataattatgttctttatgatcaagataatcatgtatcttcagcagtttgggatggacatgagcgtggtgtacttagatgccatgaacacacttcaatgcttgatcagtggaagctcacacctaaacagattaagttggttgagaaggctggtttcggtcacctacgattacttcctgctatgagtcttgacaatgcattgatagcagctttggttgagcggtggaggagagaaacaaattccttccacttaactgttggagaattgacgataacccttgaagatgtatcactactacttggattggctattgacggagaacctgtgataggtccaataagtgcaccaagttcaggttgtgaaaaattattagggagagtaccagaggacctgaatggtggaatggtgaagcttacttggctcaaggagttcttctctgagtgtcctgaagatgcatcacaggaggaaattgaacgatgtactcgtgcttaccttttatacctagtaggcagtacaatattttctacaacaacagggaacaaagtccctgttatgtacctttctttgtttgaagactttgacaaggctgggaagtttgcttggggtgcaggagcattggcatttttatatagagcactcggcaatgcttctcttaaatctcaaagcactattagtggctgtttaactctagtacagtgctggtgttattctcgcctcaatgttggactgccaaaatttaatcaagaacctgataataattgctttccctttgtgcttaaatggaaagggaaaagtggtgctcggacaaaatgtaatgtagtgtcctacagaaaggctttggactctcttaatccatgtgatgtccagtggctaccttacaaggacatggactgtacagccataccagaagatataaaagctagtctgattttacgggcatctaggactatgttattgtgttttgacaaggcagaaaggcaccttcccgatcgttgcttacgtcagtttgccatgcatcaaactatcccaaaagacgtggaacgatgggagaggaagagtcgtatagtggatcatggggtagacttgatgggaaaaatggacttggctctcaaagagtggtctgaacgttgggttcatgttgttgaaggtggtgacattgtagatgagggtgagtacatgcagtggtatcagaagattacccggaaatatattgggagagtcacatcatccctggagtcagagtatcaaagaacagttactgctatgagggaaattgcaaatattgctgatatagtctcagcagaagggttggattcttataatagagagttgcttgatgaagtgaaaaatattgtgcacaaatgtttaacagagcagtttgaagaaataccaaacgagaaagttaaaaagaagggtaatcggaaacgtaggcaaaaggaccacctgagtatggaatatgaatag

SEQ ID NO: 75991 - DNA, 534 bp, Glycine max
  Peptide Sequence Number=SeqID_192769
ggggagagggagaccaagaaggacacatggggagagggggaatataaaatggagcatccgatggtacttgggctaagaggtggagatattggtggttggcggaatctgatggagagtgaactggccttggcatcaaatttcatggcagaagtggaagatcttggtggggagtattcagttatcagcacatataaaattctcagcgaagaagggggtgattggggagaggctggggatgataatggggtgttccgcaggttggggaagttgaaggttcccagcaaggagtctagatgtccgctgtgtatgttggaggaggaagatgcttcacatttattctttaaatgtgataggatcttaccaatgtggtgggagtgtctctcatggccaggagtgtctacagtattgccacaaacacctaatgaacacttcttacagcattcatactgctgtttggaaggtgtggttcagaataggtggcaaacaatgtgggtagctttgacatggcgtatatggcaccaaggaacaggttga

SEQ ID NO: 75992 - DNA, 1254 bp, Glycine max
  Peptide Sequence Number=SeqID_192770
atggctatgtctactattttgcttttgactttcttttctttcatttatggcagtgcagctactcatcacgtttatagaaatcttcagagtttatcttctgattcctccaaccaaccttacagaactgcttatcacttccaacctcccaagaattggataaatggaccattgagatatgcaggactttaccacctattctatcaatacaatcctaaaggtgcagtttggggaaatattgtgtgggcacattcagtgtcaaaggatcttgtgaattggactccactagatcctgccatttttccatctcaaccgtccgatataaatggctgttggtcaggatcaaccacactacttcctgggaacaaaccagttattctatacactggaattgacctattgaatcagcaagttcaaaacttggcccaacccaaaaatttgtctgacccatttcttagggaatgggtcaagtcccccaaaaatcctctaatggcaccaactagtgctaacaagatcaattcaagttcatttagagaccccaccactgcttggctaggcaaagatgggcattggagggtacttgttggaagcaaaagaagaactaggggaatcgcaattttgtataggagcaaagactttgttaattgggttcaagccaaacaccctttgtattcaatcctaggaagtggcatgtgggagtgtcctgattttttccctgttttgaataatgaccaattgggtgttgacacgtcggtgaatggttatgatgttaggcacgtgctcaaggttagcttggatgacaaaaaacatgattactatatgattgggagttacaatgctgccaaggatgcatttatcccggatgaagagtctaatgaatttgttttaagatatgactatggaaaatactatgcctcaaaaactttctttgatgatgggaagaagagaaggattttgttagggtgggctaatgaatcctctagtgttgctgctgatatcaagaagggatggtctggaatccatacaattccaagggctttatggctgcataagtctggtaaacagttggtacagtggccagtggtggaagttgaaaagctacgtgcatacccagtcaacttgcccccccaagtgctaaaaggaggcaagttgcttccaattaatggtgtcacagcaacacaggatcatgcttgcaataattttaaaaagactatatatactataatattgctgaaaattagggtcaaatgcgcctaa

SEQ ID NO: 75993 - DNA, 393 bp, Glycine max
  Peptide Sequence Number=SeqID_192771
atggcaaagagtgtagaagacgatgtcagtcacttcgcgtcaacgggctcgtttaccctggttgacgaaaggtgcgggcttgtttgcccacggttgacgaaaggtgcgggtaaccataagtctctgcgcatcaacgggctcgtttgcccccggttgacgaaaggtgcgggtaaccataaggtagtctgcgcggaagatgacataaatctccgcgtgtcaacgggcttgttggccgcgattgacaaagtagtctgcacggaagatgacgtaaatctccgcgtgccaacaggcttgttggccgcgattgacaaagtagtctgcacggaagatgacgtaaatctccgcgtgccaacaggcttgttggccgcgattgacaaagtgtgcagagacgat

SEQ ID NO: 75994 - DNA, 277 bp, Glycine max
  Peptide Sequence Number=SeqID_192772
atgcctgagcggggcgaagccagaggaaactctgtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcagacggtgggtcatggaagtcgaaatccgctaagga

SEQ ID NO: 75995 - DNA, 594 bp, Glycine max
  Peptide Sequence Number=SeqID_192773
atggctctcgcctgtagcattccgattgccttttgtgccagggccgacgacggtgccgtaccttccccttcggatttattaacgtatacatccgacatgctcgaagactcggcaagttccgggcgtagtagtagtacctcagcggtcaatcaaccgcttccgggggaacaagctatgcctcccgctcttcctgttatgcaggaagctgctaatcgggctctgccctacccctatcaaaataatgagattatagggggggacagtgttgaatccatccaacggaggcttttggggagattcccctctccttcagcccatgagattcaaatggcccggattgaagccgaagacctattcgaggtcaaggtcgatatttgtcaggtcatggcgggccttcacccaagcggggattggatgggacggggggctagagctctggataatcttcgtaccgccactggagaggagtccttaagtaagctccttcgaatgcgggaggacctacagactgcgggtttgcagtccgcaaccttccggcaattggccgacagagtggcattccgggcggatggagatcaacactctgccacctag

SEQ ID NO: 75996 - DNA, 213 bp, Glycine max
  Peptide Sequence Number=SeqID_192774
atgtcgaaatatgatactcatcctcggaatgctccttttgctgagaacgatgccaacaaatgccccagatctagtcggtacggattttcggtaaatggtcctagcttttacccagtggttaatggtgcaaaagacacaaaggttcaccaaagggggaaagtcgtgcaacctacatgcggggtcgtcgtattagagacgcaagtccatttttga

SEQ ID NO: 75997 - DNA, 171 bp, Glycine max
  Peptide Sequence Number=SeqID_192775
atggcagattcaacgatgacggataatgaggttgctgaagctgcgaggaaaaaggaatacgtgaagatgaaggaaactgggggagtgaagagaacacatttgactgaatcaagaaaaatcacgcgtgacaccgatgtagaacacctgcgtgatcggttaagagcaatgtag

SEQ ID NO: 75998 - DNA, 402 bp, Glycine max
  Peptide Sequence Number=SeqID_192776
atggtggttgcatccattcggcttcttccttctccactcctctctttcgctcctcgtcgctctccatattcatattcatggcgctctcatccctctttaaccattcccttctcttccatccactccaaagcttctactaagggagatggtggagcagtggaattgggtggtgatcaaacagagcttatatttttggggactggaaccagtgaaggggttccacgtgtcagctgcttgactaaccctttactcaaatgtgaggtgtgttcaaaagctgctcaaccgggtaataagaataggagacttaacacaagcatcctcattcgtcaccccaattcctcaggaacacacaataatattcttatagatgctggaaagtatgtctctaattcccctatgtag

SEQ ID NO: 75999 - DNA, 486 bp, Glycine max
  Peptide Sequence Number=SeqID_192777
atggcaggctcatcaaattcaaggaagggaaaaagtgtggttgaaggcaacaaaacagtaaaggaaattctatttaaggacgagttgcagctggagttcattctgaacgtgggcattgtgaaagactctgagttgagcatgccatataggacgaaactgagcaatgacaagtggaacctctttttaccagtgcaaggttttgaagacatcctcttagggttcttgaaagaaggtgaagatgtcagagaggccatctcagtgaccgtgtatgacaaaggtggccacgagtttgatatgatgctcaagaaatgggtgaaggattccaaccattactatgtgctaaaccgaggctggttcagtttctgcgaccaacagtgcttaggggaaaacgatctcgtcgccttgcgtacctttcgccatgcaaaatctgatatgttatcctttgttgttactttcaaaagaatgagcatcactgttaatacttaa

SEQ ID NO: 76000 - DNA, 627 bp, Glycine max
  Peptide Sequence Number=SeqID_192778
atgcagtctgtggcatataccgcagttcctttgttcagtattgcagcagtctggtttagttggatctgtattacaaattgcacttttctctgcgttaacaggattggatgtgcagttctctacattggccaaggaagttttcatcatagcatgacaaatacattgcagtatgtggtgcatcaagctgattctactgtggataagcttagaaatacaaaaacaaatatcaataactttgctaacacccttgctgataagacaaaggagaactcagacaacatacatgatctcttagattctgcgaggctggcccttatcataatagatgttgttacgctagtcttgacatttcttggacttttattctcaatttttggcatccaacttcttgtgtatctcatggtaatcgcaggatgggttcttgttattggcacccttatattatgtggcttattccttgttatccataatgtgacagtagatagttgtgtagctgtgaatgaatggatccagtatccgactacacatacaactacgtgggagcaatgggatactttgtgcgcaacttacaacctcgagggcaaggttgtttttccaacggagggtgttgatagcaatagtgcatga

SEQ ID NO: 76001 - DNA, 126 bp, Glycine max
  Peptide Sequence Number=SeqID_192779
atgtatcaggtggagactactcttgccagatcaatttcagatgacgataggagctatgcaaagcttattggacctgagagttataccaaaggacatgagtcatcatcagctcatacaaagatgtga

SEQ ID NO: 76002 - DNA, 1821 bp, Glycine max
  Peptide Sequence Number=SeqID_192780
atgccgagtaggctcctagctaggatcatggcttcttcacctagctcacctcctcctcctcctccttcagacgcatcaacttcgccatctgctgtgaagcggacacgcaaagccacacgtctacgatccttgtctactagaccacctggtgctgagagaccagtgatccacattgatcctgctatcggcaaggccaacggttcccaccagaagaaattaagaacatatttagggattgtggctcgtgataaggtggacgtcacgtacgagaactggaaggaggtccttactgctcagaaggacttgatttgggaggatattcatgcaggatttgaaatcctagaggcttctaacagtaggacaaaaaagaagttacttcagactgtcggcgagagatggaggcagtttaaatcagacctcacaaggaaatgggaccttgcagtagatcaagacggtggggacgacactgtctgtgagaaatacggcataagcaaggaaaaatgggtccagttttgccagactcgcagagacccttcttgggaggcacaggccatccagaaacagaacactgtcccccatgttttgtctcatggaggttatgaatatttggagcagaagctcctggctgagaagactaagaagaagttggaggaagctgcacagtcaggaagcgttgatggcgtcatcgaccctccatcccccaattcctttaaggagcaggcgtcacagggatctttcatcccccatggacgtcaggatattctcactgctactattggacgtccagaacaccctggacatgtccgtgctgctagagccgatgccacaatcaagcaatactttggatcgactccacggacgtcctgcagctcttcctcactacctcctgaagaattgcagcagctgacccagcaaatcagggaccagctagaggagtcgatcacagaaaaattgactcggcaactcatggcatcgttcagccagatacagtcccagtttcagttccagatgcaatctcagggacttacactgcctccggagcctctggttggtccctcaggtcctcgagtaagcacaaaggagagttgtgttgatccctcaggaaacgatcctaggacaagtgactcagacaggtgcagcttgtacatcgaagcaaatcctgtctgcctggttgccctgggaagagtttatgagggatccactgttgttcataacactcctttgttgcctggacaagtaaaggtgggtgtggaggaggttaaagatccagatgctcccattcctgtacccactgatgaggtttccttagtggggctggcaattcacatcttccttgcttggccgacacatctggtcaagcctttatcacaccaggttacatgggatgccaccatgttcggggtctttaatccagacttcctgctctgcataaagcacgaagacctctccgaaatcgcacacggtggtcaatgtctcagcatatcaatgttacagttgtggattcttatgcgagcggggaattctgatctatatggattcctcgagccacagtccattcagaggtatgagcaatcacagtttgaggctgaaagttacataaagagttggatacagagttcaaaacacgatgtctaccttggagtctacctgaatggtgctttaaaaggtcttgttgatgctccacagcttaaatcaaaggctgctactaggtggattgttgtcaagtattttaatgatcctagaccattggagccagagagattaaatgcgcttcagatccagtgggcacagtattatcttcgagttagagctcagagctag

SEQ ID NO: 76003 - DNA, 352 bp, Glycine max
  Peptide Sequence Number=SeqID_192781
gataagaacaattgatgcggtcattattactcattcacatgctgatgcaatcggaggtcttgatgatcttagagattggacaaacaatgttcagcctcatattccaatatatgtagccaagcgcgacttcgaggatgctttgaggcctgaccgctctacttctacacattttggacttcaaagggccttggaggaagtgcgaaaaattcaacccaaaagaacactttttaccggtatgatgcatctgatggatcatgaagaagtgaatgactcccttgcgaaactattggagtctgaaggccttgatgcacaactgagctatgatgggcttcgtataccaatcagactctag

SEQ ID NO: 76004 - DNA, 210 bp, Glycine max
  Peptide Sequence Number=SeqID_192782
atgaccaacacagtggtccctaaatttgcgggagggaaatatcatgtagagaggggttctaaagggggagaagtgacgagaaggagaaaggaagggaagggtttttggatggaaagagaagggaggagggtcttattcagggagaaaagaggtgggggcacagctaggggtgggaaggaggaaggaagagggaggggtgagaaattttga

SEQ ID NO: 76005 - DNA, 267 bp, Glycine max
  Peptide Sequence Number=SeqID_192783
atgatgaacaaaacaaggccatgcaatgcatacttttatctagaggctaaaagcatcaatatatttgtacctcttgagatagaggaaagcactccagtgaagaacttggatggatgtataggatgtggaaccttgaaaattacttttcaacgtcccactcactttgacattgcatcaaacaatttcaaagttcaaacattcaacatgtacaagttatcagaactcaaagggcgaatatggactggaagaatatcccaagatcattaa

SEQ ID NO: 76006 - DNA, 1263 bp, Glycine max
  Peptide Sequence Number=SeqID_192784
atggtgcaacatctatttgatggttgggtaactggtgcatgccaactatttgatgatacaggctgggtagcagatgcaacatttgtgcgcagctttgacaagaggttatgttcttgtgctataaggagcaaaaatttggcacatgcccaaccaaatccacatgaaatgcttcaacatcatcctgcatttcatgattctgcatttcccaaaaagaagttaggtaagagggatttgagtgttgctggaagggtcattctcagaattggccataattcttatgtgcttaagcttctcaaagtagatagacccatgttgcgcattcccacattgaccattcatcttgatcgcacagggaatcaggatgattttaaaccaaatctagagactcatcttcttcatttactctcaatggaacctgagggaacttctttggaattcaactccaaagagaagaatagtgccttgccatccaaagctcatcatcatcgagtgcttatctgccttggaggtggaaacaatgaatttattttttctggaagattagataatcaggcttcaagttattgtgcattaagggcacttgttgactcacgtgaatctcctggtgacttagcaaaggtgggttcaggttttgttcaaggagctggagcacccaccatgtttcaggccatgagacgtatattagcaaataactatgttggtgaaggctcttttgtgcgcactatttgccaatcatttattgtgtctgtagataaggcccatggagttcatcctaattttatggataaacatgttggggacattccttctgtttataggtgggaaatgaccaatagggttgttcatgctgctactagaggaggaaatttgaagattttggaggagcttcttccaattgctttgatgttttggcttttagagatgctgatggatctactgttttacatgcagctactggcagagggcaagttgaggggccaattaccaatagctgaagctctagtcttagcatttcccctagtcttaacatttccctcattgatatctataagaaacatctctggagaaacttttctccacaaggctgtgtctggttttaattcttatgcatttagaagattgaacaaacattttgaacttttgagaaacatgcttagggggaagaactttcatgtggcagacaatatcaatgttaagaacaatgatggaagaactgctcttcacatggccatcattagcaacattcagttgccccatcaataa

SEQ ID NO: 76007 - DNA, 581 bp, Glycine max
  Peptide Sequence Number=SeqID_192785
atggcttcccgcaaaagaaaggttccagcctcagcatcccaggcctgctatgatagatcaagattcacatcccaagaggcctgggatcgctactctgatatagtgattggcaggaagatcctgcctgagagaaatgtcatgatttatcatacagaatttgatgagttcaaggctgagttagaaagaaggaattggcacaaggagctgaccaatttcgtggatgagagcatcgatgttgccattgttaaggagttctacactaacctttatgatcctgaggataaatcacctaagcagatgagggtgagaagccacttaattaagtttgatgaagacgccctcaacacctttctgaagacccacgtgatcatagaggaaggggggaaccttcctgcttactccagattctctcgtttgaggccagatccacaggaactggcagcccgactatgcatccctgggaggggatttgagcttaatgttgatgggctgccattgaagatcttgcggaagaatctgaccacgctcgctcagacatggagcgttttatcattctccaacctgacccctacttctcacac

SEQ ID NO: 76008 - DNA, 165 bp, Glycine max
  Peptide Sequence Number=SeqID_192786
atgaaagttgagtgtaaaaagggggcaagtaatagggttggaaataaaaagaaaaaggtttatctatggatgagtgctctcctagaatctaagcttttgcatcctagaaaaaccatgaattgtttgcagctcagcctcaatacaagcctaagaaagtccttctga

SEQ ID NO: 76009 - DNA, 204 bp, Glycine max
  Peptide Sequence Number=SeqID_192787
ttgttcaatttaattattttggagtctaagcttgttgcgtattactcattcttggctcaacaaattggtgtaatgagcgtggatcttgagttatgggttcggccatgtataagggttgagaagttcactagtcaaaatgactttggactctggaggttgaagatgagcccttctggtatagcagggtttggtggaggctcttga

SEQ ID NO: 76010 - DNA, 306 bp, Glycine max
  Peptide Sequence Number=SeqID_192788
atgacaacaactgcaatgactacttcggtgactttggcatcggagtacgccgccacctctactaagcttaagcctgacgacatcattctcgccaaggtcaacgctaccattgaaaatgaactagcgaacaagtacgatgttcagggaggaggtgtggcggtgaatgatgagaaaggcatgtttgggttgtctgatttgatgagagcggccatggaagtgcttggaaatggaagctttggattttcttacaaggttgtgatggctaatggagtggaagtggtggtcaagaggacaagagaaagatga

SEQ ID NO: 76011 - DNA, 431 bp, Glycine max
  Peptide Sequence Number=SeqID_192789
atggataaaggaagagatggggataatggacaagcaaaaatggtttcctctattagagatactcagacttatgatgctgatttcgtgctgagcacgtctttgggcttcctcttgcgccttctttgcgccaagcttgagttttcccgattagcgaggtggttcttcttctccgcgaggcgcgccaaggttgttcttcttcttctccgcgaacaggatagtaaccttagggtagaagacgagagtagaagacgccgaaaaaaatgggaaaaagggctcacggcggaggctttcggaagacccgttaggggttcttccggaagtttcggaagaagctattccggaaactttccggaagaagtgttcttccggaagttaccaaacttcttccggaagtctcccggaacacctcttctggatactttccggaagaa

SEQ ID NO: 76012 - DNA, 3234 bp, Glycine max
  Peptide Sequence Number=SeqID_192790
atgggttgcatttactcgcgagtctgcataggcgacaattgcagaggctccagcatcaacggagaccccatcgcgcgaaacgacgtcgccgaagtcgtgaatttctccccttcctcttcggatgttgaagaaggcgaaatcagagaccaattgaaccaattgagcatcaccagagactctgaagctggaatccgaagactcgctagggtttccgcgcagtttcttccaccggacggttcccgaatcgtgaatgttccttccggaaacttcgaattgcggtactcgttcttgtcgcaacgaggttactaccccgatgcactcgataaagctaaccaagacagtttctgcatccacacaccttttggtacgagccctaacgaccacttcttcggcgtcttcgacggccatggcgagttcggagctcagtgttctcagttcgtgaagcggaaactgtgcgagaatttgctcaggaactccaaattccgtgctgatcctgttgaggcttgtcacgcggcgtttttagcgacgaattcgcagctgcacaacgatgttttggacgacagcatgagcgggacgacggcgattacggtgctggtgagagggaggacgatatacgtggcgaattccggcgattcgagggcggtgatcgcggagaggagagggaaggaagttgtggccgttgatttgtcgattgatcagacgccttttaggagtgatgagctggagagggtgaagatgtgtggggcgagggttcttactatggatcagattgaggggttgaagaaccctgatgtgcagtgttggggcactgaggaaggtgatgatggtgaccctccgaggttgtgggtgccgaatgggatgtatccggggacggcgtttacgcggagtattggtgattccattgctgagactattggggttgtggcaaatcctgagattgttgtgtttgagctcacacaggatcaccctttctttgtgctggccagtgatggggtgtttgagtttttgtctagccagactgtggttgaaatggttgtgaaatttaaagatcctcgtgatgcttgtgctgcaattgtggcagaatcttatcggctctggctgcagtatgaaactcgtacagatgacattacagtcatcattgtgcattctgctgttggtcagtcagcaagttatggtgatgttttgcgaaaccctgtgcctcaagttgtagaggtgacaggttcagaatccccttccacctttggttggagcgctagaaaccatcgtgtaaggcatgacttgtcaagggcacgccttcgagcacttgaaaattccctagaaaatggtcaatcctgggttcctccatcttcagcccataggaagacatgggaagaagaatataaagtattaaatttagtttctcccattggaaagttcaataattgtgaacctttgatggcgcttcatctacatatgccccaggcacacatagagcaggcgttgcatgatcattttctcttccgaaaacttactgattctcagtgccatgttttattggattgcatgcaaagagtggaggtccaacctggggatattatagtcaaacagaattgtgacaatagttatactttgcagggtggtgaaggtgactgtttttatgttgttggtagtggagaatttgaggtcttggcgactcaggaagaaaaagatggggaggcttctgtacgtgctgtaacaaaaggaactctttgggctttaaaacgagaagattttcgagggattttaatgtcagaattctctaacttgtcatcattgaagttgcttcggtctgtagatctcctttcaaggttgtcaattttacaactcagtcagatttctgactccctttctgaagtttccttctcaaatgggcagacaataatagacaaaaatgaagtccttgcattgtacattatccagaagggacgagtgaaaatcacttttgattctgatttattgactggtccaaatgcctacagcctcaagcctgaaatccaaaatgaggatgatgcacagagcggaaaagaactgtcaatagagaagcccgagggaagctattttggtgaatgggcccttcttggtgaaaatattggttccttgagtgctgttgctgtgggtgatgttgtatgtgctttactaacaaaggacaaatttgaatctgttattggctccttacaaaagatttctcaggaagatcacaagtcaagggattattccaaggagttgactacaaattatgatttttcatcccttgataaagtccagctctcagatttggagtggagaaagacgctatattccactgactgctctgaaatagggcttgcaaatttaagagattcagaaagtttgcttactttgaagagattttctaagccaaaggtgaaagggctaggaaaggaatcacaagtcttgaaagagaaaattttgattaagggtatgggctcgtcagcctgtataccacaggttttatgcacttgtgctgaccgcatgtatgctggaatactgctaaacactcgccttgcttgccctttgtcttccatactttcaagtccttttagtgaatcagcagcgcagttttgtgctgcttctgttgttattgccttggaagacttgcacaagaatggtgttctctacagaggtgtgtcacctgatgttttgatgttggaacaaactggacatatacagctggtggacttcagatttggaaaacagctttctggtgagagaacattcacaatttgtgggatggcagattcactggctccagagattgttttgggaaaaggccatggtttccctgctgactggtgggcgttgggagttttaatatattatatgttacgtggtgagatgccatttggatcatggagagaaaatgaacttgatacagttgccaaaattgcaaaaagaaagctacatcttcccgagacttttagccctgaagctgttgatctcatctccaagctacttgaagtggaagaaagcactagacttggtagccaaggtcctgattctgtcaagagtcacccatggtttaattgtattgaatgggaagggattagacaccacacctttcccgttccgcaggaaattatttctcgtataacacagtacttggaagttcattctgaggattgtagtactggttatctgggttctccattgcaggaggtaaaagaacttaatgtgcctgaatggcttgaggactggtag

SEQ ID NO: 76013 - DNA, 1281 bp, Glycine max
  Peptide Sequence Number=SeqID_192791
atgaatcaactttgtggtgttatccttttggttcactcagtcttgtgtttccatgctagagcacagactgctgcaccttcaggagatgctgtctccaatttccaaccaagccttgctgttgtcataggaatccttggtgtcatgttcttactcacattctttcttctcatgtatgcaaaattctgtcaacgctgcgcttcttcgcccgttggagacacagaaaatcaactcccttttgttagatcaagatctagattctcaggaattgacaagaatgtcatagaatcactccccttcttcagattctcttcactcaaagggtcaaaggaagggctggagtgtgcagtgtgcttatcaaagtttgaagatgttgaaattctcagacttctaccaaagtgcaagcatgcttttcatattgattgcatagaccactggcttgaaaaacactctagctgtcctatttgcaggcacagagtcaaccctgaggaccacacaaccttcacatattcaaacagtttaaggaggctagcaaaccagtcagaggtaggtgaagaatctaacatagagatctttgtccagagagaggaagagcatcatggttcatcaagattcagttttggaagcagctttcggaaaacgggaaagtacgtcaaggaagaagaattcctcattgaaaaaggagcagaagatagtgatggtaatcagaagggatatcacaaacacaaccacaggattactatatctgatgttgtgttcaagcacaggtggagcaacgtgagttcttcagaccttatgtttctgaattcggagatgctgaacgatgcatcaagcaacagattcagcaacttggaatcaaatgctgacatgatgtctagtacaagaggggtggtggaaaatgagcaaattatgaatattaaggaggagatggagaggaagatttcatttgagagcaaagttggtgtactgaacaacatcaaatcagtttcagataagcatcttctttttacatcagattctgcagggaaatcaactcatgcaccaaagtatgcgaatcccggtgagaaaaggtcaatgtcagaaatcactgctgtctctagatttggagatttaggcatgaaaatgagggtcttcaaggattcttcttcccttcaaaacaaccttaaagaggaaagaatgaggcagatttggtttccaattgcaagaagaacagctcaatggtttgtgaatagagaaagaaggtctcaacaatctcagaataaacaacagccattagatgtataa

SEQ ID NO: 76014 - DNA, 1476 bp, Glycine max
  Peptide Sequence Number=SeqID_192792
atggaggatgagagtgggcttgagctcagcttgggtttatcttttggaggctcatcagccaaacccaagggtaagaatggtagctcctcagatactagggctgaagaagttggtaggggtggcaaaatggtggatgactttaagagcatgtttgataacgttcctcagaagcctgaatctattactgggactcgaagaactgattccccaaagcctgaggagaacttctttagtgacctttcaaaggccaaagaagacaatgcttctttgaatttaaacgggagagggtttctggttgcaaacagtaataaacctgttgaaattgaggaagataaaaggtcagaggcagcaaataagcgaaaaatgccttttgatgagatacgtgatcaaaagaagcatgacagtgatgttcatgccgatttacatgacagggctagagcctctcatatatctataacagaggagggttcgactgcagaaaatgaagatgtggctgactctgagactgagaactccacctccaggcccatctcacaccacagtgatggttccaaaggatttattagagttagtgcttcttccgatgcagcaaaagagattcgtggaagtgctgactcaaatgctactgactttagtgggcagaagaggtttactgggtcatcagaaaaagattttaagcatgctaacatgacctatggtgcttccttttctgttcaacctgtaaatacaatgaatgtaccttacccttcagtaaaagagtccagctctgttggggcaccaagccctcagatacctggagtgatgcatgtgatgcctactgcaactggtgaacacttaggagcccaatctgtgagtaatgggaatttgcctgtgatgtttggatattcacctgttcagcttcccatgttggagaaggacaactcatggggtttggtttctcgtcctcaacagttacacccttcctttgttggcagaggtccaattaactcagtaatctcaaacaatatatccgaggccatgccttatgaaggaaggccgttagaacgaaccaaaggagatggtaaacagcgtgtcaatgaagaaggctcctcctcacaacctgaagatgtgaaagcaagaagcacaaaccttagggccaaagatgtatcaggccaatcaacaggagaaggtgccatcattgatttttcaaatattaagccaggtcttgctgcagatgtgaaatttggtggatgtggttcttacccaaatctgccttgggtatccacctcaggttcaggtccaaatggaaggacaatttctggtgttacttataaatacagcactaaccaagtcagaattgtctgtgcatgccatggttctcacatgacccctgaggagtttgttcgccatgcaaacgaagaccaggccgctgcagagggcaatgcagttttggggacagtagcaaacggcaatcctgctgcctcttcccacagctaa

SEQ ID NO: 76015 - DNA, 447 bp, Glycine max
  Peptide Sequence Number=SeqID_192793
atggatcatggcagagaaaactcaaaggtaccctttgtagaacaagaacaatacactttaccatattttccctacccttttttcagcctcttcactccaaacaatcacacccttttcaccacattcagctccatgttttctaccatggaattcaatgatctgaacaattccaattgcttcacaccaagtgtagattcatctggctattgtgatgttcttggggagcattcttgtgccaagtcagacacatattcatccaatgaggaaggtgatgatgcatcagatgatgaagtgatgagtttggatgagttgcagtttgatggaaaaacaaaggagaaaattgaactattggctgcaatggttggagttgacactactgacccagcaattgtgttgaatgaagtagtgagagtcctcaaggttttgaagagcataaatccgtattag

SEQ ID NO: 76016 - DNA, 564 bp, Glycine max
  Peptide Sequence Number=SeqID_192794
atggaaattttacttgaaagcttggaaagcagcatcattgaggttcagatggttataaattctgaattgcataaacgaatacagattggtttaacggtttttgaccctgaagaggccgaagcaacttgtatagttttaagtttaatatttggttgtcccgagcttttcttgacagaggggacgacaagcaaaaacgaaaaagataaaagcaatccaaaatatcctaacaacaaatatgcctttattccactacctacgcatcttttagaagacacgatgctatcacatgggtttgcgcttttcctacgtacgacccattttactattcctatcattccacggcccttggaaattcacattgccctcaaggtgatatgcttaaccatgactaccaaggtaatactagggttccaaggtctgtggcggcaaaactcactcagctcagcgcttgcccatagtgccaagacagctgggctgcacttgcgtgagaccatgatagacccaaagagtcctggtcccagtccaaataacgcaatggctcgatgttcttcctgcttggcgtga

SEQ ID NO: 76017 - DNA, 485 bp, Glycine max
  Peptide Sequence Number=SeqID_192795
taggagctgtgtcctataagctgaagctgcgtgaaggaagtagaattcatgctgtgtttcatatatctcaacttaagaaggctatagggaattattcggctgaaccacaattaccagaaggattagaggtggagccagaggacttagaagagccggaagaagttttggcttcaaggtcggtcacggaaggtggacagcgcgtgcgacaatggttagtgcgttggaagggacgaacgatagaagacaccacttgggaggacgaatcagttctgaaaagtcaatttccctccttcagtcttgaggacaagactgttgcttctgggggaggcaatgatagaaccactgctgggcctagtattaatgaaaggcccaatcctgctgaaaggcccaatcctgctgtgtggagagtgtacgttcgtaggagtaagaaggtggggaaccattctgttagtgatgtggcaatgggaatccgtgaatatccctga

SEQ ID NO: 76018 - DNA, 588 bp, Glycine max
  Peptide Sequence Number=SeqID_192796
atggatcattatggttcttctggaggaagctggacgatgatcccaacccacaattcaagtattcaatcccaatcccaatcgaaccaggaccctaacctctttcttcaacaacaacaacaacagtttctccagtcacaaccttttcagcaagcactaccaccccaatctccatttcaacagcaccaccacctttatcagcagcagcaacaacaacaacaacagcagcgtcttctaccgcaaccgcaacagcaacagcaacagcagcaacaacaacaacagccgcagaaccttcaccagtcactggcctctcactaccatcttttacatttggtggagaatttggctgaggttatcgaacatggaaccccggatcagcagtcagatgcattgatcaatgaattgagcaaccactttgagaagtgccagcagctgttaaactcaatctctgactccattagcaccaaggctatgacagttgagggacagaagaagaagctagaggaaagtgagcaattgttaaatcagcgaagagacttgattgccaattacagaaaatctgtggaggatcttgttaggtctgagccataa

SEQ ID NO: 76019 - DNA, 2901 bp, Glycine max
  Peptide Sequence Number=SeqID_192797
atgattaatgaagaaggtgaggtaatagccattgaagttaaggaagatgaggaagaagtgctagattgcaactctatgggattgtgtggaatcactgaatcaaaaacaacattgagcaataaccctcctactacactacgcctcaagggaagtttgaatggaatatcgattgtggtcctaattgatagtggcgccagtcataatttcgtttcacctcatgtggccactgcattggggttaaatgtggaacatggaagatccatgggagtaaaattgggtgacggtcaccgagtaacaacaaaggggagatgtaggaatatggaagtacatttggatatgatcttgggagtggcttggttacaaaggtttggaaaggtgactttcgattgggagaaaatgaccattagttttgtttgggaaggagaaagggtagagttgcagggccaatttttcaccacccaggatgtatcaacgaacaacacagttcatacttcaatggattccttgcacagcttgttagaagcagagatggtaccagcagtgaataaagacacaccagagttgattggggcacagaaacaggaacttgatgaattgttgagcaaattcaaaggagttttcgaagagcacaaagggctgccgccagaacgggagattaatcataccattgaactacaaaaggaggcaggaccagttagtgtaaggccctatcgttaccctcatcaccacaagggggagattgaaaggcaagttcgagatatgttgagtcaaggtatcattcgaaacagttccagtgctttttcaagtcctgtcattttagttaagaagaaagatgattcatggaggatgtgtatcgattatagggagctgaataaggtcacagttccggaccgataccctatacctgtggtggatgaactattggatgagttacatgggactaagtatttttctaaactggatttaaaatccggttaccatcagattagagtgaaggaagaagacgtgcagaaaacagcattccgaacgcatgaaggtcattacgaattcttggtgatgccgtttggattgacaaacgcatcggccactttccaatccattatgaatcagattttcaagccacacctccgtaagtttgtcctagttttctttgacgacatcttagtatatagtaaaagttggcaagagcatttagcacatttgtctcaagtgctagaagtgttgcagcatcactgttttgtagttaatcaaaagaagtgcagttttgcgagtagaaaggtggaatatctgggccatgtaatttctgaacagggggtggcagtagatccagctaagattaatagcattttagaatggccaatccctcacaatgttaaaggagtgagaggattcttggggttgaccgggtactatcggaaattcattgttggttatggcaagatagctaaaccgttaaccgagttaactaagaaagatgggtttcattggggaccagaagaacagaaggcctttgagaatttaaagagcgttatgattcaagcccccgtcttaacccttccagattttacacaacctttcgagattgaatgtgatgcatctgggagaggaattggtgcggtattaatgcagaaaaagaaacccatcgcttacttcagcaaggctttatctaaaaataatctgagcaagtcagcatatgagaaagagttaatggcattggtgctggctgttcaacattggcgcccttatttgttgggaagaagatttgtggtgtattctgaccagaagagcttacgtcacttgctacaacaacgtatcactacagctgatcagcagaattggatagctaagttactaggctatcactttgaagtagtttacaaacctggtcctgaaaataaagccgctgatgcactatcaaggattcatgaagaagtagaattaaaaggaataacttcattccctatatgtttgcaagagcaacaaattcaacatgaagtcaggaatgatccttatttgcaaaaagtggtgactgatttacaacaaaatcctacatctcaaccggggttccaattgataaaaggaaggctgttttatcataacaggttggtgttgtcttcaagttctgattgcatacctttaatgttgaaggaatttcattcttccgctactggtggccattcggggtttttgcgcacgtatcgaagaatagctggaaacctttattgggtaggaatgagaaaatcagttcagaaatttgtgcagagttgtgatccattaccaattccggagcggatttgggatgacatctcaatggacttcataactggtctaccaaaatcaaaggggtatgaggctatttttgtagtagtggatagattatctaagtatggacactttattcccttaaagcatccatacaccgcaagaaaggtggctgagattttcaccaaggaggtggtgcgtcttcatggtatgcctcaatctattgtcagcgaccgtgaccccttatttgtcagcttattttggaaagagttattccgtttgcaagggacggtgttgagtatgagttcttcctatcacccggaaacggatgggcaaaccgaggtggtaaatcggtgtttggaagcatatcttcgttgttttgcatcagaacaaccaaaggagtggtcacgatggatttcttgggcagaattgtggtataataccacatttcatgtgtctacgggtacaacaccgtttgaaacaatgtatggaagaaaaccacctacggtggtgagatttcttcaaggagaaactaaggtggaggcggtagctacagacttgattgatcgtgacgaggctttacgtcaattaaagtatcaattgattcgagcacaggaacagatgaagcgatatgcttga

SEQ ID NO: 76020 - DNA, 797 bp, Glycine max
  Peptide Sequence Number=SeqID_192798
tacacgtcctcgccatcagagggctgcacgccctcaacttcggaggactacacgtcctcgccatcaaggggctgcacgccctcagcttcagaggactacacgtcctcgccatcggacggctgcatgccctcactttcagaggactacatgtcctcgtcatcagaggactacacgtcctcgcctatagcggactacatgtcctcgccattagagaattgtacgccctcacctttagaggacaacacgtcctcgccatcagagggctgcacgacctcaccttcagaggactacacatcctcgccatcagagggctgcacgccctcacctttagaggactacacgtcctcgccatcagagggctgcatgccctcatcttcaaaggactacatgtcctcgccatcgaaggcctgcatgccctcaccttcagaggactacacgtcctcgccatcagaggactgcacgtcctcgcctttagaggactacacgtcctcgccatcagagggctgcacaccctcaccttcagaggactacacgtcctcaccatcagagggctgcacgccctcaactttggaggactactagtcctcaccatcggagggctccaagccctcagcttcagaggactacacgtcctcgcctgtagaggactacatgtcctcactatcagaggactacatctcctcgtcttcagaggactacacgtcctcgcctatagagtgctgcatgtcctcgccttcagaggactacacgtcctcgcgattagagggctgcacgccctcacctttagaggactacac

SEQ ID NO: 76021 - DNA, 279 bp, Glycine max
  Peptide Sequence Number=SeqID_192799
atgttcaacacccatacctctagtgcttattgttcacaccgaccccctttcccgattgctggatatgcaaattgtgaagacatgaaagctgccaaggaattgtatgatgtcatgaatgacaagaatgaagtcacttgggttgcaatgatagcaggttatgcaatgcttgtttgtcatgcacaaagtagatacgcaaatgatgtgaacctgagtaggagcggatcgtttgatacaggctacggaggtttggatgacgccacttccggtgaaggaagataa

SEQ ID NO: 76022 - DNA, 168 bp, Glycine max
  Peptide Sequence Number=SeqID_192800
atggatacctcagagccttacactggggcaatgaaaggcatcatgcataaacctcaaataacgattggtacctcaaagccttacactggggcaacgaggggcaccgtgcatgagcctcaagcgaacctaggagcagatcaaaagttctcacccatcgatgttttttaa

SEQ ID NO: 76023 - DNA, 1506 bp, Glycine max
  Peptide Sequence Number=SeqID_192801
ctatcaggcatggcaatgatggagattttggatttgtctcacaacaaactcttcggagaaataccacaatcattaactgaattgagtttcttatcttcatttgatgtgtcttataatgagttgcatagggaaatcccagaaaagggacagtttgatacctttccactaacaagctttgaaggaaacaggggtctctaccgttgcagcgcttcaggctttatgccttctccgccagatgagactcctgctcagcctcatcaccagaagctgcagatcattgattttccattttggtttggttctcttgctggtattctgataaccattggcatgtattttgcttctggatggaacttcacaagtagccccaatgatttgaaagccttgattggattctctaggtgcttagaatcagctattccggactggaatagttctacctcctctgattactgcacttggtctggtgtcacatgtgttggcacgagggtggttcgcttggaacttggaagcacacaacttacagggaagatctgtgaatcattagcatgtttggatcaacttagagtcttgaagctttccaaaaatctcttcactggctctcttccacacagcttgtttcatcttccaaacttggagatcatggactttagcaataatcaatttgaaggctctatagatacaactatgtgttcctcttttactcagctccgagtatttaaactgtcaagtaactacttttctgagagcatctttctgctacagaatttgaatgaactatacctgcaggataataagctatctcggccactgagtgagggagttggcaagctttcaaacctattggaatttgacatctccaacaatgaattttctggaattcttcctaatatctttggaggcctcaccaggcttaaggttttctatgctgggtcaaatagattcaccggtccattgcctgcatcgctggtgaattctgtatctcttcagatgcttaatttgaaaatcaattctttggctgcaacactagaggttttaagtcactgtaagaacttaagtacgctagtccttacaaacaacttccataatgaagaaatgccacaagcacagggtcaaaatctagaattcagcaatctcaaggtttttgtgctggccaacagtcagatcaaaggttcaattccgaaatggttaagtggatgcaagatgctgcagatgctggatctgtcatggaatcatctcagtggaggcattcccccgtggattggcaaattgaacaacctctattacttggatttgtcaaataactctttcactggccgcataccacagagcttcacaatgttcttgagcctccagcccaataattcttcattggaaggaactctttttgcctttccctttgataccgttgagactggaactttaaagaggatgaagtatgaaaaactttcaaatttacgaccatctttgctactcagttacaaaggctttatccttaatgaataa

SEQ ID NO: 76024 - DNA, 978 bp, Glycine max
  Peptide Sequence Number=SeqID_192802
atgcagccgaaatctcacacccctttttttgttcctccccaaaaagccatgaacaacaatgaccctaataacaactacaccaataacagaatctcaacaccaagaaatggcaacagcgccacccaggcctgtgctgcatgcaagtaccaacgcagaaagtgtgcacctgattgcatccttgcaccttacttcccccatgatcgccagcgccagttcctcaacgcgcacaagttgttcggcgtgagcaacatcaccaagatcatcaagcttctcagccctcaggacaaggaccaagccatgcgcaccatcatctatcaatccgacatgcgcgctacagacccagttggtggttgctacaggtacattctcgaactccaggcccaaatcgagtactatagggcggaactcgaactcgtccttcaacaactcgccatcttcagagcccaggctcagcaccaacaccaacaacaacatggtatctttgctgcaaacaacgttaatgtagctgtcaatggtgatggtgaggttttgaacggtgatccaatgggcttgtataaccagcaacaacactatcagtgtctgcaggcacaacaggaggaggagcagtatgttatgatgcacgaaaatggtaatggaagccaaaacatcgatggcattgctttgcaggagcaaattaaaacgtgggctgtgcagaacactgctgtgtcgctttcttcgttgtcattgcatgggcagaatagtaatgtcagcgatgagtatgatcacaagccggtggtggggattgacatggattctgatgagagaagcgagttagggttcgagtctgaagaattagtccatcgcagtgatgaagcagttttgtttaagatagacgatgcagtaataaaagcggaggctaatccctgcatgcaacaagctcaagaccatgacctgaaaggtgcagcaacatcgtttactctcacaaattgtagttgctga

SEQ ID NO: 76025 - DNA, 1239 bp, Glycine max
  Peptide Sequence Number=SeqID_192803
atgtcaaattataaggtaactgggattgaccaaactgaagatcctactattcactttgccttattttcagattgtgaccctacaacattggatagtgctgtcaaagaagaaaaatggcgaaaagcaatggatgatgaaattgatgccattaaaagaaatgatacttgggagctaaatgatcttcttaaaggacacaaaaccattggcgtaaagtgggtcttcaaaacaaagcttaaagaaaatggtgaagttgacaagtataaggcgcgcttggggccaagggatacaagcaagaatatggggtcgattatacaaaaaaattctgcagtagcacctagatgtcaaatctgcattcttgcatggatacttggaggaacagaattcaagaaatctatgatggatgagtttgaaatgttcgatcttgatgttatgcattactttcttggcatagaggtggtgaaggcacgtgatggaatctttatttctcaaaagaagtacattggagaaattttggataagtttcagatgaaggattacaatcctgcaaacactccaactgagtttggcttgaaattaaataaagatcatgaagggaagaaggtggacaacactttctacaaacaaattgtaggcaagagaatcatttgttacttgcaaggaacaagaaattttgggatattctacaggaaaggtggaaaatcaattttgtttgggtttagtgacagtgattatgcaggagatcaaggtgatagtacttcagtctttatgtttggcacaagtgctatttcatggtcatctaaaaagcaatcaattgtgactttgtcaagtacagaagctgaatttgttgttgcaacaacttgcacttgtcaagctatttggcaaaggagaatacttgaggagctgaaattcaaacaaccagaaactactacagttttttgtgataacagctcaacaattaagctttccaagaatccagtgccacatggaagaaacaagcacattggtgtaaggttttattttctaagagatctcactaatgaaagagtaattgacttgaagttttgcagaagtgatgagcaattggctgatatgtttacaaaatctctcaagatttcattttttcaaaacttaaggaggttaataaaagatgtaatggaggcgtatatcagtatcatggctcatgggtgccacaccagtatatatccgtctatcaaaccaaagagagatgttataccttga

SEQ ID NO: 76026 - DNA, 2370 bp, Glycine max
  Peptide Sequence Number=SeqID_192804
atggtgtacaacacttcccaaggcatagtccctgggaagctcaatgttcatctggtagctcacacccacgatgatgttggttggttgaagaccgttgatcagtactatgttggttccaacaattcaattcagggggcttgtgtgcaaaatgtcttggactccatggtgcatgctcttctggctgacaagaacagaaaatttatctatgttgagatggcctttttcaagcgatggtggagagatcaaagtgaagctgttcaggatgtagttaagaaactcgttagttcgggtcaactagagttcataaatggtgccatggctatgcatgatgaggcagtaacacattacatagacatgattgatcagactgcacttggacatcaatttctaaaagaggaatttggtgtgactcccagaattggttggcaaattgatcctttcggacattctgctgtgcaggcttacctgttgggagctgaagttggctttgactcatttttctttggtcggatagattaccaagatagggctaagcgcaaaaaggagaagagtcttgaggttatctggcagggtagcaagagccttggcccctctgcccagatctttgctggagcattcccagaaaattatgagccaccttcaggattttactttgaagttaatgatgcctcaccaatagttcaagataacatgcaattgtttgattacaatgtccaagatcgagtgaatgactttgttgctgctgcattattacaggctgcaagacaactagaattttttagggggagagtgaattcagggccaaatacagactcattagctgatgctttagcaattgcgcaacaccatgatgcagtcactggcacagaaaagcagcatgtggccaatgattattctaagcgattgtcaataggctacaaggaggcagaggaattggtttcatcatcgctggcttgcttggttgagtcaccgttgcttactagatgtcaaaatccagttacaaagtttcaacaagttattgaggccaatgttagagttcatgactctaatggtatagaaatagaatctcaacttcttcctcaggctgagaaatatgtagacttaagaaattactacgtgaaggcatatctaggacaaactccacccaaggcacctaagtactggcttgcatttacagtttctgtaccgccacttggttttagcacatacactgtctcaactgccaaaaggacagggtccacaagatcatcagtagatatatataagagtagtgaaaagtctaaatttgatgttggtcaaggaaatttgaagcttacattttctatggatcaagagaagtgtaccaattatgttaatataagaaacctggtcgaggaacaggttgaactaagttacctatactattctggatacaatggaactaatcaaaaagatccacaggttggccctataccaattgaagatggaattggcaaagaagttgccactcggatttcaactactatggaaaccaacaacatgttttacacggattctaatggacgtgattttatcaaaaggatacgagactacagaacagactgggacctagaagtgaaccaacctgctgctggaaattattaccctattaatcttgggatatacacagaggataataaaacagaattctcagttttggtggatagagctattggaggatccagcttacaagatggacaaatagagctgatggttcacaggagattactacttgatgattcaagaggtgttgatgaggctctaaatgaaacagattgtgtcggtgatgattgcaggggtctaactgtccaaggtaaattttactacagaatagaccccttgggtgagggcgctaagtggcgtcgtacttttggccaggaaatatattctccacttctgttagcctttgctgaaaaggatgataaagatgactggatgaattcccgtgtattaacattttcaggaattgattcttcttatgcattacctgataatattgctattataacattacaggaacttgatgatgggacagttctgcttcggttagcacatctatatgagattgaagaagacaaagatctctctgtaattgcaactgtggagctgaaaaagctcttgcctgggaggaaggaggtgaaggagatgagtttatctgccaatcaagaaaggacagagatggagaagaaaagacttgcttggaaagtagaaggctcttctggaagtaagcaagtttcaaggggagggccagttgatccaaaagagctaaacgtggagcttgctcctatggaaattcgcacttttatccttgactttgatgatgtgtctaaccaactttttgatgcattgtag

SEQ ID NO: 76027 - DNA, 420 bp, Glycine max
  Peptide Sequence Number=SeqID_192805
atggaaaacagcttatccgtactagtgtggattaattctaaagttctaacgttgatgaggtcactcagcgcatacaccttctcaaggaccacccctttgctgaaaaaatggtccacccaaaggtaccctccgcctctcagcaccctgtccacatctagcagcagaaactccatcaccgtcaatggaatccatcggttcatggcgtgctcacatcgcactaaatccacgacatcgtcaaacaatggcaatcactgctgtagcagcacgagcccccgcagcatgacgacctcgttgttcgacgctgccacgttcatggtcatggtcaccacggtcacgttacgaagcctcatcgcggcggtaaaagagccagtgccgccgccgacgtcgaggccgagtacacatggaagagaacgacagtga

SEQ ID NO: 76028 - DNA, 447 bp, Glycine max
  Peptide Sequence Number=SeqID_192806
atgcccttgcggggtaggattgcatcatctggtcaagtctttatcacagtagctgtgtctctggcaaaaccacctccaaagcccgatccggaggtcgatgatccgctttatctaatgacattgaccatcccagggcttttcttgaggccttatcaggttagatgggatgccaccgtgttcggggtctttaatccagatttccgcctctacataaagcacgaagacctctccgaaattgcacacggtggtcaatgtctcagcatatcagtgttacagttgtggattctgcatctcactgaaacatgtatgcgagcggggaattctgatatttatggattcctcgagccacagtccattcagaggtctgggcaatcgcagtttgagtctgaaagttccactgcagcagacactggcagatggtggtcatcttgcccaaggaacacctag

SEQ ID NO: 76029 - DNA, 894 bp, Glycine max
  Peptide Sequence Number=SeqID_192807
atggcttctacttgttctgctattgttgcttgtgcttcttcctctctttctgttgccaaaaagaggatactcgcggctacttcacaagccatcttcatgctgctctccgtagaaacaacttggaagccattaacgtcttcttggttatgttctcagagaactacgcatcttctagttgaccttaaacctcacatccacctggcacgccgtattctcagccgacgccgtcgccggtttctcatcgtcggggagagatacggcgacgccgtcgcacagaaccttgatcccgactcgaggcgtctggaacacgcccatctgggcctccaccttggtctccagctccaccttcagcgccaccagctgactcttcctcttcatgctcctcttcagctccatcgcggcgtcactatccaccacttcctcagtgctagtaacataagcctggagcacggtggtgttcctttggcggtggaggaaggaggggatggtggtgctggcgacggcggtgtcgccgtagagaagggatacggaggtagggtcgtaggagaagatgattttgtcgttaggggaggtgacggagaatgtgggtcgttggggacggtagagaaagtagaggacggtgccggcggcaccgacgaggaggaggaggaagaggaggatcaggaggagccagcagcagagggtggaggcacatccgcgactacggcggcggcggtggtgctgcggttgggggcggtaggtggggcggttggcgccggaaagctgggatttcgtagcggggaatgtcggcttggggccggcgttggcggtggttttggccgaaggttaaaagatggagttatagatactcaggttttggtgatgggagaaagaaggttgcatggagtggggtag

SEQ ID NO: 76030 - DNA, 693 bp, Glycine max
  Peptide Sequence Number=SeqID_192808
atgtatcgattagctcgtagagtaggatcctccattgcttctccttccgctaagaatctcgtatatggtggagtattgtcaagcagaaattttgtgagcaaagatatcaactttggggttggggctcgtgccgcaatcctccatggggtaactgaggttgctgatgctgtcaaagttaccatgggacccaagggtcgcaatgtgataattgagagaagtcgtgggaatcccaggatcacaaaggatggtgtgactgtggccaaaagtacaacttgtgcaactgttttgactcaggcaatactcacagaaggatgcaaatcgattgctgctggtgtaaatgttatggatttacgtcatggaataaataaggcagttgatgctgtaattactgagttgaagaggagagcattgatgattagtacgtcagaagagataacccaggttggaactatatctgcaaatggggagcgtgacattggagaattgatagcaagggcaatggagaaagttgggaaggaaggggtcattactgtcgttgatgggaacactttggataataagttggaagtggtagaaggaatgaagttaaccagaggctacatatctccttattttattactgatcagaagacccagaaatgtgtaagtgcagactattcttttgtcagtaacatgtactccatccggtcttga

SEQ ID NO: 76031 - DNA, 1695 bp, Glycine max
  Peptide Sequence Number=SeqID_192809
cactggcatgaaaatagataccctggtatcagaaatgcaagctcattctcatcaccgtcaatttcaactaccaccggcaataatgcctatgactacataatagttggaggtggcacagcagggtgtcctttggctgcaaccctgtctcagaacttcagtgttttggtgcttgaaagagggggtgttcctttcaccaaccccaatgtttcgtttctagagaacttccacattaccttggcagacatttcaccaacttcagcttctcaatacttcatttcaactgatggagtctacaattcaagggcaagggtcttgggaggtggaagttctatcaatgctggcttctacactagagcaaacccaaggtttataaagaaggtggggtgggatgccaagctagtaaatcagtcatatccatgggttgagaagcaaattgtccaccgtccaaagttttcaccttatcagagagcatttagagacagtcttctcgactctggtgtgtcaccctttaatggcttcacctatgatcatctctatggaacaaaggttggtggaaccattttcgacagatttggccgccgccacacggctgctgaactgcttgcttcagggaaccaggacaaacttactgttttggtctatgccactgtccaaaagattgtgtttgatacaagaggcaatgctattgttacaggaaagaaaccaaaagctgtgggggttattttccaagatgaacatgggaaacagcacgaggctattctgtcaaatgataggcatagtgaagtgattatgtctagtggggcaattgggactcctcaattgctaatgcttagtggaatagggccaaaagcagaactccagaagttgaacatcccagtggtccttgacaacccctttgttgggaaaggaatggtagacaatcccatgaacacaatgtttattccttctaatagaccagttcatcagtcactcatagaaactgttggtatcaccaagatgggtgtgtacattgaggctagcagtgggtttagtcagtccaatgatagcattcactgccaccatggtatcatgtcagctgagctgtccacaattcctcctaagaaaagatcaccagaagctgttcaagaatttatcaagaacaagaaagacctaccggttgaattattcaagggaggatttattttgtcaaaagttgccaatccttggtcagtaggtgagctcaggctgaacaacaccaatgtgaatgacaaccctgtcgttaccttcaactacttcagtcatccatatgatcttcatcgctgtgtcaaggggatccgcttggccattaaggttgcccagtcaaaacacttcacaaactacactttgtgtgacaaaaaaacctcagaggaactgctcaacctcactgtcaaggctaatgtcaacttcataaccaagcatcccaatgacacagcgtcgatagcgcagttctgcaaagacaccgtgatcacaatttggcactaccatggagggtgccatttggggaaggtagtcagccctgattacaaggttcttggtgttgacagactccgcgtggtagatggctcaacatttgatgaatcacctggaacaaatcctcaagcaactgtcatgatgatgggcaggtacatggggctgaagattttgagagataggttggggaaattggctggtatataa

SEQ ID NO: 76032 - DNA, 722 bp, Glycine max
  Peptide Sequence Number=SeqID_192810
atggaagacagtttcagagtacgagcagagagagcctttggttctcttccaatcccttcttcttctctcaacactctctggtctctcaccgaagacgaaatcaataactccccttccaatcgcacccccaaacctaaacccaaaccctacccctcttcaagctcccgggttcagctccagaagggcctccacgatctcgacgacgacgacgacgacgacgacgaagaagaagaagagcctcgtggagtctctaaaccccctgattacgacgatgaacagtggcagattagggctggtattggccgagattgcaccctcgattacgaggaagaggaggatcaatatgacaagcaggctataggcaaagagaattcgggtgatcagattttgtcagagacccgcgtgcaaatcatttggcggccaaggattaggctgaagcaggatgacgaagcagcagccaaaaaaattgatgctctgcatgtctctgagaaatctgcaccagacattggtggtggtagtggcagtgatgttattaaccccaagtcaatcttgaagagtaaggataatctttcggaggccagggatgttcgcaaacgtgttcggtttgattctgaatgtgatgatagtggtaacgatgatgatgggcttgaaggaagaaccagggatgttcgcatgaagacctcttcaatggaagaggctacagcttctgaccagttgtcaaa

SEQ ID NO: 76033 - DNA, 948 bp, Glycine max
  Peptide Sequence Number=SeqID_192811
atggacagtaagaatggagtcttgtctagagggactggatttatggaaagctgtggaagattatatccgctacctaaaaaccccaccatagcccaaattaaaaaccacaaggaaagaaaaacaaaggcaaaggcgaggagttttagcagccaagcagcaaaatgtgacaaatacaagaactttgatggatcgggatcaagttcaaaatcaaccaatgcaaaaggaaattggaagaaatgttatccgccttgccaatactacagcaagaaaggtcatccttcatttagatgttgtagaagacctgatgctaagtacaatgagtgtaatcaaatggggcatgaagctgttatttgcagaaacaagaataaactacatggtgaagttgcaagggatattgatcaggaggaggagtacttgtttgctgctacatgtttctctagccttgaatctagtcaaaatcagcttattgacagtggtggtaataatcacatgacaaacaacaaggatccattcaaggaactaagcatatcatgcacattgaagaacaaaagctgtttgattgatgttggtgacaaagatattctcaaagtaaaaatgaaaggaaaaagcattgctttaaattcattggaggaggagcaaattgctttttcagtaaaagagaatctcacatcttggaatgttgttgctaaagcaaggttggcagcagcaaagggacaagaaaaatccactttagagaaagtagctattgtgcaaaagcatacaaacaagaagacacaattgagagagaaagctgcaaaaattgagcacaatgagaagtgtttaaagttcctgactaagaacttgaaagctgaaaatgtcaaggctcaatcacatgagaaggaagcaatagtatttcagcatcagcaggttaaagttctgaggaagaagataggagttcgcagcctccaa

SEQ ID NO: 76034 - DNA, 228 bp, Glycine max
  Peptide Sequence Number=SeqID_192812
atgggagttagaattgggaaagctgagagaaatagagaaagtggagaacaaagctttcatcatcatcataaaaaatgcaggaatcagatcgacgatgaagagaatggaaaaagcgtacccattagcgtgggattggaaacgattgttgagaaatgcggaaaaggaagatcgaaagagagaaaagcgatctcagactctcacgagacacaggggcattactattgttga

SEQ ID NO: 76035 - DNA, 1962 bp, Glycine max
  Peptide Sequence Number=SeqID_192813
atgaagaagaagatgatggcaagcaccgccatctccgtcgtcttcgccgcgctcttcctcttctcctccgtccactccttctacctccccggcgtcgctcctcgcgattttcaaattaatgaagatattgagttattgtttcatgtgtggcaccagggtgaccccctctctgtcaaagtgaacaagttatcatccaccaagactcaacttccatatgactactacttcttgaagtattgcaaacccaaaaagatattgaacaacgccgaaaatttgggagaggttcttagaggtgatcgcattgagaattcagtatatacatttcatatgaggaaggaacagtcttgtactgttgtttgtcatgaaattttggatgctgaatctgcaaagagttttaaagaaaaaattgatgatgaatatcgagtgaacatgattttggataaccttccagttgctgttcatagacaaaggagggatggaagtcaatcaacaacatatgaacatggttttcgtgttgggttcaaaggaaactatcaagggagcaaggaggagaaatattttattaataaccacttgagtttcagagtcatgtatcacaaggatcctgaaactggttctgctcgtattgttggatttgaggtcaccccaaacagtataaatcacgaatacaaggagtggaatgacaagaatccacaggtaacaacatgcaataaagataccaagaatttgatgcaaggtagtactgtcccacaagaagtagatacaaacaaggatatcgtattcacatatgatgtttccttcaaggaaagtgatatcaaatgggcatcacggtgggacacatatcttttaatgaatgatgatcagatccactggttctccatcattaactctttgatgattgttcttttcctgtctggaatggtggcaatgatcatgatgagaactctttacagagacattgccaattataatcagctagaaacccaagatgaggcccaagaagaaacagggtggaaacttgttcatggagatattttcaggccaccagtcaattcaaatttgctttgtgtttatgtcggtactggtgttcagatctttgcaatgacacttgtgacaatgatatttgctttgctagggtttttgtctccatctaatcgtggaggtctcatgactgctatggttctgttgtgggtttttatgggcttatttgctggctactcctcagcacgtttgtacaagatgttcaagggcacagaatggaaaaggaacaccttgaaaactgcatttatgttcccaggcattctttttgctgtcttctttgtgctgaatgctttaatctggggggagcagtcctccggggcagtcccttttggaacaatgtttgctctagtctgcttatggtttggtatatcagtacccttggtctttgttggcagttacttgggttttaaaaagccagcaattgaagacccagtgaagactaataaaattcctaggcaggtacctgagcaggcgtggtatatgaaacctgtcttctcaattcttattggaggcattcttccatttggggcagtgttcatcgagctcttctttatcctgacatcaatatggctgaaccagttctattacatctttggcttccttttcatagtgtttgtgatcctattaatcacctgtgccgagattaccattgtgctttgctacttccaattgtgcagtgaggattacaattggtggtggagatcttatctcactgctgggtcctctgcgttgtacctcttcctctactcaattttctacttctttaccaagttggagatttcaaagctggtatcgggcatcctttacttcgggtacatgataattgtttcatatgccttctttgtgttgacgggaactattggcttctatgcttgcttctggtttgttcgcaagatctactcgtcggtgaagattgactga

SEQ ID NO: 76036 - DNA, 234 bp, Glycine max
  Peptide Sequence Number=SeqID_192814
atggcagctatgcgccgatggccactttatcagttggatatcaagaaagcattcctacatggtgatttagctaaggaagtttatatggggcaacatcccgagcttgttgctcaaagggagtctagtggatttgtttgcaatatccaagatgatattgttgttacaatagatgaccacaggggtatccaagaccttaaaatcatttgtcttggcacttttagactaaggatttag

SEQ ID NO: 76037 - DNA, 240 bp, Glycine max
  Peptide Sequence Number=SeqID_192815
atgaggaatggtgttgaagaagctggccacacccaccatgcaaacacattcacaagcgcagcacacggtggtcgattgcactttggattcaacgacaacaatgactgtcgcgacaacattcacagtcacatggaattgttgcggttgagccgtggccggggaagtcagagtcacgagagagagagagagcaaagagggtcagaggttgagggcacaattcaaaaaggagatacacagtaa

SEQ ID NO: 76038 - DNA, 465 bp, Glycine max
  Peptide Sequence Number=SeqID_192816
atggttcattctgatcagtgctcacgaaacccttcttcctcccaaaccaagaaaaccaaaaccctcttcttgatctctctgctcctcttttcctctttcttcatcatcaactccgcactttccctctttgacgcgcacaactccaacgacgctgttggcgccgcgctccaattacaagtcctccccatcgcgttcgtcttcctcttctactccctcctccctctcctcagcctcagcttcaccctcccctctccgctcctaaccctcatcggcgccttcgcctttgccaaagagtttctcttgttctatctccagcgaaaggaccccagcggcgtcgagaatcactactacaatctcttgttggtgtcaattgccgtgtgcgtgttcggcacggttctggagctgggatcaccgcgctccgatggcatcgccagattaggcttaaaagttacctccttcatataa

SEQ ID NO: 76039 - DNA, 420 bp, Glycine max
  Peptide Sequence Number=SeqID_192817
atgattcactttaatatacaagacaatgaagaacctttcatagagttgaacaaggtggatcgaaggcatgggaagaggcctctcccttctgatcatgcatcaagggagagaagggaaggtttcaacttttctgttaaccaatctccacctaagagccaagggggagaagcttctcaattctcctttatgcatccaatcaatactggtgatgatagcaccctttcttcaccaattccacaatatgggcaaataagcaattcttgcttgattgagactcaggacccatccctacagcctttaaatcaaggtaaaattgccagggcattcgatagaagactccaagaagattgggctagagatgcaagaaaaggtgctagggttctcatgagccttagggtagatttcagactcatgggctaa

SEQ ID NO: 76040 - DNA, 162 bp, Glycine max
  Peptide Sequence Number=SeqID_192818
atgactcacagtcacagtgaatcggtgataattgcaagagttcagaggaacacgagagccgagattttggctcttggtggctattcacgggagagtgagagagcggagagaccgagagcaaagatagagaggtttagcaagagagtgtgggacagagactag

SEQ ID NO: 76041 - DNA, 1254 bp, Glycine max
  Peptide Sequence Number=SeqID_192819
atgtggaatgtgccactactcttggtggtggtggtgtttgcatgctcactgattggtcatgcttcagcttctgtgtcctatgaccataaggctatcaccatcaatggacaaagaaggatactcctttctggctccattcactatcccagaagcacccctgagatgtggccagatcttattcagaaggcaaaggaaggaggtttggatgtcattcaaacttatgttttctggaatggacatgaaccttcacctggcaaatattattttgggggaaactatgatctggtgaggttcataaagctggtgcagcaagcaggcctctatgttaacctcagaattggtccttacgtttgtgctgaatggaactttggaggtttccctgtttggctcaagtacattccaggtatcagcttcagaacagacaatggaccgtttaagtttcaaatggaaaagtttaccaagaagattgtggatatgatgaaagcagaaaggttattcgagtctcagggcggtccaataattctgtcccagattgaaaatgaatatgggcctatggagtatgaaattggtgctcctggtagagcctacactcaatgggcagcacatatggctgtaggacttggcactggggttccatggatcatgtgcaagcaagaagatgctcctgatcctatcattaacacttgcaatggtttctattgtgattatttctctccaaataaggcttacaaaccaaagatgtggacagaagcttggactggctggtttactgagtttggaggtgcagttcctcacagacctgctgaggatttggcattttcaattgcaaggtttatacagaaagggggatcatttgtcaattattatatgtatcatgggggaacaaattttggtcgaactgctggtggtccctttattgctacgagctatgattacgatgcgcctcttgatgaatatggattgcccagacagccaaagtggggtcatctgaaggatttacatagagcaataaaactctgtgaacctgctttagtatctggagatcctactgtacaacagcttggaaactacgaagaggctcatgtttttagatcaaagtctggggcttgtgctgcattccttgcgaactataacccacaatcttatgcaacagtggcatttggaaatcagcgttacaacttgcctccttggtctataagcattcttcctaactgcaagcacactgtttataacactgcaagggtgaggcaataa

SEQ ID NO: 76042 - DNA, 333 bp, Glycine max
  Peptide Sequence Number=SeqID_192820
atgggtaaagcggaggaggtaccagaaaagatgaaggccgacatggaggccatgaaagagcaaatggccctgatcatggaggccatgatgagcatgaggaagataatggaagccaatgcggttaccattgctgctaccagcactgttgctaaggtgaacccgatgcccccatctagcctcaatcaaattaatcatccaaccttagctatggtaggcaaagatttgggaagtacgaatggccccatgatgtgcaaattcaaaacaagcacgccttcctgccatatggcttacctcccaacttacaccagccaatgtggcgtacactcccaatga

SEQ ID NO: 76043 - DNA, 418 bp, Glycine max
  Peptide Sequence Number=SeqID_192821
atggctccgaaaaagctttccgcaaagagatctaggaaggacgccacggctgaagggaccagtgccgcccccgagtttgacagccatcgtttcaggagtgctgagcaccaacagcgtttcgaggccatcaaaggatggtcattccaccgagagagacgcgtccagcttagggacgatgagtacacggatttccaggaagagatagctcgccggtgttggacgtcgttggtcactcccatggctaagtttgacccggatgtagtcctagagttttacgtcaatgcttggcccacggaggagggcgtgcggaacatgcggtcatgggtaagaagccagtggatcccttttgatgtagacgccctcagccagttcctcggagacccgctagtgttagaggagggccaggagtgcgagtata

SEQ ID NO: 76044 - DNA, 162 bp, Glycine max
  Peptide Sequence Number=SeqID_192822
atggagaacaatcagaggactgctattatgaggtttaattgtggtagcggtagcaaatccactactttctcaactcagaccatttgtttcaagtgtgatagaaaggccatattcagagagattgcctatatcccaagaaggagcagaatggtgggggtttga

SEQ ID NO: 76045 - DNA, 147 bp, Glycine max
  Peptide Sequence Number=SeqID_192823
atgaccattcgctcagtgaatatgcatagctcatcctccttccagattcttcctcatgctcagccgagaagtgttgcgcttagcggatgtctccctaagccagaagattggcttagcgagaggttttgcttgtcctcaagcaaataa

SEQ ID NO: 76046 - DNA, 483 bp, Glycine max
  Peptide Sequence Number=SeqID_192824
atgtgggcttttcttatcgatcgtcagttcgattgggcccacttggttaagtaccataggcataaggcattacggaccaaggcacctcttccgtatcctcagttagtcactctttttcttcgtcactttcaaattcctctagatgatgaaccttttgttcaagtcaagagatctttggcaattggtgctggagtggtaacttctttcgggtaccgtaagtatattgatggacaatggattaggaaacaagatttaccaccatcgattcctgatgagcgtactccatctcctccgccacaaagagatgcttcctctactcttatgaatgaagtcctttctgaactacgtggtcttcgagcgttcgtaggtgaccgtttggatgccatggatgctcattttgaaggcatgggtacacggattactcagcttgaagacgacatgggtttcattcgccgttgcttcgatccaccggctgccccatag

SEQ ID NO: 76047 - DNA, 222 bp, Glycine max
  Peptide Sequence Number=SeqID_192825
atggaagacgcactcgtgacccatccaagagtccttttcgcgcctcccgctggagagcaggttgtgacagttggcaacttcactggggaccttagaaatatttttttctacgcacacatgacacctacagctcgcacacacattgagatattaggccctatacccagttctatgcgagccataaggagtggaggtcaatctatggtcatgctgggtctctga

SEQ ID NO: 76048 - DNA, 636 bp, Glycine max
  Peptide Sequence Number=SeqID_192826
atgacttctatagcccagtctagaacttctagacttgagtttcctgctctgatcaccaccctatgtagagccagaggggttgtctctaacagccttacatttgaatgcctgagcccggtcattaacttggcctacatcaggaagaactgttggaatcccgaggatctaacagtttctatccgagggactaggagggcgagagcgaggccaactgagcttccatccacatctacaactcctactccagcatccacttcagcagctccttctgtcccagctcagacagattctcaacgctttaaagccatgcttcaaagaattcatcagggacaaatcattttattacagagtttactggtggtggtgcctccaggatctattccttcagatgagtcatctaaggccaccattccagagccaatcgttataggggaggaggtaggtgagacacaggtgagacaggtagctgctgccactcctgagagatctcttgaggccacttcagagcctcttgcaccagtggaggacctaccctcacctcagcatgcaacagacccttccactcctatcctagagataactgaggacccgaccactccagtcctgactctggacacttttcctccagctactcca

SEQ ID NO: 76049 - DNA, 147 bp, Glycine max
  Peptide Sequence Number=SeqID_192827
atggctgatttttcaagtttaaaacggaaacagaccccagtcgctaatcactattcacagcataacacaaagctgaaacagtcgctaaaagcagttgctaaacaggggacaagactagaatgcataacagaatgctacacaaaataa

SEQ ID NO: 76050 - DNA, 549 bp, Glycine max
  misc_feature (524)..(524): n is a, c, g, or t
  Peptide Sequence Number=SeqID_192828
atggcagatgatatcatattcaatcatagaaaacaaggtattcgccttactgaaaaggaaacaattcatttatgcttaactgagattgagaatatgctacaagcgaacagaagaagcttgcgagattttctatccatcccatacccaattggatatgcacgaaaccaacatcataataatctgatccataatgaaatggcatatgacaaagaaatgttagcaaaacaatacaacacggcataccaattgctgacagatgagcaaaaaactattgtcgataccattatgtctgtggttaacactcaatcagctgcaatttactttctctatggatatggtggaactggcaaaacatttgtttggacaactttatcatctggtatacgctccaatggtggaattgtttgtacaatttcttcaagtggaattgcttcattactattgcctgttggtcagactgcacattccaaatttgctataccagtccctgcaacaaaaaattcaacatgcaatattcatcaagnccgtgagttagctgaattattaaag

SEQ ID NO: 76051 - DNA, 732 bp, Glycine max
  Peptide Sequence Number=SeqID_192829
gacggcctggaaaccatccagctgggcgtgggctaccgtgtcaacggtgaattcccgcgacgtgctgccgtacggcgcgcatgccgtggcgcaagcccagccggtgctggaagaactgccgggctggagcgaatccaccgtcggcatcaccgagtacgacaagctgcccgaggccgcccgtcgctacctggagcgcgtggccgaagtctgcggcgtgccgatcgacctagtgtcgaccggtcccgaccgcaacgaaaccattgtgctgcgtcatcccctgaagggctgacatcgggttatcattcgcaaggccgccgccggtctcctaccggcggcggccttttcgtattttcacgcaggagatccttgcctatgagcgcgccaaccagtgacgatagccatctgtgggtgacgtgggacgactacaaccgcttgatcgagcgcctggccttgcaggtgcaccagtccggttgggagttcgataagattctgtgcctggcgcgtggtggcatgcgcgtgggcgacgtcatgtcccgcatttttgatgtgccgttgggcattctggcgaccagcagctaccgcgaagctgcgggcaccaagcagggcgatatggatatcgcgcagttcatcaccatcacgcgcggcacgctgtccgggcgggtgttgctggtggacgacatggtggataccggcaagacgttcatgaaggtgtacgaccacctcaagagccag

SEQ ID NO: 76052 - DNA, 321 bp, Glycine max
  Peptide Sequence Number=SeqID_192830
atggggggaagcgagcctgttgacgcacagagactaacgtcgtcatccacacctttggcggagataccttatggtcatccgcacctttcatcaatcgaggcgaacaaattcgacggtatcaggatgatgttgtcgtccggagacattcaagcccaacaacgcacgagattcttctctgctgggcggggacgatcatgttcgatagcacgtggaaacgtcgtgggtgcaaatagtaaccatgcccacttgggcattccagggggttccaacagaaggcggtgccttttggtggaagcaacccagctcgcctgggcgagctag

SEQ ID NO: 76053 - DNA, 426 bp, Glycine max
  Peptide Sequence Number=SeqID_192831
atggctaagtttgacccagatatagttctagagttttatgctaatgcttggcccacggaggaggacatgcggtcatgggtaaggggccagtggattccttttgatgcagacaccctcagcctattcctgggtgacccgctggtgttagaggagggccaggagtgcgagtttagattttgcccggaccgctgccgggagacgggtgcggatcttgtggcatggagcggtatttacaacacttggttcaccagcaggcgcccaaccatagggggcaggtgcagatacatgagtgtctctaccagctcagcctcagtcagtagaaccagggtttcactccttttgcgtgccctactccagatcagttcagggctgaggttgcatggcccggagattggcctgaggcccaggcaggggaggcgcccgtag

SEQ ID NO: 76054 - DNA, 836 bp, Glycine max
  Peptide Sequence Number=SeqID_192832
cattccctaccaccagacggcatcgggcggtattaccactgaagagaggatcggccagtgggcgctggaagatagcgtgacgccggggatttacagcctcgatgactatgatttccgtaaacctaacgcctggctgtttcaggcgcggcagaacccagcgtcgccctcgccgggcagtatcgacgtgtacgactggccggggcggtttgtcgatcacggacacggtgaattctacgcccgtatccgccaggagcgctggcaggtagaacatcagcaaattcaggcgtccgccaccgcggtgggcatcgctcccggcgcaacgtttactctaactaatgcgccattctttagcgataacggcgaatatttgacgacggccgcagattacttgtttgaagagaacagctacgccagcggcggtaatagcgatatctcgcaccaaatccattttagagtgatcccctcttcggtagtctatcgcccggcgcaggtaaccgactggccgcgcacctatggcccgcagacggcgaaagttgtcgggcctgaaggggaaagcatctggaccgacaggtatggccgcatcaaagtgaagtttcactgggaccgccacgctaaaggcgatgacaccagctcctgctgggttcgcgtgtcgagcgcctgggcaggtcagggctttggtggcgtgcaaattccccgcgtcggcgatgaagtggtcattgattttatcaacggcgatcctgaccgcccgatcgtcaccggacgtgtgtataatgaagccagcatgccgccatgggatctccccggcgacgccacccggatgggctttatgacgcgga

SEQ ID NO: 76055 - DNA, 240 bp, Glycine max
  Peptide Sequence Number=SeqID_192833
atgaaattaccaaagtttttattagcagacaattcggaatttcctgaggatttattcgtggttcatacagaatacccaagatttatcttgaacgttgaggaagaagaagttgagtggctggatgatttggaaggagacgatgaagagaccatggcagacgaagctactaaagtggtagaagcagcgttcaaatggtgtgacgaagaattagctaaatacgacgaagaagaggaagaataa

SEQ ID NO: 76056 - DNA, 288 bp, Glycine max
  Peptide Sequence Number=SeqID_192834
atggagagtaacgcggccaccgccgctgctgttattttggctaccgaagcagacccaactctcttaactgccgtacaccccccttttccaaacatggtggaacgagagaaaagcacacatgggcatgtcagcaacccgcattcgggttataaccgaggaacttacccctacggtttaccacctaattacacaccacccgtcatgcatgatgacgtgggtcacgttcctcccctcatcctcgagggggagcctcctcgacatcctgacgaggtccacaatgatatttaa

SEQ ID NO: 76057 - DNA, 972 bp, Glycine max
  Peptide Sequence Number=SeqID_192835
atggcatcaaagaagagaaaggcacctgccacaccttcccaggcttgggaaaggtacacagacatagtggtgcctagaaagatacttatagagagaaatgtggtgatataccatactaagttcgatgatttcaaagaagagcttgagacaagaaattggcatgaagagttaaccagctttgcagaaggcaacattgatgttgccattgtgaaggtcagaggtcatctagtgaagtttgaccaagacaccctcaacacattcttgaagacccctatgatcattggggagggggaaacactatctgcttattctaggttcacactcctgaggcctgatcctcgggaattggcagccaagctctgtatcccagggaggggatttgagcttaatgctgatggcttgacattgaagatcctcagaaagaacctgactaccattgctcagacttggagcatgctttcattctcaaacttggtccctacctcacacacatcagatatcactctggatagggccaagttgatttatggaataattcagaggatggacatgaatgtgggctacttaatttctcatcaaatctgtatgatcgcccagcacgactcctctaggctcgggtttccagccttaatcactgctttatgtaaagttagaggagtcacttctaattctaagacgctggagagtctcagccccgccattaatttggcatatgtgaagaagaactgttggaatcttgatgatctaacagtgacttttagagggcctaggaaggccaaggggaagaaatctgagactctttcatcttttgaggttccccctaccacatcaactccttccacatcagcaccaactttttctaccctagctacttctgcttcatcaccagctcagctaccagttttagctccttcttcttctgaaccatcagatttttcttttacaccagagatgctacatgtcatgatttag

SEQ ID NO: 76058 - DNA, 300 bp, Glycine max
  Peptide Sequence Number=SeqID_192836
atggagaattggcgaacagcgctacgcaataactttgcggggctccagagtcgtaggtggaggatgcatgaacagcgccaggcaatgacattcatggggctccgtaaaaaagtggagaatggagaattgtggagaatggaggattggcgaacagcgctacgcaataacttcgcggggctccagactcgttggtggaggatgcatgaacagcgccaggcaatgacattcatggggctccgtaaaaagtggagaatggagaattggcgaacagcgctacgcaataactttgcggggctctag

SEQ ID NO: 76059 - DNA, 396 bp, Glycine max
  Peptide Sequence Number=SeqID_192837
atgatggcacatcaaaaccccccatacttagccttttgcactcctgggcaaaatgaaacaaagaacaaaatccaaggatatcagagggagacaaacaaaaacattcacatatttctcaatgaacatccaggaatgaaaggaatggcctttgagaaacaacatttcattcagcatgcttgtagtgagcttcaaaacaaggaaagggaaacaaggctcaaaagggctatcaaaggaattaattcaaggacgcatcaacaagaatcaagccaaggttattgtgcaagcaatcaatggggcaaaacacaccaaatgattataatgatggatggctcaaattctaacaaaggtaaaatcatcactttcaaattgagctttcaaaactatcatgacatgtag

SEQ ID NO: 76060 - DNA, 362 bp, Glycine max
  Peptide Sequence Number=SeqID_192838
cgaccgatccagacacgggtgactcagacaaatgcaaattgtacatcgaagaaaatcctccttgcttggttgccctaggaagagtttatgagggatccacagtcgttcacaacatccctttgttgcatgatcaagtgaaggttggtgttgaggaggttaaagatgcagatgctcccatttctatacccactgacaagggaattgtgggaccagcaaaacctgcagataggctggatcctaaggttatgtgggatgtttccctgttcgggctgtttaatttagacttccccttgtacataaagcatgaagatctgtctgaaataacacacgatggtcaatgtctcaacatctctgttatatag

SEQ ID NO: 76061 - DNA, 171 bp, Glycine max
  Peptide Sequence Number=SeqID_192839
atggctacaaagaaactcccagccaagaggtccaggaaagatgccactgaagagggctccagtgcggccccgcaggaggatatggactttgataggcataggtttcggagtgtggaacaccagcattggtttgaggccatcaaaggctggtcattcctcagagagagacga

SEQ ID NO: 76062 - DNA, 323 bp, Glycine max
  Peptide Sequence Number=SeqID_192840
agtccattctatcagtagagcagttcattgagaaggtatcctggcctggaaccttactttctactgtgggagagggagtagagatgagacctgagggggctactttttctgagccaattgtgccagctatacatgagactattgaagcagatcctcctacaccagtacatgagagaccaattgatcttcctacacccatcatggagatgccagaagaccctaccacaccagtcctaagacagtcatccactcctccagctaccccagttttacatctgacagataaggaggatatgcaggaccaggacacacaaggcacatag

SEQ ID NO: 76063 - DNA, 792 bp, Glycine max
  Peptide Sequence Number=SeqID_192841
atgtcagatatcaaacttttcatgttccagtcaggaacgcagcaatgtaaatatcagcatattcggatgaatcagggcgcaggcgaacgttatgaaattccggttccctggtttctgctgacccatccggagggttttaccctgattgacggtggtctggctgtagcaggattgaaaaaccctgctgcctattggggaaagggtatagagcagtttaaaccggtgatgtcagaagaacagggctgtctggaacagcttaaaaggcttggcatcgctccagagaagatccgctatgtggtgctgtcccatttgcacgctgatcacactggcgcaatcggtcacttcccccatgccactcatgtggttcagaagcgagagtttgaatatgccttagatcctgactggtttacatcggacgcctattgccgacacgattacgatcgtcctgaactcaactggctttttctcaacggattgcctgaagataactatgacctttacggtgatggcacgattaagtgtgttttcacgccagggcattcaccggggcatcaatcttttcttatcagcttacccagcggtaaacattttatgctggcgattgatgcggcttataccttagatcattaccatgagagggcgctccctggactgatgacgtcagccacggatgtcgctcagtctgtccgaaaactgcgtcagctaaccgaacgatataacgcgacatttatacccgggcatgaccctgaagagtggggaaaaatcaggcttgctccagcctggtacagttga

SEQ ID NO: 76064 - DNA, 165 bp, Glycine max
  Peptide Sequence Number=SeqID_192842
atggggggtgtagtgaccttgttggatatccctggtgggggaaatagagtggaatacttgtacttgggggcatgtcacttggtttggaactcccttgagactcaggctgataactgggggggaggagttgcctgtgcacgacaaggtgacctcgacacttactga

SEQ ID NO: 76065 - DNA, 384 bp, Glycine max
  Peptide Sequence Number=SeqID_192843
atgttattgcctagtgctgttcatgtgtcctccattatcaagcacgaagcctctggtgactgggaaacacgttattctgttgttttcctgatcggttccttcgccaaatatgtaagaaaaaaagaaggagtagagacgagagtcgtcatcacggaaagggcaggacggacgaaatcagtgtcctatctttgctttcctcttatctccgatgagaggcgaggatgggcattctcaccctgggtcaaggtttatggtgagttgggattttggctcaaggcttgtagaacggctggacacgatatatgtcagagtgttggtttggccagcggtttagggataaaggggatgtcccacattatttccatgacacacatgcaacaatga

SEQ ID NO: 76066 - DNA, 182 bp, Glycine max
  Peptide Sequence Number=SeqID_192844
ataaccacttgggcacctccacatgtcacctgacttcatgggtctggatgacaaaaaccgtttgtacggataaccgcttgggtatctccgtatgtcaccgaactcgccgtctcgggatgacaaaagttgcggataaccatacggcacccccgcatgtcatcgaacttgtcgtctctagatga

SEQ ID NO: 76067 - DNA, 623 bp, Glycine max
  Peptide Sequence Number=SeqID_192845
atggtcgatgaagtacttgcggttgggcaggcgggtgacggcgtcccgatggatttcgctctgcagcgattcgattcgtgcgttctgttcctgcaccgtcgcggcgacctgccgctgcgcgtcgaccagggcctggtccgtcagttcgctggggcggccgggcgcaccgccgtccggcgcctgcacgcgtgcccggtcgtagatctcccgggcggcgcgcgcttcgatccagcgcaacaggttggcggcgaacagcacccagaagacggccgcggccaacgtcaggccgatgacccgcacgccgccctgccacagcgtgtcgcgcgccagccgggcgtcggcctggaccgtgaccgtgccgagccggcggccgtcgggcgcctgatagggccgggtggccgctggcgcttccatcgccagccagccgttgcgccagtcgcgcgccaggtccagccggtcggacgcgggctcgcgccgctcgacttgggtgtccccgttttctcccgtgatccgcaccatggcgtatgtgccagccgcgaagaggtcatcggccagcctggacttgtcctggtcgtcggccgcgtcgtgcgacagggcccaggacagggcgctcgcaccggcct

SEQ ID NO: 76068 - DNA, 202 bp, Glycine max
  Peptide Sequence Number=SeqID_192846
atgggtaatcctgttttgaaatcgtcccgccctgcaccctccccgaggagtatatgcttcaacaaaaatcacacaggggaattggcgacttacccattcaatgactttggcaccggacgttcccaaactggaatgtgtattatcgatataggggatctttcaattgagaagatccatcgacctgagacgaagagaaagaaag

SEQ ID NO: 76069 - DNA, 264 bp, Glycine max
  Peptide Sequence Number=SeqID_192847
atgcaagttaaacatgttggtccacgaacccacgaattaaggagtcaatgcatattaaggctgaattgggaagcacgcgccgtttggagcgtgaaagatagatctaacgatcataatctgcttatgagtgagtcattcttctggttcacacagaagaacagaacagaggtaacgagtggagaaagaaagaagaagcacataaccgaaacgacaccgcagcaggagtttgcatggtctccgtttcgtgcatccccaaaaccctaa

SEQ ID NO: 76070 - DNA, 820 bp, Glycine max
  Peptide Sequence Number=SeqID_192848
atggcatctcagaaaagagaatccattgcttcttcatcttctcagctcaaatatgatagatacaaattttcttcccctaaagcatgggatcgctacaccaacaacatgttcggcagaaagatcattcctgaaagaaaggtgcagctgtcatttaatgactttgaggaatttcaaggggagttaaacaggaggaactggcataagaaaatcgctaatttggaagagggaagcatagatgtggcacttgtaaagaagttttacacaaatgtttatgatcacgaagacaagtcaccaaaacaggtcaaggttagaggacaatggattccatttgactcagctgccgtcaactcttttttagaaacaccagtggtcatagaggaaggagaaagtcttccgacatatgcaagatttgtgttgctaaggccaaaccagcaagagttagcagcctgtttgtgtatcccaggcaagggatttgaattgaattcagacggattacccttgaagattttaaggaaaaatttgactacttttgctcaaacttggagtgtcttttctttttctaacttggcccccacctctcatacttctgacatcaatttagatagagccaagttagtatatgcactcatacagaagatggatatgaatcttggttccttcatttctagtcagattacactcagagcccagcatgactcgtcgaggcttggctttcctaccttaatcactgctttatgcaaagcccggggagtccgctctgacttcctgaccttggagagcttgagtcctgccattaatttagcatacattaagaagaact

SEQ ID NO: 76071 - DNA, 456 bp, Glycine max
  Peptide Sequence Number=SeqID_192849
atggctccaggaagcttccttgagaagctttctcgagaggcttccttgagaagcttcctcgtgaggcttcttcgagaagcttccttgagaggcttatttgggaagctagagtggtgcgaagagtggagcttgaaatcgaggtttcctcaactttaccaaatgccggagaacaagctaagccgggtgagggatatggggaggtgggctcagatgatagatggatctagactgttgattgttctaatatcttctcagttatatttagaagattctggtcatgagatacaacaattatatataaaaataggtagatgttttgtggggaaaaagggtacacagatgaaatacttggtgtggtatgcgacatgttggtgcatctggattacaggaaactcagttatttttaggaacaagtgttttttggctatggagatgcttacacatattaagatatag

SEQ ID NO: 76072 - DNA, 252 bp, Glycine max
  Peptide Sequence Number=SeqID_192850
atggttgccttgaagtatgctcaagatgaggaagctgctgatgatcaagaggagacaggatggaagtacattcatggggatgttttccggtttccaaagtacaagtttttcttttcagcagcccttggttctgtacaatctttatgcttgtgtaatgtgattttcactagaaataatattatctactccgatattagtaattcagttagttttcatattgtccttggtttaaaggatatggtcaatggctag

SEQ ID NO: 76073 - DNA, 1316 bp, Glycine max
  Peptide Sequence Number=SeqID_192851
atgggactaactgaaggagttgatgatattgctaggaggagagaccagttggcgctattgcaaattcaacaagggggagtagaaaaggcccaaaagtcgaagctgcaatatctgcgaatagaatatgaaagaggatgtcctgacaacaaggtggtagataaaattctacgcaccatgccaatgaagtatgataatgtgaagataggaaaagtaagtgaagaagcattgaaaattcaaatgaatgtagttgaatccactcaaggagcagaagccaaaagtcgaggaaatttcgacaacggagaaagaggatatttgagacgaagagatcgaggaaattatagaagtagaggatgcaaaaatttcaatcaaggaagagacaataattttggagcttttaatgaagggagaggtgcaggtaattttggtgctgcaaaccaaggacgaggtcaaggtaacaattaccaaggtcaaacttctcacaacttattaagcatggaacaactatcagagaaaggttttaacatgaagattcatcagggctattgcacgttgattgacaaaaatggaagattcattatcaagcaaaaatcagaagcttgtgatgctttcaatgtgttggtagagaagcaaaatgggtgtagaatcaaagtacttcgaactgacaaaggacaagaatatctcacttgcataactttccttgaccagcatgggattcaacatcaattggcaacaagatacatgcttcagcagaatggagtagctgaaagaaagaatagaacaatcatggatatggtgaggtgcatgtcgaaggccatggaaatgcctaaggagttatgggcagaagcaaaattggacgataaaggagaaaagtgtattttcattggctacaacacagagtcaaaagtctacaagctttataatctagagacaaagaaggtgattattagcagagacgtggcgtttaacgagaaaggcatgaaggattggtcttcaaagaatcctcaactctcagctagattgcaagattatgtcatgtttaatgacaaagatacatctaatgaagagattatcaattttactttatttgcagactgtgatccagttatttttgaagaagcctcaagtgacgagaattggagaaaggcaatggatgatgagattcgtgctattgagaagaatgacacattaaaatgggtgtacaagactaagtacaatcctaaaggagaaattgatcgcttcaaagcaaggatggttatgaaaggttataaacaaaaaccaggtatcggttactttaaagtatttgctcttgttccaag

SEQ ID NO: 76074 - DNA, 423 bp, Glycine max
  Peptide Sequence Number=SeqID_192852
atggttgcatgccatgatttccttcagctgactcatgccagggaaataaagccactgacccaacattccccgctcaacaaaggcaccgtagtgaaggagaataatctcaatgaagttcctatatctaaaccatcatcagagaagaaagaagactcaattgtgacaccgaagaatggtgttgcgagttttgggaattcaggtgcagcctacacaaatgctttccgacccacaacaccagggaacagtcctggtgttggtcaccgaaaatttgcactagaagataaagatatgaaagcaacaacaaaggtggtagttgaaagttctgatgttaaagtttatgttactgaggggacaacgacaaacggtttcaaacctacaaacccaggtcacagtcctggtgttggtcatgatcaccaaaactaa

SEQ ID NO: 76075 - DNA, 468 bp, Glycine max
  Peptide Sequence Number=SeqID_192853
atggagaaaccagattatggctttaaaggtattgcttttaaacacttatgtcttgaggatagtttgtctctgatttcccctttcacggaggtagaagtcaaggatgctttttggagttgtgatggggataagggcccgggcccttatgggtttaattttaacttctttaatgttttggcctcgagattgaagaaagttttgccacaagtgatttcaatgagtcaaactgcttttttgctaggaagaaatatattggatggagttgtgatgcttaatgagttggtgaattttgcctcgagcctgacaaaagaatttgaggctcaaagggggttgaaacagggggatccattggcaccttttttattcattatagttgttgaggctttgataggcttgatgaacaaagctatggagttggggaggtttagggggtttcaggtgactaagggattgatttttccttattaa

SEQ ID NO: 76076 - DNA, 453 bp, Glycine max
  Peptide Sequence Number=SeqID_192854
atggggtgtacccatgggcccgaaatctaccctaaggctcataagaaccctagggccttctcttgcatctctggcccaatctacttggagttttctatccaatgcccttgcggggtaggattgcatcaatccgtctccaagggagaaaatgagcggagtcgccaccaacgtttattcgaggaaaacgttagaaaaaccaaaaagaagtccttgaatttggaaaagatggattcgggagtcgtttacggtcgacaagggtgttgcccttgttcttacgaatcctcaggtgcaatgaagaattcaaacctacctagttctttatgtctgaagcaaaagatggcatttgggaccaaggaagcctgccctggcgagctgatgcttcatcctgaagtaactggctcgcctaggcgagctggttccttcagccctaagcaattcgggggcccaggctag

SEQ ID NO: 76077 - DNA, 257 bp, Glycine max
  Peptide Sequence Number=SeqID_192855
gctaagcatgcatccaccgtgaagcgcaacttcaacgcaacagaagaatctggcagagcatcaatatcaaggtcgtgcgctaagcgcgagatcagtgcgctaagtgcagcagttgtcttctgccgggctcagcgcacgactgacactaagctcaaatccacttactcggcacagaattctacagcacaccacaatgcctattttgggaaaagagctctggaggcagcaagaggaacaacttttgcaaaaatacctag

SEQ ID NO: 76078 - DNA, 489 bp, Glycine max
  Peptide Sequence Number=SeqID_192856
atggtgagtattatggaagatacagtgaaagtggacaacatcccaatccacttgctaagttccttgaaaggcgtggtacttgtgctcaatacacaatgccagggttcctatacaagaattgttgaaactggaaatgccaggttcattgagaatggtgaaactagtgagagtgaagcttcacaaaatgtggagattaaggaagttagagtacaagttcctttaactagtgcttctacttcaagaatttttgttccttatactgttgaaccccacaacaatcaagaagaacaacaaattaatgatcatgaggttaacaatgaacctatagtagaacaatcacaagaaatggtattaagaagatctcaaagagaaaggagatacgctatttcgaatgactatgtgatttatctacaagagtcagaaaatgaattaagcattggtaatgatccaatttcattttcaaaagccattaatggtgatgattcttga

SEQ ID NO: 76079 - DNA, 489 bp, Glycine max
  Peptide Sequence Number=SeqID_192857
atggagacttttcgagtctcacaagttatccagaactacgtaggcggcgggcccgatgacaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacgagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcacccctttgctag

SEQ ID NO: 76080 - DNA, 1039 bp, Glycine max
  Peptide Sequence Number=SeqID_192858
caccggcagctacagccattccaacgtggcgctcgaccaggtgtaccagattggctggaacagcaacaatccggacctgctcaaccgctactactccggtgagcgctcttcgctcagcgcatgggcgaccgataaccagctgcaggcggagtttgccagcggtgcgctgcagcatcgcgtcacgcttggcgcggagtatcaccgctacaaaaatgatctgagcgacgccagcggcgctgcctcaccgctgaatgcctggaacggcgaggccatcggcagccagccggattacctctggacagcgcagacgcgccgctactatcagagcggcctctatctgcaggatgagatggcgtggcagcgctggcatctggatttgtctggtcgctatgaccgcatcgtgtcagagaatggcaatagtcgtcgtcaggacgatcacgtcagcggccgcgccgcgctgctgtacgcctttgataacggcgtgtcgccgtacgtcagctggagccaggcgataaccccggcttcgctgaccgatcccgacgggaaccagctgaaaccgaccacctcagaacagtatgaagccggggtgaaataccagccgaacggcacgcgcgatctctacagcgtggccctgtacgatctgacgcagaacgatgtggccaaccgtaacgtgcaggacggcacctacaccccgtccggcaaagtgcatgcgcagagcattgaactggaggcgcgcagccaactgaccgaacggttcagcaccattgccggttatacgctcaaccatctgcgctttaaggattccgtggacggcaacgatggccatacgccttacgtcacgccaaatagcatggcgtcgctgtgggggcattatcagtttgattacggcctgagcgcgggtgccggggtgcgctatattggccgccagtgggccgataacgaaaacaccacccgtttgccgtcggtgaccctgtttacactcgctgcgcgccgatctggacgcgtggcagtcgagcctgaaaggtcctgctgcagctga

SEQ ID NO: 76081 - DNA, 342 bp, Glycine max
  Peptide Sequence Number=SeqID_192859
atggaaatcgctcactgcgaagcggatctgcgttcggcgcgctgctggttctacgacgccatcgacgatgtctggcaagcgattctgcgcggcgatgaaccgggagaagagcggattaacgccatgcgcctctcttccacccacattacccgcgtctctgcttcggttaccacccgcgcgctgaaactggccgggatgccgggcatatcgatgctcagcccgcttcagcgctatgcccgcgactccatggtcatcacccagcacgcctttatgggcgagctgacatacatcaacgccggcaatatgttcttcggccactcgccgcagccaggctatttatga

SEQ ID NO: 76082 - DNA, 351 bp, Glycine max
  Peptide Sequence Number=SeqID_192860
atggatcgagttacatcgcagtcatcgttgtttcctctactgccaaacacatttaggactgttgatgtccatgttacttctagtttcaccttgacaaagatgtcatggaccataaaagaacaagttttacggtgcccttaccgaacctgtgctagagctagagtaatgggtgaagtagaggaggtgcaagagcagatgaaggccgacatggaggccatgaaagagcaaatggccacaatgatggaggccatgatgagaatgaagaagataatggaagccaatgtggttgcagttgccgctaccagcgctgttgctaaggtgtgttggatcgagtggcctcagaataattaa

SEQ ID NO: 76083 - DNA, 189 bp, Glycine max
  Peptide Sequence Number=SeqID_192861
atgttgaccactagtctctttgccccaagtggtctagtggccaaggatcatagctgtgtcgctttacgtgtccacttttgggtggacggagacactgctgctactgcagaaggagaaggagaaggagaagaaggaggaggaggaggcaaggcagtgatcgaggccgtacccgaatcaaataaacattaa

SEQ ID NO: 76084 - DNA, 625 bp, Glycine max
  Peptide Sequence Number=SeqID_192862
atggaaccagggcgtggcgatgagggtggtgccgcttggcaccggcgcggacgccgcgatgcgcggcgcgccgcaggcgaatgcgggaaaggaagccggcagcgtggcgtccagcagatcccagatatgacagaggtcgcaatggcccagcttgtcgggcgtgtgcgcgtcgtcctggctggaagcgggactccccgacaggcgcacagccaacccagcactgcccatcgggcagggcgcgcagcgggatggaggcgggaagccggcggcatgggcggggcggaaaggcgaaaaatcggaatgatatattgtttctttgattgtggcgatgcgcgcccgcgcatccggccgcgcaacgcggccgaatatgacacttcatgtagtcctaggctcgggcataatcgttggcatcggccctcccggcttgatcgccgcgagcggccgctgaaagaagaccataagaaagcggagccaagctcaatgatgaacgcagtacaccctttgtcctcgatgaaccggcccgaggcgattcctttcgagccctaccatgacgccgtggcggcggtggaccggctggccgaaatctatgcgcgcaacacggccttcctgcgcgcggcgtttcgcg

SEQ ID NO: 76085 - DNA, 268 bp, Glycine max
  Peptide Sequence Number=SeqID_192863
atgttgtcccttgtggttcatcatggtgcatgcactctccacagaggttttagagtatttccatacttattttgctctaagagaagatgggctgacatgttagggccacaatggaataaggatgagcttgaacatttctatgaagcttaccgtaaatatgggaaagattggaagaagcagcaacaacatgataagcttgagcgaggaaggtctgcgtctggattggaggaactcatcatgggttgctcttcaagtgaaatcaaaaaag

SEQ ID NO: 76086 - DNA, 1151 bp, Glycine max
  Peptide Sequence Number=SeqID_192864
atcccgcatgttggaacccaagcacatgccttgctcgacgaggccgcccgtcgcgggctgccttcgtccgacggtatccggctgtgcttccaggtgctggccctggccggcgccatcgaccgcgactgcgccgcgcgcctggcgccacggcagttgtccgaaggcaagttcgtgctgttgttcctgctgcatggccaggccggcggcctgtcgccgcacgagctggcggcgcgcgcgggcgtgacccgcgccaccgtcacgggcctgctcgacggcttggaacgcgatggcttcgtgttgcgccagccgggccaggacgaccggcgccgcgtcaccgtgacgctgacgcccaagggcagggcggtggcggcgcgcctgttcaaggagcacgcgcaatggatcggctcgctcttcgacggcctgtcgcaagccgagcggcgccagcttggcgacctgttggccaaggcgctggcgcccgaggtcggcgccgcaggcatcgcgcgcatgcgggccgcggcggcgctgggaatttcccggcgcatggcgctggcggcgcggatcctgggggaaagcctgggcgaacccggcatggcgcgcatggcggcgcaggcgtcggataccgcgcgcggctgggcctgcttcatggtgggcgccgcgccgggcctgtcgctggcgcagcgcctggcgcggatccggccgctggccgacgacgcgcatttcggtgtgcgcgaatgggcctggctggcggtgcggccggcgctggcggcggacctggacgcggccatcgcgcaactgcaggcgtggacggcattgccgtccgagcgcctgcgccgctttgccagcgaagcgttgcggccgcgcggcgtctggtgcgcgcacatcgccgcgctcaaggcggatccggggcaggcgctgccgctgctggagccgctgcgcgccgatccggcggtctatgtgcaggattcggtggcgaactggctgaacgatgccagcaaggaccagccggactgggtccggcgggtgtgcgcgcgctggctgacgcacagcccggtcgcggcgacgcaacgcatctgccagcgggcgctgcgcaccatcggggcgtagcgcgccgcaggccgcgcaggccacgcggctatcgatcgccattgcgg

SEQ ID NO: 76087 - DNA, 501 bp, Glycine max
  Peptide Sequence Number=SeqID_192865
atgggcgccaagcacctcacgaggaccaaagaatggacgcacgtcatcgagcaaagggctatacgtcctctctttcagtgggctccacatccgtaccttaagagaattcaaggtcctcttccggccaactgtgtgagcacaaccagaggaggaggctattgtgcagctactatgcataccggggcaagatttcactcgagccgctacaaagagacgaggatcgtgccccctacgaggagtcccttagacccggagaagtctaacagggccctagagttcctggctctgatcatcaggcccccattaaccgagctttcatcgagaagtactgcgaccctaggaaggcacagggcgaggcatcataatagcttggggacagccaacaacgggcaactgacgcaccgccaccacctccagaatccacctcagctcatctacaaagcttggagcgttgcctacgacccgtggccgaccagcaggcgaccaagtccaaagccaaag

SEQ ID NO: 76088 - DNA, 380 bp, Glycine max
  Peptide Sequence Number=SeqID_192866
gatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaaatgagaactttgaaggccgaagaggggaaaggttccatgtgaacggcacttgcacatggg

SEQ ID NO: 76089 - DNA, 668 bp, Glycine max
  Peptide Sequence Number=SeqID_192867
atgggcggcggcaccagccatttcgacgatgcgaaaccgctgggcaccgtggaggcgttccacaccttctacactctgaacggcaaacgcgtgtcgttgcccaaagatttctactccagcaaggcctatgccgatcagctggaacagtggatccgcgatacgccgcaaaataagcccgtcttcgcctatctggccttcaccgcgccgcacgatccattgcaggcgccggatgactggatcgccaaattcgacggcaaatacgacgccggttaccagcaggcctatcagcagcgcattcagcgcctgaaagcgctggggctgatttccgagcgcacgccgatgccgacgctggcgctggataaggcctggaacgcgctgacgcccgagcagcaaaaatatgaagccaagaccatgcaggtgtacgcggcgatgatcgcttacatggacgatcaggtcggcgcggtgctgaacaccctgaagcagaccggccgcgaccaaaatacggtgatcgtgttcgccaccgacaacggcgccaaccccgccagcggcttctactacggctcgaagccggagtattggcggcagttcgacaacagctacgccaacctcggccgcaagggctcgttcatctcctacgggccgcactgggccaacgtcagcaacgcgcc

SEQ ID NO: 76090 - DNA, 264 bp, Glycine max
  Peptide Sequence Number=SeqID_192868
atgaatgaagaacgtcgaagaacggtcgaaacctttgcgaaattcctcacgaaaaaagttacggaaacgtttcggaagcgcctcggcttagattttcttcacggaaacaatttttccaagcaaattcgaaagagagagaacaaaataggggagatggttgccgcccagctcgcccaggcaagtcaggttgcttcctccagaagcaacagccttctggagggcccaagtgggcctggttgctatttgcacccccatttttactaa

SEQ ID NO: 76091 - DNA, 465 bp, Glycine max
  Peptide Sequence Number=SeqID_192869
atggagagtgtatccgttcttgtgtattgtgatcttgacattattccatcagatgaagggatagtgtttgaaagccctaatgatcctaaattcatcacaataagtgaggacatgtcacttgttgccttaaggaaaacaattttttacgccaacagaggtttgagcgtacctctcagcgtgatattaaccatatcatttcctactatgcttaccttgtgtttgcgtaaccggacaaccctttatgattctcacaataattcttcgagcatgatgccaatgaaaggcctactagatctatcttccatcgagatacggtcgttgaagtccacgaggattgtggaagcaatgccttccaagattattttgatgatgccaaagaatcaagagttaagcaaattccaaagattcaagaatcaagtttcaagaatcaaaattcaagattcaagaatcaagattcaagaataa

SEQ ID NO: 76092 - DNA, 261 bp, Glycine max
  Peptide Sequence Number=SeqID_192870
atggaggcacacacttctgcaataatcaaccacagaagctgtacaaagagagggttaaaaggtatcatgataaaaagctactcaagcaggattttcaaccaagtcaacaagtgttgcttttcaattcaaggcttaagttgtttcctgggaagctcaaatctaaatggcccggaccatttaccatcaagaaagtttgaccatttggagcggtggagctttattactctcaagctaaagatcctgacagaacatgggtggtga

SEQ ID NO: 76093 - DNA, 1566 bp, Glycine max
  Peptide Sequence Number=SeqID_192871
cttgggctgccaagcgtcttcgtcactacatgattaaccacaccacctggctaatatccaaaatggacccgatcaagtatatctttgagaaacccgctctgacaggaagaattgctcgttggcagatgttgttatccgagtatgatatcgaataccgcacccggaaagcaattaagggaagtgttcttgctgatcatttggctcaccaaccaattgaggactatcaacccatcaagtttgactttcctgatgaagagattatgcacttgaagatgaaggattgtgatgaaccattgcttggagaaggtccagatcccgagtctagatggggtttgatttttgatggagccgtgaatgtctttggcaatggaattggggcagttattatcactcctgaaggcaatcatctccctttcgctgcaaggttacagtttgattgcaccaacaatgtggcagagtatgaagcatgtatcctgggcattgaaaaagccattgacttgaaaatcaagaaccttgacatttacggggattcagctctcgtaatcaaccaaatcaaaggagaatgggaaactcgccaccccggcttgattccatacaaagattatgcgaagcatttgctaaccttcttcaacaaagtggagcttcaccacatccctcgtgatgagaaccagatggcagatgcgttagcaactttatcctccatgtacgaagtgagtcaccggaacaatttgccaacaatcagaattcagcgcctcgagaggcccgcccacgtgtttgcagtcgaagaggttgttgatgataagccctggttccatgatatcaagtgtttccttcaaagccaggatatccacccgaagtatccaacaaagacaggagactttgagaagatgtctgcagaatttttgatgcacgagatacatgaaggctcctttggaactcactccaatggacatgcaatggcaaggaagttgttgagagcaggttactactggatgtcgatggagacagattgttgcaaacacgcaaggaagtgccacaaatgccagatttatgctgacagaattcatgtaccaccaactacacttaatgttctttcttctccgtggcccttctctatgtggggcatcgatatgattggtagaatcgaaccgaaggcttcaaacgggcatcgtttcattctagtggctattgattacttcaccaagtgggttgaagcagcatcttatgcaaatgtgactaagcaagttgtggtccgctttatcaagaatcagatcatctgccgttatggtgtgcccaacagaatcattacagataatggaacgaacttgaataacaagatgatgaaagatttgtgtgaagagttcaagattgagcatcacaattcttctccttacagacctcagatgaatggcgcagttgaggctgcaaacaagaatatcaagaagatagtgcacaagatggtggtcacatacaaagactggcatgagatgttaccgtatgctttgcatgggtatcgcacttcagtgcgtacttcaccaggggcaacccccttctctttggtgtatg

SEQ ID NO: 76094 - DNA, 288 bp, Glycine max
  Peptide Sequence Number=SeqID_192872
acttatcaaggtaatccttgtggcgactatcctgacatatcttccttcactggaagtggcgtctatcctgacttatcttccttcaccggaagtggtgtctacccggacttatcttccttcaccggaagtggcgtctaccctgacttatcttccttcactggaagtggcgtcatccaaaacctccgtagcctgtatcaaacgatcccctcctactcaggttcgcatcatatgcgacatcggccaagaaagaataccagtcgaggcatgccaaaaggcatcaccggatga

SEQ ID NO: 76095 - DNA, 559 bp, Glycine max
  Peptide Sequence Number=SeqID_192873
atggatatgaacttggggtacctcatctcccaccagatatctctgattgcacagcatgacacatccagacttggattccctgccttgatcacagctctatgcaaggccagaggagtccagtcagattctagatccctggagaattttagccctaccattaacttggcatatattaagaagaatcgttggaatcttgatgatccaacagtaacatttagaggtccaaggaaggccaggggtaagagatcagaggtccccactacttcaacagcaccagagacaccaactccttcttcttccacagctccagtaccttcctcagctccagttattcctcctacatctacacagataccacttccagctcctatagctgcaggaccatcagactttatatttacacctcagatgcttcattccatgctccagagcatccacagggagcagttcattatcatgcagagccttcagggcttgggcttgccatccattatgagcatgcatgaatctgatgcgcaggtggcctggccaggagcccagccttctccttctggagggg

SEQ ID NO: 76096 - DNA, 411 bp, Glycine max
  Peptide Sequence Number=SeqID_192874
atgatgctcttttggcacataggactgctacaaagcacccataggaatgtctccttatcgggttgtctttggaaaggcatgtcatcttccactggtgaggaaagaaagttgcaactgagtgagttagatgagatccgcctagaagcctacgagaatggaaagttctacaaagaaaagaccaagaagttccatgatagcatgataattaagaaggacttcatggttgggaaaaaagtgttattgtataattctaagcttggactcatgagtgttgagatcaaaagcgactccacaaacaagagcttcaaggtcaatggacaccgacttaagccattcctcacaaacccttctttagtggacgtagtggtggaagagacttccttactccaccctactcttcctccaccatga

SEQ ID NO: 76097 - DNA, 534 bp, Glycine max
  Peptide Sequence Number=SeqID_192875
atgaaggtcatgcgagctgatgaaaagattctcggcatggagatcaagaaggatcgagaccagaagaagctttttctatgtcagaaggaatacattcagaaagatacaactaatattggactagtctaccatagagacatgtttcatgctctcgctggttactcaaattctgactatgttgcagatttggatgcaaggagatttgtgactgggtatgcattcatgattgacaactcccttgttagttggaaggaaacacttcaacccgcagtggatttatccactacagaggcagagtatatggctctaacgaaagcaataaaagaagggatttggttgaagggtttgattagcaatcttgggtttccacaacaaaagactatcattttctgtgacaatctgagtgcaatctgcttagccaaggatcataaagttgatacaagggagaatccgactgatatgttcacgaagcctattccaagaagcaagttcatgcattgtctagatctacttaacgtagattgctggagatga

SEQ ID NO: 76098 - DNA, 201 bp, Glycine max
  Peptide Sequence Number=SeqID_192876
atgacagtggtagagtggggtgctagcagtggaagtggcaatagcagttttggaatggtggtggtgatggcgacaatagtggtagggtggaatagtggtggcagcaaaatgcatgttggtgaggcgacaatgatgatgtgtggtggtggtggcggtgaaaatggtggtagagtggtggttgtggtggaaaggtggaagtga

SEQ ID NO: 76099 - DNA, 303 bp, Glycine max
  Peptide Sequence Number=SeqID_192877
atgggtattggactcgggttggagtttgagagctccataatcagaaacattagtgatcagaagcagtttgaagcacctgatgaggttgatcaagatcttcaaatgaaccctcatcatcataatacaacaccactcgcttgggctaaagagaaaacttcagccctaagcaagccactcgcctgggcgagctccaacttgcctgggggaagaggaaaaaagatccagcagcctgaaaccagagagaaaaatgcagaagaagaaggagaagagggaaagtggagtcgaggcactgcagagttgtga

SEQ ID NO: 76100 - DNA, 207 bp, Glycine max
  Peptide Sequence Number=SeqID_192878
atggcgtgcgatgacgagcgggtcgtggtggggcaacgattgcatgcaaaggaagggatcgtgggaacgatgatcaatggtggttttggagttgtgcaaagatgcattagggctactggtggtgtgcgtgcgagtctcgtgatttccatatctaagaaagggaaggtggttgttgatgcaatcctaccccgtaagggcattggatag

SEQ ID NO: 76101 - DNA, 255 bp, Glycine max
  Peptide Sequence Number=SeqID_192879
atggagtcaatgattacaattgcttcctctaggttcttagacatcatattgtgcaacctcatcaaaattatggtttgggcacctccacaacaaagctttgaatctttcccatgtttcacagagaggttcatcaaaaccttgggaaaaagtagcaatggcggattttgcactaatgaatctagacggaggaaagaaccttgcaatgaattgttcctccacctctccccaagtgttaaggcttttgtttggatgtga

SEQ ID NO: 76102 - DNA, 220 bp, Glycine max
  Peptide Sequence Number=SeqID_192880
atggaggattgggagaattttctccaccaaatccttgaggaggattctgaggattctgctccaattaaaatgttcctcttgttgtgggggttcggcggcaagcaacggcggctcgtggcggccaccggtggtcgtgggtggtggaaaaggaggtgttcgggtttgggtggcatttggagaggaggaaagagtgaaaatcttgtttatcacgctgaagaac

SEQ ID NO: 76103 - DNA, 552 bp, Glycine max
  Peptide Sequence Number=SeqID_192881
atgccctcgccttcagaggactacacgtcctggctttcagaggactgcacgtcctcgccttcagaggactacatgtcctcgccttcagaggactacatgcccccccttcagagggctacacaccctcaccttagaggactacgtgccctcaccttcagaggactgcatgtcctcgccttcataggacagcacgtccttactttccgaggactacacgtcctcgccttaagaggactgcacgtcctcgccttcagaggactacacgtcctcgcctttagaggactgcacgtcctcatcttcagatggctgcatgccctcacctttagaggactacaaaggactgcacgtcctctccttcagagggctacacgtcctccccttcagaggactgcacgtcctcaccttcagagggctgcacgtcctcaccttcagagggttacacgttctcaccttctgaggactagacgtcctcgccttcagagggctacacgtcctcgccttcagaggactagacgtcctttccttcagaggactacacgtcctcgtctttag

SEQ ID NO: 76104 - DNA, 361 bp, Glycine max
  Peptide Sequence Number=SeqID_192882
atggcgaacaagtccgatgatatcaggatgatgttggttgcagggacgatcgagttcgatagcatgtggaaacgtcatgggttccagaagaaggcggtgccttctggtggaagcaacccaacttgcctgggcaagctgggcggcaaccacctcccttttttctcctataaattggggaaggagggcagaacaaatgggttcagcccttctggtattgagaaatctctcaaaattagtgagaaaaattgtttccgtgaaaaaaatccaagccgaggtgcttccgtaatgcttttgagacgtttccataagcgatttcgtggagattcttcattgttcttcaccgttcttcggtcttcaaccg

SEQ ID NO: 76105 - DNA, 471 bp, Glycine max
  Peptide Sequence Number=SeqID_192883
atgaaatttcaaaaaaagaagggagaagcatgtccgctgggccgtgtccaaattattgtgtccctgctatgggccgtatacaaatttgtgggccatgtcagacatcgcgtccatgccgtttccatgctggaaacgccattgacgggcggaagaggcagttctgtgcttcctagtcatgaccatgttggagaaggaaggagtcatgagttagtaaatgacaacaagcaccaacaacacaaattcaaaatcaaacatgtgcaagttgtttcagctaaggaagatggaggattcatctgtgtgatggggataactaaaattggatttttgtggtacgttggggttgaaagcagagaccattttgaaggtctatgggatatggcccatgagccagttctcgagaacgtcatgatgatggtaccaagcggggtaatgggtcctaatcattttcctataatggagattagtagatga

SEQ ID NO: 76106 - DNA, 267 bp, Glycine max
  Peptide Sequence Number=SeqID_192884
atggattggtctaactctctaacaaagtccccagtggagtcgccaactgtcgtaacctacctttcggcaggaggccgacgagaggctcatgggtgcgtcttccaagaaaggaaaatgcgtggagtcaccaccaacgtttattcgaggaaaatgtcggaaaaaccggaaaagacgtggtctagaaactttaagtgtgaaaggttcgggagttgtatttacgcacggggaagggtgtttcccttgctcctacgtattcctcaattgtga

SEQ ID NO: 76107 - DNA, 285 bp, Glycine max
  Peptide Sequence Number=SeqID_192885
atggaagccttcaggtatgcagcagaagatagatgtggagtggttgttaaaggagcaaatcggagtggaaatatagcaggaacatgcccattgaaggacaacgacattcttttgacagcaagagctttggatgattccaatgaagtaagaaacacaattgctgttgtgaatgagttgtccaaggaaatgagacaaattttgctttctcatcctgcgaatcctaaatgtgctccaggaggaaagaacatagcaagtgtagtccttttaggagactctggcatttga

SEQ ID NO: 76108 - DNA, 495 bp, Glycine max
  Peptide Sequence Number=SeqID_192886
atgaccactttcggccaaggccaactctcaaggagcttcaccgtcatgtatttaatcatagatgtagataccttctactttgctttgattggcaacaaaacgctaaacaaacttgaagccattgtctcgacaccacatctcaagatgaaattcccaaccttgatgggagagatcatgactgtcaaggtagatcaaaagcaggcccgacaatgctatgttgaaagcttgaaagtggaaccatatcccccttctagtagtcaagtcataagcttagacaaagggtctccaatccgaaccctgatcgtctacaaggcaagtttgggagatcaagatggtgtattcgatgtggatccatgcgacgacactattggcaaatgcccaaagcctatagaagaacttgtcaagctgcagctcagacccaaatctaggcaatgtatgcagctcagtagggaccttactagtcacgagtacaaatgcatagttgaagctcagtag

SEQ ID NO: 76109 - DNA, 243 bp, Glycine max
  Peptide Sequence Number=SeqID_192887
atggatgccgacctacccttaggttggaaatcgctcaacccagagcactatgatggaaccacaaattcagacgaacatttgaatgtgttcctcacccaagcaaatctctacaccaacaatgacataattttgtatcgcattttcccaacacccgtcaaaagggcaacactaacatggtatgaaggactccctctgaggtccatcgacagcttcaacacccttgtcgagcatttcaattcttag

SEQ ID NO: 76110 - DNA, 243 bp, Glycine max
  Peptide Sequence Number=SeqID_192888
atggagacgaccatgaggtcgtcctggttgataaggttaatgcccttgaagtctctatcggtgaatcttatgggagagaaacttcatggtggtgaggttggcgttcatgtctttggtggtgatgcctctgtctacctctatcttctgctctgccccattttttattggcatcgtgatttttgtgctagtcctcatggtgtcctctgggtcttgctcctggaattaatgaaacattgggcttaa

SEQ ID NO: 76111 - DNA, 3996 bp, Glycine max
  Peptide Sequence Number=SeqID_192889
cgcaggacgagatcgaaatagagatcgcggaagtgttgtacggcatgatgagacaacctcagggaccgtcgaaacaagatatcgtcgcaaacgattccaacaagttcgattcccgagaatctaataaatcttccaccgatgccaagtcaccgatctccaacccacaaaattcaagctcttccgccactcccatgtccgctgttgctccgaagaggaaaagaccgcgaccggtgaagcacgaggatgagaatccggcgagtttgagcgttcggagcagtcccatttcatcaacgacaaaggctgagagcgatcagccttcaaagatggagacttgttcttccaatttggataagaacaacgtggggtctgtcaccgagaatctggtgaattctcagacagttcaagttatgccggagagcaacgagcctaagccggcgacggaggtagcggagaggcagaaagatgtggtggggttgttgagtgaggtggtggtgtctcctcagtcgcccaagaaggaatctcctgtgcgacaagtagcagatgatgaccgtgaagatgtgaaagcgactaaagcgaatcactcaatatccgagagtgaaaatcagcgagaagagaagttccagatagatttgatggcgccacctcctcccttgaggtcttccccggaaagggatgcggagaataataatatggtggttgacgcagaaaaggaagtgaagcctatgacaaaagaggacgagaaagtgctgagaatgaacaaagaagtagcaatggctatagaaatggagaaagtaaaagcaaaagccgaagaaaatgattcgcagaaaccaggtttattgcagaaagaaagaggaattgacttacagcttgatttggagaaagctgatagggtagatactagtggcaatgtcggtggtatggttaacaagaagcagcagcaacatcagaacgctcagaggcagccacagccacagctgcagcaaacgaactcagagaaaaatgtccaatccaattctttgcctctaccattgtctgttccaagctggcctggcgggcttcctcccatgggatatatgacacctctgcaaggagttgtatcgatggatgggactcctgtgacatctgcagccataccgcctccccatcttctttttaaccagcctcggccgaaaaggtgtgccacccactgctacattgctcgcaatattttgtatcaccaacaaatcgcgaggatgaatccattttggccagctgcagcaggttctgcatcactatatggagccaagcccagcaatcttaatgttgcaccctccacagaattgcatggtaatgttccttgcaggtctgcaaactcttcccaggacaaagggcacggtattgccatgtttccaggacatattgggaaggacaaagcctctcagcctgccaatgtggataattcatcaagaaaacaaattttgcttcagcaagctttacccccaggagcagcacctagtaatatcttgcatggccctgcattcatattcccgctgaatcagcagcaagcagctgctgcggcatctgtacggcctggatctgtgaagtctttgccagtttctagtaatggagcaccctccagtgtgtccaattcagctccgccgaatgcttgtggcacgggtgctgctgcgggggcagctgcaccaacaatgagcttcagctatccaaatatgcctggcaatgaagctccgtacttggccattttgcagaacaatgcttactcatttccaataccagcacatgttggtggtccacctgggtaccgtggaaccccccatgctcaggcttttccgttcttcaatggctctttctattcttctcaaatgctgcatccttcacagattcagcagcagcaacttcctgctcagtcacagcagcagagccaacagggccatcaaaatgcaagtatgtctagtggatcatccacctctcagaagcagcatgctcaaaaccaacaacaaaagcctaataataatgctactgggtccaatgggggtggaagcttgcaaggctttcctgtcaccaaaaacccaccatcactgccactgcagttgcaacagcaacagccgcagcagaggcagaatcatcacccttctcatccagctcgccaggttgagtctgagatgggtggtgaagacagtccatctactgctgatagtcgcctcgctcgcgctaccatgaatatttatggccaaaattttgcaatgcctatgcagtcgcctaactttgctttgatgacacctgcctcaattagtgcagcaggctctaacggaggtcacggtgaaaagaaacaaccccagcagcaccctggtccaaaggctggaggtgaaacagctcctgcatttgccatgtcatttgcatccatgaatggagcccctggccttgacctctcatctattgcacagaacccttcaatcatgccgagtaatcataactatcatataatggcagcagcacaagctgccagtgctcagttgaagaagagttatcatgccgctgaggaagggaaaaatgtagttaattcttctaatctagacgaagatagaaaagcaatatctgctggaaaaattccggcaacaatgggacaatccattgcattcggaaggccagaagtatctgatccctcattagcgtcgttatcaggtggcaacaatgtgattgatacctcgggtcgtaatctaaaccttggttctgcttcttctcgggcttctacttctgttatgcctgctgtcatcagcaccaatccagccagttctcagcaacaaatgcagcgaaatcagcagcagcagcaaattcttcagcatcagaagcagaatcaatttgcagctgcagctgccgccgctgctcgcaacaagaccccatcaacaagcaatggcagtgtttactctgataacctcccctctacatcttcaatggctaataagtttcccagtgccgtatccgcatttcctcaaagccttgtacagagcagtaacaccgttgctcagtcacctcagtggaagaactctgtaagggcaacgaccacttcacagtcgcccccatccatggcttcaacaacaccgccctcatcagtcaaaaaccttccacagcagcaggctcgttcccagcaacctcacacccaaatatctttcgcgacaaatccaaaatcatcagcagcacaagtgcaaccttcaagttcgacccagtccccatctcccccagtcatggttggctcaccaacgacttcatcaatgtcgaaaaatactggtagcccaaggacaacatcagcttcaacaaccaacaataagataagccaaagttcttccttatcctctcagcaagccaagaactcttctgctgtgccggcccgtaaatcgtctcctgttggcagcaggaatgtgccatcaatactcaatgttcctcagctaactccctcttccagcactgggagtaaatctcaattgccacagaagcagcagccgcagcagcaaataccaaagcaagcattacaacaggcccagcttttgttctctagtccttacgtgcatccgcaatccaacagtaccacatccaccaccacagttccaagtggttattaccttcaacatcaacaacggcgtggccctgagcagatgcagcgaccgggctcttcccctgccgtaaacaatgtgaaaggcagcagtgccttacctacacagggtcttttgcatcctgcacaggttgctgcaatgcaaccctctgggagccaccctcagtttgttcctactggcttttcttatgcttcttatcatgttcattctgtgccctcagttcaagtgaagccagcggagcagaaacaacctgcggtgaagcatgtgaattggcatgggattttgaagtgcaagatggggtccctctcaaatggtgggggtaaaatgtcatgttgttatgttgatgatggaatgccgtatgtggaaaaagcaagcaagctggatggagtag

SEQ ID NO: 76112 - DNA, 585 bp, Glycine max
  Peptide Sequence Number=SeqID_192890
atggcgggaggaggatttgtatcagcttcaggggaatcccactttgaggcaaaaatcacgtttgccgtcataatatcttgcataatggctgccaccggtggccttatgtttggttatgatattggaatttcaggtggtgtcacatcaatgcctagctttctagaaaagtttttccctgaggtatacagaaagatacaagatcatggtgtggacagtaactactgcaaatatgacaatcaaactctacaattgttcacatcctctctgtacctcgcagctttggtagccaccatgtttgcctcttccgtcaccaggacgctaggccggaagcaaactatgttgattgctggcatttttttcatcgttggaactgtcttgaatgctgtagcaaatagcttgctactgctaattgttggcagaatcttacttggttgtggtgttggtttcgccaatcaggctgtgccagtgtttatttctgagattgcacccacaagaattcgtggagcacttaacatcatgttccagcttaatatcaccattggaattctcatagcaaacattgtcaactacttcacagcaaagtaa

SEQ ID NO: 76113 - DNA, 342 bp, Glycine max
  Peptide Sequence Number=SeqID_192891
atggagatccgacgtggcactgggcattcatggaaaaaacaagcagattccaaagaaggagcgagtccgacatggcacctaaaccaagagctttctaattacacggctgagatgagcgccgaagcgagagtaacacagagtcacggtcacggaacttccaagccttggatcttggtattggttacacttcgcttcgcttttgatgagggtgctttcattctctctcgctcactcgctcactcgctcactcgctgtcgtgaaatcccacagttgtgccacgtgtgcaccggaactgctacctcaggcagcctacgtggcttcgtttatgaccgtagacactaa

SEQ ID NO: 76114 - DNA, 697 bp, Glycine max
  misc_feature (582)..(582): n is a, c, g, or t
  Peptide Sequence Number=SeqID_192892
atggtggagtttcatgtttgctttgcttttaccaaggtcccggcaaccggatatatccgggtgaggattgcaagaggtgacgcggtggagaatcgtgaccgtccaggagtctttggacagcgtgaggaagagaagaacaagggaaagaaagataagctaagcaaagcaaagcaaagcaaagcagcccccctaagatctctctggattagagaagccagaagaagcactatggctgcaaatggattaaccagacgaagacacaggactaacagtcttagagactcaccagaggaagatggaggcatggagctgcaagaaccatccaggttgcgagatcgaggagggagtgggaaaaaggatcgagatcgtgaaagggagagggaaagggagagagatcgattgggtcggagcaagaagagaagaggagataggttgatgcatagcagcagagaagatggcggagaagacacttctgaagagagtatcaacgatgaggacgatgatgacgacgaagacggtggcggcggcggaggtagcgcttcagtaagaatgcttccgttgaacccatcttcgctctccaancaccaccatcggaagagcttccctccggcgaaagttttaagaccaacgccgccgacgacgtggaaggccgccgatgaaatgatcggagtatccgtccccagaaaagctcgctcag

SEQ ID NO: 76115 - DNA, 922 bp, Glycine max
  Peptide Sequence Number=SeqID_192893
gattgaaggtggatatgggtggaggatatcagtggctttggcagggattccagcaataatgctgacatttgggtccctcctggtgcatgacactcccaacagtcttattgagaggggtttggaggatgaagggaaggctgtgctaaagaagattcgtggtgtggaaaatgttgagccagagtttcaggagattcttaaagccagtaaagtggctaaagcggttaagaatcccttccaaaacctccttaagcgccacaaccgtcctccattgatcattgccgttatgatgcaggtcttccaacaattcaccggcatcaatgcgatcatgttctatgctccagtgttgttcagcaccttgggatttaaaagtgatgcttccctttactcagccgtgatcacaggagctgtgaatgtgctatcaaccttggtgtctgtttatttcgtggacaaagctggtcggaggatgctgttgttggaggcctgtgtccaaatgtttgtgtctcagatggtgattggcacagtgcttgggttgaaggtccaagaccactcagatagcttgaacaaagggctcggggtgttggtggtggtcatggtttgcacctttgtggcatcttttgcatggtcttggggaccacttgggtggctcattccgagtgagacattcccacttgaggctaggtcagcggggcaaagtgttaccgtgtttacgaacatgctcttcacatttattattgctcaaggtttcttgtccatgatgtgccacctcaaattcgggatcttctttttcttctccgcctgggtgcttgccatggccatattcacagtgttgctaattccagagactaagaacatacccatagaggagatgacagataaagtctggagaaaccactggttctggaagagttatatggaagattaa

SEQ ID NO: 76116 - DNA, 345 bp, Glycine max
  Peptide Sequence Number=SeqID_192894
atgcctcttcatacaactccacaaccaccatcgatcgtagtacccgccacctccctcttctattgcaattacatccctaccacatcaaggagggttgatgggtttcaaaatcaagggtttagagggaacgagggtgggaatgatggtgctgcagtgccagtgactggacaacaaccacatggtggggggattatgggaaatgagggtttgtatgttaattctggaggagttggaggtgctagtgttgatgttattgttcctggtgatactatattgtttgtgggtgatttgtattggtggactattgatgcagagcctaaagctgggctaagtatgaggctgtga

SEQ ID NO: 76117 - DNA, 459 bp, Glycine max
  Peptide Sequence Number=SeqID_192895
atggctttggtagagagagttgtggttttgttcatagtgatggcatttgtgcaggtttcatttgcagctgtatacaaggttggagactctgccggttggactacccttggcaccatagactacaggaaatgggctgcaaccaagaacttccaaattggtgacactatcatatttgaatacaatgccaaattccataatgtgatgcgagtgacacatgccatttacaagacatgcaacgcatcatcccctattgctaccttcaccactggcaaagactccatcaacataaccaatcatggccaccacttcttcttctgcggcgtccctggtcactgccaagcaggacagaaggttgatattaacgtgctcagcatttctgcagaggcacctactccttcaggttcagctttggcctctccaacagttcaaacctccactgtgcctgcaccttctccttag

SEQ ID NO: 76118 - DNA, 1317 bp, Glycine max
  Peptide Sequence Number=SeqID_192896
atggggagatttgaatcaggtggggtgacatcgatgccagcattcctgaaagagttctttccggaagtgtacagaaagacagtggaagaggaagagttggacagcaactactgcaaatacgacaatgaaaagctgcaactattcacatcgtgtctgtaccttgcgggtttaatagccacattcttcgcgtcacatataactcggaggcagggaagaagagccaccatgttgatatcaggcttcattttcatcgctggagttgccttcaatgctgctgctcagaaccttgccatgctcatcattggtagagtcttacttggttctggagttggttttgctaaccaggccgtgccagtttttctttcagagatcgcaccttcacaaattcgtggagcattgaatatactgttccagctgaatatcacccttggcattctcttttccaaccttgtcaactatgccaccaacaagctatctctgggtttgggtggtttaccagcattgcttcttacgttgggggctttcatggtggtggacaccccgaacagtctcatcgagcgtggccacttggaagaaggaaaagttgtgctgagaaagattcgtgggattgacaacattgaacccgagttcttggagcttcttcacgcaagccgtgtggctaaagaagtcaaacaccctttcaggaatatcctcaagcgcaagaaccgaccccagctagtcatttgcattgccctgcagatttttcaacagttcactggcatcaatgccataatgttttacgccccagttctgttcaacacattgggattcaagaacgatgcttctctctactctgccgtgattattggtgctgttaatgtcgtctctactgttgtctcaatctattcagtagacagactcgggaggagaatactcttattggaagctggagttcaaatgttcttatctcaacttgtgatagcagtcataataggaatgaaggtgaaggaccattctgaggatctctcaaagggttatgcagtgctggtggttgtgttggtatgcatctttgtgtctgcatttgcatggtcatgggggcctcttagttggctgatcccaagcctttctctcaatgctgtgtttcttcaagtttggcatcttcttgttcttctctggatgtgtcttgctcatgtccacctttgtgcttttccttctccccgagacaaagaatgtcccattgaagagatgactcagagtgtgtggaagcagcattggctgtggaagaggtttattgaagatgattgtgttaaagaagagaaagtagacactggcaattga

SEQ ID NO: 76119 - DNA, 666 bp, Glycine max
  Peptide Sequence Number=SeqID_192897
atggcaggcagttccagattttctttcagagatcgcaccttcaagaattcatggagcattgaatatactgtcccagctgaatatcacccttggcattcactttgccaacctggtcaactatgccaccaaagtggatggggatggaggctatctctaggtttgggtggtttaccagcgttgcttctgacgttgggggctttcttgctggtggacacaccaaatagtctgatcgagcgtggtcacttggaagaaggaaaagctgtgctgagaaagattcgtggcattgacaacattgaacctgagttcttggagctacttgaagcaagtcatgtggctaaaggagtcaagcaccctttcaggaatatcctcaagggcaggaacagaccgcaactcgtcatttccattgctctgcaggtttttcagcagttcactggcagcaatgccataatgttttatgccccagttctgttcaacacattaggattcaagaacgatgcttctgtctactctgcggtgattactggagccattaacatgctctcaactgttgtatcaatctattcgagtcggacgccgaatgctcttattggaagcaggcattcagatgttcttgtcacatgttgtgattgcagttgtaatgggaatgaaggtgaaggaccattctga

SEQ ID NO: 76120 - DNA, 592 bp, Glycine max
  Peptide Sequence Number=SeqID_192898
cgccagcgtcagatcgaagccggagctgacgccgccagaggtccagattgggccgtcctggatatacagcgggccgccttcaacctgcacgcgcggatagctggcctgcagcgtgtccagcagacgccagtggctggtggcgcgccggccatccagcaatcccgcctccgccagcagcatcgccgccccgcaaatcgacaccacgcggcgcgcctgcggggcagccagcttaatccagtccaccaccatattgcgttcttcggggttatcaccgcggccggtaatcatgatggtgtcccagcattcgcgcggatcgagttcagccagtttgagatcggcgagcagattgaggccggactggccgtggatcacctggtgcggctgcgtggtcgcaatgctgatgcgatagcgatgtcggcgatacccgccgcttcgaacagcatgccgccgtccgggacaataatcagaaagggtttcgctctttttaatcccttcgcgcgtgcaattcagcgagacgctgcgcgtcaccgcataatcacaggagggttcaacaatcgcgccgacgaacgtgatttgaccgtccgcggcaagg

SEQ ID NO: 76121 - DNA, 138 bp, Glycine max
  Peptide Sequence Number=SeqID_192899
atgttagcttctacgatggttgacaaccgtctttgtcaatggcagcagcttcaaaactatacaatggaggttacaaaaatcttggatggttggctggaggctttaatctttcaaagaacaatgacttcccaacagtag

SEQ ID NO: 76122 - DNA, 426 bp, Glycine max
  Peptide Sequence Number=SeqID_192900
atggtgggaacatatgctaagttgatgcctcggatggttagtttgactatttatgaacctctatttgtgttgaacaatgctggctgtagtgatggctgtcttgtaaggcttcggagttctctgtggcttcaatttaaaccccatcatattgctgctggagctgcatatcttgctgccaagtttctgaacatggatctcgcagcttatcagaacatctggcaagagttccagacaacaccatccatacttcaagtgaatgaagagcctatctgtgaaagcacacaaagatttgtaactttgtatgtgcgcaacaattattgggttaggaggttcaaatttatttttggctgccctcctgactctggtctttggtatgaaaggaaaattaaattgacatctgtagttatggtgaatcttggtgcctag

SEQ ID NO: 76123 - DNA, 321 bp, Glycine max
  Peptide Sequence Number=SeqID_192901
atgtctcactgttctagcacctctatttgtttcaacaattgggaggtccttattgtgaccttagggtgcaagggtaaacagcttcagggtgaccactttcccaaaaaagaaaaagaaacttctaagcaaaccctaaccagtctagcactatttttcaaaaagccaaatttgcacatgattacccttcaagtggaatgttgtcaacttatgacaaggttgagcacacaaaatccagtacattataactttcacactagttgtgcagaacttccagaagaaatgaaggtattagctgtaaatcatattggagaagaaggataa

SEQ ID NO: 76124 - DNA, 198 bp, Glycine max
  Peptide Sequence Number=SeqID_192902
atggatcacacgcctgctgcgcaacgtcgtctcaaagccattcacgcccacctcaccgccaccgccgatgaatctccctcccacctccgatccaatcccaccgccggcgagttcttctccgattggagaaaaacaaacagccagtacggattggaggagaagattcgttttgtctcactttttgctagggacacttaa

SEQ ID NO: 76125 - DNA, 186 bp, Glycine max
  Peptide Sequence Number=SeqID_192903
atggtgtgtctcaccaagaatgggattataaggaccaggggttatgctttcattgagtatctgcatacaacagacatgaaagttgcttataaacaagctgatggtaggaaaattgatggtagaagggtgcttatggatgttaagcgtgggaggactgttccaaattggagacatattttacaataa

SEQ ID NO: 76126 - DNA, 632 bp, Glycine max
  Peptide Sequence Number=SeqID_192904
atggactctccccctcgcgttctcactccaccagcctcccctaaaggctctgatgtgctatgccatcctctactcatacaccaaggagcgcgcgggttgtctgaagcccaacgtcgacatcgtggaggaggtcatgaagaccttcgtggcttcggtctacgacaggttccaccttgtccccgacgaggtcctcaaatacacgaatcggaaggttgtcgagttagacaaccatgttccctccaacgtgaaaaaggccgtgatgtcatctctacctacgccatgaacatttactccaagtacgagcccacgacaacggcgaagcagtgtgcggatgtggttctgcaacctgaatggcgacgaccgaggcctagtgctcctcttttagaaccttccaatcgtgtcaccaaagaggagttgttattccaaccggaatggagacgcttaaagccaagtgcgactgcaattgcgaatgccaatgcgagtgtttgggaacctgaatggaggcgatcgagaccaatggcaacgacgtttccgtggaaccagaattacaacgttcgaaaaggtacggcgtcgagttccgacgacggcgacggtggggttgaaagacgcgaagaccctaacgacctttggcg

SEQ ID NO: 76127 - DNA, 159 bp, Glycine max
  Peptide Sequence Number=SeqID_192905
atggaggcttcttatgacagaatattttccatagaaatgtttgagcatatgaagaactataaagatcctctcaagaagatatccaaatggatgaaaaaggatggcctttatttgttcattacttttgccacaaagcatttgcctacctctttgaggtga

SEQ ID NO: 76128 - DNA, 345 bp, Glycine max
  Peptide Sequence Number=SeqID_192906
atggagttgttgacaccaattggtgttcagttcttgcaagaaaggcagaagacatccatgttagcatcgacctgggccatgattcctaaaacaaacaaacaaacaaacaagttagcaaaaactgaatatgatacaaaagcatataaagaagataaacaattcatcttcaagatccctgataggattaagagatttgaaccagtgagaaacagaggttgggcaggcatccagccaaagaaacccatctctccttcttcttcggtctacaatagaaataatgaagaaaaaggttgggagtggcctcgatgtatgtgtatagacaaaggcttcagaacacttgaatga

SEQ ID NO: 76129 - DNA, 243 bp, Glycine max
  Peptide Sequence Number=SeqID_192907
atgaaggatccctttatgaacacctttcctccaccttccaaggaactaaagcccaaggacaagagtaagcacaaaaggaaacactatgatcataagcatgtggctgccgaaccctccagtcatgcaggttttggtgaggttgctagtcttgccaactcatctgctcggtcattaatgtctcgattgatgtgtcccacctggacttcatcaaattcttcccttaactgttggaaagcatggtaa

SEQ ID NO: 76130 - DNA, 551 bp, Glycine max
  Peptide Sequence Number=SeqID_192908
ctgaggaatgttgcactcagtggatggctcgctaagccagcagattggcttagcgagaggggccactttatgccacagacaactctcctcaatatgtgccaagatcaccttattttggggaggattcttttcaatgtgtcagggccaccctatgtcgaggaggacttagagcatacaatgatagcaacgacaattggtaggggttaccctgaggaggagctggggggctcattgaagaaattagtgaggaggattctgaggaagatttcgatgaggatatgtgggatgcttcctcacgagagtcccgttgttagggatcttctaaactaccgaccttttgtcacaccctttttgcatgcagtttcttccctaggtttgggttgcttgaaggagttcatggagtcaggttccaaggttaagggtcctaccgacgaggtgtttaaggtctttccaaagcaagtcgcatataacattactcactacatagataaggttgttgacaacactactgttgttgttgatgttgcaatgagaatagctcaagagaagag

SEQ ID NO: 76131 - DNA, 261 bp, Glycine max
  Peptide Sequence Number=SeqID_192909
atgggaaatgagcaaaaaactcaaaataggggtgaaaagatcaatttaaggggtgttcttcagccctgggcccatctaggtccattaggaagcttcaacatgaagcaattagctcgcctgggcgagcatgttgcttctgaactaagccaccagctcgcttgggcaagctgggtagcaagctcctcccttattttggctatgaaagggcgtgggaggctgaggggaaggggtcagcacccttggtattcagatttcacttaa

SEQ ID NO: 76132 - DNA, 192 bp, Glycine max
  Peptide Sequence Number=SeqID_192910
atggctagtttgtcgtattttcacgaggaatcgggtgcacttgtcggaggcgaacaagcatcaaagatagtaatgggagctcaaggactctttgaaggtacatttgacgggggtggtgacaaagataagcctagtgaagttggaaaagatgagatctctataacctccataggtgttgccacccgaccctaa

SEQ ID NO: 76133 - DNA, 249 bp, Glycine max
  Peptide Sequence Number=SeqID_192911
atggagcctccggtgaggggaaaatacgggaaagaagaagaaaagacgggagtcactcatttcaaatcgttttgggttggaactattgggcaactgccataccctaatttcgtccggggaccattgtttgatggcatgcaacctttgcttaaccacttcgagaagtcaaaggaaaacattgttgcacgatccgtgaaattccgtaacatgccggaaaccaaaaggaagcattgttacgcaatccgtaag

SEQ ID NO: 76134 - DNA, 909 bp, Glycine max
  Peptide Sequence Number=SeqID_192912
atgcagtgcaggccacagctgaatgggatatccttcagtaacattggccagcagcaaaatcagatgttggtgtgtaatttttatgagcaggaaataagggctttcaacaaggcactacttggaaaatggaggtgggatatgcttcagcaaagtaacaagttatggtccaagatactgcattccaagtatggtggatggagatcattggtggaaggcggtagaaggaataatgagtcaggttggtggaaagacttaatggaggttacacatgaccaacagatgaattctatcctccaagatggcactacttggagggtgggatgcggggataaaataaaattctgggaggactcatgggctggacacggaaaggctcaaaagatgaaatacccaaggttgtataggatatcacttcagcagcataaactcattcagcaggtgggaagtttcaatgactcctcatgggaatggaacctctcatggagaaggtctttgttcgataatgaaatcgcatctgctgcaggttttttggaacaaatttgtcagattacaatccagccacatatagcagattgttgcaagtgggaagcagagcctaatggttgctactctacaaggagtgcatataacataattcagcaggaggatgcagcccatctctttttcaattgtaccaaatctctagccttatggtgggaatccttagcgtggactggaatagttggggcattccccataatccctaggtaccattttctgcaacaccaaaatgagatgaatggagggaaaagaaacaataggtggaaggatgttgacgaagagaaggacaaggaagaacaaaataaaaagaagattaaggaagtgtcacatggtgaacaagcacaaggccatttggatgacaaagcctga

SEQ ID NO: 76135 - DNA, 586 bp, Glycine max
  Peptide Sequence Number=SeqID_192913
atgaaatttagtccctgtggtcagtatttagcaagtggaggtgaagatggtgttgtttgcatatggcgtgttacatcactggataagtccagtatttgttccaccacagaagacagtacttctaatagtaaagtggaatgtgacaactcttctcctcggaacaaacactcaagtcaacccttcattttccttccaaatagtatttttcaaattgaggaatcaccactgcaagaattctttggtcattccagtgatgtcttggatttggcttggtctaattcagatattctcctttcatcttctatggacaagactgtccgcttgtggcaaattggttgtaatcaatgtctaaatgttttccatcacaatgactatgtgacatgcattcagttcaaccctgttgatgaaaattacttcattagtgggtccattgatggtaaggttcgaatatgggggatacgtgaagagcgagttattgactgggcagatatacgagatgtcataagtgctataagttaccagcaagatgggaaaggatttgtagttggttctgttacaggcacttgttgtttttatgttgcttctg

SEQ ID NO: 76136 - DNA, 389 bp, Glycine max
  Peptide Sequence Number=SeqID_192914
gaagaatccagaagaagatgagctttacaggttcgctaagcgccctgcttcagttcatccgctaagcgagaaaggcgcgctaagacaaaaatcactaacgtgggctaagcgaccagagcttgaagcaagagccggtttaagagcttcagatgagtctgtgagtgattgtgagatcctagaggcttcttggtatggaaagctaaatcctctgttggatcttccctttaggtacctgatatgcatgctgtcgcaacctaccattcggcgggaaggcgacgcgagactcgcgggatgcgtgttccacgaaaggaatacgcgcggagtcgccaccaacgtttattcgaggaaaacgtcggaaaagacgcgatctacgaactttttagtgaaag

SEQ ID NO: 76137 - DNA, 600 bp, Glycine max
  Peptide Sequence Number=SeqID_192915
atggcgagggtactagtcataaggacccttttatctagaatcttagatgagttgagttccctcaagttatggaaagaaaaactagaaagaaaagtaaaaggaaaagagagggtaaaaataaatcaagatgagagggaacaaataagggaagaagaaagaaggaaaataccaaaagagttaagaaaagaaaaacatgcctcctatagtagtcataactcttgcaagagcctaagtgaagaaattcgtgactattatgaaggaaggcatagatcacatcttagacctcactcccataggagagaaaatgaaagaaagcctcaaaaggctaatattaacctcccatacttccatgggaaggacaatgtagaggcttacttagattgggaaataagggtaaagcaaaaacgtaaaagaaagtctactttaaaatcatatggctctcactcttatccaaagaatgaccaaggtctaggcatcttaggggcagcaccttctaagcccaaagatgataaggggaagacaatagaaaagcaaccccctgaggctagtatgcaagggaagactagctctataaagtgctttaaatgtcttggaagatga

SEQ ID NO: 76138 - DNA, 468 bp, Glycine max
  Peptide Sequence Number=SeqID_192916
atggttcaggggctaaaccagggactacaccatccgtatgtagaagttgtggagaaagaagtatcccgtttgcgtggtctagttggtggaggagaaattcaggataatgacatttcagttgtcagcttcccaggttctcctggatccttcaagtgggagggtgtgcaaggatcattcagtccattaacctctgttaaaaggatatctcagaaaaaagactatgacattgcccttgttggggcctttagaagggaaaaggacaaagagatggaattacaggcactaagagatgaaattcaagcgtccatgaagctggtgagacaaagagaagatgagatacaaagtttgaagatgagactacgttttcgagaagctggaataaaaagattagaaacagttgcttctgagaagatctcagctgagacacacttgctaaaagaaaaagaggagcacttgaaggaaattgag

SEQ ID NO: 76139 - DNA, 597 bp, Glycine max
  Peptide Sequence Number=SeqID_192917
atggagaagtacattgcgactatgagaagaagcgattcccgaccggtgacggcgacctcggtggctattgcggcgtgctactctttgaattgcatgctgaggtttttcatctcgttcacggttcgagggaactcccaatctaggtcaatgtcgtggaacccgaaggtgcacgcgagggtgatggtggagttgatgaaggtggcgcgcgcggtggattttgcgttgatgagagagaagagagtggcgttggagttggtgccgccgatggagatgagggtggtgatggtggagccaagggtggtggtgaactttgtgaggtttgtggctgtggagtttgaaacgtgtgcgcgggtgacagttgaacaagtgcggcgggagaagctgttgttgcaagagagagaatgggaactagaggctgagttattccttatgagaacactattaccaaattgccccttgaattggttgtgggctcctattaaatgtttggactcctctagcccacgtgcttatccggcgcttgttagagtagaattgagagagttgtcggagactacccctcactttgcggttgcctcatctttcaaatccaactag

SEQ ID NO: 76140 - DNA, 1113 bp, Glycine max
  Peptide Sequence Number=SeqID_192918
atggggaaggccagaaaatggatcagaaacttccttctagggaaaaaagaagataaaatcaagaagatcgaggataagagtctgattgtgagtcccaaagtgaagtgcagatggagctttggaaaactaacaggaggaagaataacaagcaaggtagtaggccataaattttccagatcatttgactcaggtgactctgccaagctgcaaatacaacccttgttggaaactaagactccaaggcatcttccaaaaccactagcaaaggcttctaaagataaaaacaaagccgctacaaagattcaggccagctttcgctcgtatttggcaaggagagcattgcatgctttaaggggattagtcaagttacaggcactagtgaggggtcaccttgtaaggaaacaaacaactgctacactacgtggaatgcatgcgttgatggccatacaagttagagcccgaattcacagaattcagatggcagaggaagcaaacctcctcggacaacagcctctgcaacatagacaactcccatacttcacagatctcattacagaagaaaataaagattcaaacgatatgagtgtggaagaaatagtggaggttttgaaaagcaggagtggcccactagatggttcatatgttaagggaagagagcgtgattccatgacatactattcgaagcatgtgccggttgtttctaaacgacaaaaccaatacaagaaaactctaatggtagaaccaaacagcctaggaaactaccgtgccatgtctgaatttaacccagcgacaattgccttgtcaacttctcagcgccattatgtgcctcaccgtcaatcactgtcaccaaattacatgaacaagacagaatcttcaagggctaaagcaaggtcacagagtgaaccgaaacaacgaccaagacggggaacgaggcacaaaggcaagtctgtggaatccccattgaatggtccaaggcaaaatctattctcaaactcgttacgcttcgatcacagaagcctggaccattgggttatcaatcctcatgggtcaaaaaacgacagcaggcgcaattcctttggcagcagctcggttactactgaatcctattattga

SEQ ID NO: 76141 - DNA, 1668 bp, Glycine max
  Peptide Sequence Number=SeqID_192919
atggagcagtatgaaatacttgagcaaattggaaaaggtgctttcggttctgctcttcttgtgaagcataagcacgagaagaaaaaatatgtgctgaagaagattcgccttgcccgccaaactgagcgctctcgtaggtctgcacacctggagatggagctcctctccaaattaagaaatccatttcttgtggagtataaagattcatgggtagaaaagggttgctatgtgttcattattataggttattgtgagggtggagacatggcggaagctataaagaaagctagtggtgttatgtttcctgaggagaaactatgtaagtggcttgttcaacttcttatggcacttgattacttgcacgtgaatcatattcttcatcgtgatgtcaaggttgtgggaactcctagctacatgtgccctgagctccttgctgatataccttatggctctaaatcagatatttggtccttgggtgtcttctgtaaccatgctttcttgcttatttatttcatgtacttctggatccaggctgcagagctacttgggcaccaacatcttcaaccttatgttcttaaggtccatctcaaaatcaatagccccaggcgaagtacattgccaggccattggccagaatccaattacatggagaaaactagatttttgaagtctgaagatgatcctgtttccttctcagggaataagaggcattcttttagctatgatcggactttaaatcctagtatatctggagcagagcaagattctctatgctctacgctagagattgattgtactcctgataatttaaatcaaagatttgccgaactttctgttggagacaaccatgacgtgaagtcactccataagccagttgcttccagaacttctagtaaagccaggactcctagactaactgcatcaaaagcttctgccgcccccaagaaatcaatggtatcctcaaagaatcataagacgcttcctgtttcacacaatatgaaagaacctgtccatacaactcgcagagcatcattgccgttcccaagaagttgtaccatacagcagcctcctcgcagggccagtattggtttacttgaccatgtaaattcgctcaatatttcagttaactctcctcgtattgataggatagcagaattcccattagcatcatatgaagatcaattgtttcccatcaatagttcttcaccaaactcggcacagggttcctcaggcttccctccttgtggcaatgattcaactttgattgacaaatgcacaatcaaggtatgtgacacatcctatgttaggccaggatgtacggatgcttggcagggaatcacgaacagcatgttcaagaaaaacgatgaggataaaagtggctcatctgatcaaaatgcaactgctggagcatcaagccacaactcttcagacctgcgccaccgacagtttgatacatcatcattccgacaaagggctgaggccttagaaggtttgcttgaatttagtgcaagattactacagcaggaaaggtatggagaacttggagttttattaaaaccgtttgggccagggaaagcttccccgagggaaactgctatttggttgagcaagagtttaaaagagaacactttcagccgggaacaatccaccccacctaaattgctgtaa

SEQ ID NO: 76142 - DNA, 2772 bp, Glycine max
  Peptide Sequence Number=SeqID_192920
ggtgatatttttcgcgttgctgatattcaagaggaagtagctcgtcttcaacaaggaactcttgacatctcttcgtatttcaccaaattgacgacgctttgggaagaaattgagaattttcgtccaattcgtgattgtacttgtgctataccgtgttcttgtggtgctgctacagatttacgcaaattcaaggagcaagataaggtaatcaagttcttgaaaggtcttggtgatcaatattctcatgttcgctcgcagattatgctgatgtctccacttccaaccctagacaatgcattcaatttgattcttcaacaagaacgccagttcaatcttccttcaaccactgattcttcaattgagaatcaatcgtcggtgaatcacttctctcaaacgccttctcgtccttctaataattccggtcgtggtcgtggtcgtggatattccttcggtggtcgtggcaaccggctatgcactcactgtaatcacaccaatcatactgttgagacttgcttcatcaagcacgggtatcctcctggttttcaacatcgtaagtccaattcctctggaaatgcctctgtggtgaactctgttcaagatgctggttctgctcacatttcctcatcatcatctgcttccacatcaacaaatgaatcaagtgcttctttgtccacgattcaagagcaatatactcatattttacagctactccaacaatccaagttgcaatctacttcaccttcttcagttaattctgtttttgctacaaattttgtctctcatacctctccctctccttcatctagtaagaatctatcaaataataccagtcactggtggattgttgacaccggtgccattgatcacattactcatatctttgacagtttttcttccacatatcacattgcacccaaaactatgaccatgcctaatggtgacactgtcactaccacaatagctggtttagttttgttatatgactcccttgttcttcataatgtttactactttccttcgtttcatctacttcatcccaagatgactggatttacagctaggaggattggcaaattgtatgtgcttgacaccacctcacctctggttttctctcccacacctgacacatctgacattctcctagatcttccactatccttacctccaccaaatgaacctacctcccctcctgcaccaaccagaaaatcacatagactaacaaaacttcctgcttatctctctgaataccactgcaatttgctatcctcaatgctgccagcatctaatccagaacccaaaacttataaactagcttgtaagtttgattgctggaatcttgctatgaaatctgagttagatgctcttgcatccacaaacacttggtctgttgttgatctgcctgaaggtaagcaaccaattggttgcaaatgggtttacaagatcaagcatcatgctgatggatccattgaacgatacaaagcccgtttggtggcaaagggatacactcaactagagggtgtggattattttgacactttttcaccagttgctaagcttaccacaattcgcacccttctatctgtggctgctattaaggactggcacttagaacaacttgacatcaacaatgctttccttcatggtgatctgcatgaggaagtatatatggatctgcctcctgggttcttgccacctggttcttcttctaataaagtctgcaaattacataagtccttatatggactgaaacaggctagcagacaatggttctccaagttatccactgctcttatctcccttggatactcaccttcatctgctgaccattctttgttcacaaaactacataattctcatttcactgctcgtctagtctatgttgacgatattgtcttgacaggtgatgatttgcaggaaatacaatctgtcaaacaattccttgactccacattcaaaatcaaggaccttggcaagcttaaatactttcttggattggaaattgcaagatctactcaaggcatctttctcaatcaaaggaagtatgcattggaattgcttgaggacaatggtttattggctactaagcctagtacaactccctttgattgctccttgaagcttcatgacagtgactcacccccttatgaagatgaaacagtctataggagacttgttggcagacttttatatttaactacaaccaggcctgacattgctttcattgttcaacaacttagtcaattcatctctcagccattacaagttcatcactcagcagcaattagagtcctcaaatatctcaaaagtgctcctgccaagggattgttctattcttcctcctccacactcaaactctggttttgcagactcagattgggcaagttgccctgctactcgcagatcagtgactggttactgtgtctttcttggcacatctatgctgtcttggaaatccaaaaagcagtccacagtatccaggatcttcacatctctcttgatcaacctatctcagtctactgtgataataagagtgctatctatcttgctcataaccccatcttccatgagaggacaaaacatattgaaattgactgtcatgtcattcgtgagaaaatacaaactggcctcattcatctcctgccagtttcttctgctgcacaattggcagatgtacttaccaagccattgcctgctccctccttcaattcattgatttccaagcttggcctattagacattcatagtccagcttgtggggggctattacatgat

SEQ ID NO: 76143 - DNA, 198 bp, Glycine max
  Peptide Sequence Number=SeqID_192921
atgtgtgggtggcatggagtagctgacggtgatgatggtgcaattaacggcatagggatggcaggacacgtgaaaagaagcagagagaatacagtgctgtcgtacaggaacagcagccagcacgtgcaagcgcttactgtcacagagcaagagccaagagcacatgggatgggagaagcttattattactgtgcataa

SEQ ID NO: 76144 - DNA, 420 bp, Glycine max
  Peptide Sequence Number=SeqID_192922
atggagcaacagaaccatacgacggacactgatcagtttttgatcctgggccccacaccgaatgagccacacactccaatggcgcacgtcaacgtcgccgacaccaacaacaacgttgttggcggcgcagttaacgttggaattggttctggttcggcgcatgttgtggccgtagcgaaatccgagactgtaggttcgggacaggcggtgaagagagggagggggaggcctcggaagaacgacattgtcgaaaacgcggtgtcgccggcgacggggccgccgggattttccgatcaggctgccaagagaggcaggggacgtccccgtggttctaggaaactgcagattctagcttccattggtaataatctgaaccaacttgaacaagggagaattttattgcacatagcaatcatctga

SEQ ID NO: 76145 - DNA, 486 bp, Glycine max
  Peptide Sequence Number=SeqID_192923
atgacgggggaaatcgaaaagttgttcctcaggttgacttttcaagctagttatgccttgaaggctataggttctgattcggatattctgcgaaacaagcctgaagatctgctggaattactttcatatagtgacagtagtgagcaattggtagacacagatttagacaaaattaacaagtctaagcctatgaacactgtcaaacaaatgggtgcagcaaatgggaaaaatgaagaagcctttgattgcattagagaattagagagctctgatgacattgcaaaggttgagaattatagtgagattttaggtgaggaagtaaaattgccacatgacgaatctctcattggctccagctctcaagattcccaaatcgctctaaaattgagctttactcttcctgcttcatgctatgcaacaatggccataagggagctgctgaagacttcaacatctgttgcatatcacaagacattaaaccaatag

SEQ ID NO: 76146 - DNA, 390 bp, Glycine max
  Peptide Sequence Number=SeqID_192924
atgacaaaatcctcttggagcaaagttgggagcacattggaccagctaaccaaattggtttttctgagtgatgaatgtcatgttattgttacatttctggatgcaattttgagcaaaacactttgtggtacccttgccttgttggctggtcgtggctgtgggaaatcagctacccttggtttatctattgctggtgctatcgttgtcgggtattcaaatgtctttctaactgcacctagccctgataatttgaaaaccttgtttgaatttatactcaaaggttttgaggcacttcactacaagcttctccttgtgtatgctgtaagagataatatcatagatcctgtcaaagacgagatacttgattctctgaatttttctaaaaaataa

SEQ ID NO: 76147 - DNA, 168 bp, Glycine max
  Peptide Sequence Number=SeqID_192925
atggcgacatgtggcatggtgggacaaggagtcaaagtggtgctgaccaaggcgctaccggattggacgcgccgatggtgctacgggtcgcgctctgcgtgcagacgcgttgacccgcgctcttgcccgaggcgccttgggtcgcaccgtggtcccaggcgcgtctag

SEQ ID NO: 76148 - DNA, 752 bp, Glycine max
  Peptide Sequence Number=SeqID_192926
atacagctgggggaagcatcatacctcacgtgctgactgtgaaaattggagaggatttggtcagcacgataatgtcattttttgacaaagaccctcaagcaatttgcatactttctgccactggtgctgtttcagatgtggccattcgccaaaatggtgcttctcatgttattacgagactcgagggtacgtttgagatattgtctttatctggagcatttacctacgctaatagccctactggtccagttagtaaaactggctcgttgagtatttcattggctagaactgatgggagggtttttggaggtattcttgagagcgcattggtagcagcatgccctattcaacttgttatggcctctttcaagcaaaacatcagcagccaacaaatcaagagaaaacagttgtctgaatcttctaatgcacccctaatgctgtgcaattcagattcagaaagggaccaactgaaacttctaaagttgacggaaggtggtgacaagagttgtccttcaccaccaccaacaacaacacttgagccaacaacagcaacaactaatggtgtagcggataatgtctttactgcaacatccaatggagtggttgataatgtttttcttcaaaatcaaagtgtgcactctgcctctgttaatggtgttgctgatttggacagccaggccccgcagcccgcatcagactattctgaccaaatgactcatgcagatgtgaatgcaagtgtcattgtcttatga

SEQ ID NO: 76149 - DNA, 1017 bp, Glycine max
  Peptide Sequence Number=SeqID_192927
atgcataacttctttaaggaaaactttaagttcctggtcactgatgtggtcaatggacccgatgcttcatcgaaatgtatccgtgtgagattgaattctgctgaaccaaacaacaaaggcaaaaactccaagaaacgcaaagaaagagatgataagccttttgacagccgaggttcagaaaattggcctgaaaatgttggcaagttccttaggtttcatctttacaaggagaacaaagatacacatgaagccttgggggttattggaaatatgctcagcatccagccaaaatcatttggatttgcgggtacaaaggacaagcgtgctgtcacgacccaaagggttactgtttacaagcagcaagcaagtcggctagcttcccttaacaagcgcttgtttggtattaaattgggtgatttctgctttatctttgtatccatagcattgacatattttctcagaggtattgttgcagattctgaagatatcataaaagcatctgcagatgccttaggaaggcatggcttcattaactactttggtctccagaaaagtgcaatagccaaggcacgtaagtactataaagaaagtagtgatgttgttgggacacttaagcagttgcctcgatatttagttgctgaaagggctgtgctgcaaactttaaaaacgtctcctggaaattatttgcaggctttgaaaagtattccaaggactctgagaatgttgtatgttcatagttaccaaagctatttatggaaccatgctgcaagtaagagggtgcaaaaatatggaactgaaaatgtagtattaggggacttggtatattgtaaagaaaattctactggtaaggttacagagtttgttggatctgaatatgctgaagactgcaggggtaggtatgattctaataatgaagatgaagtctctggagagattcatgaagaaataaatagcgtcaaggttagtcttttgattttggcccattgcagaggcctgttgtactcaactgatatgtag

SEQ ID NO: 76150 - DNA, 336 bp, Glycine max
  Peptide Sequence Number=SeqID_192928
atggttactaagacagaggagactcaattgaacaggctcgaaaaccaggtcgataacggcggcggcggcgcgtgggagtacctctgcctcgtgcggaagctcaaagttcggcggtcggagaaagttctgaagcacggtctctccatcttgaacgacctcaaacaacgatcctctctcggctccgatgaatggaccttgtatgagcaggttgctgttgctgctatggactgccaatgtctcgacgttgccaagttgtgttgtggggatgctgatgatgcacctgagatggttgctcatgagtttttaccggggattataaacttgcttgagccttga

SEQ ID NO: 76151 - DNA, 198 bp, Glycine max
  Peptide Sequence Number=SeqID_192929
atggcgacgcaaagaagcaaaataacggaagtgaagagaatggagaagaggggacactactacggaagaaaacggaaactgggtattattggtgaccggcgaacgaaggttactcattcaacactcatgacgaaatgtgaaaccaaaaaaagtgagaccaagcttttacctgacacgaagaggagaggcttttgttaa

SEQ ID NO: 76152 - DNA, 1020 bp, Glycine max
  Peptide Sequence Number=SeqID_192930
atgcaagaaaatcaccaattagtcccctgtcctactgactgtgacgaagacttgaaggagttgaagaacaaattaaacaggatgatctcaggttgtttcagccaacccaacactccctcatcaagcaacatcagctacagctcccaagtgccacagaatgtggtgacatgcacatacctaactcaactatgcaactcccccacttatctcactctcagctggtccagaacccttttctcccactccctaaccatttcagccacagatatattttccatcacaatttctctgaactcctcaaccttcttcttcagaacacgccatggctcaaaatcaatcaacaaccgcaaaatcaagctccactggaacttcacccgcgccgagttcattcaaaactccgctgagccagagtcacgcttctacttggcaatctcacacaatggcaaactccaattctttttgggcgaccttgtccgcgatttgactcggcgccacaaaaagctcgacgttaaggctaacaacgttgttgacccagttctggtgtcgagaagagagcacgtgttcggaagaaggtgttacgtgtcacgtgcggtgttcatggggtcgaagcacgtgatagagatcgagtgcggagggggtgtgctgggagtgaaagtggacggtgagacgcggttggtggtgaaaaggttggcgtggaagttcagagggtacgagaagatattcatcgacggcgttgaagtggagttttattgggacgtgttgagttgggtggttaacagagacagcaataacgggcacggcgtctttgtgttccaagtgggagatggaacggtgtggccagaaatggtgggtgcggagaagaaattaatgaacaagagcgtgtcgtcggcttctagcgtcttgcaatgggcagaggagactagtgagtgtgggaggacctcttcttcttcatccacaaagttttctgggaccaatgccaccggcttctctttgttgctctatgcttggacctttaattaa

SEQ ID NO: 76153 - DNA, 993 bp, Glycine max
  Peptide Sequence Number=SeqID_192931
atgaatcagcttcaagcatctgagtttgttgaacttgatccaactgccagatacggcagaagccctgaagatctcgagaggctttactgtgaagttcatctcctcaagacgttgaagcacagaagcataatgaaattttacacttcttgggttgatacagcgaacagaaatatcaactttgtgactgaaatgttcacttctggtacccttagacaatataggcaaaagcacaagagagttaacattagggcagtgaagcattggtgtagacaaatcctgagagggcttctctatcttcatagccgtgacccacctgtgatccatagagatcttaaatgtgataatatttttgtcaacggaaaccaaggggaagttaagattggggatcttgggttggcagcaattgtccgcaagtcccatgctgctcattgtgtaggaacgcccgagttcatggcaccagaagtttatgaagagtcgtataatgaactagttgacatatattcctttgggatgtgtgtattagaaatggtcacatttgaatatccttatagcgaatgtagccatccagcacaaatctacaagaaagttatttctgagtggcaagatatcaatcgcattttacatttccaggggaagaaaccggatgccttgtataaagtgaaggatccagaagtgcgaaaatttgttgagaaatgcctggcaacagtgtctctaaggctctctgcaagggagcttctagatgatccttttcttcagattgatgattatgagtatgatttgggaccggtggacagtggatcatttgatgacttgggtcctcttacccatcagccattctttgatctccaccggacctatagtaacatgagtactgaatactcgaatggctttgaatatgaaggagactggtattctcatccagctgagattgaacctagtggaattgacttttcgagtgccatgacgatgaagcctctgaagatgttgacataa

SEQ ID NO: 76154 - DNA, 846 bp, Glycine max
  Peptide Sequence Number=SeqID_192932
atggttgcagaactcgacattactgatcaggatgttaccagtatatcagatatgatagacggggaaattgcttccttggtacctgaatggaagccaggaccaggaattgaagaaactaaccattatttaaataaaattgtttgtcacaattgtgtgtctaatcaaggcagaaagaacttgcagcttcctcaatgttgtaggcatggatgtgcttcaatgcatgggcgcttcgaggagattaccttcccatctgagtgtgacaatcatgttagaggggatgcacctatcaaatcaagccaatcagactgcttgcagtatcaggagtcatggaatcatcatgaaagttgtgaactgagtccagtagagtctgaccaaagtcattctggcgagcaatatgaacaatttgataaaccagtattagcagaagacaaagaaggaaagggtatttgggaaaacaagtttgcacatgatccaggaaaccccccacgaagtttatcaggaaattatttctctgctatccgttttttatgttgtggccctgagaatgaatatgagaaagaggttcaacaagaaatgagatggatcaaagcaaaacacgaaagggagtcaaggaaacttagggataaactgtttggtatagcagctaaatcttcacataccagtaacagagagcacaaaacccaacaaggcattatgccaccactgccacaaacagtaaacggagtggaccatggtattcacttgaaacccttgggtaatttctggaattatgattcagttgccgttctcaagtccaaaagaaccaccccaatttgggcacccaaagggcccaaaattgtgaggtga

SEQ ID NO: 76155 - DNA, 180 bp, Glycine max
  Peptide Sequence Number=SeqID_192933
gcagttgaggtgttatggacaccacagaatgagaacgatactctctcagaacgtgagttacttgaagattacccacttttacggcctttgatcatctccagtagtactgaaataatatcgttaaaactgatgagattgtcctgctactcaatctgcaaggcaattttcagctgcggctaa

SEQ ID NO: 76156 - DNA, 270 bp, Glycine max
  Peptide Sequence Number=SeqID_192934
atgacaacaggtgattcaacccaacagaagacaagtcaaggaaatgagaaaaagaaagaagatgaaaatataactcacgtgaaaaataaaattaagggtttcctttctctcgatctcgttagaggcgttccacctcaacaggagagaagtctaagaatcgagatagaggaagaactcaagaatattacgaaaggcgaaaagaagaaattcaagaatatagcacaagtgtttgttttacctatacatttaaaaagcgttaaaactcaatag

SEQ ID NO: 76157 - DNA, 258 bp, Glycine max
  Peptide Sequence Number=SeqID_192935
atgcttaaagggaagggagaggaaggtggaagagaaacatctgggttcattgcaaagacgaagacaaagttccactctggaagacacctcatacaaaatattacacacaccagacaaatgtggctaaccggaaagactctgcaatgtggaaacaaaactttcacagggatgagttcctacgttgcacgagatgtgggaaggagcgcaggttccatctcaagagcacaccagacattaagaactaccatgatgctttaa

SEQ ID NO: 76158 - DNA, 625 bp, Glycine max
  Peptide Sequence Number=SeqID_192936
atggcagaaatgggaaagttggatcatctagaggaaaggctcagggccatcgaaggaggtgaagattatgcctttgctaacctagaagagttgttcctagtacccaatatcatcacccctcccaagttcaaggtgctggactttgacaagtacaagggggattacttgccccaagaacccatctttaagatgtattgtcggaagatgggggcatacgcaaaagatgaagaattgttgatacatccttccaagaaagtcttactgggtgtcgatataatagcttcggataggatgcaactgcaaaacatgtgcaaaaaaaaggggcacggatctttcaaagaatacgcccaaaggtggagaacctggcagctcaagtggcacctcaatgacgaaaaaacgatgacaatgatagtagacacattaccagtattctactatggaaaatggtgggctacgcaccttcaaagctttgcggatttggtctttgccagtgaaaggatcgatgtgggtctggaaagaggcaaatttagtcatcctgcttggaaaaatgagaaaactggggcaaaggaagagggtgaggatgaaggagaagcccgtgctgtgactgccattcctatacagccaa

SEQ ID NO: 76159 - DNA, 279 bp, Glycine max
  Peptide Sequence Number=SeqID_192937
atgataccgacccaggcaggtgaccagcccagacatgcacctgccgcagaccctgaggagtacatgcagccgcccatcccacaggttccaatggcatttgacgcccctccacatgcagtggcgatcacggataggttggagcgtgtgctcaaccttaggatggtcactgcagatacaaagttacatgatattatgcaggattgcctcacggtcgctagagggggtgccagtgcagatggaagtgtcagggctcgacagagacggcgcacagagcattga

SEQ ID NO: 76160 - DNA, 456 bp, Glycine max
  Peptide Sequence Number=SeqID_192938
atggggcacccaacaaacaatgaatgggcgaaattgtccttctgcgattccttatttcggaagaacctactttcggacaaaattccggaagaggtctttccggaaaactcccggaagaaccttcttccggaagaagaaggtgggcttccggaagaactcccggaatacgttatggaaggacgtgtttcggaattttttccggaagtaggtttttccggaagaccaccttcttcttccagaaaaagatttttagagaagatgaacagtaaaatggtaaaaactttttccggaagaacattgaactaccggaggaagttgttccggaagaacagttgtgaaatttcggaccaacttattccggaagttgatgtggcaacttccggaagaagtgattccggaagagatttccggaacaacttcttccggaatttcagtgttgttcttccgaaatgttag

SEQ ID NO: 76161 - DNA, 151 bp, Glycine max
  Peptide Sequence Number=SeqID_192939
atggacgtaattggtactcgagatgatgttttgcagtgggctcgaacagttgcccatgaaaatggatttgttgtagtgattatgaagtctgacacagataccggtagcagaggaagaagttcatttgtcttaattgggtgtgaaaggagtg

SEQ ID NO: 76162 - DNA, 1248 bp, Glycine max
  Peptide Sequence Number=SeqID_192940
atgcttgatcacaaacataccaagatatctatattctcttttatcacattctcagccatattttatctcatgctctgtgattatcttatctaccacgattccctacaccctggaacactagtagaagtgctgcaacacagaaatggagaagggataaggtcaactttgactctctcacacacccctttacgttccatgcaagaagagaacgaaggagttggtgacagaaaccatggagtactagttgctccacttaatgccaatgaagaagagagaattgcatggtttagagggaagcttcacgagttcaagattctcaattcagacaagttgagcaggcgattccatgctcgggttctgcgatttttcagccacgaatgcgagtctcgatttttcatgatttgggagtcccctgcaggctcatttggtgcaagagaattgatgtccatagatagtgttttcaaggtgcatcccaaggcatgcttggtgattctatcaaggactttggacaccatccgtagctatagggtccttaagccaattcttgatgaagggttcaaagttcaaccagtgaccccagacttgcaatttctcttcaaggggactccagctgaagcatggttgaatgagttgaagaaagggaagaaggaccctggtcagatttctctctttcagaatctatcaaacttgattagacttgcagttttgtacaaatatggtggtgtctacctagacatagattttgtagtcttgaaacctatatctttgttgaggaattctattggagcacaaagcatggatgctgggaataagcactggactagactaaacaatgcagttctgatatttgacatgaatcatccacttcttctcagattcattgatgaatttgtgttgacttttgatgggaacagatgggggcataatggtccctaccttgtttccagagtggttaagagactaggggaaaagccaggcttcaattttacaatcttgcctcctatagccttttatccagcagattggaaaaagattggtggtctctttaggaagccaaaaactagaagtgaatcaaaattggttgatgccaaactgcttcagctcagtggtgagagttatggggtgcatctatggaacaaagaaagtaggagattgaagattgaagaaggaagtgtcatggaaagactaatatctaatcattgtgttacttgcaaaaacttaggcttcatttcaccaaccaagctttga

SEQ ID NO: 76163 - DNA, 1320 bp, Glycine max
  Peptide Sequence Number=SeqID_192941
atgtcgttgaagctctcagtcgtgccttgcttcttctcaatcagcttccgctcatcgctaaaagaaaaaggagggagttcagtccacgagttgcaggatcagccaccggttatacagaacagccggtgggctagccttcttctggagcttcttcgtgatgttattaatagattggaagcaagcgagagtacatggcctggttgtaagcatgtggttgcatgtgctgccatgtgcaagtcctggagagaaatgtgcaaagaaattgtcagcagtcctgaattctgtgggaagattactttccctgtttccttgaagcagcctgggcatagggatggacccattcagtgtttcatcaagagagacaaatctaagctgacataccacctcttcctttgccttagtcctgtcagttctactcctgcagtcttgcttgttgaaaatggaaagtttcttctctctgcaaaacggacaagaagaacaacttgcacaaagtatattatatcaatgaatgcagataacatatcaagatctagtagtacttacattggaaaactgagagagcgaatgatgataaaggtatacggagggaaaaaggataaatggcttcctctccacactcttgctgcatgtggagaattttaccttttagattctctgttgaagcacaatgttgatatcaatgttctgaaaaatgaagattcagggccattgaaggaatccacatccttgattgagcaccgtaagtgggatggattatattgtcttccttcggagaagagtgagattgtttcagatgagtatcttcctacaaatgatccaaagtctaacaataatataaatgatgaagctgcagaactagtcaagctgacagagcaatcactttttctcaagaaaaggacaaaccaaacaaagcccaggcctatagtagtgagattggatgatggagatgtggcaccaatttcagtcaaaagaccagagccaatggatgatattgtattgaattacaagcaagtgggaatgagaacattattgaaagtattctccttagttggctcatgttggagtattctcccttcttcctctgtatcttctaatggctatgtggtgttatcattattgaaaggtaaaaaaatcaaggcgaaaagcaagaaagacaatgaatttgatttcttctactttgttcagcagtggccaggagcatactgtgacacaaagcagagctgctgctatcctaagactgggaaacctgctatctatcatattttggtgctagaggtaaattgccttgcctccacgctcaaagtcttaaatctcacttaa

SEQ ID NO: 76164 - DNA, 366 bp, Glycine max
  Peptide Sequence Number=SeqID_192942
atggagcacacaagtttggcaacccattttgactcttatagtggctcacctattatcaagtccatatctttgtgggaaagtgattctgagcatgaattccaggatccttgggccatgatcaagcaaattggatccatcccttttgctggaaccgagagagaaagtgagttagcctcaaagggtagttacgtggaaggagattttggctctcattatagaaatgataaaagtggcaagcgcaagttgactaggaaagagtcctttaggagattgccaggatttggtttgtggagatgtggaagatttagattccctttgaaatttagacggcttaaacttagaattcggggtagaatattcggatag

SEQ ID NO: 76165 - DNA, 375 bp, Glycine max
  Peptide Sequence Number=SeqID_192943
atggccggtttcttcagcgccttcagcgtgttcgacaccgtgctcgccagaacctcccacggggactgcaaactaaacgtgttatccggcttccgcgacgaggagatacatttgacgcttgaaacgcggcgtttcgagtcgggtattggagtgaaacggtcgggccttgtgcgacgtggaagggaaggcgatggccagaaaaaattaaaaatatctcatataattatgaaatcacccatcaccacctgtgtgatcattactgtcactcgttctcgatgcatcacctctaacaacaacaccacaatcatgtgcagcttgaccgctaatacagtcatgcacaacactcccaccaccacattggattcacattcgtga

SEQ ID NO: 76166 - DNA, 970 bp, Glycine max
  Peptide Sequence Number=SeqID_192944
atgtccataacactcttactccaagccaacccctcccacttgaaatggaaccagttaccttcccttccacgtcgcacaaggcccgaccgtttcactccaatacccgactcgaaacgccgcgtttcaagcgtcaaatgtatctcctcgtcgcggaagccggataacacgtttagtttgcagtccccgtgggaggttctggcgagcacggtgtcgaacacgctgaaggcgctgaagaaaccggccatagctgcggtgttggtggggctgttattaatgtacgatccaacttgcgccttcgcggcatctggagggagaatgggaggaaggtcgttttcttcgtcttcttcttcgtctaggagttattcagtgccgaggacgtcaagctcagggttctctttttcggcgccgtattacgggccttctccgttcggtggggtttatgtgggtcccgccgtgggggtcggagtcggtgctggctcgagtttctttctcatcttagtgggattcctggcttttgttttggtttctggctttctttcggatcgctcagagggtagtgtgctcactgctgccgacaaaaccaccgtgctcaagcttcagttgcacggctgtgcttgtgtttctgaaccaaaggtaacggggccatgtattgaatgttctgaaggtcttgcaaaaaccagccatagctgcaatgatgctgggaggctgacatcctccaaccctggccccacccaaggcacctctttttcagcaccatattatgtgccttctatgttagtgtttggcagtggctgcagtgtgatttacattggtcctgctattggtctcagggtagtgtgcttgctgccactgataaaaacaccattctcaagcttcaagggtggtcaagttggattgttggggatgggtcgcacacttcaaagggatctgaataggattgcagaagttgctgatacatcaacttcagaag

SEQ ID NO: 76167 - DNA, 352 bp, Glycine max
  Peptide Sequence Number=SeqID_192945
actttacatcctggagatgctacagaaattaatgaagagatgaaagctagggcaagaggagacatgcctggagaaccacgtgcttcagttttggacaagagttgtatgtttctgtctttgcgggaagctcgtctcaatcccagctcagaacacaatatggcgagtttgctaagtgtgttctcacttctcagagaagcttgccgtgtgtgtggttgggacttggaaaaaattcagtccagctcaatttctgaatccttgctgagtggggtggtgtgggttcttcaaacccttgctgccattgtgttgctcaaagctttgctgcaaccttgtgtgattggccatgtgctgggat

SEQ ID NO: 76168 - DNA, 423 bp, Glycine max
  Peptide Sequence Number=SeqID_192946
atgggagtgccagcgttttaccggtggctcgcggatcggtacccgctctcgatcaccgacgtcgtggaggaggatccctctgccggcgccgttgatgtgtctaaacctaatcccagtggcatggagttcgacaacttgtacttggacatgaacggcatcattcacccctgttttcaccctgatggcaagccagcacccgctacctacgaagatgtattcaaatcaatctttgactacattgaccatatattttcattggttcgcccaaggaagcttctttatcttgcaatcggtatgttgcttcttcttgttattgtatctcttgtctatggagcaccaagcatttcccaatacttcatcgtacttgcagatgacactcacggaggaaataagattgacactattcctctttgtaaacaataa

SEQ ID NO: 76169 - DNA, 834 bp, Glycine max
  Peptide Sequence Number=SeqID_192947
atgaatcaacaacgttcacggcgtttccgagccgcaaaagatgcagctgagaaagacgcagctgaggctgaagctgaaattgaaagacttagggaagaatttgagggtgagatgaaactcttgtcttctaaagacaagccagagacttatgattcaaatgtcattacccctggcactccatttatgggagtgctgtcagtggctcttcagtattatatacagactagattgaactacaaccctggctggtggaatacaaaggttatactttctgattcaaatgttcctggtgagggagaacataaaataatggattacatacgattacagcgtaaccttcctgggtttaatccaaatactcgtcactgtttgtatggattggatgctgatttaattatgttgtccttagccacacatgaggttcatttctcaatattgagggaggtaatcactttccctggacaacaggagaagtgttttcagtgtggccaacttggccattttgcagctgaatgtcgtggtaagccaggtgagaaagctgaggactggaatccagttgatgataccccaattcacaagaagaaatatcagtttcttaacatctgggtgctgcgtgaatatttgcaatatgaaatggagattcccaaccctccttttgagattgactttgaacgcatagtggatgattttgtatttctatgcttctttgttggcaatgactttcttccacatatgccaacattagagatccgtgagggggctttaaatttattgatgcatatttacagaaaagaattcaccgccatgggtggttatcttactgaagcgggtgag

SEQ ID NO: 76170 - DNA, 168 bp, Glycine max
  Peptide Sequence Number=SeqID_192948
atgggtgatcaaaaaggcccatggcctaggttggtggcctccattgcacttaggagggactgtataagctcggcttcctccttgacaacgtatgtgtccgtgcttgaaaattttgtgcccattgtcgaagactccaccatgactaagggtctaagccccatcgaataa

SEQ ID NO: 76171 - DNA, 540 bp, Glycine max
  Peptide Sequence Number=SeqID_192949
gtccattatgaaaccactggaccagagatctggaagggctctagtgggaaggttgatgctcttgtctctgggattgggactggaggtacagtaacaggtgctggaaaatatctgaaagagcagaatcctgatataaagctatatggcattgaaccagtagaaagtccaatactgtctggaggaaaacccggccctcataagatccaaggaattggtgctggcttcatccctggtgttctggatgttgatttacttgatgaagttgttcaaatttcaagtgaagaagctattgaaactgctaagcttcttgcattgaaagaaggtttactggtgggaatatcatctggtgctgctgcagctgctgcagttaagatagcgaagaggccagaaaatgctggaaaactcattgttggggctgcgcgaacgcaagcccccactagcacaaattatgatgtaggctctcccacttggggagaccttaggtgggcacccctcctaagtgcaatggaggtcaccaacctaggccatggaccttcttga

SEQ ID NO: 76172 - DNA, 771 bp, Glycine max
  Peptide Sequence Number=SeqID_192950
atggaacgtgtagctgaatccgagcgaactctgtacccatacgtgactggatcctctgtagtcgctatcaaatacaaagatgggattctaatggccgctgacatgggaggttcgtatggatctaccctgcggtacaagagtgttgagcgtatcaagcctattggaaagcattctcttcttggtgctagcggggagataagtgactttcaggagattctgcgttaccttgatgagcttatcctatatgacaacatgtgggatgatgggaattctctagggccgaaggaggtgcataattatttaacccgtgtgatgtataatagacgtaacaagttcaacccattgtggaatgcacttgtacttggtggggtgaaaaacgggcagaagtaccttggcatggttaacatgattggcattaattttgaggacaaccatgtagcaaccgggcttggaaatcatctcgctaggccaattctccgtgatgagtggcatgaaaacttgacctttgaagagggcgtcaagttactggaaaaatgcatgcgtgtgcttttataccgtgataggtctgctgtcaacaaaatccagaacatagttattattcaaacaagtgaaatttctgattcaagcaagtctcagtgtctcaccctgttccaagagatatctaaaattacagatgaaggtgccactgttttcccaccattctcattgaaaacgtactgggagttctctgccttcaagaatccaactgtgggcgctgaaggttcatggtaa

SEQ ID NO: 76173 - DNA, 1395 bp, Glycine max
  Peptide Sequence Number=SeqID_192951
atggcctcatcttctccctctctaatgttcacagtgcgaaggtgccaacctgagctggtggctcctgctacacccactcctcaccaacttaaaccactatccgacatagatgatcaagacggctttcgtttccaggttccaattattcagatttatcataaccaaccatcaatggcagggaaagaccctgttgaagtcattcggcaggcactggcaaaaacacttgttttctattacccatttgccggtaggcttagggagggccctgaccgcaaattaatggtggattgtactggggagggcgtcatgttcattgaggctgatgcagacgtaacactttatcagtttggtggtgaagctctccaacctccattcccatgcttccaagaacttctatataatgttccagagactgaagaaattactaacactccccttctactcatacaggtgacacgactcaggtgtggtggtttcatcctggccactcgcatgaaccacaccatgagcgatggagctggtttgtcacaattcatgaacacttgggctgaaatggctcgaggtgttaaaagtccttccattgtacctgtgtggcgtagggagctcctaatggcaagagatccacctcgcattacatgcaaccatcgcgaatacgagcatgtcccagacaccaaggaagggaccatcacttcctcgtacgacaacgacaacaacatggttcatcgatcattcttcctaggacctgtcgagatagcagcccttcgccgcttgattccccataaccttaaatactgcaccacatttgatatcatcacagcatgcttgtggcgctgtcgcacaaaagcattgcaaatagaggcagatgaggatgttcgcatgatgtgcatagtcaatgcacgtgccaggttcaatcctccattacctgttggttactacggcaacgtttttgcataccctgcagcaatcaccactgcagggaagctttgtggaaatccatttgggtatgcggtggagttaatcaacaaagtgaaacgtgaggtgacggaggagtatatgcattctgtggcagatctattggtgatcaagggacgatgcttatttaacactgtacggtcttatattgtgtcggatttgtcacgtgccaagtttaggaatgtagattttgggtggggtgatgctgtgtttggtggaccggcaaaatgtggggcaggggcttttccaggagtttcctatttcaccccgggtaagaatgcaaaaggagaagaaggtataatatttgcgattgggttgcctgatgaagcaatggagaggtttgcaaaagagttgaatgacatgcttaggaaccaaaaccaacctcaaacgagtggtgctaactttatcatgtcttccctgtaa

SEQ ID NO: 76174 - DNA, 2556 bp, Glycine max
  Peptide Sequence Number=SeqID_192952
atggtaaagttgcaccttggtgactggttggttggtcatggtttcgaatccgaaaactttttttttgcacatgcaagagtaaggctgttttctgcaatgcaccgcgtgggtagtgcaagtaacggaaacaattcaactcgccctcgtaaggagaagagattaacctatgtgttgaatgattctgatgactcaaagcattgtgcaggcataaattgtctggctctacttatgtctgcagcatctgatgggtctgattatctgttcaccggaagccgtgatggcaggttaaaacgatgggcactaggggtggatagagcaacatgcttggctacctttgaatctcatgtcgattgggttaatgatgctgttcttgttggtgatagtacacttgtttcttgttcctcagatacaacccttaagacatggaatgccctgtcctttggaacttgtactaggactctccggcaacactctgactatgttacttgccttgcagcagctgaaaaaaataacaatactgttgcctctggtggccttggtggggaggtttttatatgggatatcgaggctgcccttgctccctctaagtgtaatgatgctatggttgatgaatcttcaaatggtatcaatggttctggcaacttactaccattgacatccttgcgtactattaactcaagcgacaatatgtccatgcacaccactcaaactcagggatacgttccaatttctgccaaaggccataaagattctgtttatgcattgactatgaatgaaagtggaacaattcttgtctctggtggcacagaaaaggttgtgcgtgtctgggacgcaagatcaggatcaaagactctaaagctaagagggcatacagataacatcagggctctgcttctggattctagtggcagatattgtttatcaggatcttcagactctatgataaggctttgggatataggtcagcagagatgtgtgcattcttatgcagttcatacagattctgtttgggcacttgccagcaccccaacatttagtcatgtttatagtggagggagagacttttcattatacttgacagatttgcaaactagagagagtagtttgctttgcacaggcgagcaccctattcttcaattggctttgcatgatgatagcatatgggttgcatcaacagactcttcagttcatagatggccagctgaaggatgcgaccctcaaaagattttccagagaggcaattcttttttagctggaaacttgtctttttcaagagcaagagtttcaccagaaggatctacccctgttcctgtatataaagaacctaccttaactatcttgggtacacctgcaatagtacaacatgaagttttgagtaataagaggcatgtgctgacaaaggatgcatctggttcagtgaagctgtgggagattaccaaaggcattgtcgttgaagattacggaaaggtttcatttgaggagaaaaaggaagagctatttgagatggttagcattcctgcatggttcacagtggataccaggcttggaagcttgtcagtccatttggacactccccaatgtttttcagcagagatgtattcagctgatcttaacattgtaggcaagcctgaagatgataaggttaatttggctcgagaaacccttaaagggctactggctcattggttgagaaaacgaaagcaaagaatgggatccccagctccagctaatggagaactattatctggaaaggagactgcttctagaagtagtacccattcaagaattgaggttgatggtagttctgagaatgatgctatggtttatcctccatttgaattctcagttacttcccctccttccattattactgagggcactcatggaggtccatggagaaaaaaaatcactgatttagatggaaccaaggatgagaaagactttccttggtggtgtctggactgcgtcttgaataatcggttacctcccagagaaaatacaaaatgcagtttttatttgcaaccatgtgaaggatcttcagtccagatcctcacacaagggaagctaagtgccccacgtatattaagaattcacaaagttgttaattatgtaatagagaagatggtgcttgacaaacctttggacagcttaagtgctgaaggtagtattgcccctggtcttactgggtcacagtcacagcatcaagcagttggggatggatcttttcgatctggatttcagccatggcaaaagcttagaccttctattgaaatattgtgctacaaccaggcaagcaatatgttgtcttgtatgcaatcttatgacagtgtatactgtatggtgctgtctcctgaaatgagcttagccacagttcgagcttatgtatggaagaaatcagatgacttggttctaaattacagactagttcaaggcaggttttcttgtgattatgtaaaaatacttctgaacaacaattcttcttgggttgcctgcattgatcggtgctggcgtgcatacttctgctggacatggtggaatcgtctgcatctggcatga

SEQ ID NO: 76175 - DNA, 405 bp, Glycine max
  Peptide Sequence Number=SeqID_192953
atgatgagcgatggagctggtttgtcacaattcatgaacacttgggctgaaatggctcgaggtgttaaaagtccttccattgcacctgtgtggcgtagggagctcctcatggcaagagatccacctcgcattacatgcaaccatcgtgaattcgagcatgtcccagacaccaaggaaagaataatcatccctgagaacgttcttcgatctttcttctttggacccgccgacatagagccagaagaggatgttcgcttgatgtgcatagtcaatgcacgtgccaggttctatcctccgttacccgttggttattacggcaatgcttttccataccctgcagcagtcaccgctgcagggaagctttgtggaaatccatttgggtatgcggtggaatcaaccaagtga

SEQ ID NO: 76176 - DNA, 1320 bp, Glycine max
  Peptide Sequence Number=SeqID_192954
tgcgaaggtgccaacctgagctggtggctcctgctggctgctacacccactcctcaccaacttaaaccactatccgacatagatgatcaagacggctttcgtttccaggttccaattattcagatttatcataaccaaccatcaatggcagggaaagaccctgttgaagtcattcggcaggcactggcaaaaacacttgttttctattacccatttgccggtaggcttagggagggccctgaccgcaaattaatggtggattgtactggggagggcgtcatgttcattgaggctgatgcagacgtaacactttatcagtttggtggtgaagctctccaacctccattcccatgcttccaagaacttctatataatgttccagagactgaagaaattactaacactccccttctactcatacaggtgacacgactcaagtgtgatggtttcatcttggccttccgcttcaaccacaccattggagacgcaggtggtatatcacagttcatgaacgcttggtctgaaatggctcgaagtcatgctaccaaaccttccatcgcacctgtgtggcgtagggagcttctaagggcaagagatccacctcgtattacatgcagccatcgcgaatacgaccaactcgaagacaccatcatcaccccttcgaacgataacatggttcagcgatcattcttctttggacccaccgaaatagctgccattcgtcgcttggttccacaccaccttcgtcaatgctcaacgtttgatctcatcacagcatgcttctggcgttgtcgcacaaaagcgttgcagatgaaaccagatgaggaagttcgcatgatgtgcatcatcaacgcacgtgctaggttcaatccccctttacctgttggttactacggtaatgccgttgcactccccgcagcagtcaccactgcagggaagctttgtggaaatccatttgggtatgcggtggagttaatcaataaactgaaacgtgaggtgacagaagagtatatgcattctgtggcatatctaatggatttgacacgtgctaggtttagagaagtggattttgggtggggtgatgctgtgtatggtggagttgcccaagctggggctggcacctttcctgcagcaacttatcatgtttcctataagaatgcgaaaggtgaagaaggcatagtgttaccgattttgttgcctaccgaatctatgaataggtttgcgaaagagttagaccacatgcttgggaaccggaaccagaaccagaaccagaaccaaccgacgacaagtagtcctaattttatcatgtctaccttatag

SEQ ID NO: 76177 - DNA, 528 bp, Glycine max
  Peptide Sequence Number=SeqID_192955
atggagagtagcttgctctttatattttgcactgttcatctaccacccgagaagtgtagggagctcttgaaggcaaccacctcgaatttcacgcacccatcacgaatacgaagtggaaaacaaagccaaagacacaatgatcccattaaacgactgcaacgttgtttcttcttcggacctagcgaggtagcttctctccgtagtttggttcccaaacatcttggtagatgcaccacttttgaggtcatcatcgcatgcacgtggagatgccgcataagagcattgcaacttgaccctgatgatggtgttcgcttcatttacaccgttaactttactaccaaggtgaaccctccgttgcctaagggttattacggtaatgaatttgtgctctcagccgcagtaaaaacatcacgaaggttacgtgagaatccattagggtatgctttggaattggcaaaaaatgtaaaatccaacgtggatgaggagtatgtgcttttggattgcgtggctaactgtattcggttctag

SEQ ID NO: 76178 - DNA, 690 bp, Glycine max
  Peptide Sequence Number=SeqID_192956
atgccttcacttcgcatcctaaacaaaatctgttattcgataaaccagaattgcaaatgccagtaccgaacaatctcctccacggcacagttgcagggttcatggatggaaaaggtcaaaaacgtcatcaccggccaaaacagcacgccccagtcccagggagacgcctccgaatcattcagtctgctccgttttgcggatgaaatgaagaatgcaaagagaataggcgcgtttaaggagttcatggttgggcgaagcagcgaagccactttttcctccgccttcgacaaatacgaagccataattcgatttctcggtgctttggaccccactggagagaatctccagacaactcagaaacaagaagcggcaaaacattgtaattgcacgattgctgatgtggagaatgcacttgccaagtttacttgggccaaggaagcacagaagaagttagagaagctaaaagaagaaggaaaaccaatgccaaaaagctttgctgaagtccaaaagctagttggttcaactccattggatcttgctaggtctaatttggcccaagctggacaaattagcaggaatgcactttgtccatgtggtgctgcggaaaggattgaaggaattcagagattaaatgttaaactgccaggaagcctgatctgttatggtggtttcatacctacacatggctaa

SEQ ID NO: 76179 - DNA, 282 bp, Glycine max
  Peptide Sequence Number=SeqID_192957
atgcgctgtaaagaagtgaaacgcctgcggaaaggagccaaatcacgaatggcagagggaacccttgttcaaaaaagcaactttgtcaagagtaagcagccgattccttttaacaagccacaaaatgaaagacatcttaggggggattgctgggttccatataacagaacaccaactaacagtaggcttgacacctctaatgtattcatagactttgtcaacaagcaattgttcattggtgctctaagattgaatcctctttttggcctcttccgtacttag

SEQ ID NO: 76180 - DNA, 198 bp, Glycine max
  Peptide Sequence Number=SeqID_192958
atggaatcaatgcagaccgaagctttgcttcttgatgggggtacgttgaactacttcgggaaacccatccccatcaatcttcttgttgttgagatagttcttgtgggaggtgatgagtactacagaataattaatggcttggtatctaacatttttgttactaagggaagggttaatgttcattttggtcatccaaag

SEQ ID NO: 76181 - DNA, 558 bp, Glycine max
  Peptide Sequence Number=SeqID_192959
atggcaagggtggatctctccaggattagtctccgaccattcaagatgagtgatgttgacgatttcttgatatgggcaggggatgatcaagtgactcgaaacctccgatggaagacgtgtggttcaagggaagaggctctggccttcataagggatgtttgcatacctcacccatggcgtagatcaatctgccttgatgaccgttccatcggctttgtttcggtgtatccttggtcgggcgatgaaaggtgcaaggccgacataggctatgctattgggaccaactactggggccaagggatagctaccaaagcactcatgactgcagtgcctcaagtcttcaaggactttaacgaattgctaaggttgcaggcttttgttgatgttgagaacaaggcttctcagagggtgttggaaaaggctgggttccttagagagggtgtcctcagaaagtacacttatcttaagggggttgttaaggatttgaccaattatactcgtttgagacagattcctccatctgatggtgtcgtgatgtttaacttcaatccattataa

SEQ ID NO: 76182 - DNA, 201 bp, Glycine max
  Peptide Sequence Number=SeqID_192960
atgaggctgcttcttgcctttcttctggaagtttcacgcccttttggagttccctcccctttctgcggtgaagtcagtccaatgaggctgcttcttgcctttcttctagaagtttcactcccttttgccaatcaagtatcattatgttactgcactgtgtccgggagggagcaacaaaaaattaccaatgggtccttctaa

SEQ ID NO: 76183 - DNA, 1659 bp, Glycine max
  Peptide Sequence Number=SeqID_192961
atgagcaccatcacgatcatgatcctaataccctttatactagcttcattgtttccctattttgaagctcagactctttcatcaaccttcgcgaaccaaggccaatggaatctcgtgcaaccaagcgttggcatatcagcaatgcacatgcaacttctccacaacgacaagatcatcatgttcgaccgaaccgattttggccactcgtacctccctctttccaatggccgttgccgcatggaccccaacgacattgccctaaaagttgattgttccgctcactccgtactatacgatgtacccacaaacactcttcgacccttaatgattcaaactgacacctggtgttcctcgggctcggttctccccaacggcacattgatccaaaccggtggctacaacgacggtgaacgtagcattcgcatgttcaccccatgcttcgatgaaacatgcgattgggtcgaattcccaggtttgttgtcacaaagacgatggtatgcaacgaaccaaatactcccagatgctcgtgtaattgttgttggaggtagaagacaattcaactatgaattcttacctaaaacacctagccctaacagttctccctcgtctattccacttaactttctccaacaaaccagcgatagaagtgaaaataatttataccctttcgtgcaccttttacccgatggaaacctattcatcttcgccaacacaaaatccgtgttattcgactacaaacaaaacagtgtgatcaaagagtttcctccaatcccaggtggtgatcctcgtaactaccctagctcgggttcttccgttcttctcccactagacgaaaacttagcttccctcgaagctgaagttgtggtgtgcggcggagcgccacgtggctcgtttgagagtgccgcacgtgggaacttcgtgcaagcccttggcacgtgcgggaggatcaaagtcactgaccctaaccctaattgggttatggagaacatgccaatgccaagagctatgggagacatgcttcttctccctaatggagatgtcgttataactaacggcgtaggggccgggaccgccgggtgggaacatggccatgacccggtcttgacgcctgtgttattccggccatcggagacggtgaatcggtttagtgtgatggcaccagcgtcaagacctaggttatatcactcttcagcggtgttattgagagatggaagagttttagttggtggtagcaacccacatgtcttttacaatttcaccggggttgagtaccccactgatcttagcttggaagcgttttctccgccgtatttggcgctggatttcgatccggtgcggccaacgattaggtatattacgaacaacaatgtgttggggtatagggtcttttgttacgtcacattcacggtgcctaattttgcttcggctagtgaggtttcggttaagatcgtggcaccgtcgtttactacgcactcttttggacagaatcagaggatggtggtgttgaagttgagtggggtgacgtatctggccggcgaggcttattatgccaccgtggtagggccttccacggcggagattgcgccgccggggtattaccttttgtttgtggttcataagggtgtgccaagttcgggttcgtgggtgcaagtgatgtaa

SEQ ID NO: 76184 - DNA, 615 bp, Glycine max
  Peptide Sequence Number=SeqID_192962
atgaacttgtcgcgaatcaccttgcggcctttgaagctgagcgacgtagatgatttcatggtcgtagctggtgatgatagagtgactcgctacacccgatggaacacttttgtttcgagggagcaagcgttgactttcattcgagatcatcaacatccatggactcgcgccatatgcgttgacgatgtaaccattggatatgtgtcggtgtctcctggatcgggtgatgacaggtgtagggctgagattggctgttacatagctaccgattactggggccaagggattgccaccgaagcaacgaagattgctgcgtcacaagtcttcaaggatctccctggcttggtgaggttacaagcttttgttgctgtagagaacaaagcgtcccaaagggtgttggaaaaagcagggtttcttagggaggccatactcaaaagttccttaatcttaatcgctatcattaaggaattagttagtaacttgttaaaatatggagtgggatttaattgggtagaaagaaagaggcatgaggcatgtgtagaccgccaacattattcacttgcccaaaagatgcgggagcaagccaaggagttcgaggcaagttcattcctgtga

SEQ ID NO: 76185 - DNA, 643 bp, Glycine max
  Peptide Sequence Number=SeqID_192963
atgatccccaagcgcctcctcaacaattcctcttcaatcgcccacacacaaccccactcactatccgacgccgtttcgctctttcaccgcaccatcgacaacgaccccacttccccaccctccgaacccgcctgcagcaccctcatcgacaacctccgcaaggcgcgccaatacgacgccgtcgtgtcggtataccacaagatggtgtccgcgctcgtcttgcccaggttcacctctctcagcgccttaaccgaaagcttcgtcaacacccaccacccaagtttcgctttttcggtcctcagcctcatgacaaagcgcggtttcggtgtcaacgtctataacttaaacctcgtgctgaagggtttttgccgaagtggtcaatgcgacaaggcaatgtctctgttttctcaaatgaagaggaattacgattgtgtggttcctgattgtgttacttacaatacccttgtaaatgggttttgtaaagctaagagattggcggaagctagggttttgtttgaggcaatgaagaaaggtggggattgcagacctaacttggttacgtatagtgttttaattgattgttattgtaagagtggtgaagttggtgaggggttgggtttgttggaggagatggagagggagg

SEQ ID NO: 76186 - DNA, 411 bp, Glycine max
  Peptide Sequence Number=SeqID_192964
atgaagatagttagtcatttgacttcttacttcctgcagtattttttttcttatctcattacttatgtttattgtaaggttaatgggggacgagaaggccggccaattggtgcttacgaactagcaaaagcagttgaagagcttggcgctggtgaaatactacttaattgcattgattgcgatggtcaaggaaaaggatttgatgaagatttgattaagttgatatcagatgctgtaagtatccctgttatcgcaagtagcggtgctggtgctcctcaacacttctctgaggtgttctataaaacaaatgcatcagcagcacttgctgccggcatctttcacaaggaagaggtgcctattcagtcggtaaaagagcatttgttgaaggaaggcatagaagttggaatttga

SEQ ID NO: 76187 - DNA, 201 bp, Glycine max
  Peptide Sequence Number=SeqID_192965
atggctttaggaatggaatttaagcagagagatggtgtgaagcgtcaaagagaaagggacggagctggtcatagtcctactgatttgttgggtgttggagaagttggacgacttcgatcactgtcgattcggtgtcgttctgtgaagaaggcgaaggtgaggatgaacagttgtggcagcgccataaagaggaaaatgtga

SEQ ID NO: 76188 - DNA, 756 bp, Glycine max
  Peptide Sequence Number=SeqID_192966
atggagtttggaggtcatttcaaccagttgccattttatggcaaagagatgcaaaatcatgttagattggctaaccttaaggctttctttctcattttgagacaaggaatcctgtatcctgattggggtgagataaactgtcaatcttctactggagtcaactttggtctcattattgtcgacatcaccttattggaatttatcatcgtcgttgtcacctccgttgtcggcaaaatcatcctccacctcaaccctgattccttctacggtagtcactttgcttctctttccctcaacgacctcacttccactttggtggggaggttgatgtcagtgataggtgggggaagtggttgtgtaaggagcagaaggggcaatgtcagattggtaattaaggcgtgcgtaaaggttcaaaacgacgtcgcatcgggagtagaggacagggtcataacggagaagagggaacccactgttcaacaacatcaaggtgaagaggacaaagttgttgcagcagagggcgcatatacctccattatgacacggtcatcgcagaagctggagaaggcgagcaatgcaatctgcctcggcacagggatcgaggtggcgacgttcgtggtggatgtgcgaagcgtggaggaattgtctagagcgtctgcggcagacatcggtaggccctcgactgtgaacttggcggacttggagggtgagaagagggagaagaaagtatgggagaaagagaggagggagacgagctag

SEQ ID NO: 76189 - DNA, 1371 bp, Glycine max
  Peptide Sequence Number=SeqID_192967
atggaccaaactcaaaatgagtctggttggatgcattctatcaaagtgacactaggatctctagatcacagagaggttaagtccttcataagcagcatcccttgtgtttcaagcaagcttagaaaatcaaatgaggaagcttattcaccaaagtttgtcagcattggacccttatacagaggaacaagtagccaccttctggccatggaagagcacaaatggcgttacatgctggctctccttcatagaactcaaaatccagtttcaaccttggatgaatgtggcactgtcattctaggcttggacgatgcagttcgtgcaagctatggaggtaacatcaaatatgaaactcatgagctagccaaaataatgttacttgatggctccttcttgctagaacttcttcttagatgcgcaccaccaaacatggttcctcaaattccaaaagaagataaccataataatggttcttcttcagatccaatactaggacacaaagaggtgtttttatctattctcaccgatttcactctactagagaaccaaatgcccttttttgttctcaagacattggctaggatgctttttcccaatgtcttcacaagtgaagctgatcaccttgttgctgatctcacactgtctctcttcagctaccctttgatccggtgtcctagcgtggcgcattttcttcacctcatgcacttgtcctccattgttgatgagggacaaaaggtgaaacaagctcagcaagagcttaagcgttgcgcgacaaggcttagagctgctggtgtaacaattaggaaagttgagagacacagcaagttggttaactggtttggctttgacataagattttccaaaggggtgcttgaaattccaccacttcatgtagttgacacaactgaggtctatttgaggaacttcattgcatgggagcaaagtagaattggcatcaacaggcaattcacttcttatgctttgtttcttagaggcttgatgtgttctgtgcaagatattgagctgcttgtggaaaatggtgttttggtgaaaggtactaagatcagcaacagagatttgctcactttgtttggcacaatcacaaagggagtggaccaaatggacaatagttacagcaaactttgtgaggacttgaatgcttactcagcagtgaaccccttgaggaagttccctatactgatgttgcattgttgcaacctttgtgtagaatgcatcagatactcttgcaaacacagctataaaatcttgattagagatcatatcccaaatgtgtggaaattgatagggattgtggtagctgctgctctgcttgctcttaccattatgcaaacctactattcagcccgtggctaa

SEQ ID NO: 76190 - DNA, 303 bp, Glycine max
  Peptide Sequence Number=SeqID_192968
atggaagatcatggacagaaccaaaggaagaggcacaatgtatttggtgcgtttgtggataaatcacttggttacccatcttctggtgcagatgaccatgaccccaagaagcttaaacccaattctgaagctcctttatcaaccatagaccaacaagtccctgcattaccccttcccaatatattggtttctgcatttaaggagaacaccacagatggtgtcaaatttcaactgtttgtgagcaaatcttatacacaatcaacttcaacttcccctccaccaggtcagtatgcatctttatga

SEQ ID NO: 76191 - DNA, 825 bp, Glycine max
  Peptide Sequence Number=SeqID_192969
atggttgggctatacatcaaatggatgtcaagacaaaaagagaaagtgtatagattgaataaggccttatatgggctaaaacaagcaccaagatcatggtatagcgaaattgatgcacacttggtgaacttaggctttgtaaaaagtccaactgaatttaccctttatgtcaaaaaggttgataatgacatacttgtggtatctctttatgttgatgatttgtttgttacaggaagtcatgatgagtttattgataagttcaaagaaagagtgaaagatgcctttgaaatgacagaccttggaaagatgacattcttccttggtatgcaggtgcaacaaaagcataatgaaatatttgtgtaccagcaaaaatatgcgaaagaagtccttaggaagttcaacatggaagagtgcaaaccaactccaactccaatgaatcagaagaaatttttttgcaaagaagatgaagctgaaaaggttgatgaaaggttgtacaaaatcctaatagggtgcttgatgtatttgatagcaactaggccaaatataatgtatgttgtgagtttactatcaagttattctgataatgattgggcaggatgtgttgatgatatgaggagcacttcaggttattgctttactttaggttttggtatgttttcatggtgttctaaaaaacaagaagttatacttcaatcaacagcagaagcaaagtatatgactgttgttgctgcggtgcttcctaaaaacagatttgagttcttgaggaaaagatttggaataagagcttcacggtcaaggaggagtgttgattgcaatgacccatga

SEQ ID NO: 76192 - DNA, 789 bp, Glycine max
  Peptide Sequence Number=SeqID_192970
atgaaactaaaaactgcaagtgccatatggaattatttgaaggaggagtatgaagaagatgattggatacgaaacatgcaagttttgaatttaattcgagaattcaaattacaaaggatgaaggagtctgatacaatcaaagatttctcagacagactgcttgacattgctaacaaggtgaggttgttagacacagaatttgaagattcaagaattgtacaaaaaatacatgtaacagttcctgaaaaatatgaagcctctgtaacaactttggagaacacaaaggatcaatctcagatcactttgttagaagttttgcatgctttaaagacgcaagaacaaaagaaggcttatgaggtaggaagaatctgtggaggcaacagacctgaagcttttgcaaacaacaaaaatcaaaacagcaacactcaggtacatccaccttgcccttactgtaaaaaaactaatcacccacaaaaaaagtgttggtggaggccagatgtaaggtgtcataggtgtggtcagttagggcatgttgaaagaatatgcaaatttcaacaacaacaagaagaagtcaaggttgttgaggaccaatcacaagaggagcagttgttcgttgcatcatgtttggcttccagtagctctacaaaaagttggcttattgatagtggttgtacaaaccacatgacctatgatcgtgagctctttacagaacttgatgaagctattttttctaaagtcaagataggaaatgcaacatatattgaaataaaaggcaaaggaattgtgtga

SEQ ID NO: 76193 - DNA, 753 bp, Glycine max
  Peptide Sequence Number=SeqID_192971
atggaggattctgccacgactggtcatcacaacgaaagaaaaagaagctgtgacaacaatgcttttgccaagtttgttcccttttctccaccattagaacacgacaccgaatcaatcgaggctaaatttggtggtcaccatgaccatggccaaaagagactcaaaccaaattctcaagctcctttattagaaaccaccaccaacttctccccctcttctcatcttcctaaccaaaacattgacacaaaggaaacaccagattttccatctccatcaacttcctttaagcattcagataatgttggaccatcacctcaatccattggtagcaagtcatcacacattgagtatgtggagaatgatgggaaaatcagcaaaacagtctcagatagttgtaattggaaagaagatcagaatcagagtgagctagaatcaatgatatctatggcagctgaggaactatccaggaggcctaaaaccgggggcatctacaaagaaattgcgaatcaacgcgagtgcaccgtgaaacgtttgaaagatttgtcaaacaaagagcctacaatagatgttggacttgagatggctgatgcagcacatcttttgaaacttatgagcttctcaagcaatgagatcgagatggcagggcaaaagggtcacaaaggagctaagttgttgcttcaagcagagatcctacgcaagaaaggacaagaactcattgcggagtgccagaacttgctgcaaaatgcattataa

SEQ ID NO: 76194 - DNA, 327 bp, Glycine max
  Peptide Sequence Number=SeqID_192972
atggccacaaaggaattgaacgaagagcaactagaagcacctgttgaagaagttgttactgatgttgagggttttccagacggaccccatgacacatcagttcttagagattttgaaaatcacattactttaagagtctgtaatggagaagaacgtcctgagctgaagttatcttcccatggaaggaagatggctaagttcgagaggcctacttcagagattgaagatctcgtggcgaccagtggactaaatcctttgatcgtctgttccctagatactggtgtttcacctctcggcaactgtgaaatttatcagcaagtatactga

SEQ ID NO: 76195 - DNA, 318 bp, Glycine max
  Peptide Sequence Number=SeqID_192973
atgtccacaagagataatccaggttcagttggttgcggtgaaattttcagaaacttcaccggctctgctattggttgtttcacggcttctttgggtattcagaactcttttgtcgagataatgggtggtgctatttttgcaatagagcttgcaacctcaaaagattttacaaagagtatgaattctttagttggtcataaacaggaaccacgagtgagagccaagctgaatcttttaagggaattgaaattgaaattgcatagcaatgaaattaaaattttagtgccactaaagagtgaggatgaggaccacgagtaa

SEQ ID NO: 76196 - DNA, 783 bp, Glycine max
  Peptide Sequence Number=SeqID_192974
atggaaacaatgttgcctccgaaccaagcagaggaagcaatagtcacaacaagccttaacgagacagagagtgaagttggtatgagggaagaagagaaggagttgcaacaacaagatcactccatgttcaacatcaagagcttcctctggcatggaggctctgtttgggacgcatggttcagctgtgcttcaaatcaagtggctcaagtgctgttgacactgccctattctttctctcaactgggcatgctatcaggaatcttgcttcagattttctatggaatcttgggaagttggacagcgtatctaatcagtgtcctctacatggagtaccgtaccagaaaggaaaaagaaaatgtcagtttcaagaaccatgtcattcagtggtttgaagtgcttgatgggttactgggtccgtattggaaagcggtggggttagccttcaactgtactttcctcctctttggatctgtgattcagcttatagcatgtgcaagtaacatctactacataaatgaccacttggataaacgaacttggacttatatctttggagcttgctgtgccacctctgtgttcataccttcttttcacaattaccgtatttggtcttttctgggacttggaatgaccacttacactgcttggtacttggcaatagcagcccttattcatggccaggcagaaaatgtgacacacacgggtccaacgaagctagtgctgtacttcacaggagccaccaacatactgtacacgtttggtggacatgcagttactgtgtaa

SEQ ID NO: 76197 - DNA, 2292 bp, Glycine max
  Peptide Sequence Number=SeqID_192975
atggcactagaggatgtcaacaaaacagcttttcgtacacatcacgaccattataaatttctggtaatgccatttgggctttgtaatgccccctcctcgttccaggaaactatgaacaccatttttgggcctcacctgtggaaattcgttatcttcttcttcgatgatattctggtttatagcaggaccttctccgatcacctggaacacttgcgtcaaacctttcagacccttgccgacaacagctttgtccttaaactatccaaatgctcatttgccacccagcaggtcgagtatttagatcacttggtatcgcaaggtgacatagaaccagtactagagaaagtcgccgccgtacagcaatggccacctccgcaattagtaaggcagctacgtgggtatgcaaccttggcggcaccttttacgacactattgacaaaggatcaatttcaatggacatcggaagctgccacaactttctccaaactgaaggaagctctatgccaagcccctgttctgggcttacctgacttctcagtgtcattcgtgattaagactggcgcctcaggcatcggcatgagagcagttctctcccaacatcaccatcaccaccctcttgcattctttagcaaaaccttttgctcgaaactcctccgagcgtctacgtacgtgcgagagctagttgcgatcatggcggccgtaaagaaatggaggcaatatttattgggccatcattttataatcctcacagaccataagagcctgaaagagctcatggctcaagcagtccaaactctagagcaacaagtctacctcacacgactaatgggatacgactacactatccattaccgtgccggcaaacataacttggcagctgacgccctctcacgcttgcctgatcctccacagggtcaatcttttatgctaaccattcctaattgtgttttcttgcagaaactcaaagcagagcttgcctctaataaggaattccttactaggaagaagcaaattcaagagaagccacacaatcaccccgagtgcgttctccgggatgacctgatactacaacatgggcgaatttggctcccacgaggacttcaaattctacagacaattttggccgaattccactccacccccactggtggccatatggggatcatgaagacattggttaaagttcatgaaaacttcacctgggcatcaatgaagcaagacattcatcattatatcaccaattgtatcacttgtcaacaaatcaaagttgatcatcgtcgtccagcaggactcctgtgccctcttccaattccggcaagaccatgggaggatctctccctggacttcatcacgagtctacccatttatcgtggaaactcagtcatcttggtaattgtggatcgcttctcaaagggaattcacttgggaccactaccccaacatcacacagcttccgacgttgctcaattgttcatggaaatctccggcaagtttcacggcatgccacacagtctggtctccgataaggacccactatttgttagtcgtttctggcaggaactattcaaaatgagtggtaccaagctccgaatgagctcagcgtaccatcctcaatttgacgaacaaacggaggccatgaatcgctggtcatacaatacatcgactcactccgccacagggaagacaccttatgagatcactttcggcaagcaaccaccaagcttgccacaatatctcgaaggaagttcgaatgtcaatgttgtcgatgagtggctaacacaacgcgatgaaatatttgcaagcttggcaaagaagctagccaaagcccagctacgaatgaaggaatttgcagaccaatggcgccaggatgtaagctacgaagaaggagacactgtgttggtcaaactacgacctcgtcgccaaacgtcagcaacaggaggcacttattccaagctcgcaaaaagatactatggaccattcaaaattgttaagaagattagcagtgtgggttaccaattgaatttgccaccaacttctagaattcatccagtttttcactattcactacataagccatatcatccttctgatattgaagtcccacctaacctaccagcatcctctgaaggaaatgaacctctcatcactcctctggaaattttagatgcaaaatgggaagagacaccgaccagcaacaatagctacaaccttgaggacaaggtcgttttggaagcatacggggatgttatgaacgcagaaccaacaccaagaatagagcaacacaaggaataa

SEQ ID NO: 76198 - DNA, 873 bp, Glycine max
  Peptide Sequence Number=SeqID_192976
atgccgatgcctgaggcgccagtcttaatcacgaatgacactgagaagtcaggtaagcccagaacaggggcttggcatagagcttccttcagtttggagaaagttgtggcagcttccgatccggagagccccaagaaaccacgtagctgccttactaattgcggaggtggccattgctgtacggcggcgactttctctagtactgctgttgtcggcaagggtctgaaaggtttgacgcaagtgttccaggtgatcggagaaggtcctgctataaaccagaatatcatcgaagaagaagataacgaatttccacagggccctgtagtcaacgcagaagcgccacgagccatcccttttcttgacaagaagaattggggaagagaaagggcttgtattgggacgaatgatgccattctgaagcatcgtgttgacttgggattcaatttcctgtttctggaagtggggatagcggtagggtcagacattaatgggggaggagttagggagaaggtgaatggaatgatcggtgggtctggaagggggaaggtgtgttggaggttgaaagagggtgggaaagaggttgatgatggagagcatagtggggtgggtgggttaggtggtcgtgggttgagggcacacccggatgtggaaaaattcattggcactgcgtgtttggaggagatgccagagctggggagtgcagatggccccattggactccgaagacgatgtaggcctcgcacaaagggaggacatgccaagagacttgacgaggtgttcttgcacaaagttgtgtgtgctgcctccgtcaatcaaaatgatgacacagtggtgagaaatccggccagtgatgcagagtgtttccgatgttga

SEQ ID NO: 76199 - DNA, 1914 bp, Glycine max
  Peptide Sequence Number=SeqID_192977
atgcaccgtgtgggtagtgcgagtaacggaaacaattcaactcgcccgcgcaaggagaagagaataacctacgtgttgaatgattctgatgacacaaagcattgtgcaggcataaattgtctggctctacttacatctgcagcatctgatgggtctgattatctcttcactgggagccgtgatggtaggttaaaacgatgggcactagatgtgaatagagcaacatcatcggctacctttgaatctcatgtcgattgggttaatgatgctgttcttgttggtgatagcacacttgtttcttgttcttcagatacaacccttaagacatggaatgccttgtcctttggaacctgtactagaacactccgacaacactttgactatgttacttgccttgcagcagcaggaaaaaatagcaatattgttgcctctggtggccttggcggggaggtttttatatgggatatcgaggctgccatcactccggtttctaagtgcaatgatgctacaattgatgaatcttcaaatggtatcaatggttctggcaacttactaccattgacaagcttgcgtcctattaactcaagcaacaatatgtccatgcacactactcaaactcagggatacattccaattgctgccaaaggccataaagattctgtttatgcattggctatgaatgaaagtggaacaattcttgtctctggtggcacagaaaaggttgtgcgtgtctgggatgcaagatcaggatcaaagactctaaagctaagaggacatacagataacatcagggctctgcttctggattctagtggcagatattgtttatcaggatcttcagactctatgataaggctttgggatataggtcagcaaagatgtgtgcattcttatgcagttcatacagattctgtttgggcacttgccagcaccccaacatttagtcatgtttatagtggagggagagacttttcattatacttgacagatttgcaaactagagagagtagtttgctttgcacaggcgagcaccctattcttcagttggctttgcatgatgatagcatttgggttgcatcaacagactcttcagttcatagatggccagctgaaggatacgacccacaaaagattttccagagaggcaattcttttttagctggaaacttgtccttttcgagagcaagagtgtcaatagaaggatctacccctgttcctgtatataaagaacctaccttaactatcttgggtacacctgcaatagtacaacatgaagttttgaataataagagacatgtgctgacaaaggatgcatctgattcagtgaagctgtgggagattaccaaaggtgttgtgattgaagattacggaaaggtttcgtttgaggagaaaaaggaagagctatttgagatggttagtattcctgcatggttcacagtggataccaggcttggaagcttgtcagtccatttggacactcctcaatgtttctctgcagagatgtattcagcagatcttaacattgtaggcaagcctgaagatgataagattaatttggctcgagaaacccttaaagggctattggctcattggttgagaaaacgaaagcaaagaatggaatccccagctccagctaatggggagttattatctggaaaggatatttcttctagaagtcttgcccattctagaattgaggttgatggtagttctgagaatgatgctatggtttatcctccatttgaattctcagttacttcccctccttccattattactgagggcactcatggaggtccctggagaaaaaaaattactgatttagatggaaccaaggatgagaaagacttcccctggtggtgtctagactgcgttttgaataatcggttacctccccgagaaaatactaagtaa

SEQ ID NO: 76200 - DNA, 285 bp, Glycine max
  Peptide Sequence Number=SeqID_192978
atgtataagaaccggttgcaagaattggctcaaagaagttgttttaatttgccagcctactcatgcattcgcgaagggccagatcatgctcctcgttttaaagcaactgtcaattttaatggagagacctttgaaagccctacattctgctctactcttagacaggcagaacatgcagcagctgaggtggctcttaacactattgcaaaaagaggtccctctggagctttggcagcaagagttctggtgagcaagtgggaatttttcatcatccccctttcctag

SEQ ID NO: 76201 - DNA, 462 bp, Glycine max
  Peptide Sequence Number=SeqID_192979
atgaaaatagctggggtgggagagaggaatgagaagaaaatagctgctattctaggagcaatggttaaggaattagttcttgactacaatgacttaatgaagatccccatagtcaacgatcaaataagaaatatgaaccgtgactcagttaagtttagagatgaaacaagtggcgaggtggcaaaccaaaatctctcttttccggtgcttctaccaaagataccaggtcgcttttactttctatttgggaagcccataagaacaaaaggcatggataagatgctaaaagacagagaaagtgccaaccaaatgtacctgcagattaagtcagaagttgaacacaatttaaattacttgatcaagaagagggaggaggatccatacaggaacttcatcgataggaaaatgtatcagatattttatcctcctgaaactgattcaaccccatcatttaatccctga

SEQ ID NO: 76202 - DNA, 138 bp, Glycine max
  Peptide Sequence Number=SeqID_192980
atgaccaataagtcaccaaggaccgctgcaccagggctcgccctcaagcgaatcaggaagcacgctctttgttacacaaacacacagtgcaggggtttatatgtgacagttgacattggcatcaattatgaacattga

SEQ ID NO: 76203 - DNA, 1151 bp, Glycine max
  Peptide Sequence Number=SeqID_192981
tgtcagagcaccatttatcttcttcaacttcatcttcattttctcgagagtctaaagcaaatgaagaacaggagcaagtaatcatcgctggggtccttgcaagtttacacccatctggttcaaagaacttctccacaagtgatagtcaacttggatggcaaaagtccactacaacctctttggtgtctactcagtcaactgcagacttgtatcctatgcaatggcattgtggaatctctagtttctcgccagaggtggctctatatcagacttggcagcaacaacaaattatgcagcagcaaaatcgtctattggaactaaccattcaaccaattattccatctactccagagatttatccgttaatgcaatccgttttccagccagaccactgcctttattttccagctcgagagttagcatcagttcctctaggaccaaaattatcaattgctacatcaaacccttcattttactcttcaaaccaaattgttcccgagttaaacacgggcaggtcaacactaaccatcagagagatacaagaagaaaaaacagaagatcccccagtttgcacttttagcaatgaaactagagtcctaacaccagctccagaggatgagattcagaagcatggtggctctggaggcagaagtagaaatgctgagctggtaggagaacactgtgagaaaactgaatgtgattctcattggagcacgcgatctgtaatcagaccagttaatactgagctgcaaaacccatccagtattgactcatctgttctcagagcacactcacaagcaagttccaacagaagttttagaccaccagctgctgcatcatcctccattgtgagaaccatgtgccctacttcatctgtgggttcaagaccacagcatgctgcatcaaggttgagaaccggaactccacgaagtccaggcattcctacctctgaaaggtttggcatgataagagcacctactcctctattcatggcaccagctgtgagaatccgatcagtggtcccggtctgctcagctcctccaaggagatccatggcagaggtgtcccaaagcaaggaaaaagaagatttgaagcctgaagacaaagaggtgtcaagaactagctctgagctaggccatcttagaatatga

SEQ ID NO: 76204 - DNA, 369 bp, Glycine max
  Peptide Sequence Number=SeqID_192982
atgaaatcactatttttggtgaccccggctgtgcgactttgcctccttatgcgaagaaatccagcacgtcagccatatcgtcatccttctgagctcctccgtcatccccaggggcctctgcgggtcatgcctgtgtctcaaaattgggctcctaactctggttgtgcatattgtaccggtagaatcctcatcgtcgaagccagaggcctgactcctcctctggctaaactcatagtgctggccttcctccaagaccaatggatgccccagaaactggttaatggcatcctcatcgaagggattcactggcctctcacccaggagtgtttgtctttaactccctcctttgtaggccatgcattggcataa

SEQ ID NO: 76205 - DNA, 446 bp, Glycine max
  Peptide Sequence Number=SeqID_192983
atgagacattctaccggtacaatatgcacaaccagagttaggagcccaattttgagacacaggcatgacccgcagaggcccctggggatgacggaggagctcagaaggatgacgatatggctgacgtgctggatttcttcgcataaggaggcaaagtcgcacagccgggaattggcagaggcccatgatcagagcaggaaatcccagggccttgctggacttctccgggtccactgggtgtctcgaagagggtacatctacttgggtttgactgagaacaagagagggtacatctcttgtggatcagttctagtggagggtacatccactaggttgttcaaagagaacaagggagggtacatcccttgtggatctttgcttttaaaaggatttttacaaggttggaaaagaaatctcaaggaccacaggtcgcttggggactggat

SEQ ID NO: 76206 - DNA, 354 bp, Glycine max
  Peptide Sequence Number=SeqID_192984
atggagggtttagcctctcattaccatgagagactttacactttaggggttgatgggaatagaagaagaagagggatgaataagggaagagaagggaagaatggatctagaaaaaggccctgcttcctaacgctaagcgtgttgtgcccattgagcttgtgcatcgtgctaagctcttgggacgcagatatatcaactgatatcaagcttagaatctcatcaagactggagagatcacctgaaagattattgtgtgagagattcgacgtttctaatcggttcaactctctaagcatgggtggtattattccactcaaaatttctcctgaggtcaagactttggagatgctttaa

SEQ ID NO: 76207 - DNA, 144 bp, Glycine max
  Peptide Sequence Number=SeqID_192985
atggaaacgatcgcctcccttaacaaatgcttgcttgacgaaagtcctcgttctcgccctaccatggagcaagtttccaaggagcttgcaattttgaagttgatgcaatcctaccctctaagggcattggatagaagactctaa

SEQ ID NO: 76208 - DNA, 560 bp, Glycine max
  Peptide Sequence Number=SeqID_192986
gagccactctaggaaaaggtttgaataggacaattgcaacattggctgctggtgctcttggtgttggggctcattacttagctagcctatctggtgcaacaggggaacctatattgattggcgcgtttgtctttgtgcaagctgccatagcatcattcataaggttttttccgaaagtaaaggcaagatatgactatgggatgcttatattcatcttgacattctctttgatatccgtgtctggttttcgagaggttgaagtgttggaaatggcacacaagaggctatcaaccatattcatagggggttctgcttgtgtgatgatttccatttttgtttgtcctgtgtgggctggtgaagagttccactattccattgctcacaagttggaaatacttggcgatttcttggaagcttttgtacgtgtatacttcaagatatcaaaagaaggagaatctgaagacaacaaaggagattctaaagacaagtcgtttttagaaggttataagaaagttctcaattccaaaagtgttgatgactctctggtgagtgtgctttaa

SEQ ID NO: 76209 - DNA, 261 bp, Glycine max
  Peptide Sequence Number=SeqID_192987
atggagaaccgagttaacaaggtacaacaagcaaaaaggagcagaaataaagaaaaaaaagaagaaaatcagaagaagcctaagtccagcaagacgctaagcgcgagatacgcccagcgtgcaagaaggcaaggcgctaagcgcatgatacgcgctgagcgcgtggtagcgctgagcgcaaggcttcgcgctcagcgagactacgaaggcccaaagcccaattttgcacctataaataagagggtcagcctagggaaatga

SEQ ID NO: 76210 - DNA, 303 bp, Glycine max
  Peptide Sequence Number=SeqID_192988
atggtaaagatgtttttctcttcaaggctaccatttcatttagcaaggaatccttgttatagggaggctttttcttatgctaccaatacttctaatattagtggatataagcctccaggtgtgaccattgttagtgatgggtggagtgatcctcaaagaagacctcttattaacttcatggttatcactgagagtggaccaatgttcttaaaggcgatacattgctctagtgatgtaaaggacaaggatttcattgctcaacacatcaaagatgcaattatggaggttgggtcatcgtggtaa

SEQ ID NO: 76211 - DNA, 531 bp, Glycine max
  Peptide Sequence Number=SeqID_192989
atgcaagatggtgctcctctaaaagtccctagacctttagaaaaaggtttcaatttgcaaggcagggatggtcttgatgctagaattgcaaggatgtttttctctttagggctaccatttcatttagcaaggaatccttattatagggaggcattttcttatgctaccaatactcctaatctcagtggatataagcctccaagttacaataagttgagaactaccttgcttacaacagagagaagccatgtggagaacctcttgcaaccaataagaaatttatggaatcagaaaggtgtgaccattgttagtgataggtggagtaatcctcaaggaagacctcttatcaacttcatggctatcactaagagtggaccaattttcttaaaggcggtaaattgctttggtgatataaaagacaaggatttcatttctcaacagatcaaagatgcaattatgaaggttgggtcatcaaatgtatgtaaggcagcaagtatgatcatagagaatgagtttcatgtcatctattag

SEQ ID NO: 76212 - DNA, 306 bp, Glycine max
  Peptide Sequence Number=SeqID_192990
atgaggggtcgttgtacgatgtatccgtatgtaatgattgctctcaattgtcatccacatgattttgtaagatcatcaagacctaggaggattgatggcagtgattgggcccaatgtttaaaatttgaggtgttacatgcggcatcagaggcatttggttcgctggtgggaaatgacaaggagaagaagaagatggtgggccacgtccaattgtgtgtgctcggttggccaaccgtgtctgacaacgatggatgcaccttacaccgcgtcacacgtgagacgattccacatccgtttcctgtatga

SEQ ID NO: 76213 - DNA, 951 bp, Glycine max
  Peptide Sequence Number=SeqID_192991
atgagtcgtttagggttcaagcacgaggtgtacgacggcgacaagcacatcggcgaactagatgtgattcctccgtcgtcgttgacgacgacgacgtcgtttcacaacaacttccgcttcccgaacaacgagattcgcatccaccacttcagcgcgaagagcgagcgctgccctccgctctcgatcctccaaaccgttgccgcattcaacgtccgctgcaagctcgattcctcagtcgccactgaacagaaggaactaatcgccatccacgccagttgcttctacgaaatgaagacggcggtggtggtggtgaacgacgaggagattcacctcgtttcgatgccgagcaagaggaagaagttcccgtgcttctggtgcttcgcggtgccgttggggctctacgacgcgtgcttggggatgctgaacctgcggtgtctcgcgattgtcttcgatttggacgagacgctcatcgtggcgaacacgatgaagtcattcgaggataggattgaggccctgagggggtggctttcgcgtgagaccgatccgttgcgggtgcaggggatgtcctcagagcttaagaggtacctcgaggacaggttgttgctcaagcagtacgcggagagtgacactgttgttgataacgggaaagtgtataaggttcagatggaggaggcgccaccgctgtctggtagccacgagaaactggttcggccggttgtacggttgcaggagaggaatattgtcctcacgaggattaatcctgagctgcatttggcctctgattgtggattgcattgggctgcatcagagcacaatgcaactgcaatttctaaccttttaaagaatgaaagaggagctggggagagtagtaaatcttctggaataattgttcgcaaacccctcttgtactcgtttatgggtcgcacaataacacttctgtgcggggagtga

SEQ ID NO: 76214 - DNA, 1092 bp, Glycine max
  Peptide Sequence Number=SeqID_192992
atggctgaaagggattatgctttggaaatatggaggcttcttgaccctggggcacatcttataggtttaaagcaagtccttaatcgtgtgatttgtgtcaaatcaggctcccgaaaatctttactaaatgttttccaagatggtgtctgccatcccaagatggcaatggtgattgatgatcggtcaaaggtctgggtagacaaggaccagcctagggttcatgtggtgcctgcctttactccttattatgctcctcaagcagaggtgcagacagccaatgctgtcccagtcctatgtgtagcaagaaatgttgcatgcaatgtcagaggttgttttttcaaagagtttgatgagagtttattacaaagaattgctgaaatcttctttgaagatgatattggacttctacctcatcctccggatgtcagcaactatttgatgtctgaggatgtaccaaatggtaatgctaatgcccccttcagtgaaggaatgaatggtgcagaagttgaacggaggttaagccaacctgatgataagttttctgttgatttatccacccgacccatgacaaacagtgttgaattcagacatgaaacctctcagccaactgctgaacctggtttgcttggacctcctgtcaagcatgatggcaactctgttgatcgtgattatgacatgagaaaaggacttttaggcatgaggcatggtccagatataagaggtcaaatttcagctgaacctcctctgatattgaggccacctaatcaagcatcaccatctttgatgcagccatttggaggtgggttggtagaagatgatatagccagcagaagtcagaccaatagttggccttctgcatctgttaaagaatctaatgtaataaagtccgataagcatcaggctcaacagaaaccattttctaatagtgtcataggttcatcccccaatgttttactcccacaagcatcacaactaaaggctgaagaggcaacttctgtttctgatttgcagaggcagattgttccatctaagtctcagctatcatcagttttgatgtactgtttgaaagatcaagtgttaaatcagaaatag

SEQ ID NO: 76215 - DNA, 717 bp, Glycine max
  Peptide Sequence Number=SeqID_192993
atggccctcaacacctcttgctccatggccattgttgacatgctaggaactcatgttcctaaatgtgctattcatgtttctaacacacccaaattttccttgtcccagctgaatgacaaaaagggctgcaacttggggttccccaaacttgttcaaaacaacaagggccttttcccacttcatgctgtgccatccaaaacaatggtggacttggacaatttggtgcttcaatctcaagaacaaccaatggaatcaaagacaataaatgtcaaatttcagttacaacgcaattgtaattttggggaagaatttctagtagttggtaatgatcctatgtttggttcatggaaccctgaaaatgccataccaatgacatggtcagaagggcatgtgtggactgcagagatgggtgtacctgttggaaaattccaattcaaaatcattctgaaaacaagagaaggtgagattgtttggcagccagggccagatagaaatctccacacatgggaagcaatgaacagaatcactgtttgtgaggattgggacaatgctgagcaacagaaagtaacagaagatgatggagttccaaacattaaggaggaagatcaacttgctaacacaaacaaggaattccagatggagtcagaaatgccaaattttgccgagaatttgggtaattctaaggagaagctgaaatcaattctgataaagtgctaa

SEQ ID NO: 76216 - DNA, 575 bp, Glycine max
  Peptide Sequence Number=SeqID_192994
agtatgggatatctcagaatcatgcctcttctaacagcaaagattttcaacatgaagctggaaaaatgaacttcttatcccctctatctattcaagtgctgcaagaaattgggaggcggtgtaactctaaggttgaatttaagtctattttaagcaccagcaaagacttgcagttttcagtggaggtactattcactggtgagaaaataggtgttggtatgggtaggacaaggaaggatgctcaacaacaagctgcagagaatgctcttcgtagtttagcagagaagtatgtggcacatgtggagcctcaatgtagagctgtcgataaagattttgacaagctttctcttggatgtgacaatggtttcttgtgggatgtgatcaatccagaatccagtgaaccgcaaccagaagatggagtgtctagagaaaatgcttctgaggaaataggtgatgcttggataaggggtatgtggactagaaattccagatggaagtggttgtatagagaaatcacgttgtttatggaattgtgtagcatcaatgtgaaggctaaatcactgaatggggagtga

SEQ ID NO: 76217 - DNA, 3075 bp, Glycine max
  Peptide Sequence Number=SeqID_192995
atgaaccatccttgtgcaaattctaagagcctactgttacaagtccttaatggatgtcttctattatgcatgatcttaatcaaggactcagcaatagcagcaatccctaccggaaatgaaactgatttgcaagctttagttcacttcaagagtaagatagttgaagatccattcaacactatgagttcttggaatggctccatcaatcactgcaattggataggaatcacatgcagcaacatctccaatggaagagtcacacaccttagccttgagcaactgagactaggaggcactcttacacccttcataggaaacctcacattcctcaccacagtcaacttgttaaacaatagcttccatggtgaatttcctcaagaggttggtcgtttactataccttcaatacctaaacttcagcataaacaactttggtggcagttttccaagtaatctcagccactgcacaaatctaagagtgctagctgcaggtcttaacaatcttacaggaacaatcccaacttggattggaaacctttcttccttatctcgcgttagcttcggtttaaacaacttcattggacgcataccacatgaggtaggccttttgtcaagcttgacatctcttgtgctatatgggaattacttaactggcacagttccttcttcaatctataatatctcttccttatactatttcacttttactcaaaaccatcttcatggaaccttaccagcagatgttggatttactcttcctaacattcaagtatttgctggtgcggtcaacaatctcacagggtctgttcctgcatcgttgttgaacgcatcaaaacttgaaattcttgacttttccttgaatggtctcactggaacactgcctaagaacttaggggtattgtacaggttaactagacttagctttgagcacaacagacttggaactgggaaaacagatgatcttagctttcttgattctttggtcaactgcacagctctacaagttttacgtctaggcgtaaataattttggtggggtgttgcctaaatcaattgctaacttttcaagccaactgcacacatttgcccttaattctaatagaatacatggaaatatacctgctggaattggaaatcttgctaacctggcccttataggattagaaggaaacgagctaaccagtagtgttcctgatgcattaggtaggctgcaaaatctgcaattattgtatctgaatgtcaacaaattttcaggtagaatcccatcctccttgggaaatttatctttaataacaaaactctttctggaggaaaataactttgagggaagcataccttctagtcttggaaactgccaaaagttattggtactcagcctttatagcaacaagctcagtggcaccataccaacagaagttattggtctttcttcactagcaatatactttgatgtgtcttataatgctttgtcagggaccctgccggttgaagtgagtaagctacgtaatcttgcagagttggttctgtctgagaacaacttttctggagttattccatcttctcttggcagttgtattagcctggaaaagctgcatttgcagggtaattcttttgagggaaacattcctcaaactataaaggatttgagaggtttactagacatagatctttcgcgaaataacttgtccggtaaaattccggagtttcttggtggattcactgagctcaaacatctcaatctttcttacaataattttgaaggtgaaataccaaagaatggaatcttcaagaatgcaacttccatttcattatatggaaatatcaagctatgtgggggtgtctcagaactaaatttccctccatgcactataaggaagaggaaggcctctcggctaagaaaacttgttgcctctaaggtggctatccctatagctattgcacttatattactattgcttctatcatgttttcttacattgttccccatagtaaaaagagcaaaaaggaaaactcctacatcaactactggaaatgctttggatttggaaatttcttactcagaaattaccaagtgcactggtggcttctctcaggataacctgattggttcaggaagttttggttctgtatacaaaggaactctctcgggtgatggatcaattgttgcagttaaagtgttaaatcttcagcagagaggagcttcaaggagcttcattgatgaatgccatgttctgagaagcataaggcaccgtaaccttctcaagatcataaccgccatctcaggtgttgatcatcaaggcaatgacttcaaagctctagtgtttgagtacatgcctaatggaagtctagaagattggttgcatccagtaaacaatgtgcaaactcagactaagaaactgacatttatccaaagactgaacatagcaattgatgttgcttgtgcactggaatatctccaccacttctgtgaaactccaattgttcattgtgacataaagccaagcaatgtacttcttgacaatgatttggttgctcatgtgggtgactttggattagctacatttctgtttgaagaatcaagcaagttttccacacaatcagttatttcagctagcctaaggggttctattggatacatccctccagagtatggtatgggtgggaagccttctacacttggagatgtctacagttatgggatactattactggagattttcacaggaaaaagaccaacagatgaagaagcatttgaaggtggcatgggaattcaccagtttgtagcaatggctttacctaaccgtgtcacggatatagttgatccttcattagtttctgaacaagactttgatgaggaaaatcaagaatttgaggatgaagagaaagcaataaggaagaactatgagattgaagcctcagctaaaggtttgatggaggattgctttgtgtcactgatggaaattggagcgtcttgctctgcaaatccacctagtgagagaatgccaatcacagtggtgatcaacaagctacatgctatcaagaactcgtttaaaaagataaagcatagtgctatatga

SEQ ID NO: 76218 - DNA, 333 bp, Glycine max
  Peptide Sequence Number=SeqID_192996
atggcttggtataatcagtccctggtatctacccattatccaattctacgtgttcccttacacatgtccccgatcgaagctctgcgagctcagacaggatttcttgaagaagaggaggatcatcggcacgaggaaagagttgcgagttcgagaacgggattttgggaactttcaggtgaaagagaagatgaagattataaaggaaatacaaaaacgttttggaaggctttggatgctgagactaggtcaagtacccctaacgccattaatcagcaaatggacaagcgtatgagctccccgaggatgcccaattctaaacgattgaaggaatga

SEQ ID NO: 76219 - DNA, 303 bp, Glycine max
  Peptide Sequence Number=SeqID_192997
atggtgcttcttgacaacaatatggtggcacatgttggtgactttggattagctatatttctgtttgaagaatcaaacggttctccccaacaatcaaccatgtcaaaatatggaatgggtggccagcctttagcactggaagatagttacagttatgggatactattacttgagattttcacaggaaaaagaccaacagatgaagcatttgaagaatttgatgatagagatgaagaattttgggcaaaggagaaagcaatgttgagggagaatgaacctgaagtaatagagtgttgcaaatag

SEQ ID NO: 76220 - DNA, 417 bp, Glycine max
  Peptide Sequence Number=SeqID_192998
atgttgggtgtaggaaaaataacccatgagatttttacactacacaatgggctagttgggctggcatttagattgaatatagaccgaacatatagggacatgctaggtgcacccagcaatttattgaatgggccattttgcccttcatttaaaaatttaaaaagctgctcctccttcggaagaaccacttttgttcttctttgcgctgcttcttttcttcttccccacaagcctcgtgcctcttcttctccgcgagcccggctgcttcttctcgttggatcagacgtgatttgccttcgagaagacgctggaaaaaatggggaaagctcggttacggtggcgttttctggaagaaccgtgaaggcttcttctagaacttccggaacacttcttccagaaagtttccggaagaagtag

SEQ ID NO: 76221 - DNA, 892 bp, Glycine max
  Peptide Sequence Number=SeqID_192999
atggcttcggggccaatagttggagatgatggagcgaaagagaagcagaggtacaccgagagtaaggtttacattagtaaagcgtttaaaggtcctaagaacaaaggtaacgccttcagcaccgtgaacgctgttcctcctcctacagccgcagctactaccaacggcggcgacaacggttctgctaccgctactgccgttgattacaacaaggataacagtactgtcaataatggtgatgttagggctaaggataatagcaacaacgcctcggttctgccggtgccggttccggtgccggaggatgggaattcagctcggccgcaagtgaattcgaggttggatgtgatttcagatgactcctccagcttgaaccgtcctcgggatgagcctttgagtgttccaggcgtgcgagagcggtcgccggggccagagaattgtgttaggatcagtttggcttcgcggtctaagcaagagaagcgggagctgaggaggaggcttcagggtgagcttattagggttaggagtttggtgaatgggattgaggagaagttgggggtgcttggtgggtatggtaattcagataggatggtggatcgtgggattggaaatgggattggagctaagagggctcactcggaggttgcatctgctgttgttacactgcgagaacctacccggcctttgcatcagttgagtgtctcggtgttggagaatagtcaaggggttggtgaaattgttgaaaaagagaagaggacgcccaaggcaaaccagttctatcgcaattcagagttcttgcttgccaaagataagtttccacctgcggagagtaacaaaaagtctaaattgaatggcaagaagcatggcacgggtgagatgggacatggaatgg

SEQ ID NO: 76222 - DNA, 138 bp, Glycine max
  Peptide Sequence Number=SeqID_193000
atggaccgctcaatgctcattagtggattttggcttagtgcgtgtttttctcacttagcggatggactgaagtgccgaggagtgttgcgctcagcggatggctcactaagccagaagattggcttagcaagaggatga

SEQ ID NO: 76223 - DNA, 1134 bp, Glycine max
  Peptide Sequence Number=SeqID_193001
atgagcgatccttacgtcggtcagctgacctttgtgcgcgtctattctggcgtgctgcgcaagggtgacagcgtgtggaacgcggtaaaagggcgtaaagagcgcattggccgcatcgtgcagatgcaggctaacgatcgcatcgaaattgatgagatccgcgccggcgatattgccgcctgcgtcgggctgaaagaggtcaccaccggcgaaacgctgtgcgatcctaatgcggtaatcacgctggagcgcatggagtttcccgatccggtgatttcgctgtcgattgagccgaagaccaaaggcgatcaggaaaaaatggggctggcgctgcagcggctggcggcagaggatccgtcgttccggctgcacaccgatgaggagtccggtcagaccatcatctccggcatgggtgaactgcatctggagatcatcgtcgatcgtctgaaacgcgagtttggcgtggaagccaatattggccggccgcaggtaacctaccgcgaaaccatccgcaaaacggtgcgcgaggtggaagggaaatttgtgcgtcagtcgggcggtaaaggccagtatggtcacgtggtgctgacgctcgagccgcaggcggccggaagcggtttcgcctttgaagatgcgaccaaaggcggcgtggtgccgcgcgaattcattccttcggtggagaagggcattcgtgaagcgctcaacagcggcgtgctggccggttatccggtggtcgatatcaaagccacactgacgtttggctcttatcatgacgttgactcgtcggagatggcgttccgcatggcggcgatctttggcttcaaagcggcagcgaagcaggccgatccggtgatacttgagccggtgatgcaggtggaagtggagacgccggaagagtatgccggcggcgtgatgggcgatttgtcatcccggcgcggcacgctgcagggcatggacgagcgtttcggcgcgcgcattatccgtgctgaagtgccgctggccgagatgtttggctacgccaccacgctacgctcaatgtcgcagggtcgcgccacgtacagcatggagtttgcccactacgccgaagcaccgcgtaacgtcgcggaggcgattatcgcggctcgcgcacagtaa

SEQ ID NO: 76224 - DNA, 492 bp, Glycine max
  Peptide Sequence Number=SeqID_193002
atggaccttgcatcaaacaacttcatgctcccattaaaggctagtggcgaaggcctacacaggcatcgcaaacatggagcttggggaagtggtccacacgctcgcgttgaaggctggtggtttctcttacttgtttgtggggaatgcgttgatcgccatttctacttctcatattgcatctcgtgtagaaccacaaatagaaaggggaaaaagggaatgatggtcatagggatgcgagaaaggaaatgggaaagaggggatgatggcccacttgggccttccagattcttcctccagaaggcggttgcttctggaggaagcaacctggctcgcctgggcaagctgggtggcaagctcctcccctattttgctataaatagggggaggagtgaagaagaaaagggttcagccttcttggcacttcgtattcacttgaaattgctgaggaaaattgtttccgttaagaaaatccaagccgaaggacttccgtaa

SEQ ID NO: 76225 - DNA, 981 bp, Glycine max
  Peptide Sequence Number=SeqID_193003
atgtataaatgccccaggtgtggggtatcacggtacaaagtgaaggataatgacgagtgtagtagtgatgaaaatacaaagaaagacccccaacaaaggtgctatgacttgaaaaatttgtgggacgaagaggttgacgtgtttgatgagaatcgaaataagaccttcaagttgggtgcaatggtattttgtaccattaatgactttctagcatatgggaatttgagtggatattgtgttaaggggcatcgtgcataccctatctataaagaagacacaagctacttacaactgaaacatggaagaaaaacaatgtgcactcgacataaatgttttctcaaaccttatcacccttattggcaattgaaaaaagtttttaatggaagtcaggaaaatgaaattgtgccgatacccttaattggcaagacaaaggatggtttgaatacttgtcaaaatctagatgagatgggtgtacgtgaccagttacatccaaggtcggatgggatgtacccagttaagcgatacatgaatatcttaaaaaggtatgctaagaatctacaacgtcctgaagcatccattgttgaaaggaacattgcagaagaagctattgagtattgttcagagttgaaaaggcaaaacatgttgggcttcctgagtatcctcatgacgagaaagtgggagggatacgatatcaacaagtatttgttcctcaccaaatcacaagatgacaagaatacagtgaaaaacaatgggtgtaagtgggttgatagcaatatcgatgtgcagaccgatgatttcaaatttactttggtagatcttaagaaggttttacacgaagaaaccattggtgttaatcttgaagatgatgaatcaaccctttatacttgtcacactcctttctccacacatatgcctaccatcaatggagaaaatgaagttgacgatgtacatgcaaatcgaaatgatcatgatgaaggataa

SEQ ID NO: 76226 - DNA, 148 bp, Glycine max
  Peptide Sequence Number=SeqID_193004
atggtgagtattatggaggattcagtgaaattggacaacatcccaatccacttgctaagttccttgaaaggcgtggtacttgtgctcaatacacaatgccaggattccttgtacagcagtcctaaatacgacttccagctgtgcacag

SEQ ID NO: 76227 - DNA, 444 bp, Glycine max
  Peptide Sequence Number=SeqID_193005
atggtaccaggaagcggaaacggaaacggaaaggatgccacaaagaataatcaccatcatcctcagctagagaatgttatgctcctccgccgcaccaccgcctcctccgccagaggtccaccattcgtgctgtcgattctgaatcctgtgcagtacgaaagtgagagtaaggctatttttggtgctcttaatctaaacccgcaactcttctataacgaagttctcaacattgtcaacaatgtgctcgacaaagctttcaatatcttctaccaggacgcatctacaaagctcaacatcgaaggcacccaaagttcccacgatctgaaaatgtttattagtgttatggttcaaaacctggaattgatttacaaaaccagcaaacagagctacacaacaacaggtttgtgttcctcttcctcattgaatagcgcagataaagtctag

SEQ ID NO: 76228 - DNA, 348 bp, Glycine max
  Peptide Sequence Number=SeqID_193006
atggagctttgtcaagaggagatggggctatatatttatgtttccctcataaaggataccgtgaaagaatatgggatcatactgctggcagcattgttttcaaaagttgatgtctcactaagcgagctcaatgcacttagcgagtgtcatccgctaagcaagacatcagcgtgcttagtggataggaggaatctggaagggaatctgtcacgcaggcacgcactcagcgcgtcattagctcgctcagcgagtcgtttgtcaccttccaggcttaggacgagtttggcgctaagcaaaaattcacttactcgtgctaagcacaagaatggcgctaagtgcaacgtcgag

SEQ ID NO: 76229 - DNA, 202 bp, Glycine max
  Peptide Sequence Number=SeqID_193007
atggtgattcaaatggtaccatcttctcctccaccttcgtgggattggggcttagggtttcctccttgtgacaaagaagatgcgcgagtgagagagatgatgtgcgagttagagagtcgcatgggattcatttttggttcctcaattgcgttaggcattagtgcaaagtttgttcctttatgcaaacttggaaagctaccag

SEQ ID NO: 76230 - DNA, 216 bp, Glycine max
  Peptide Sequence Number=SeqID_193008
atgggcaatatcgatgtgcagaccgatgatttcaaatttactttggtagatcttaagaaggttttacacgaagaaaccattggtgttaatcttgaagatgatgaatcaaccctttatacttgtcacactcctttctccacacatatgcctaccatcaatggagaaaatgaagttgacgatgtacatgcaaatcgaaatgatcatgatgaaggataa

SEQ ID NO: 76231 - DNA, 273 bp, Glycine max
  Peptide Sequence Number=SeqID_193009
atgttgtactttaacatgcacatagatataccgccaggctcccctcctcccgagtcagcaccatcaccgtctatgtccaagaggactagaaaagtcacacagcttagatcattgagtgccagacctatgggtttggagagaccactagctcatgtggatccaaacactaggaaagtccctgtagctcagaaggatttgatttggaaggacaatcaggctgaatttgatattccaaaaacgtctgataaaaggataaagaagaaaatcctttag

SEQ ID NO: 76232 - DNA, 162 bp, Glycine max
  Peptide Sequence Number=SeqID_193010
gaaggaagcatagatgtggcaatggttaaggaattttatgccaatttctatagcctagcagatcaagctcctaaatgtgctaaaataagaggccatttaatcaagatagatgcagacaacttaaatgagttcctccagactccaatgttattagaggagtga

SEQ ID NO: 76233 - DNA, 213 bp, Glycine max
  Peptide Sequence Number=SeqID_193011
atgaccatgattacgccaagctcgaaattaaccctcactaaagggaacaaaagctggtaccgggccccccctcgaggtcgacggatgtacttgttggtaactatctcaagaaatggatggggtagagttagattgtggttaggaggagtgagagcggatggagttagaaggagtgtgaatgtactaccacaagaattggatgtgctggattaa

SEQ ID NO: 76234 - DNA, 522 bp, Glycine max
  Peptide Sequence Number=SeqID_193012
atgtttgggttgtacaatgataatgttcccttgtacataaagcatgaagatcttgggaaaatatcacatagtggtcaatttcttaacatcattactatacaattgtggattatgcatatgagtgagttaagtttgcaatcgaggaatgactctgtgtatggattccttgagtcacagtccaaacagagatcagggcaattgcaatttgaatctaaagattatattaaaaaattgatgtcgaattcaaaaagatgtctacctagaagccttcttgaatggggattcaatgataaacacagaagtaaatccaaggcaaatgctaaatggatctcagttaaaagtaataagcaaagaggaagcactgagtgcaactattacgtcatgcattggatgtcgaccatagtcctaggaggtttcaaggataattgggaaatgcctacttttaatgactggagtttcaacattggttcaaaactaatgttgaatgttgatgcaatcctaccccccaagcgcattggatag

SEQ ID NO: 76235 - DNA, 441 bp, Glycine max
  Peptide Sequence Number=SeqID_193013
aaatttggactgttcgaatgcgacgtggattatgagaggaggaagactcaagtcaagaaaggttcagtgcgtcatggacgtggcttgtgtgaggtgcaggggaccatgcgtagcagggaccacgaggacaaggagtggccgcgggtgagggtcgataacgctaaccgaattctgttacgcttttgtcacctttccttgggaccttgtcggcgatcgtacccgttggatgaacaatgcgaagaggtaaggttgaaacctaaaaattcagaattcaaaattgatttagccattgatctggagtcaaataatattgacaaagagtttgccaacaaatacaacaccacgaagcaggtgggaaattcctctaaaggcgattctcataacaatcactacctctggcaaatttcaggttatcatccggtgcttcacggttgtaacaag

SEQ ID NO: 76236 - DNA, 216 bp, Glycine max
  Peptide Sequence Number=SeqID_193014
gcgcctagctgccctgcgctagccgtagcgcctgactcctgggcgctaccaaaggcgcttgacccctgggcgctaccaaaggcgcctgcatcaggggcgctacccactgtgtcacgtgtcacgtgcacagtggaagcgcctgggtggggagcgctttgcaataaaaaaaatagaccccccctccccggaaataattgtaaaaagacccctttttaa

SEQ ID NO: 76237 - DNA, 1020 bp, Glycine max
  Peptide Sequence Number=SeqID_193015
atggattatggccgatcagcgcaccagcgacaggcggcgctcggtgggcgtgccggcaccatcgggatcacggcgcagggtggcgacgccgtggccgcgctcggccaggtattccagccacttgccgaggaaggtgttcatccgcatgcgatggctgatcagctccgccggcggcggatacaggcccatcgtgtcctgccagcggcggcccacgtagcagtgggtggtctcggcctggcgggcgtcacggtacagccgcacataggccgacgggtccggctctccggtgaccgggtcggccaggtcgtaggtcaggcgcagttccaccgtgtaacggtggcactcgatcacgtccagacgaacatccaggccgtcgccgatcgaggaaatgtagctgcccgccaccagtccggccggttcgaacaggcgcaccaggtggcggtagttctccgcgtacaggcccatgagccagctcagccggctcaggcggggaatgcgttcggtacggggcaaggctcgggccatgggtcgatcctacacgttggtgcttcaacgtgggggcgcctcaagccacagccaacccgtcggtcgctttctcgtggtagtgccggccgctggccggcagccccgcagcgcaggagtcgctgccacggcggtagtgccggccgctggccggcagcctcgcagtgcgaaaagggtcaatacagctcgcgctgcagccccaatgtggccagcaccttgctggaaatctcctcgatcgaggcggtccgggtcgatggtcaacccgaacagcttgcgccggtagttgcgcaggcgcggcggcaggcgatcactttccaggtcctcgtcggtcaacgggtagttggccgcgcgcaccccgtaatgcagggccaggtagatgcaggtgggcgtcttgccagcgcgcgacaccgctaccaggatcacgtcggcatcgtcgtagttcaccgcgatgccgtcgtcgtgggtcagggcgaagttcatcgcgttgatgcgccggtg

SEQ ID NO: 76238 - DNA, 174 bp, Glycine max
  Peptide Sequence Number=SeqID_193016
atggagaagtgttggtggaagtggcaaggggtatcgccattgaaaatggcggcaagcatggtaccgccagtgttgttggcgagacagcagcttaagtggaaggtgccgccagtgaagctggcgagacacctccacgttggatctgcttcttctgctggcgatacagcatcgtga

SEQ ID NO: 76239 - DNA, 264 bp, Glycine max
  Peptide Sequence Number=SeqID_193017
atggcacggaacaaattcatttcctctatgattattttccttgcactgatcattttctgccggcaattccactccactaaagcacgatatctaaagcacaaccaagcaaaaaacaacagcaacaacaacaaacaccttgggaatgatgtgcatggtgacatttcagcaactggggtggcaccaccaccgggtcgcggtgttgaggattttagacctatgaccccgagacacagccctggtgtaggacactccgttcataactag

SEQ ID NO: 76240 - DNA, 303 bp, Glycine max
  Peptide Sequence Number=SeqID_193018
atgtgttctctactttggagttccattgcattgtgtgtagcaatcctactccttcagcttggcattgtgcacccttcaccctctcaccataggatcactcgcttaccaggtcaaccccatgttcagtttcatcagttttcagggcctggttgttcttttgaagggcctggttgttcttctcttggagttggtgcatttttagagaatgaaccatttagacccaaaggagagggcttggttagaaaccaattcagctggaaaaaaggccattatgttcctcagctggctgagcttatgctctga

SEQ ID NO: 76241 - DNA, 261 bp, Glycine max
  Peptide Sequence Number=SeqID_193019
atggtgaacaccaggagtggaaagcctatggcaaaaccaaagaataaagaaaaagccacttcaacaccaaaaaaagaggctctcaatgaggagagtcgtgacacaaaaaaaatgggtgaaaaggaggtattggcacctgctcggaagttggggttgcatgaacctcaacttactaacatctctcttcagcttgtggacaggaccctcaccaatccacgaggagtaatggaaaactatgagtcaaggttggcaaattcctaa

SEQ ID NO: 76242 - DNA, 372 bp, Glycine max
  Peptide Sequence Number=SeqID_193020
atggcacattcttggttccacacaactcaacacattaccactataaacaaaccatacccatttgcacaaaacagaaactttagacattcaaaagaagaaaaattagaattagtgacaacaacagcgtggaccaatcggttccatggtgaaacttcttttttccgttgcgacaggaaaccctcgtcatccattgaaacgactcctcttctaatgccggtagcggtgagggcacagtggatagcgtcatcgctttcaaaacggcacgagctcactttgatggccagagacaatcttcacagcccgaccaacactgcttcagggagacagagcgaggtttcatggagacacagtgcttcacagtgccgggtgtag

SEQ ID NO: 76243 - DNA, 897 bp, Glycine max
  Peptide Sequence Number=SeqID_193021
atgattgaattacattacggcaatcataggccacctgccgggccaccgcacgaacgcaatccattggctatcttgctcgcattactgggcctgatcagcattatctgggtggtggcattcgttgctacccaacccttgcgcaaactggcaaatgccgccttgcacctggcgcataacatagagcatccccctttaccagaaaatgaaggttcaactgaagtacgccatgctgccaaagcttttaatgagatgcagcgcagcatactcaagcatatccaggagcgtggttttattctgggtgcgattgcgcatgacctgcagacgccgctcacccgcttacgcctcaggctggaaaaggtgaaagacctggagctgaaacagagccttatcaaagatcttaccgcaacacaggaaatggtacgtgaaggcttggattttgccaggttatgtggagaaaacatccacaagagtaaaattgacctgacagcgctggcaacagcgagagcaaattgccccacacaatccatcacaacctggggttcagcgcacttgctcacccgctgcctgaccaacttattaaataacactgttgcatatgcaaacacgccaaagctatcgctttatactgaaggaaagcaggctatttgcatcatttccgatgatggccccggcattcctgaacaggagcttaacagcgtactggagccattccgcagagtagaagactcccgctcgcgccagacgggtggtaccggtcttggcctttatattgcacgcatgatcattgaaaaacatggcgcatgggggctgcggtgtagactagcgcccttgccgatgcttgttgttacgatcacaagccggttaggagaagtggcagagctggttgaatgtacctga

SEQ ID NO: 76244 - DNA, 447 bp, Glycine max
  Peptide Sequence Number=SeqID_193022
atgactcaagagctggtagcccgcggagacaccttacggttatccgcacctcgtcattcggtgaccccaagtgtgattcacgagcagagaccaatatggtcatctgcgcccttttcggagatgtcagcattttccgatggagacttttcaagtctcacaagttatccagaactacaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggtggcgggcccgatgacaagcagagaccaagttgggtcattctgcacccttgtatcatccagaggcggcgggcccgatga

SEQ ID NO: 76245 - DNA, 587 bp, Glycine max
  Peptide Sequence Number=SeqID_193023
agacaccatctccacctgctgcttgtggttatggcaatactgcatataactacggaaaaaagccccattcctcctttgagaataccctgaaatatggttcaaagaaagcattgcttagagattatggagatagaggagatgcaacaagggttgctaaggctttcaagaaatcatcaccaaggatatgtaaatactggatcaacaacaattgtgtacatggtgaacaattcctgtatctgcattcatggtttcgtggtgatgggttttccactgtaatgaaacttcaagaacataagaaggttatcactggcatcgcacttcctgttggatccgacaaactttattctggcagcactgatgggacagttaggatatgggactgccatactggtcaatgtgctaaagtcatcaatcttggtgctgaggttacctctttgatcagtgaggggtcatggatttttgttggtctgcaaaatgctgtcaaggcttggaatatccagaccatgtcagagtttactcttgatggacccaaaggccgagtccgtgccatgactgttggcaacaatacactctttgctggtgcagag

SEQ ID NO: 76246 - DNA, 534 bp, Glycine max
  Peptide Sequence Number=SeqID_193024
atggagtacctcatcgagtggaaggatggccacgcgtcgtcctgggttcccactgatttcatagccaaagacatcatcgccaagtacaaaacaccatggtggaccgccgcaaagaaacccgatgaatccatattgaagaacttaattgaatccaacgacggccacaacctggcggaggctggcgcgaatctggaccaccgcaaccaaagtggcggcctcacgaagctacatctggcggcggggtacgtgaggcccagcgtggcaaaggttctcttagatctcagcatagatcccaaggtggcaaacaatcgcgagagaatgacattagatctagcgagggatattctgaaggtgatgccgaaaaggaatctgatgcaattcgggtgcaggattagactcaaaggagtgattagggttttagaagaggtggaatttgagtacgcgaaggtgcaggagattcttgaatggagagggaaggctgagaatttagagtaccttgtgggtggaaagacaacgaagcaaaccagtgggtga

SEQ ID NO: 76247 - DNA, 201 bp, Glycine max
  Peptide Sequence Number=SeqID_193025
atgaggttctatgtcgataaaatccctgagtatctcctcaagttcggcgaggaggagggccccacagaaggtttgaacatggaaaaatgccagagagagagaggacagaaagaatgggtttgctacatgacaaacaacaaaccatactttctcaatgatggtgggtttgctgctagtggtagccaaggcttcaacggctaa

SEQ ID NO: 76248 - DNA, 285 bp, Glycine max
  Peptide Sequence Number=SeqID_193026
atgtcgatgttggatcaatttcatttgtgcattcacaattccattgaaaatattgtcgatgtcaaagttgacggtatgggtgaagattcatggtctttggtgcataatcatttgcttaaagaacttgccaaatggtctgatgagtatatcaacctccttggtggcatagtcagatttgatgaattaaagcggtccctacttgttgatggattatccatggttatcatggataaatggatgaatataatcgacatgggatatgtcattgcatcaaggtttatttaa

SEQ ID NO: 76249 - DNA, 158 bp, Glycine max
  Peptide Sequence Number=SeqID_193027
gcggtgttgtccttgctgaggtgttgttggctgattcacgattcactcgaccggatatgggttttcacccaacaaaactcgatttcgtgcctagaaatgcggatgaggcgccactcgatgtttccatttgcctgcatgcctttggtatagcgaggtga

SEQ ID NO: 76250 - DNA, 306 bp, Glycine max
  Peptide Sequence Number=SeqID_193028
atggaagttcatcacgaagctttagccaaggaaagtaacccaaaaatgaccaagaatagggtgttgaaagagcaaaataagactttcttgaatcagtttaaagatataatctttgatgacaataatgcttctgaaacactaagaaagttagcagatgggcctaaaagaaatgttataacttggcatggatacgatatcaacaagttttcattctacccgaaatcacaagacaacaaaagtacattgcaaaatagtggggttagtctaagtgctgaatctcaacacttcgctactgtacgtgggtga

SEQ ID NO: 76251 - DNA, 440 bp, Glycine max
  Peptide Sequence Number=SeqID_193029
atggcaccaaaggatatggaaaagactactttcgtcaccctgtggggaacgttctgttacaaggtgatgtcctttggattcaagaatgccggggcaacttatcaacgggccatggtagctttgttccatgatatgatgcatcaagagatcgaggtctacgtggacgacataattgctaaatctaaatctgaggaagaacaccttgtcaacctgcggaaatttcgaaaaggaatagaggtagacccagacaaggaaaaggccatcctcgaaatgcccgagccacgcacgagaagtaagtctgagttcgtccaatgggacgatgattgtcaagtggcgttcgaaaggattaaatggtgccttatgaatcctcttgtgctcgtgccaccggtgcccggaagaccccttatcttgtacatgactatgttagatgagtcaatggg

SEQ ID NO: 76252 - DNA, 546 bp, Glycine max
  Peptide Sequence Number=SeqID_193030
atgacagtaggaggcgagatagacaggcagggctatgaagatcttcaatttcttagtagctttgtgtatttcttttttatgggtgtgggaatctatgagaaagaaacccttgcatcccaaggcaagtacaaaagcataccacaaacccactgcatactgacttatcccattgtactgtatacttggaaagatggcacagggcatatccatatctgtaacatgtactggatagtattgcgaattcttaagcccccagaattgatctctttggctgtctggtttcgtttgactgggttatactgctttgctcctcttaatgagcttgaagaagtggttgatacatctggagggtgcggtgcaagttttgtggtggagattgtatcagaacaatttgaaggcaaaaggctacttgagaggcatcgaatggtgaatgctgccttagaggaggaaatgaaacaaatccatgctctctctattaagaaagctgttaccccagaccagtggaaacaacagcaagaatccaaccaatcaaatcctgctgcctaa

SEQ ID NO: 76253 - DNA, 1638 bp, Glycine max
  Peptide Sequence Number=SeqID_193031
atggcatcgtctcatggtaatgcccactcggatgctgcaaagatggaacaaataatcaccgagttcttcgccaagagcctgcacataatactcgaatcaagggcactctatgtgtcctcacgcaattcctatggtgatcaagctgtttcgtctccgtgttcgtcgtcttcatcttcgtcgagtgtgcggccgagggataagtggttcaatttggctctccgggagtgcccggcggcgctggagaacattgacctctggcgccagaacaatcttgagtgcatagtgatagatgtgattttggtgcagaggcctctggattgggatcctgtgactgtgagtttttctccaaagagggttcttcctaggagttcttcactgaaggaaagatgcccttttggctggaacactgatcaggaagaattgggggttgtgggaaggagtgaaaagattgtggagaggtggcttgtgcagtatgagagtaggaagacaagggattctaattctggcagtaggagatcaagcaatgtttctttacataacttgtataagaaatcaactttgcttctgaggtctttgtatgccactgttagacttttacctgcctataaacttttccgagagcttaattcgtctggacagattagggactttacccttggtcaccgtgtgtcttcttttgttgagcccttcacccggaaacaagaggctgaaatgatgaaattcgggttcacccctgtggatacttcttctggtaggctgtgtctcagtgtgatgtattgcccctcagcatcagatgtgagttctgaaccttccactccgatgtccccacaagttataactgattatgttgggagtccattggctgatccattaaggaggtttccttctcttcctgtggcaggtttgccatcttcaaggcagcgtagttggagtttcgatcattatagagcctcacctccttcttatttaccttcgcctactcattcagaatcactctcgtcagggtataatgcatgtttgcggcgtttcccccctgcaagtttgcctcctcatccatctgagatgtctttgattcagaagaagaatacaaattttgatgattattatccctctgcatcaccttcaacctctaattctgggccgttaccatgcaaaccccttttacgatctgaaagtgctccagtcagcatacctactgctgaagttgataattcccctggatactccaataggcataatttgcctccatctcctcccctaagaatttcgaggggcattggtaagattgataaaaacccaatgcaaacaggagcaacagctgagaagttgttttctcttggaaaagacgagtctcgaaaatattctggagtgaagatatcagctaacagctcgccccagatttcaatttccagaagctcaagtaggtcttatcaggatgattttgatgatactgattttacttgtccatttgatgtggatgatgatgatatgacagatccaggaagcagaaataagagacaatctaaatccatagtgggggtaagcaggttgaacaggtacaggaacaagagtacttccatcccactgggatttcctgtttctggtctgggaaagtccagcacagttttttacatgtag

SEQ ID NO: 76254 - DNA, 201 bp, Glycine max
  Peptide Sequence Number=SeqID_193032
atgccgccattgtggcaccggaccaaatactataaaattaacgcatttgctctggagaaagtgcaaagagctattaatcgactagtctgtgaaacagtatcaagaaattctatctgtggtgccatctacgtggccggcatcagaaaccttgaagatggaggaaatcatcctgttcgtaaccttcgaactggccaggtttaa

SEQ ID NO: 76255 - DNA, 150 bp, Glycine max
  Peptide Sequence Number=SeqID_193033
atgatgctaggagggttgcaaaaccggacccaggttaattcaaatccatctttaacagtctcagttctcaaactcaaacagatcaaaccattggataccccagtaacgtcgtactttatcttcactgggaagtcatcatcttcattatga

SEQ ID NO: 76256 - DNA, 1242 bp, Glycine max
  Peptide Sequence Number=SeqID_193034
atgggaggatgtgcaacgaagccgaaggtctccaaggacgatcccgatggaatgcccaaggcaccccaaccagaaccccaacctgaactccaacccaacaaggacacccttaaaaccaaagcacccgccgcccaagtggaacaagctgctgctgctcacaacaacaaccttaatgtcaacgaaattgttgacgacgaccaagccaacaaacgacgctctctcagcttcttgttcaaggagaatgaagataaaaagggttccacagaaaatgagaaaaatacagttgaggaatctgtgaaagaagaagtgttagaggtcaagaaacctgcggaagatgctaaaagcaatgagccaatagttaagcaagaatctccaaggccagatgagaagctgtctgaggagagtagaaacaatgaatcatcaaagcaagaaaacgagactttgaagacagaaacatcacatgctgaggaaactcatgtcaatgaaccagctaaggaaacagtgaaactagagccagaggctcagaaaccttcagaggaaactcttgccattgaaccagctaaggaaacattgataatagagtcagaaactaagaaaccttcagaggaaactcttatcgttgaaccagctaaggaaacggtgatagtagagtcagaagctaggaaaccttcagaggaaactcttatcaatgaaccagccaaggaaacagtgatagtagagtcagaagctaggaaaccttcagaggaaactcttatcaatgaaccagctaaggaaacagtgatagtagagtcagaagctcagaaacctttagaggaaactcatatcaatgaaccagctaagaaaacagtgaaaccagattcagaagctgagaaaccttcagaggtaaacaatgaaagcagcaagccactgaacgaagaatttgtacaggccatggagatactttcagaggaaacacaaagcaatggactcatcaaactcaaagaagtgcctattgaaccatcagaagaaggtaagccaagtggggaatcagagaggaatgcttcagaaactgaaaaacctgaaacttccattgtgactgaggtggttcctatgcctgaggagagagtaattgaagaaattccaactgatgcaaagtctgtagagaaggtaacaaaggaagctgcatcaagcacagaagagacaagccataatggggtggagaatgcacctaaggttgttgatgctggaactgagattcactaa

SEQ ID NO: 76257 - DNA, 237 bp, Glycine max
  Peptide Sequence Number=SeqID_193035
atgacaaacaacaaagatctattcaaggacccaaatatatcatgcacattgaaggttggagttggagatgacaagtgcattactaatttgtggagtgttggacaactaattaagaaaggttacaaagtattgtttgagaacaaaaaatgtttgattaaagatgtcgatgacaaatacattctcaaagtaaaaatgaaagaaaaaagctttgctttaaatccattggaggaggagtaa

SEQ ID NO: 76258 - DNA, 483 bp, Glycine max
  Peptide Sequence Number=SeqID_193036
atggatgaaatagagaaggtgcaagagcagatgaaggccgactcggaggccttgaaagagaaaatggccacaatggtagaggccatgatgagcataaaggagatagtggaggtcagtgcggcttaccaaacccgtgctagagctaaaataatgggtgaagtagagaaggtgcaagagcagatgaaggccgacatggaggccatgaaaaagcaaatggcacatgaaattccccaccacaatctagccgacttcgagccttgcctcggatatgccactgaaggacaagcagttggtggtatacatatgccaaacacttcggaaggccctcagtatcacccccagctacacctcttgcattccacgacaagtaaaaaccctcatgctatggtagaaatgggaaagttggatcatctagaggaaaggctcagggccattgaaggaggtgaagattatgcctttgctaacctaggagagttgttccta

SEQ ID NO: 76259 - DNA, 609 bp, Glycine max
  Peptide Sequence Number=SeqID_193037
tacctcgggggttgctaagttggttggtgtagtggcatgcttgacgggatcagcaattcttgctttctataaaggtcctcatttagaagttttaagccattatcacgttttagggtaccataaaaaccaacaacatctgggtcgtgttgcatctgggacatggattaagggttgcttcctcttgctactctccaacaccttttggggaatgtggcttgtgctacagacttatgtcataaaaggatacccttcaaagctgctcctcacaactcttcagtgtttcttaagctcgattcagtctttgggcattgccttggccgtagaaagagatattgagcaatggaagttgggatggaatggaatcatggtgaccggtgtaacatattacttacaaacatgggttatagagaagaaaggaccggtgtttctagccatggcaacaccacttgctttgatcatgaccatcttctcctccgcagttctcttgggcgagatcataactttgggaaggtggcatcgctttggtcattggactgtactgcgtgctgtggggaaagagcagagagcaaatgccaaaagcctcgttagacttggaggaggcatcatcgg

SEQ ID NO: 76260 - DNA, 189 bp, Glycine max
  Peptide Sequence Number=SeqID_193038
atgaaggttgttgtagttacatatgcagtgtgtataaaaatagtagtgatcatgaatgagaaatatgggagtgcagaagtggcacttggcatgtcagtgaatctcaacaaaaactcttctagtgtcgttcatggagacaaagttgctttcatggagcagaaactcttccattggcgtccattgaggtag

SEQ ID NO: 76261 - DNA, 207 bp, Glycine max
  Peptide Sequence Number=SeqID_193039
atgtcgcagaacttcacggattgcttaacgatgggtgtcaagttcctcgaagtggtgaagatggatccactcctggaaatggtgcctcagctgatgctggcactggcagataagtctgctaaagctggaagtagggctgaagtagaagatgtagggatgccaactattggtgcaaaggaagagggaacatcagctgctctgagcttg

SEQ ID NO: 76262 - DNA, 474 bp, Glycine max
  Peptide Sequence Number=SeqID_193040
atggggaagcataataactctggatgggagtggtattttaattggagaagaccactgttcgacagcgaaattggaatggctatcacttttctttctgaagttgaaggtaagcctattcacaattatgggtctgatagctgggactgggcagcagaaccatggggtatctactctacaaataatgcttattcaatgttttgggaggaagcagcagtggacagtctcgaggaatgctttgaggagctatggaaaatcaagattcctagtaaaatagcgagacataccttcgatggcttccctgggagtcttaaagccaaccacaatggacttccaaaatcgattcccacccttttcgagactctttcctttcctagttttcttcgagctacgaaatcacggaagcgcagcccagtttgtgacaaagacgaactcaggcagaaggagaaagaagaagaacaccctgggaatcttaag

SEQ ID NO: 76263 - DNA, 282 bp, Glycine max
  Peptide Sequence Number=SeqID_193041
atgctttccaagtttattttgatgatgccaaagactcaagtcaagaatcaagagccaagcaattttcaagaatcaaagagtcgttcaatcaagaatcaagattcagcacaatttgtccaaaagaatttttcaaagaaaaatcttttaccaatagttttactctccgataatcgattacctgaaggcagtaatcaattaccagtagccaacattctttttaaactgatttacaaagcagtaatcgatcaccatgagcatgtaatcaattaccaatgtttttaa

SEQ ID NO: 76264 - DNA, 326 bp, Glycine max
  Peptide Sequence Number=SeqID_193042
cgaagcataaaggttatgtgagtggtagcttgtcggatgaggggaaggttgaacttggaggagattctggtaaatcagaaagttctttggagaaaggcttagttgatcgcagtgacgcttcagatgttgatgctaaagtagataacatggcgaggtgtttcagaaccaaccagaggatactggtattgtcagcagccaaagttgccaaaaagatgaagctaaaatttactaaagactggattgcatatcttagattgcctcttccaattgatgtttacaaagagctgaagcattatattctgaaacatggtgcgaatgtcatgtaa

SEQ ID NO: 76265 - DNA, 246 bp, Glycine max
  Peptide Sequence Number=SeqID_193043
atgttgctaaataacaacgtcatccatatccatgtaagagtggtcatgttggtgtgcatgatccgcactcgtctttttgcagcggcacgggtgaaatcttgccccagtatgcatactagatgcgtgatagcctccctttctggatgtgctcgcacagttggtcgccctccaatatcagggggtggcccaggaactgatataaggaaactaactggccccttaaccgggagcgcaagtctcggttaa

SEQ ID NO: 76266 - DNA, 520 bp, Glycine max
  Peptide Sequence Number=SeqID_193044
tcttcgcccgtaattggctcgttttcccctggttgacgaaagctgcgggtaaccataatgtagaccccgcatgtcacatgacttcacgggtcaggacgacaaaaggtgcagaagatgatgttagtctccgcacgtcaatgggctcgttttccctagatgacgaaagcgtcaacgggctcgttttccccttgttgatgaaaggtgcgggtcagtgggctcgtttgcccctggttgacgaaagtaaccccgcatgtcacctgacttcacgggtcaggacgacaaaaggtgctgaagacgatgtcagtctacgcgcgtcaatggactcgtttgcccctggtgaagaagacgatgttggtctccgcgcgtcaacgggctcgtttcccctggttgacgataggtgcgggaaccataaggtaacccagcatgtcacctgtgttcacgggtcaggacgacaaaaggtgcagaagacaatgttagtcttcgtgcgtcaatgggctcgttttcccctggttgacgatag

SEQ ID NO: 76267 - DNA, 615 bp, Glycine max
  Peptide Sequence Number=SeqID_193045
atgcaaattatttatcctgatgattattcaaacctaggcagaccggatgaaaattttgccgaggaatttacctgcgtcaaagatagaggaatacgctgctttctactttcctcagaagccgcagcattaggaaaaacccgtttttcgggccgctttgaaccaggcataccggtaatctggcgtggttggatgctgaatgcagaggagtatcgccaactgcaccgtacggtagcagctaatggaggggaaatgcttgaatccccggatgactatttgcgtaatcaccatataaccggctggtatgagccatgtaagtcatataccgcagagaccgtgctcgccacagctgataccgatttcgacactctggtcacccaactttgttggcccgcctactttgttaaggattatgtgaaatcgctgaccacatcccgaggctcggtagctcacaatgccgccgaaatcagagaggttattaaactgattgcgcattaccgaggggagcttgaaggcggcgttagcttaagacgctttgaaaacttgattgacgacagtgagcgccgatacttttcgctaaacggccaggttttttccgcacgatggcgaaatacctga

SEQ ID NO: 76268 - DNA, 258 bp, Glycine max
  Peptide Sequence Number=SeqID_193046
atggtggaagttatcagttcgagcctgattatccctaaacccaagcgaactccagtcgaatatgaagcgcctggatacaagttatgccttggaatggaagagaattccgaatcagctttgtctacgaacaaggaagctataagtaatgcaactaggaatctcatggagagttcgatcatggctcaggatgaacgctggtggcatgcattacacatgcaagtcggacgggaagtggtgtttccagtggcggacgggtga

SEQ ID NO: 76269 - DNA, 309 bp, Glycine max
  Peptide Sequence Number=SeqID_193047
atggctgagaagaccaaaaagaaactggaggaagctacccagtctggaaccactaacggtgtcattgaccctacatctcccatcagacgccacgtgaagtggaagatgacccgcaccaagaaaattgagcagatgacatctgaggcagcaaaggaaatcgctgagaagatcgcatcacagggatcgttcgtccctcatggatgtcaggatgtcctaactaccatcattggccgaccagaccaccctggctatgtccgtgctgctggatctggtgtcaccatcaaacaatatttcagatcagctccataa

SEQ ID NO: 76270 - DNA, 267 bp, Glycine max
  Peptide Sequence Number=SeqID_193048
atggtggaaagggaaaaattcgatcatatagaagaaaggctgagggccattgaaggagatgaagactacccttttgccgacatggaagaactgtgcctagtgcctgacatcatcattcctctgaagttcaaggtgccagatttcaacaaatacaagggaactacttgccccaagaatcacctaaagatgtattgccggaagatgggagcatacgcgaaggatgaaaaactattgatgcattttttcaagagagtttggctggggtag

SEQ ID NO: 76271 - DNA, 411 bp, Glycine max
  Peptide Sequence Number=SeqID_193049
atggaggagacgcatgaaattccccaccacgatctagccaacttcgagccttgcctcggatatgccgctgaagggcaagcagttggtggtatacccatgccaaacactttggagggccctcagtttcgcccacaaccacaacccttgcattttgcggtgggaagagcccctcctgctatggctgaaaagggaaagttggatcatatagaggaaaggctcaaggacattgaaggagtcgaagattgtgcctttgctaacctagaagagttgttcctagtacccaatatcatcacccctcccaagttcaaggtgctggactttgacaagtacaaggggactacttgccccaagaaccatccaaagatgtattatcagaagataagggcatacgcaaagatgagggactgctaa

SEQ ID NO: 76272 - DNA, 459 bp, Glycine max
  Peptide Sequence Number=SeqID_193050
gagcaaacgagcccgttgacgcgaagagactgacatcgtcttctgcaccttttgtcatccagggacggcgagtcaggtggcaggtggagataccttatggtcatccgcgcctttcgtcaaccgaggggaatgaattcgacggtatcaagatgatggacggtcgagatgaatccgcacctttctcgtccggaaacattcaagcccaacgacgcgcaagattcttctctactaggcagggacggtcgagtacaatggcttccgcgacatgccggaagtcgaaaggaagcattgttgctcaatccgtaaagttcagtaacattccagaagtcaaaaaggggatgggtctgcaaatagcaaccagacccacttggaccttccagggtgttccaacagaaggcggtgccttctggtggaagcaacccagctcggctgggcaagctgggcggcaaccaccttcct

SEQ ID NO: 76273 - DNA, 1221 bp, Glycine max
  Peptide Sequence Number=SeqID_193051
atgcgctggcattccgatgcggcgctgatcaacggcgtgatcgatgccggcggcagcggccggatcataggcacgctggatttctaccgtaaatccagcagggagagcgcgcccatgtataaaaagctgaacagcagcgccccccgcgagagcatcgtgggctcacacgggcagaagaactccacgcaacgcgattcaatcagcctggcgcacgtattcacgccaggaaacaacaccctgatagacacgatggaaagcaaggtcttctatcagcgcacgcgcgttggcgacgacacggtgtcagcgcaggatatcgtcacttcatccaggtggaggtcgaccggcatggagacggagaaccccttggagaatgtttcgaccttctccgacatgaacaccaagacttatggcctgcaaagcgaaatcaccaaggactatggcgcccaggccttgaattacggcgtgaatttctcgataacggatttttcccggccgtttgaacaagtcggcgcggaccatcccaccttgcagccacagggcaacaacagaacctatgacacgaatgtgtggctgagcgacaccatcaccatcggcgcgctttcggtaatgccgggcctgaaatactcgtggcacaaaatcaacccgcagggctttgaggcgccctccgacgacaaggcgctgggcgcattgacgctggcggaaatcaacgagatacatggcaagacgtttacggacgggaagctattgccttcgttgaccgtcatgtatgcgtccaagcaggggttcaatacctacctgcaatacaaacgcggagtctcctaccccaccagcagccagatagcgggaatctggctgcaccccaggatcgggcgcgcctcgcccgccatggtgggcaattccgacctcaagtccgaaaccagcaaccagtttgaattaggggtggttggcaaggcagcccgtggccttacagtgcgcggcaatgtcttctacaacagctacgacaatgtcatctataaccggaaatacgccttgagggactaccagacaggcgcgccgaaaccgggcgtgcaaagcctgctggccaggcttccggcatcgatctccagcctcaccatcgcggagaaccgcgacaaggcatacatctatggcgccgaggtcgtcacccggatcgattatggcgcgctgttcggcgccgccccccgattgagcagcacttttgcc

SEQ ID NO: 76274 - DNA, 499 bp, Glycine max
  Peptide Sequence Number=SeqID_193052
gagatcgcttggaggatatgattcatgaccttggacaagagtcttttcagcaagcacatgcccctatgtatgatacattgcaaattgattcaaagaaacttttgtatccaagttcaccacttcaagtagtgcacgatatgcttccagagggaaacacattgcttaaaagttactatcaagagaagaagatattgtgtccgatgggtatggagtatcagaagattcatgcttgcccgaatgattgcatattgtacagacatgaatttcaacaaatgccaaaatgccctaggtgtggggtatcacggtacaaagtgaagtatgatgaggagtgtagtagtgatgaaaactcaaagggcccgccagcgaaggtgttgtggtatcttcctattattccaaggtttaagtgtctatttgctaatggagacgatgtaaaagacctgacatggcatgcaaatgggagaaactgcgatggaatgctccgtcatctggcagattcctc

SEQ ID NO: 76275 - DNA, 240 bp, Glycine max
  Peptide Sequence Number=SeqID_193053
atgggtagaggtgtcatagaggagcaggtatggaggaagggaccttggactgctgaagaggacaggttgcttgttgagtatgtcaggttgcatggtgaaggcagatggaactctgttgctaggcttgcaacaaacaagaactctgagtacttcgacatccttaccttgacagtagcaagatcgcgacaccactccaaagagcacgacttcggctatggcggtggtgggaacaacaggtag

SEQ ID NO: 76276 - DNA, 282 bp, Glycine max
  Peptide Sequence Number=SeqID_193054
atgagatggaagaggagcaaagttgttggggtatttgaaaagtcacagcagtatgtaaagcgtttcagccgctataaaaatcccgatgctgttagagacaaaattctcgcaagatatcaattggctgagtttgagttgtgtgtccttggcaacctttgcctagaaactgtggaggaagctattgctatggttccatctatcgagtcaagaggacgggctcaagatgatgaagcaatcgagaaaatgttaaatgacttgtctttgattaagaaatttgaataa

SEQ ID NO: 76277 - DNA, 507 bp, Glycine max
  Peptide Sequence Number=SeqID_193055
atggaaaaaacatatatagctagaagcaaacaagtcattcacatttcacacacaaacgatgacgttttaagtttcttggcgattccctttcaagtgtttgcgagagaatggagttcggtcgggaagccggggaggtgggaggcgatagcggcggcgttcggggggaggcacagggtggagagtgtgataaaaaaagcgaaggaattgggggagaagagagtggatgattcggaatcgtatgcgcagtttttgaagaagaggaaggcgttggataagagggttgtggaggagaatgagggtgaaagtgaggggaaagcagttgataatggttggagttctgctgaggatattgcattgctgaatgctttgaaagcgtttcctaaggaagtttccatgaggtgggagaaggttgctgctgcttttcccgggagatccaagcctgcttgcatgaagagattcgccgaattgaagaaaggctttctgactgcaaaagctgcagccgagtag

SEQ ID NO: 76278 - DNA, 3549 bp, Glycine max
  Peptide Sequence Number=SeqID_193056
atggacgcggatctgaagtcggcgaaggcggcgtaccggaacgccaaggcggagggaaaccaccgagaggaggcgcggtgggccaacgtcatcggcgacatactcaaaaaccgaggagagtacgtccaagccctcaaatggctccgaatcgattacgaaatttcgctcaaacacttaccggaaaagcatttgctcccaacttgtcaatcccttggcgaaatgtatctccgcctcgaacacttctccgatgccctaatttatcagaaaaagcatttagatcttgcgagggacgctggcgacgtcgttgagcaacagcgggcgagcacgcaactcggtcgcacttaccacgagctcttctcgcgatcggagcacgaccacaactcaattcgcaacgcgaagaagtacttcaagtccgcgatggatctcgcggtgaagctccaggagaatcctccaaacagcaagtcctcttttctcaaggagtacatcgacgcgcacaacaacataggcatgctggagatggatctcgacaacttgcatgaggcgcggaagattttaactagaggattggagatttgtaatgacgaggaggtcgctgaattcgatgatggccgcagtagactccaccacaaccttgggaatgtgtatatggaacttagggattgggataaagctaggaaacacattagaacggatattgtgatttgtaacagaattggacatgttcaaggggaagccaaggggtatattaatcttggtgaagtgaattacaggactcagaagtatgaagatgcaagtgcttattacgagaaggcgcttggtttggcaaagagcttggaggatgaggatgctttggtaaggcaaatcgagcagaatattgaaactgtgagagaagctgttaaggtaatggctgatataaagaaagaggagcagagccttaagaagctcaaaagagatatagccactgccagagggacaccaaatgagcgcaaattcttgctgcagcagaatgcagttcttgagcgtttggttgagaaagcaaggatgatctctgcgtgggagaagagactttttcaagctatgcattgtgaatttgcaaaggagaagaagaaaatagcaagtgaactctgtgataggcagagactggctgattcatatctggatgttgcagaatcataccataaactcagaaaattcaacaaagcaatcaagtggtacaaaaagagttgggaaatgtacaaaaatattggtaacttagaggggcaagcaatggtgaaaattaatattggtaatgtttatgattctactgaaagttggagaaaagcattggatgcatttcaagagagctacagtatcgctgttgaagcagacctccctgatgtgcaactcgctgccttggaaaatatgcattatagcaacatgataagatttgatgatgaggatgagacaaggaggttgaatcttctaattgataagctgaagaaattagaagaaaaagaggcagaagctaaaagtatgccagaggatttttgctctgaaactgatactgaagcagatgagtgtctgtcaaacagtgggtctgatgatttttgctttccaaagacaatttctcgatcaaaaactctgactactggagaagaattgaaagaggacgcacctcttatgtcactctatcagtccttaaaaggctcatccaaaaagaaagcaggccacaaagaaagtcttgccaactctaccaagcaagatgagcattcacccagtagtctgaaaaatcaaaccagtgatcatcagacagttgttggtcgtaaacgtgtccgtgtaattctttctgatgatgatgatgatgaagtcgagtgttcaagcagaaaggatcataattgcccggtagaggacttgcccacttatgatgccattaagagtaaagccagtccttgtaaatttcaggttatctcagaaaatggatccaagactgcaattaatgttgaagaaagtagtagttctttcaaatgttggagtccacatagagccacaaaatctggcagacattccaggtcttttagcaatgatatagttgctgaacctgattttcctggtggttctaaatgtgacactgatgtctctggcaaacaaaatgatattacccagcctatgttgcatcattcccaaaatgacctccagcaatatgttacatgccggattgggaatgacctaatacgtgtagaagcatccttgtgtaccactggtgaccagttgaacattgactctttgaaggctgtagttgcttgcttatattatctacaatttccaactgaaaagagatcagagggtttgttgcccattattgagcatataaaatgtgctggaagagatctagaatccctggaaactgttgaacatcttaaggaagttttgggaaatgacatggttgaagcttccgttgatggatggattcacaagggcctgataaaaatgtatgtagaccactgcaaggagttgtcagaggtaccgaacatcaaggtattgaagaagctttacaatttagaggtttcagatgacgaaattgttgtgtctgactgcgaccttcaagacttgtctattacaccattgataaatgcactgcattctcaaaagtcatttgcaatgcttgacctctctcacaatttgttaggaaatggaacaatcgagaaactgcaaaaggtgttcacagcatcaggacaatcttatggtggcttaactctggatttgcattgcaatcgatttggcccaacatcattgtttcagatttgtgaatgttcactgctatttgatcgactagaagtgcttaacatttctggaaaccgtcttactgatgcatgtggatcttatctttcaacaatattaaaaaactgtacagctctttgtagcttgaatatagagaactgttgtgtcacatccagaactattcaaaaagttgcggatgcattggactctacatctgttcttgcccatctatgtataggatacaacagccctgtatctggaaatgctatagttaatcttgtgtccaagctttctactctgaaaaggttttctgagttgaatatgagtggtctaaaactaggcaaaccagttgtcgataccctttgcaagcttgcagggaccttaaatttgtcaggactaatacttggaggcacgggtgttggaactgaaggggcaattaaattagcagaatcattgctccaagggactgaagagcttgtgaaacttgacctatcatattgtggtctaacatttaactttgttttaaacaccagtgttaattttttttgttccatcctagagctgaacctggaaggaaatcctatcatgcctgagggcagcaatactttattttctcttcttgtaaacccacagtgctgtctcaaagttttggtccttaaaaagtgtcaacttgggcttgcaggaattcttcacataatcgaggctctggcagagaacagctgccttgaggaacttaatgttgctaataattctattccgaaggaagtttctgctctacaatatgatttatcg

SEQ ID NO: 76279 - DNA, 705 bp, Glycine max
  Peptide Sequence Number=SeqID_193057
atgttttctaaaaccaaacaagctataagaaatcctccaagaaagaaaaagaaaatacaccagagtgaatatgagaaatccaagagttctgctgtggtccccaatctctttgcatatttgaaacttcaaatagaaattcctttgaaacagccagaaggagaataccaaagagagattcaaggagttaacctcctccaaagggtctcccctttacatgagcagttgctcgctgggaaacacaaagcactggatggatttgggcatgctctggaagttgcaactgaaaagcaaaagccccaatttgctttaacaccaaataggggtcatagtatcttgcagccagctgaatctctggatcacggtcatatagctgagacgcttgaagctggaggattctttcccattagaaagtctcaagatgctgctgttggtgcgcttgtacatatgctgaagaaagcgccacctctgcatcaagatttctccacctcacaacacctctcacaaggtgcataccctgaaacctggaaaaataacactcaagggaccaatcagatcctagaggcatcatcaaggccagtgagcataatgtcttctgggatcatagctactaggaaaacaacagctgatgcattggaagagttccatggttacaaagagatgaaaaacttgttgcttaggcgaggtagtagtaagcaccagaaataa

SEQ ID NO: 76280 - DNA, 1455 bp, Glycine max
  Peptide Sequence Number=SeqID_193058
atggattttgagcaattttattactcatttggccctccttacatgaatcaactccatgagtgtatctcagaaaatgcatttccatttcaaacagaaaatctcttatctccaaatactttcctagatgaaatgtttgatcaagagtactccatggaaggattgctgcagcaacatgcaaacaaccaggaggactttggtttcttgaagcatgatgatccactagagactgaattttgtcatggatttagccctagtgctgaggaaaatatgcatgtttcaatggaagaaggggattcttgtttgaagggaatccaagcagagctaatggaagagactagtttagctgatctgttgctaacaggagctgaagctgttgaagcacaaaactggccccttgcttcagatataattgagaaacttaacaatgcctcatctttagaaaatggtgatggtttattgaacaggttggctcttttctttactcagagtctctattataaaagcacaaatgcccctgaattgctacagtgtggtgctgtttctacgcacacaaatgctttctgtgtgtttcaggttctccaagaactctctccctatgtaaaatttgctcatttcactgcaaaccaagcaatcttagaggccacagaaggtgctgaagatcttcacatcattgattttgatatcatggaggggattcagtggccacccttgatggttgaccttgcaatgaagaaaagtgttaattcccttagagtaacagccatcacagtgaaccaaagaggtgcagattctgttcaacaaacaggaagaaggctcaaagagtttgcagcttctatcaactttccattcatgtttgaccagttaatgatggaaagggaagaagattttcaaggaattgaacttggtcaaacactcatagtcaactgcatgatacaccagtggatgcctaataggagcttctcattggtcaaaacattcttggatggtgtgaccaaattgtccccaaggcttgttgttttagtggaagaagaactatttaattttcctaggctcaagtccatgtcctttgtggagttcttctgtgaggctttgcatcactacactgcactttgtgattcacttgctagtaatctatggggtagccacaagatggagttgagcctgatagaaaaagaggttattgggctcagaatattggacagtgtgaggcagtttccttgtgagagaaaggagagaatggtgtgggaggaagggttttattccttgaaagggtttaaacgtgtacctatgagtacatgtaacatttcacaagccaaattcttggtaagcctctttggtggagggtattgggtccaatacgagaagggtaggttggccttgtgttggaagtcaaggcctttgactgtggcttcaatctgggaaccaatggcttatctggatgacaaggtcaaatag

SEQ ID NO: 76281 - DNA, 327 bp, Glycine max
  Peptide Sequence Number=SeqID_193059
atgctcaatgcctatgtcatggccctgctcaatcgcgatcgcaaggccatctacgccgcatggaccttcccgcccagcgatgcacgacgcgccgacgatgccgcattgcgccagctcacggacgtgctcagcctgcgcctgaccagcgaactgccggtcgcgcgcgacggtcaccagccgccgcagctgctggaggttccggtgcagatccgcgcggtgacccctgaaggcaccttccgcttcggcggctggtaccgcgtgcagcccagccccgatggccgtgcgtggcagatccagtcggcgcaactgcggccatcgctggactga

SEQ ID NO: 76282 - DNA, 501 bp, Glycine max
  Peptide Sequence Number=SeqID_193060
gccggccacggccgggtccagcttgtacatcggttcgcgctgggcgtagtcgctcagccaggcattgagcaggccgcgggtgcgcgaatcgaggcgaccgccctggttggccggggtgaagtcatccacgctcggctgctgcaggtggaagccctgggtctgcgcgtcgtaccgcaggccgctgctgagcttcaccgttcccagcttggacgggttgccaccggcggtggccagtgcgaggtccatgcccaggttcaaccgttcgccggccggaaggctcagctgcggatggctcatggtcagggcgatcaggccacccagggcgtcctgggtgcgcgggaagctgccatcgaggtactgctgcacgtcgctggcaccgaccgacagttcgcggccggaaatggaaggggcggcctgggcgccgatcgcagcagcgatcagcacggtggaggccgcgaggcgggtcatcagggaacgcaggcgcatggcggtgaccggtga

SEQ ID NO: 76283 - DNA, 339 bp, Glycine max
  Peptide Sequence Number=SeqID_193061
atggtgatataccacactgagtttgatgatttcaaagaagagcttgagagaagaaattggcatgaagagttgaccaactttgcacaaggcagcattgatgttgccattgtaaaagaattttatgctaacctctatgatctagaggataaatcaccaaaacaggtgagggtcagaggtcatctagtgaagtttgatgaagacgccctcaacatattcttgaagactcctatgatcaccgaggagggggaaacactatctgcttattccatatttgcactcttgaggcctgatcctcaggaattggcagctaatgtgccatcattttcttatatttcttaa

SEQ ID NO: 76284 - DNA, 731 bp, Glycine max
  Peptide Sequence Number=SeqID_193062
gatcatatctggcatcggtcagtaattctttcaaggcgtctaaactcatgatcaatgacctcgtgctggaaattcaagaatttagagagagtcttttagatttagggatcgaggttagatcaattttggtgcctattggacaagggagttcacacgtttcaggatcatctcaattatcatcaaaagatgtgtttctgtcaaagactgaagtaaaaaatatctctcagattaatgctagttcagaggagtttgtttgtgttactgtcgccaagattacaaccatagtgatggacaactattcatggtgctatccgacttgtggtcaatgttataaaaaagctaacatgcaaactgtgtcgttcacatgtctgtgtggcaaagagaatgatcaacctgtactgaggtatcgggttgaggtgatggatggggatgttgatttaaatgtctctcctcaagcactagataggctattgggttgtttccttgcattcaaagtgaaggtgcaaccaaggttcaggaattctgttgttcttaaatattcagatgaatcagacttgatcaatgtcgtgctagatatgattcccgatagtgagcaatctctgtctattatcgctgatcatgatcggtcaatgcttggctcaagtgagcctacagagtttgaatctcaatctgtgtctgttaccggggatcatgacccttttctcaggattccattgacaccaactaagcgt

SEQ ID NO: 76285 - DNA, 567 bp, Glycine max
  Peptide Sequence Number=SeqID_193063
atgggaacaagaggttgtattaattataatctcgtcctcgccatcagacagcttggctaccccatgagaggagcgccatcggaggaaagcatcgcgcctttcatcgcacggggtttcagtgaccctaatgcaggggtacttcaaggagttcacaaggcatgggatgtggtgcaaaggaaggacaaagagcttaggggaagtagtaatgggatcatcagcgactatcttaagccgaagctccagaagagagtgaggaggtacctaaaggcagagcttgaaagagcccgggcagtcaaaaagaagttcaagtcaacggccatcaaagtccaaagagagtacgatgaactaagggacgtcaatatggccaccatcgaagccttggaacaagaaaccaagaggatgagtacaccaagatatcagcggaaagggaagcatgggaaagcattcacctttactttgaatggaagtcaagagctttcccaacttctagctaaggccaaagcaatggcggacgtgtacagacccctgaagaaattcacaggctcctcaactattgccaacacatga

SEQ ID NO: 76286 - DNA, 216 bp, Glycine max
  Peptide Sequence Number=SeqID_193064
atggagcttatggacaaactccaaaggcttagacaagggagtatgagtgttgaagaatatagacaacaaatggaactactccttgaaattctgatactgggacagatgtcgtaccggatatttaaacaagtaaataacacaagagaattgttaacccagttcggtgcaacctcacctacctctgggggctaccaagccagggaggaaatccactaa

SEQ ID NO: 76287 - DNA, 226 bp, Glycine max
  Peptide Sequence Number=SeqID_193065
gctagcctctagctcgccttggtccccaaattacttcagggtgaaggaaccagctagcctgggcgagccagttacttcaggagtaagcatcagctcgcttgggcgagttgccattgacccaagtgcccattttcctataaataggcgtgcaagggaggctgaggagaggatccaaggttcagaagtggagggaattgagagaactaagaaagaagaagaagaatga

SEQ ID NO: 76288 - DNA, 141 bp, Glycine max
  Peptide Sequence Number=SeqID_193066
atgagcaagaggcagcaagaggattggtatcaagagcatctacatggagaagaagatccaaggcctataagctctacatggagctatgacatgtggtatcaagagcatcttcgtctaggttctatcatttttcagtcataa

SEQ ID NO: 76289 - DNA, 339 bp, Glycine max
  Peptide Sequence Number=SeqID_193067
atgcccaagaggaagaaaaataacaggcttaagtatgcttttaagtatgattttgtttccccaaatatcggaaaattagctttttcaattttggttcatttgtcatatgctcacggaatcaaaattgaaaacaaacggctaaaaatcagcaagatatcgtatagaaacaaaaaaaaatacacaaggttaagcggcgttggtgtgtggctaagcggaggcggcttaggagagcgcaatgatctcatgggcatttccccagaaaacggtggacttcagtcggagaagtttacagcagacatcgaggtggaaggcggaggtggaggcagtgtcataccctaa

SEQ ID NO: 76290 - DNA, 576 bp, Glycine max
  Peptide Sequence Number=SeqID_193068
atgcaaagttttatcgataagcaattgaacacaactttcttgagaaacctaacaattgtgaaacaagatgctgatgtcagtgttattgatctctttgatcttcatcatcagtgggtcaacatccaggatatgcagtgtaccgacaaacataccttaatatcacgctcccgtccatcgttatcacgttggaccagcctcaatgagaaactagagcagcttcttgcgaatgtgtctaaattaacaattgaagagcatggagaatggagggaaatggcaaacatgatgcaaaatgtcgtggctccaccagaggcttttttccagaccgttcttgccaaggaccaaattttcggtgaaattagtaaggtatatgctgtcaagtgggaggacgtacttgacggttctgtcaccttcaagatttatctcactgagcagaaagttacctgtagcagtctgacaaaggctagactcatttgcacttggagaacgttgcagaatgtcggcttatgttcaatcattggaggaagacacttagaattggagctggatggaaacatttatgcgaaaccttgtccttga

SEQ ID NO: 76291 - DNA, 336 bp, Glycine max
  Peptide Sequence Number=SeqID_193069
atgggtgtggtgagagttgagcttgggggaggaggccttttgggcatggacccattgagaaaacgacatgaaataattgaaagcatagcactttgtgagaacaaaatgggagtgctagctgcgacaggaaaggggccggttgtgttgtgcctcaaaggtggtcctcaactcggtcgtgtaaaggagttcaggtggcactgccgccggccggcaagggtggccacagccacgtgggagttgtggtccaaaggggatcagtggtgttcgccatgtgtcctgagaaaagaggtgacagcctgtgttgtgcaagaagagcatggtcatggatatgcatga

SEQ ID NO: 76292 - DNA, 207 bp, Glycine max
  Peptide Sequence Number=SeqID_193070
atggtactagagtctattctagatccatcgttgggtcacctgcatttggcacacttcaggctgaaagtcctgggagtgagggagaaaaatgaatcacatgaagacagtacaaatggagacttcaatctcttctccgtctctctaacgtttgggaactctatcagagcagttggaggaaaaactgaaagaatcttaggaaaccgctag

SEQ ID NO: 76293 - DNA, 300 bp, Glycine max
  Peptide Sequence Number=SeqID_193071
atgcctcctaaggcatcgggaatctccctaaggggaggaaggagtacaggcaaaggagccagactggctcttccagagccaaccatcaagaaatcatcaacctcttctgggtcaccaactcaggctgggtcatctacccagaaaaccaatttagaagggtcatcaacccagattgcctcaatcaaacctgagccatccactcaggaatctcccaaaccggcaaccgccaaacaaacatcagccgactatgcatggccaattgaaacccttcaggcccttcaagacatggatggaacctga

SEQ ID NO: 76294 - DNA, 243 bp, Glycine max
  Peptide Sequence Number=SeqID_193072
atgtgggtgcaagccattggtctgtttgctcaagcgacctgtgctcctgagtttggacttccaagaccgctcaatcagagattactcgtcttgcacgttggtgggggtgccgtaaaacaacaaggacaacccttcccttatgctcaagaatcccctacaacaagagacccacggtctcttaatcccttttcggaaataagaagaagagaagaagaaatctctcgtaaaagaggtagattgtaa

SEQ ID NO: 76295 - DNA, 147 bp, Glycine max
  Peptide Sequence Number=SeqID_193073
gcatgtcgtcttcccgtagagatagagcacaaagccaattgggctgtgaagatatgcaacttctcttttgatcaggctggagaggaaacaaagttgcaactaagtgagctagataagattgatcgaggccgtaaacgaatcaaatag

SEQ ID NO: 76296 - DNA, 225 bp, Glycine max
  Peptide Sequence Number=SeqID_193074
atggggctccagataagatttgatggtggaggatgcatgaacaacgctaggcaatcaattcgtggggctccggactcgatgataagatttgatggtggaggatgcatgaacaacgctaggcaatcaattcgtggggctccggactcgatggtggaggatgcacgaacaacgctaggcaatcaattcgtggggctctggactcgatgggggaggatgcatgaatga

SEQ ID NO: 76297 - DNA, 331 bp, Glycine max
  Peptide Sequence Number=SeqID_193075
atggctctgagaaagcttcctgcaaagagatccaggaaggacaaagcggctgaagggaccagtgccgctcctgagtatgacagccatcgcttccggagtgttgagcaccagcagcgtttcgaggccatcaaaggatgctcattccaccgagagagacgcgtccagctcagggacgatgagtacaccgacttccaggaagagatagctcgccggtggtggacatcgctagttacccccatggccaagttcgacccagacatagtcctggaattttatgccaatgcttggcctacacaggagggcgtgcgggatatgcgatcttgggtgaggg

SEQ ID NO: 76298 - DNA, 684 bp, Glycine max
  Peptide Sequence Number=SeqID_193076
atggcagacgacgaactttcctcaaagtgcctggaccgcctcgaggccaccattgtcgatctcgttatcacccaagcctccatggctgccaaactagaccttcttatcctgaaaatggataccctattaatcagccaacaccctctatctgcttcctctgcgaaggcactcctcgcacacacactcatgccaactccgccgcccatgccaactccgtcgcctatgccgattccacctccacgccttgcactcatgcagcaacaccccgcacccttgtcggctccgctgaccattgttgtcgttcaccaccccgataacagcaagccccagatgtcctcccctggccgtcgcgaggccgccacccatcagatcggtgcggagttccccagccgtcgcatcctcccctctgtcctttgcttatccccttccgtcatgttcattgtcaaggtcagggacaaagagctcgaccaccccttcctccttcccttctacgccagtattgacgccgccaaatggcttcgcttccgcaacactaaccttcatttgcgcacgagctattttccttcaccttttttaatttgggtcccggttccacttttgaagccatggtttgaagcccaacaccttgaggacaaggttatcaaaaacttctatggaagggaaatagggttttcatacggataa

SEQ ID NO: 76299 - DNA, 195 bp, Glycine max
  Peptide Sequence Number=SeqID_193077
atggctcaccgtggtggcataagacagaacgtgaataggggaaagaaaactggcaccttggtggggcttgacaatggtaataatattacttggtcttttacatggcagcaactgccggtgcaaccacttgtggctgagaaaccaagcagcaaaaaagccttagggtggtgccacccaataggaggtaggggatag

SEQ ID NO: 76300 - DNA, 816 bp, Glycine max
  Peptide Sequence Number=SeqID_193078
atggcttcaatcccacaattctatccaaactatacgttcaccactcacgatctttccgagtaccctgtccctcttctcaatggtggcggtaatgcctcggttatggacagcaccaccatgtggggtggtggccaagatagcttgagtattcctgtgctggatatgaacaatggtgcacttgatcatattgtgtcgcttgattgtgacaccatggcttgtgctgctaattggatgccttcgttttcggagcagctcggggggctctcggatttggccatttcggactgcaaaattgggttctatggaggagggtttcagagtttcaataacagcagatcgtaccaacctcatgttggggagtttggagatgaatgttgtgggtttgtggaggatcttaagccacctccttatcctaatgctgcaagagaaaactggggaattgaaggtaatcaaatggcagcagttgaggagcctaacataaaggtaggaaggtactcagaagaagagaggaaagaaagaattctccgatatttgaagaaaagaaatcaaagaaactttaacaaaaccatcaagtacgcatgtcggaaaaccttagctgataggcgagtcagggttaggggaaggtttgcaagaaacaatgagctttgtgaagaagacatggcaaccaaaaagcatgagaatcatcatcaccacaaagaagacttttatggtggcgattcaatccagtttcagttaaagaacgatgaggaggattggcttcaagaggccatggcaagtctagtgtatttatctcattcttcaccggaagatatgtaa

SEQ ID NO: 76301 - DNA, 477 bp, Glycine max
  Peptide Sequence Number=SeqID_193079
atgcaaaagttgttggagtggaaaatgtttttgcaccatagctttcaagatacagttgtttggaacagtgaaatctcaggtgaattcttgaccaagtctggttattggtggttgatcaaatgtgattttcctagcaatatgggtagtggttggaagtccatatggcaacgattatcccagttattttatgggaaatttggaaagctaggaatgctaacattttccagcaggaaacatgtgaatcttcatcataatgtagggaaaatattgatcattcatgaagctattatcatggcttttgatgcccataatgatgctagtgatgcaaattcatcctcctcgaagtgggtttcttgtatccatcctataggtaatcaagtgtccctgcatggatgcaatgggaacatggattcatgggttatatggagacatagggcagatggacatcaccaaagaggagctgttagcaattcttaa

SEQ ID NO: 76302 - DNA, 108 bp, Glycine max
  Peptide Sequence Number=SeqID_193080
atgggccttgtgcatgacatcttgatgaggttcaagtgtggttcgaatttggaaagcatgggtttgagtattggtggagttaccatgttggtgtgttccaaggtttag

SEQ ID NO: 76303 - DNA, 1836 bp, Glycine max
  Peptide Sequence Number=SeqID_193081
atgtgtctgttcggagggattttttggaatcaatacatagcgcctgctacagcctctattcagccatctatttggtccactacactaaactgcttcagtatggctgttacactaaacagctccaccaaggtagcccctgaagacaggggccgctccgcactgctacaccactataggcctgctacagccgctattcagcctgctatttggtccactatggccgctacactaaactgctctgctacggcagcccctgtagctgacaggggccactccgcaccgctacacctctatagtggcactataaccattgcaacagtatgcatgtttcttgctgggaaggttgaagaaactcctcgcccactaaaagatgtaattcttatttcgtatgaaattatacataagaaggacccagcggcaattatgagaataaaacaaaaggaagtgtatgagcagcataaagaattaattttacttggagagagggttgttcttgcaactcttggttttgatctgaatgtgcaccatccttataaacctcttgttgaggcaataaagaaattcaaagttgctcaaaatgcccttgctcaagttgcgtggaattttgtaaatgatggacttcggacatcactttgcttgcaatttaagcctcatcacattgcagctggagccatattccttgctgccaagtttctgaaggtgaagctaccatcggatggggagaaggtctggtggcaagagtttgatgtcactccacgccaattggaggaagttagtaatcaaatgttagagctctatgaacaaaatcgaatgccaccttccaatgatgtcgaaggaggtgggacttccaatcggaccactgcaaaagctctagctactaatgatgaaaatgcagctgcaaagagtaattcccaggctggagccacaaggctggaaacatcaaagactgcatcttctatggccatatttgattcaccggtcccaaatcatgttgggcgtcccatctcaaaccatggtagaagtggtgattatgggagcacagaaatgaaacatagggtggaaggtgatgccaaaggcaatcaatatcctgagcgagaatctataccatttaaggaaaactctcatgaagctcaagacgtggtgaaatttcgatttgataatggtgaaaaagagcacgaaagcaatgctggagggactgaaacaaaagaactgactgaattgaaagacagacataatagcagaaaccctgatcacagagaggatgcatttagccggcctcctcaggaagccattaagaaaattgatactgacaaagtaaaggctgcattagaaaaacgaaggaaagcagctggtcatataactaagaaaacagatgtcatggatgatgatgatctcattgagagggaactggaagatggaattgaactggctcctcagagtgagaaaaataaggataagaggcaaagctggtctaagccctctgacagatctgattatgataacatgcgtggaagacatctagatcatgaagatgagcaatatcatggagtaaagggtttggcatcatatgaaccagatctaagtgctgttgaagaaggggaggtatcggcacttgatgacattggggtagggcttccatcacccaagtcaagcaatcgcaagagaaaagcaggaagctcccctgaaagaggaatggaggggaagcaacgtcataattatggccttggaccaaaccacaataatcgttttgattacgtggaggatcgaaacaaggtcagtcggctaggccatactgagagggacagcaaaaggcatgtacaggaaaaccatgtttga

SEQ ID NO: 76304 - DNA, 2308 bp, Glycine max
  Peptide Sequence Number=SeqID_193082
tgttggggactcactcatggctggaaatgggacatctcggtggctttctccttcaggtgattttgcatttgggttttaccaacttcctaatgagtttttcttgttggctgtttggtatgacaagatgccaaataagaccattatttggtttgcaaatggagacaaccctgctcctataggatcaaggttagaactaaatgactctggactagtgctcaataacccccaaggtttagagctatggagatcaaattttgcatcaggtacaatttttaatggtctaatgaacgatgatggaaattttcaactcttagaccaaaatgctgtgtcactatgggagactttcacccatccaactgacacgttagtacctaatcaagtaatggagttaaatggaaaacttttttcacgacgaggagagtttaacttctctcatggaagattcaaacttcatttacaagaggatgtaaatcttgtgctcagccttatcaatttgcctagcaactacagttatgagccttactatgatactggcactgctgatgctaataaccaaacgaatattggcatgaaattgatatttgacaaatcaggcttcttatacatactgaaaaaaagtggggagaagttttatattaccaagccaaatgagacgatctcaactaatgacttctactacaaagcaacgatcaattatgatggagtttttaccgtatcatattaccccaaagatctaagaaaaggacaaggatgggtcactacaaagactataccagaaaatatttgtttgagttctacattcacagatggcgaaggtgtttgtgggtttaatagcatatgcaatctcaaagctgaccaaaggccaatatgtaactgcccagagagatattctttaattgattcaaataacatgtatggtggttgcgtaccaaatttccaagttgtttgtcaaggaggtgggtatatggtttcacaagatgattacataatgaaggaattgcgaaacactgattggcctacatctgattatgaaacattaagtccttatagtcttaaagaatgcacaaaatcttgtttgcaagattgcttgtgtgtgttggttactttcagtggaagttcttgttggaagaaaaaacttccacttacaaatgggagaagagataagggagtaaatgcaacttctgtcataaaattgatgaaaaatgattaccttttgacctctttcccaaacccaaatgggaagaaagatcatgatgtcttgatcgttgtgttatcagttcttttggccggctctgtgttaatcattttgatgttggttggtgcattatattttggtttctcgtgcaaccgcaagaagatcgaaagtagtagaaccaacaaaagtgttgctaaaaagaatttgcatgactttaccttcaaggaacttgtggaagcaacaaacaactttagagaagaattgggaagaggatcttttagcattgtatacaaaggaacaatagagatgactagtgtggcggttaaaaaattagacaagttgttccaagataatgacagggaatttcaaactgaggtgaatgtaataggccaaactcatcataggaacctagttcgtctacttggatattgcaacgaaggacaacatcgaattctggtatacgagtttatgagcaatggcactttagcaagcttccttttctcttctttgaaatccaattggggccaacgatttgacattgcccttgggattgccagaggtcttgtttacttgcatgaggaatgttgcacccaaatcatccattgcgacataaagccacaaaatatacttttggatgatcaatataatgctagaatttcagattttgggttagcaaagctattattgatcaatcaaagccgcactgaaactggaattagaggaacaaaagggtatgttgcaccagattggtttagaagtgcaccaatcactgctaaggttgacacttatagttttggtgtgttgttactagagatcatttgttgtagaaagaatgtagaaaaggagcttgttaatgaagaaaaagggatattgactgattgggcatatgattgctacaagactagaagactagaaattcttttagaaaatgatgacgaagctattaatgacataaagagctttgaaaaacttgtgatgattgctatttggtgcattcaagaacatccttctcttaggccaacaatgaagaaggttttgctgatgctagaaggaaatgttgaagttttaacacccccaagtccctaccttcatggatctattagtgaaaattga

SEQ ID NO: 76305 - DNA, 618 bp, Glycine max
  Peptide Sequence Number=SeqID_193083
gggtcaattccacgaagttcactttggttaaccaatgcaactacacggtgtggccagcgttaatgggaaatgttaatctttcaacgttaaagggaaatgataatctttcaacgactggcttcgttttgagaagtggcgaatcttccactgtgactccacctgcaaaatggaacggtcggatctggggccgcactctctgcaccaacagttcaggaaatttctcttgtgtcaccggtgattgcggttccggaaagatagcatgtgacggaaaagcaggttctatgccggtcacggttctagagttttccttaaggcacacccattatgctgactattatgatgtgagcctagttgacggattcaatgtgccgttcgataattgttcccataagcagcagcagcaagtaacccctgtggtcggcggtcccaagaacgatatttttgttgtattggtggtgatgcgagatccaactgcaaaccaagcgtgtactactcgaaaatattcaagacttcatgcccgcaagcctacagccacccaaaaggcgaccaaaccagcatgttcagctgctacgatcctgtcgattacaacattgtcttttgtcctacatctagcaacag

SEQ ID NO: 76306 - DNA, 2502 bp, Glycine max
  Peptide Sequence Number=SeqID_193084
atggtgagactgtggaacaagcttaagagactgcagcaggatatgagaaggtttagcaaacccctgagtaatctaaagcagaatctgatcaaagccagagaagatcttcaatttgctcaggaaaaccttagaaacaataacatgaatggagatagtattgatagagtgaggcagctgacagaagaggttattaatcttaatgaattggaggaaaaagatgcttatgcagagagcaaaagtggattggataaggaaagaaataatagaagaaatatatatatgctgcagaaaactgatggaaccttacttgaaaaccagtctgagatagaggatgagatcatggatttctacaagaaactcatggggactgaggatagccagctgcaccatattgacatagatgctatgagaaatggcaaacaagttaatatggatcaaagaagatatcttgtgagcaatatcactgagcaggatattgagagagcccttaaagggataggtgatgataaaagcccagggattgatggatttggggctaagttttttaaggccagctggtgcatagtaaaagaggatgttatagcagctattctggaatttttcaacacagaaagattgtatagaggctttaataatacagtggtaactttaatccctaaaggtgataatgctaggtatgtgaaagattatcgtcccatagctggctgcacaactgtgtataaaatcattgccaaaatcataactgagagattagggaaaattcttcctagcatcattagtcatagccaggctgcctttgtgcctgggcagaatattcacaaccatatccttttagcttatgagctcctcaatgggtatggcaggaaaggtggaacccctcgtgtgatgatgcagttagatttacataaggcatatgacatggttaattggagggccatggaatgtattcttaaggaaataggtttacctatgcagtttgtgagttggatcatgactggtgtctccacattctcctataggtttaatgttaatggaatctattctgacattatgcaagccaagagagggattagacaaggggaccccatgtcccctatgctttttgtgataatcatggaatatatgcatagaactttggtgaagatgcagcaaaatcctgacttcaatcatcactcgaaatgtgaaaaaattggcctaactaatctcacttttgctgacgatgttttacttttctgcaggggggatagtaaatctgtatctatgatgatggaaaccattagaaaaaattctgattctacagggttaaaggtgaatccagcaaagtgtcagatgttctttggaggaatggatggttgtagcaaagaaaatctgagaaggataactgattttgcagaaggaaaactccctgtgagataccttggcgtgcccttatcttgcaaaaggctcactattcagcagtacatgccactgatagacaaaatagtggacagagtgaagcattggactagcaaattgctaagctatgctgggagaatccagttggtgaagagcatcactagtgccattgcaatgtactggatgcagtgcttcccactgcctcagtttgttcttaggaagattaatgctatttgccgaagttttgtttggacaggtaaacaagagattagcaagaaaagcctagtagcttgggatacaatgtgtaggaataaaagccagggtggtgttggcattattaacttgcaggtttggaacattgttagtctgatgaaatgtctttggaatatttgcagaaattctgagaatctttgggtgctgtgggttcatacatattatctgaagggcaatgatgctattactgcttttgtcaggcctaatagttcttggatccttaagaacattatgaatcaaagagataaactgggtcagatacaacaacattgggaccaagctctcagtagacagaagtttcctatgagtgctatgtatcatgggctgacagaggaacaccaaagagtgccgtggaggtctgtgatgtgtgggaacaaggctagaccgcgagctgtcatttgcttgtggcttgcttgtcacaaaaagctctctactaaagatagactaagaagatttggaatgatccaaagtagtgattgcagtatttgtaattgtgctgatgagactataaatcatctttttttcaactgcagtggcactagagaaatttgggggaacattttggattggctgggtagaagacatgatccgagggagtgggatatggagcttgcttggattattgagaacaccaaaggtaaaggttggaaaagtgctctgctgaaaatggcaacagcggagacagtttataatgtgtggcactatagaaatagcatgtgctttggtacagttgtggataaacaggttatagaaaggaatatcattgacaacatagtgtatagaagttggcaatatccaactcttagaagtcatgttgcaaagctaatgatgtag

SEQ ID NO: 76307 - DNA, 189 bp, Glycine max
  Peptide Sequence Number=SeqID_193085
atgaaaggtcggactagggtttcgttctctcccgaaaccagagccaagttggaagattccgcttcgatcgaagggttcctctcagtgtggggttgcaacggagaacaacgacggaacggaagcttcgcgcacactccagacatcttctcaacgatcccaacggtcagatcgtggacaattgtcttgtga

SEQ ID NO: 76308 - DNA, 327 bp, Glycine max
  Peptide Sequence Number=SeqID_193086
atggctcaggctcagaaaaatgatcctttagacgatggaggaggtggtgtttcaaaaggaaaagtctccttcaaagacatgacaatggcaaacaagcaagatgctttggttgcaagttttgaaattctagacattggaaatgggtatttcatggtcaagttcgacaatgaagatgatcaaaataaggttattgtcgatggtccttggatgatctttgatcattatcttacggtaaggacatggtttgtggatttcatctccctacaagcaacaattgtcaagactatggtatggattcaatttccaagtcttaatcttttgtactaa

SEQ ID NO: 76309 - DNA, 549 bp, Glycine max
  Peptide Sequence Number=SeqID_193087
atgcaagacgaagaccctgctgcagcccttcgactcctgctgaacaccagtcaagccaacacctcaagtgaaaagaatcctggtgcttcgtcctcatctgatgctgatataacctctacaaaaaaacgcgaaaatggcgccagactcgatgcccagaaacaggcacatatccttctgctcgagaaagcccgagcggctcaacgtgaagtcgagcgtctcaccaaagaggcgaaagaaggatcttctgagatcaaagcctgtgatgataatatctcctcctgggaggcaactattacaaatttgctgtctcaggtcgatgatctaaggcagaaaattgtaacagagcaggctaaacgcaaagaactccaggagaaggccgctgattcgattcagaagctggttgccgaaaaagggagggaaggcctgaaggcctttagtgcatctcaagcggtagcagatgaggcgagagctatggagagtgctgaccaggttttaagcaaagagatggccaccttgaagaagctatatgaggatttgatcatgacttag

SEQ ID NO: 76310 - DNA, 195 bp, Glycine max
  Peptide Sequence Number=SeqID_193088
atggtagaggtctctggtaatcgattactaggctgtgcaatcgattacacagagggatgggtcactgataatcgattaccagcctctggtaatcgattaccaaggctgtgtaatcgattaccagagatgaaaagccttcagatactccttttaattgcatgtagtggttatgagacgcattgtgcggcggcatag

SEQ ID NO: 76311 - DNA, 438 bp, Glycine max
  Peptide Sequence Number=SeqID_193089
atgaatagaatgataaaaaagaggaaaggaatagcactcagagcctcatcaacttttattcaagaagaaagtgacaaagaggacttgaatgaaatagaagaaggtgatgatttcataccttttgtgaagagattcaataagtttctgagaaacaaaagaaatcaaagaaaatcaaacatcaattcaaagaagaaaggagaagattcctccttagccccaaaatgctatgaatgcaatcaacctgagcacttgagatttgattgtcttgtccttaaaagaagaatggaaaaattcgacaagagaaatttcatagaaaagaaagcatacgtcacttgggaagacaatgacatggatccttcaggtgattcagaaaataaaatcataaatctgggtctcatggcgaaagattatgaaagcgaagaagaattgacacattga

SEQ ID NO: 76312 - DNA, 916 bp, Glycine max
  Peptide Sequence Number=SeqID_193090
atgccgatttgggtaaagttaccacaattgcctctatgcctttggggattgaaaagcttgaacaagataggcagcgcaataggcaatcctttgatgactgatgaatgcacaactcagaaacttagagtttcttatgctcgcatattggttgaggttgatactacccaaaaattggtagaggaaatcaccatatctgacagaactggaggaaagataaagcagattgtggaatacgagtggaagccagaattttgtgagaaatgtcaaaaggctggtcatcaatgtggaaagaagaaagttgtcaagaaatggatacctaggaacaagcaagcagatgaggtaaaggcagatccccttccaaagacacctgtgcagaatactgaaactgaaggagaggacaaaccagaaggttggattacagtgggcaaagctgcaagacatacaggaaaagctatagaggtaattggaaagctaaaggagattagctcccgtctcctaaagcttaggcctaccattgctattttgattgaaactagagtgaaaaataagaatgctaagaaaataagagataagcttaaactacctcacaactacctggacaattacaagtggcatgataatgggaggttgtggattgaatgggataatagtaaaattgatgtgaggcatgttaagtgttctagccaatatgtgcacgtggtgtatgccttaaatcagttggatagaaggaaagttctgtggaaagatttggaggctatccataaacatcaacagggtccttggtgtgtgattggtgacttcaacaatgttactaaggctcaagatagaattggaggaaaagctgtgacagaaagtgagtacattgatttgctgaacatgatggagactacaggcctggctgagatggataccacag

SEQ ID NO: 76313 - DNA, 1188 bp, Glycine max
  Peptide Sequence Number=SeqID_193091
atggatgtgccttttaagtttgacgaggagtgcatgatagatttcaacactctcaaggagaagttaattatcgcccctatcaatattgctccaaattggagtcaaggatttgagttgatgtgtgacgctagcgattatgttgtaggagcagtcttggggcagtggagaaacaaggtttttcactctatatactatgctagcaaggtcttgaacgacgcacaaatgaattatgccaccatagagaaagaactgctagctattattgtatatgctctagagaaatttagatcatacttgattggctccaagatcatcatcttcatcgaccactctgccatcaaatatgtcttggccaatgcagattcaaagccaagattgatttggtgggttcttttaatgcaagagtttgacttagaaattaaagacaagaatggttgtgaaactcttctagttgatcatctttcaagattgatgaatgaggaggtcacccacaaagaacaagaaattcaagatgagttcctagacgaatctttgatggtgagcaggcgcaactttgaagaagccaaaggtatcttatggaattgccataattcaccttatagagggaactacagtgatgagaagatatctacaaatgtacttcaatctagattttatttgccatccattttcaaagatgcatatgttcatgctcagtcatgtaataaatgccaaagaactagaagtgtttccaagaggaatgaattgccattgcataccattttggaggtggagatctttgactattggggcattgattttgttggtccctttcctccatcattctccaatgaatacattttagtagcagtagattatgtgagcaagtgggtggaggctgtggcatgccaaaagagtgatgccaaaattgtgatcaaatttctcaagaaacaaatcttttctagattgggcgtcccatggtacactaagaagacaagattgaagcttctagagctcgaggagttgaggattcatgcttatgattcctccaagaacaacaaggaaaggtccaagtggtcaaggttgttccttgttaaagaaggcaagccatatggggcagtagagctggtgaatccatttgcaactgagctagcaaggagttgggtggtcaatggccagaggttgaagtcctacctcattcatctcaag

SEQ ID NO: 76314 - DNA, 395 bp, Glycine max
  Peptide Sequence Number=SeqID_193092
atcccttttccgccgaagctggtttcgtggcgctggaaaggctcaaggatgttgtggtgaagaagaaagatttcgagtcacaaatggaggttggaaacactactagaaaaaacattttctacgacatcgatgtggcaagggtactgacggatgggaaaattgttgaattaaatcagattggaaaaaaagatgagaacctgactggggagtggaaccacacctctggtcaatggaatggagatgctaatgacaaaggtattcagaccagtgaggattacagattctatgttatttcagctgagtaccctgaattaggattatttgtgtcacctgatttgaatcaggattatttgtttgatgttggggtgattgtttggttagaggtgcagtggtga

SEQ ID NO: 76315 - DNA, 216 bp, Glycine max
  Peptide Sequence Number=SeqID_193093
atggctaagcctcactcaagtgtggggaaggaagattctccaaggaagaaagtcattccaaaagaccctagatggactaagaaaaaaggagataacatcaccattcaagatcttgactatggagtggatgattatattagaggatcaatgaaaaaggaaaaatcaccttgttcgagggtggttgattgcctttcctttctcatcttccagacttga

SEQ ID NO: 76316 - DNA, 876 bp, Glycine max
  Peptide Sequence Number=SeqID_193094
atggcggcgccgaacaggatcgaacgcgcccaccagatgtaccgcgacggaagttacgaggaggcgttagggttctacacggaagcaatcgccttggccaagaccaaccctcagaagatcgctttgcatagcaaccgagccgcgtgctatctcaagcttcacgatttcaaaaaggcagcagaagagtgtacttcagtgcttgagcttgatcacaagcacagtggggcattgatgctgcgggctcaaacgctagttaccctgaaggagtaccattcagcactttttgatgtcagcagacttttagagttgaatccatcttcagaggtttatcaaaatcttcaagctccgagggaaagtggaagtagtagaataaaaaggagtagagaaagaggaaaggcacttgctccaataccagaatcagaagaggagtttcaagaacaggaagatgaggaacctgaggtgatatcacaaggagaaaatgaaaatgaagagatgggagagaaatattcatcgatttctaatattaggacagatcaaaaggttgagcttggcaaaggtattattattgctgattgtgctccccatgaaacagacctcaaattttcatccaagcaaggaagaaaccaaaaccatgagcctaagaagtccatagcagatgctatagctcctaaagcaccaaacagggaaacaacagagcaacattcaaaagggtggcaaacaattccaaaaccaaaaggacattcagctctagactatgcacggtgggacagtgttgaagatgattctagtgatgatgacgatgacgatgaagatgaagaatctttgcctcagtaccgatttcgtgtaagaacagttggtgtccgtcctgtaaagtga

SEQ ID NO: 76317 - DNA, 252 bp, Glycine max
  Peptide Sequence Number=SeqID_193095
atggagataaggagccattgggagggatggagatgtgaaaacaatattacttggccaaaaagcagtctaaagctactatgtcatcatggacctcatgtatcaaaagcaaatacaaatggtaatgatgctgatgttgcacctgaattttctcctttgaaaactgttcaatttggaaatccttctcaagacactgttgaaccaagagatgaaggctttggaggaagactatggagatggaaatgggaaaaatga

SEQ ID NO: 76318 - DNA, 159 bp, Glycine max
  Peptide Sequence Number=SeqID_193096
atgagcactttctcccttggaactcccaaatttttgctaattgtggttttcttcatggtggtttctattagttggagccttagagtgatcccaaatcatgctagtaagttggccagcttgcaaaaagagaaaccaaccattagagataaaaaggtatga

SEQ ID NO: 76319 - DNA, 297 bp, Glycine max
  Peptide Sequence Number=SeqID_193097
atgacaataatgatgataatttgtgtcaatgttgataccaatggtgatgatggtgacgacgacaatcttagtgtaggtgatggagtcaatgttaatagtgatggtggtaacaatattaatggtaatgacagtgataacaataatgataatagtgataataatgtcaacggtggtagcagtgttggtatcaatggtgatggtagtggtggtagtgacaagaatgctaccaatgatagtggtactaatattgatggtatggttattatggtggtggttgtagtagagggatattgttaa

SEQ ID NO: 76320 - DNA, 471 bp, Glycine max
  Peptide Sequence Number=SeqID_193098
atgatagcgcgagagtggttgcaagaacgagagcatgagtatgagaatgagatgatagtgagatcgagaacggtgtggccatgctgccgcaaagagtgtgtgagagtgagagtgagaaggagagcgcgagagatgagtgacaatgagaacgagaataattttaaggaaaaacaacaaccgaatttcgatgatgaattgcaagtttattctaaaaaagacaacgatttcatttggagaacaccaaaaagttgcattcaactcagtcgaacctttggtactagacatggcaagaaaacccgtacccgtgagtactcgcctgaatccgtcccgactttgacgggtaatacccaagttgaccgggtatgggtttgggttcgggttttccccgataaccaaaagtcgggtacgggtacgggtatgggattactagacccgtcccgaccccgaaaccgaacccgtcccgccacttaa

SEQ ID NO: 76321 - DNA, 150 bp, Glycine max
  Peptide Sequence Number=SeqID_193099
atggaagaagttttaaaatgtttgaaacttgaaatggctgtggtgcaagtattggagtcccatcaagcaagcaaagttgatgcatctggaactgcaaaggctgtaatttcttgcttcaacaaactgggggtgtcttacgatatggatcag

SEQ ID NO: 76322 - DNA, 489 bp, Glycine max
  Peptide Sequence Number=SeqID_193100
atgtctgccacatctgtcaactccgaacgagcacttgcccctcctgccattcccttgccccctccccctctctctaacttcaaaattggtctctatcaactctctgtcagccccgacaaagacaacaacatcgcccatgctcgcaccgccattcaggatgatgcatcaaagggcgcccaacttgttcttttgcctgaaatttggaacagtccttattccaatgatagttttcctgtctacgctgaggatattgacgccggtgcttctccttccactgccatgctatctgaactctctcgtatcttgaaaatcactattgttggttgttttattccagaaagttatggaggtctcttgtacaacacttgttgcgtctttggcaccgacgaaaacctactagccaaggaccgcaagaggtgtatggtggcgaaaggaaatgaaagttattatggttgtagccttgtaagattggataaagctctaaaatga

SEQ ID NO: 76323 - DNA, 351 bp, Glycine max
  Peptide Sequence Number=SeqID_193101
atgacttcatcatctgtcaatgtgattttgcattacaatggcgccatcataaaaactaaacacggttcaacatttgtaagcgattcaccaaaggtcattcaacttgacaacaaaatgtcacttcatgccttgaaacaagctattggaaacaagatttgtctaccaaatggtaaagtggtcaatgatatatattttcaattgcctgtatcatttgttggtaattatggtcagtatagggcatacatactgcacgatgatgcagacgtaatgactatgttttctatgttcaagcaagtctccaacctcacatgccttaagttatatattaccaccacaaacacacccacataa

SEQ ID NO: 76324 - DNA, 597 bp, Glycine max
  Peptide Sequence Number=SeqID_193102
atgctcaagtttacatcagtgcaacttgttgacgatgaagacatcaaagagcctacctcatcaacccaactaaatgagcttgagtttacaaccgaacctagcttatctaacaaagaacttagtccctttagtgaggatgaagacgaagttctacgcagtaaaccccaagaagatgatgaggaacaagttgtgcttgtttctccaataacaattgtaccaccatactacatacccccacacatgcataattttgaagaatctaattttgtagtttctgaatacaaccatagcttagatcacgaagaagtccaacatctagtggagactctttttgaagggatgcattttctaacaaaacaaggagtacaacatgctttgcaacagtatcatttttgcttggaggtgcagggtagcatacatccctgcaaaccatgtatcgatgggtttcaatattgcaagcccatagttcaggtcgatggaacacgattgtacgataagtacaaagggaccctccttgtggtagttgcacaagatgacaataataaaatccttcaaatagcctttactgttgtcgagggtgaaacaacggaagcatga

SEQ ID NO: 76325 - DNA, 635 bp, Glycine max
  Peptide Sequence Number=SeqID_193103
atcaagagaaggaacgtgagagagcaaggaatgctgctgagtttgagtttctctcaaacaacacgagcaacaacaacacagtggtaactgctgacgagcttttctttgaagggaagctcctacccttttggcagatgcagcatctagagaagctgagcaagatcaacctcaaaaccaaagaaggagaggaagaagaggaagaggaattagaagaggaggtagtagtggtgagcaacaacaacaaagaggataataataatagtaatagtagtagtagagtaaattggtttgtggacgatgacccttctccaaggccaccaaagtgcactgttctatggaaagagttgttgaggttgaagaagcaacgtgcttcttctttgtcaccctcttcttcttcctcatcttcttcctcttccgcaagctcacttggtgatgtggctgccaaagaagggtcaaggagtagtagtaacaaagaacatcagcagcacgtgaagagggtaaagaaagggttggagagaacaaggtcagctactattagaattagaccaatgattaacgtgccaatttgcacacaggtcaaaagcagtgccttgcctcctcttttcccaattaagaaaggaaaattagagaggtag

SEQ ID NO: 76326 - DNA, 117 bp, Glycine max
  Peptide Sequence Number=SeqID_193104
atgaaatcaaaagctataccatctcgagttaaagttcttcctccaagtggcagcacatcaaaaacttcaccagcattgattgaggggcccaaggaagaactagcagcaggggtcaaa

SEQ ID NO: 76327 - DNA, 2088 bp, Glycine max
  Peptide Sequence Number=SeqID_193105
atggagcttcagaggcgccaagatcagagcctctcccagcggaagggccagaagcggaagctcgacgaggagcagcaccacgaggaccgccagatctcgccggcccctcccaccgccgacgagcgcgccgccctcctctccgacgtcgccgaacaggtgagcatcctcgagtcgactttcacgtggaacgaagcggaccgatccgcggccaagcgcgccactcacgcgctcgccgatctcgcgaagaatggtaaaaaatcgatgcctcctccgatctcgccgcgtgtcgctgccttcgtttggattgcggtttcggatgtggtgaacttgattgttgaaggaggcgcgattccggctttggtgaagcatcttcaggcgccgcctctcagtgaccgtgtccagaatccgttgccgttcgagcacgaggttgagaaagggagcgctttcacactaggacttcttgccgtcaagccagaacatcagcagttcattgttgacagtggtgccttaacacatcttgttgatcttttgaagaggcacaggaatggcttaacttctcgtgctattaatagtctcattcgtagggccgcagatgctattactaatcttgctcatgagaacagcagcattaaaacccgtggtggaattccaccacttgttcatttgcttgattttgctgatgcaaaggtgcaacgagcagctgctggtgctctgcgaaccctggcttttaaaaatgatgaaaataaaaatcagattgttgaatgcaatgctcttccaactttgattctaatgctacgttctgaagatgctggtgttcattatgaagcggtcggtgtgattggtaatttagtccactcttcccctaatataaagaaagaagttcttctcgctggagctttacaaccggttattggattacttagttcctgctgctctgaaagccagagagaagcagcattgttacttggacaatttgcagcaactgattcagactgcaaggttcacattgtacagagaggtgctgtccaacctttgatagagatgcttcagtctcctgatgtacagctcagggaaatgtctgcttttgcattggggagattggcccaggacccacataaccaggctggtattgcacacaatggtggcttagtgccgctgctcaagcttcttgactcaaaaaatggctctttgcaacataatgctgcttttgctctttatggccttgcagataatgaggataatgcgtctgatttcataagggtaggtggagttcagagactgcaggatggagaatttattgttcaagcaactaaagattgtgttgccaaaacattgaaaagattagaggagaagattcatggccgtgtgctgaaccatttgttatatctcatgcgagtttcagaaaagggttgtcaaagacgagttgctttggctcttgcacatctttgctcttcagatgatcagagaataatttttattgatcactatggtcttgagttgcttattgggcttcttggctcatctagctctaagcagcaacttgatggtgctgtggctttatgcaagttggcggataaagcctcgaccttgtctcctgtggatgctgctcctccttctccaacaccacaggtctatttaggagagcagtacgtaaacaatgctacgttgtctgacgttacatttttggttgaaggcaaacgattttatgctcatagaatttgtcttcttgcatcatcagatgcatttcgtgcaatgtttgatggtggttacagggagaaggaggcaagggacatagagattccaaatattagatgggaggtttttgagttgatgatgagatttgtatattgtggatcagttgatgtcactctggatattgctcaagatcttcttcgagcagccgatcaatatcttttggaaggacttaagagactctgtgagtacacaattgcacaggatatatcgctagagaatgtgtcaagtatgtatgaacttacagaagccttcaacgcaatatcattgaggcatgcatgcatcctttttatcttggagcaatttgataaattgagttcaaggccagggtattaa

SEQ ID NO: 76328 - DNA, 833 bp, Glycine max
  Peptide Sequence Number=SeqID_193106
atggaggataactatagtgttcaagattttcaaaaagatgaaaagggagcaattgtgttgatgacggaggaaaagagagcaacagtggtggcagtttcagatggaagttctgtggagggcagtcttgagatatttgaaaataaggaggcgcagttagcaaaaaatgagctggaggaagcaattgccgaggaaaagtttaagatttgtaccacaaatgactggcttcggcctagtttcagaaaaataaatttgtttgggcctcttagattgagtagtaagaagtccagaggctttctcatcaactgcggggcccactccgcggcccaattccaaaaccgcacttggctccccgactctgccttcatctcttcgggcacccccctgaacgtgaccacccctgttctgttccccactcttcacacccttcgctccttccctcgccgagtcaataagcactgctacaatattcccgtgtatcgcggcgcacagtatttggtgcggaccacctacttctacggcggagtcaacggcgccgaccacccctcgccgccggtgttcgatcagatcctcgatgggaccctctggagcgtcgtcaataccacccgggattacgctgatggaaactcttctttctacgaaggggttttcttggctcaggggaagatcatgagcttgtgtattggctccaatacttacaccgattctgacccctttatctctgctctggagttcgtgattcttgagggttctctttacaattccacggatttcactagatatggccttgccttgattgcacgacacggttttggatattccggaccacccattcg

SEQ ID NO: 76329 - DNA, 3267 bp, Glycine max
  Peptide Sequence Number=SeqID_193107
atgtctattcatataaccatatccattaatcgggagtggtctctaagctggagttctgacaattttactgaagaactgtggtactgtgttgatccagaattgccttcaagcaggggagaggacctgcagacaaagtgcttgcttgaactttatggactaaagctggcagagttgcagatgaaggttcggtctgatgtgagttctgaatactggctcaatgctaagtgtgcatatcctgacaggcaattgtttgattggggcatgatgaggttgcgccgtccattgtatggtgttggagatccatttgccatggatgctgatgatcaattaaagaagaaacgggaggctgagagactgtcaagattagaagaaaaggagaaaaatcatatagagactagaacaagaaaattctttgcagaaatactcaatactgtccgtgagttccaattacaaattcaagcttctgtgaagaggagaaaacaaaggaatgatggtgtccagagaattgtacttggagtgtgggaagtgtcagagaaatacaaacttataataactccagaagctccaggggcttccacgctaagcgtggttcttcaaattagtataggcttccagccaagtttaaagcacttgtcttctcatgattggacgctgaagcagtatcgtccaatgattgatactttggctatcattcagagtctttctgtgtatgcttttctgcttgcatggcatggaaggcaaaggcaacgggcaactcgggcagagaaattgagattccaagcattgaaggctgatgatcaagaagcctacatgagaatggtgaaagagagtaagaatgagagattaactttgcttcttgaagaaacaaataaactactagtaaatttaggagcagctgttcaacgtcaaaaggacaacaaatattcaaatggcattgaagccttggaagattccgaagctgatttactggagtcagatgctttaaagaatggagtttctaaggaatcacctcttgatgaagatatagatatgatagattctgatcataatggtgattctagtgatttacttgaaggtcagcggcaatacaactctgccatacattctattcaagaaaaggtaactgagcaaccgtctatgcttcaaggtggagaattaagaccataccagatagaggggctccaatggatgctttctttgtttaataacaacttaaatggaattttggctgatgaaatgggactcgggaagacaatacaaacaatttcgctgatagcacatcttatggaacacaagggtgttactggtcctcacttgattgttgctccaaaggctgttctaccaaattgggtcaatgaattcacaacatgggctcctagcatcacagctattctttatgatggacggctggatgagaggaaagcaatgaaggaagagttgtcaggggaggggaaatttaatgttctattaacgcactatgatcttataatgagagataaagcatttctcaagaaaattcaatggaaatacttgattgtggatgaagggcatcggttgaaaaatcacgagtctgctctggcaagaaccttggacaatggatatcgcatccaacgaagacttctgttgactggtaccccaattcagaacagtttgcaggagttgtggtctttgcttaattttctccttccaaacatttttaactcagttcaaaattttgaggactggtttaacgccccctttgcagaccgagttgatgtctctctcacagatgaggaacaactattgatcatccggcgtctgcatcaagtaataaggcccttcatattaagaaggaaaaaagatgaggtggaaaaattccttcctgggaaatctcaggtcatactcaaatgtgatatgtcagcctggcagaaagtatattatcaacaagtaactgatgtaggcagagttggcttggacaatggttctggaaaatcaaaaagtctgcaaaacttaacaatgcaactcagaaagtgttgtaaccatccctatctctttgtgggagattatgatatgtatagacgtaaggaggagattgtcagagcatcaggtaagtttgaacttctagaccgtttgctcccaaaacttcgcagagctggtcacagagtcctccttttctcacaaatgactcgacttatggacactcttgaagtctatttgcgacttcatgattttaagtatcttagacttgatggctcaacaaaaactgaggaaagaggcaatcttctacgaaaatttaatgctcctgactccccgtacttcatgtttcttttgagcacccgtgctggaggtcttggtttgaatttacaaacagcagatactgttataatctttgatagtgattggaaccctcaaatggatcaacaagctgaggaccgagcccatcgcattggacaaaaaaaggaggtcagggtttttgtgttggttagtgtaggatcaattgaagaggtgattttagagcgtgcaaaacaaaagatgggcattgatgccaaagtcatccaggcaggacttttcaacactacttcaacagcccaggacagaagagaaatgttagaagagattatgcgtagaggtacaagctcacttgggacagatgtgcctagtgagagagaaattaaccgccttgctgctcgatcagatgaggaattttggctgtttgagaaaatggatgaagagagaagacaaaaggaaaattacagatctcgtctcatggaagagcatgaattgccagattgggtgtattctccaatgaacaaggatgataaggccaaagatttcaacagtggtgttactggaaagcggaaaagaaaagaagtggtatatgcagatacattaagtgatctgcaatggatgaaggctgtggagaatggggaagacatatcaaagttttcaggtaaaggaaaaaggagagaccaccgctcatctgacagcgttgcacaagccagtgataatacaggagcagaagaaagtttagagttgaggactgaaagtgttcccatggaaaatgagcgaactagtgaagatagtttccatgtgacccctcccgcaaagagattcaagcctgaaggaacaaatttcctgaaacatacatacgaggatgttggaagtggtttgaatcgccatttgttatcatggaatactcacaaaaagaaaaggtcaagttttcttggccaaggttcattatctgatactagagggcattcttcaaatggaagagcaaactggaactga

SEQ ID NO: 76330 - DNA, 279 bp, Glycine max
  Peptide Sequence Number=SeqID_193108
atggagaatgagcgccacgccaagacgctcatctgtgccctcaaccttctctcgcgagacctacctctccctcctcacatcctcaattccgtctcttccatctaccgcaacaatcatggcgatggagggaattctggagaagatttgatgacagatcttgaagatgcactgtccaagcagcgcccgaattgtgtgcctggtttcaaattggagcaatcaagggataatcggtatcggagtctgattcagcatcggttaaatgagcttcaaggtcaatga

SEQ ID NO: 76331 - DNA, 474 bp, Glycine max
  Peptide Sequence Number=SeqID_193109
atgtgcctcgctctccagccgtctgctgtcatgcttgcactctgcaccacgcttgcaaacttgttggttgtgcaacgtgaccgcgaagaaggatccagcatccaagaaaacccatctcttccttcttcagttttcttcagcttggtgtttgtgcaacgtgactgcgaagaagcatccaacaggcaagttaaagcagttttcactgctccgtggttttgcaacgtcacccgcgaggaagtatccagcatactaacattgactcatatttctgcacagcagcaaaggtttgtaactttcaatcttcatgggtacttgagattcaacatttttacccctaaagcactggcaataaatgacgcgacggtaaagtttgagacttgggacacaacaggacaagagaggtaccatagcttggctcccatgtattacagaggtgttgctgctgctatcattgtctatgacatcactagctcg

SEQ ID NO: 76332 - DNA, 234 bp, Glycine max
  Peptide Sequence Number=SeqID_193110
atgcataaataccccaagtgtgggatatcatggtacaaagtgaaggatgatgatgagtgcaatagtgatgaactcacaatgaaaggccccccagcgaagtggaagatgattaaccgtttgtatttggatttcgagaaagaggcaagaaatcttaggcttggacttgccactgatggaataaatccttatggtagtttaagcactcagtgtaacatcccaatttttcgtaaataa

SEQ ID NO: 76333 - DNA, 708 bp, Glycine max
  Peptide Sequence Number=SeqID_193111
atggcgaagaagaacaagaagcaggcaacagagggcgaggtggaaccggaactcaacaccaacaatgacgacagcgatgattctcacaataagaagaaacttaagaaaaagaataagaagatgaaaatacccacagttagcatagccgtgcctggttccatcattgacaacgttccaactctcgagctcgctacccggttggctggtcaaatcgctcgtgccgcaaccattttccgaatcaacgaggtggttgtgttcgacaataaaagtaacccagataatgattccgtgctggataattcgaatgatgaaagtggtgcctcttttctgatgcaaatcctgcagtatcttgagacacctcagtatttgaggaaggctctttttccaatgcataacagcctacgatttgtgggcctgttgccaccccttgatgctccacaccatttgcgcaaacatgaatggggtccttatcgagaagattacatattaaaccatgaatcactaataagcaaaaataagtgcagtagagacaagaatgctgaggttttgatatattgcaataacttcataggtgtcactgtaaaagaaagacacttgaactctggggcaacgctagttgatgttgggttagtgaagattaaatcactttggccagtttctgtccttttaatatggctattaagtaggcttcagtttatttgtgtatga

SEQ ID NO: 76334 - DNA, 378 bp, Glycine max
  Peptide Sequence Number=SeqID_193112
atgatgagtttttcaaaaggatactcgctcgctcgctggacactgtatcctaacggttatcttcttttgacttttgttttcagtggccacatcacatggtgtaaggtcatgattcaggctgctgaatcagaagatgataagagtacagaagctgagaggaaggcgcagaggaccatctctggagcactctatactatttggaaaagagaaggtatattgggatttttcaaaggattgcaggcacatatattgaaaactgttctcagctctgcattacttctgatggtgaaggagaagattgcaaagtccacatggattctaatcctcgtgattggaagatacctgtctgtgaattcccccaaattgaaggcagtttga

SEQ ID NO: 76335 - DNA, 837 bp, Glycine max
  Peptide Sequence Number=SeqID_193113
atggcaacctatggaatgaactctagaaacttcttggattctgtccagggatcaacttgcacgggcttaaaggatgtttgtcagatagatagcatacggttctcaactgtatatcataaagcggattcctaccagagagcaagcaacaatgatgatgacatgtgtcagatggatgaagatgattttttcattgattcatcagtaaaatctaaatctctattggcttctgatgatataaagagtttcaatcctatgtgcaaacctttggatggccggcctttcaattttgatgaaacccaatatttggagaaaagaagaccaaacttgccattttcaagtgagcctctaggaactgaagatgatgatgaagttactgagtctaaaattagagccttcctggatgataaggcccttgaactgaagaagctccaaacacctctttatgaagaattccgtaacatatcaaatgcagccattgctccagctcccattgaagttgcaaagattaaagttatgtcggatgtctcaaatgtaacatcatcaataggcaggtctgctagtcaggcttggagacgattctctatggttggcagtgctaatgttgcaagccccgggagtcatacgaaataccgatcaaatcttagtggtgctcactgtcgacctttgcaggaaattcagccatctgagcttaatgaatcagaggagactcttcatgatgctgagctggaatcatctaatgtaagttcaagcttctctgagaggcaaaggaaatggaaggaagaattggttgaagagcttgactggaagcgaggcaagttttctcttccacaattataa

SEQ ID NO: 76336 - DNA, 816 bp, Glycine max
  Peptide Sequence Number=SeqID_193114
atggattttgtggatagagttattgcaatccgtaaaccattggatctaaatatttttgcattggtttgtgaagtatttactgatgcttcccgcttcaattcgtgggcctttataatggcagacattttgctcaaccttccatcttccattcacttttcgaatttgaagttgttgactcttcagtatgttgtttttcctggctatgagtccactcaacaactattttctggcttgcctgtcctggaggagctaactttggatagctgctgctggttgaattttgaaattgttaccatagctcttcccatgcttaagaaattggatatcaaagaaaatttagcagaccatgataattgtcagttctttattattgcagagaacctcaactccttttattacattgatacactcaaaaatgactattggatatataacaccgtatcccttgattggggattaatgggcttgtgcagcactgatgacattggagagagtagcagactaagagaagttgctcaaagagctggtaggcttagagggatctcttgtgcgaaagaactattgctaactccttatgcgtttgagggcatctgtttgtctgggaatcatgaaggaggaagttggatactggatcctgtaccttcttcttgtttctcaagacatctcaagttcattaggatgtcaattctgtggaacagatggggaactgcaaggaaagggatgttcttgaacaattgcgaatgcttcctagagcctccacttactgcacaatcaatatttcttgaattattgtatgggggtccttctgggaaatga

SEQ ID NO: 76337 - DNA, 315 bp, Glycine max
  Peptide Sequence Number=SeqID_193115
atggtattagagcatatgaaggagaaaataggttatcgatggatactcgggactaagtttaaggcagatggaagtattgataggcataaggcctatttagtagctaaaggctacacacagcaagcaggtattggactttttggaaatcttctcaccagtggccaaaatgctaagggggagaacctagcttgcaagctcaaccaatttgtttatggtctccaacaagcgtcgaaacaatggttcccaaagctctcctgtgccatcatcagctcaggtttcattcaatctagtgcagctcagttattggtgtcttga

SEQ ID NO: 76338 - DNA, 357 bp, Glycine max
  Peptide Sequence Number=SeqID_193116
atggcaaccctccattctcaccctttttcggagccccatgaacgttattgcctagggctgttcatgtgtcctccactttcgtgtttggagctgtgtttcacgattgccgaagtgcggaccctcaaggcaatgctccattctcacccttttccggagccccatgaatgttattgcctagcgctgttcatgtgtcctccacattcgagtttggagctgtgtttcatgattgactatgtgcggaccctcaaggcaatcctccattctcaccctttttcggagccccatgaacgttattgcctagggctgttgatgtgtcctccaccttcgagtttggagctgtgtttcatgattgcctaa

SEQ ID NO: 76339 - DNA, 272 bp, Glycine max
  Peptide Sequence Number=SeqID_193117
atgagtgaatatgcagttgctagctggttatttgagagagactatcctcatccggctgttgatttaggagtagccaaagcattaggtagacatgtggaggttagtgaacggcaacgaaaacgaaaacaatttccagcttctatcacacacagctttatcaatggacagcagcatcaaagtccaagagctttaattgaggcatatggtagtgacaaaagccaacaaacttcaagcagcaagtctttgttagttgaaccactggataataaatg

SEQ ID NO: 76340 - DNA, 248 bp, Glycine max
  Peptide Sequence Number=SeqID_193118
aagactcagatgaggatgagttcgccttcatctctcgcaaaatccgcatgatgtggagaaacaaaaatgggtctaagtggagaagctcttcaagaagaatgtcatggggcaagaaggacaaaaacaaaagctctatagtctactatgagtgcaaaaagcttggacacttcaagttggaatgtccagatctggagaaaagtcaagataagaagaaattctttaagactaatgaaaaaaagggctcataa

SEQ ID NO: 76341 - DNA, 1578 bp, Glycine max
  Peptide Sequence Number=SeqID_193119
atgtatatttgctttgggttgagtgtagttgcattggaccaaatagaaagcacaagatcaaccatatttggctcagctagtaacatccattccaatggtgaaaagcaatccgaaaatgttgctcatataccttctgttggaaacaaccaaactcccaaggttgctttacttcacaaattaaaatattctttcccttttcatggagaaatatggctgaaaaactacctttatgttgcacttttatttttgattcctgaaacttctttcaattcccaccaggtgaggaaaccatataccattactaaacaaagggagaagtggactgaggaagagcatcaaaagttccttgaagctttgaaattgtatggtcgtggctggcgccaaattgaagagcatataggtaccaaaaatgctgttcagattcgaagccatgctcaaaagtttttctctaaggttgtgagggaatctgagggcagcgctgagagttctatacaaccaattaacatacctcctcctcggcctaagaggaaacccctgcatccatatccccgtaaatcagttaactctttcaaaggacactgcataccaaatgaaacagaaatatctccatctacaaacctgttagttgcagagaaagacaccccatctccaacctcggtgctatctacggttggttcggaagcatttgggtctcaattttcagagcagactaacagatgcctttcaccaaactcttgcaccactgatattcactcagtcagcttatcacctgctgaaaaggaaaatgattgcatgacatccaaagcatccgaggaggaagagaaagcatcaccagcttcacttcctttatccactgtttctaacccaaacatgtgcatgaagcctgagtttagttccaaggacactttcatagaagatgctgccaatatgccacaaaccactagtattaagctttttggaagaacggtctctatggtaggtaatcagaagtcactgaacatagatgatgatgatggtaagccaataactgtgaagtctgatgaagtagatgatgttgagaatgagaagcttggccaatcaggagaatccaagcaagtagatacacaattatcacttggtgtggttagtggtaactggattataacacctgatgctgatggagctaatacaaccagcatagagcccccaaaggagaacctatgcttcagtgaatgtgcacctgatgcatcttttccgcagtggagtttgtaccaaggccttccacctttctacctgaggccatgcaatcaggtcctaaatcccttgcctcttaggccctctttgaaagtaagaacaagagaggaggagagttgttgcactggttccaacactgaatcagtttgtgacatggaaaaccaaggcaagaactcagatgctgttgattctaagtgtcaaaaatatcacaaggaaggagctgcaccccagaagcgtgcaagggggtttgtaccatataaaagatgtttatctgaaagagatggaaattctttaattgttgatatggaagagagggaggggcaacgagctcgtgtgtgctcatag

SEQ ID NO: 76342 - DNA, 546 bp, Glycine max
  Peptide Sequence Number=SeqID_193120
atggctaacaacgtcgttgttgttcttaaggtagctcctgtttctctgcctccatttcccataacaaacaatgctctcactttcaagagccaaagacacacacttcatctgaattgcttccaaaccaaaaacagaacaacctcattcccttcttcctcgtcaatcctcagaaacaaagctagttgctctgtgttggcgtgtctccctcctgaatcctcaacctcatcttccactgctaaaccctcttttccttctcctcaaactaagctttatgtcagtgggctatcatttcgtaccactgaagagagtttgcgaaatgcatttaagaattttggtcaacttgtggaagtcaagctggtgatggatagaattgctaatagaccaagagggtttgcttttcttcgttatgcaactgaagaagagtcgcagaaggctattgagggaatgcatggaaagatgcataaatggaagtttatcttatccaggagagtaatttggagagttcgagttttttgcaacttcctttggtttgctaactttaagtaa

SEQ ID NO: 76343 - DNA, 714 bp, Glycine max
  Peptide Sequence Number=SeqID_193121
atgtcaccggttggattaccacctggctttaggttccatccaaccgatgaagagcttgtcaactattatctcaagaggaagatcaatggccaagaaattgaacttgatatcattcctgaagttgatctctacaaatgtgaaccatgggaattagcagagaaatcatttttgccaagtagagacccagagtggtattttttcggcccccgggataggaaatacccgaatgggtataggacaaatagagcaactcgggcaggttactggaagtccactgggaaagacagaagagtttcatgccaaagcagacctattggcatgaagaagactttggtgtactatagaggtagagctcctcaagggatcagaactgactgggtaatgcatgagtatcgccttgatgacaaagagtgtgaggacaccactggattacaggatacttatgcattgtgccgtgtgttcaagaaaaatggaatctgttctgatattgaagagcaaggacaatgtagtatatcactaattgagagctcccaaaccattactaatgagtgtgaaaccatgtctcctgacataccaggggcatcatcatcatgcttggaagaggaggacaaagatgattcttggatgcagttcattacagaagatgcatggtattcttctaatgcagctatggttggtggtgaagaagtatcacatgttacatttacaaactaa

SEQ ID NO: 76344 - DNA, 135 bp, Glycine max
  Peptide Sequence Number=SeqID_193122
atggctgtgaatcaagatggcacccacacacgcactctttgtgttggtaccatttatctctttatcaagatggcacctaatggtgctaattctacttctaaaaggtggactggtgataagactcatttattatga

SEQ ID NO: 76345 - DNA, 291 bp, Glycine max
  Peptide Sequence Number=SeqID_193123
tgtcttggcaaagttgttgtgcacaaggttggacagtgatgaactatctgcatgctgcaagggcttgctggaagaggaaaaggatttggttggcaaggtggaatgcattacggtggagagggatgagcttgccaaggtggttactcatttaaaggctcgactgaaagagtcagagtataggctagaggagtctgagctgcgagtggctaaggagaggccttggatcttcttcatcaatggagtcttttgcttcttgaagatcaatgacagtggaatagagaagaaggaaag

SEQ ID NO: 76346 - DNA, 1944 bp, Glycine max
  Peptide Sequence Number=SeqID_193124
tctcaacaagagagatacgaaaacaaccttctgagggttgagaatgacaagcttcgagcagagaacagtaggtacaggaatgcactatcgaatacttcatgccctaactgtggagcccctactactcttggagaaatgtcctttgacgagcagcagttgaggatggagaatgcgcgacaaaaagaggagattgatagcatgtcaggacttgcagccaagtatgcagctggaaaatctgcgagcaattcgtactataacatgccatctaatcaaaaccagatgccttcgcgctcgcttgacctgggagttgttaacaacaacagcagcatcaacaacaacaacagcagcatcaacaacagcaacaacaagaacaacaacaacaacaactatattgtacaagcgcaacctgtagccatggttggggaaatgtatggtggaaatgaccctcttagggaactcccacttctttctagttttgacaaagatttaatttcggagattggtctcgtggcagtagaggaaatcaatcagttgactctgtctgcagatcctttgtgggtcccaggcaattacggaagtgaagttataaatgaagatgaatacctgaggcatttccctaggggaataggtccaacactcttgggcgcaagaaccgaatcatctcggcaaaccgctatagtaatgatgcatcatatgaaactcgttgagatgcttatggatgtgaatcaatggtcaaatatgttttgcggcatcgtttcaagggcagtgacacacgaagtgctgtcaattggagaccatgcaagatacgatggagcctaccaagtgatgtcagctgagtttcaggttccttcaccccttgttcctactcgcgacaactatttcatcaggttcagtaagaagcacgcaggacaatcatgggcggtggttgatatttcaatggatcatctgcgacctggtgcagtcacaagaacccgaagacgaccctctggttgcataattcaagaattgccaaatggttactcaaaggtcatatgggttgaacatgtcgaagttgacgacatcgaggtgcataatctttacaaaaatttggttaactctacccttgcgtttggagctaaacgttggattgcagcaatagaaagaacatgcgaacatcttgctagggcaatggccaccaacataccccaaggggcactttgtgtgataacaagtcacgagggtcggaaaagtatgatgaagctggccgaaagaatggtattgagcttttctactggtgtgggtgcttccactgcaaacgcttggacaccactaccacttgatcttgaaaatgttagggtcatgaccagaaagagcgtggatgatccaggcagaccttccggtatagtgctcagtgctgcaacttctctctggctcccagttcctgcaaggagagtttttgactttctcagatccgaaaacactagaaatcagtgggatattctgtcgagcggggctcaagtgaacgagcttgcacatattgctaaagggagagaccatggaaattctgtctctcttcttcgagtgaatactcagaatgtggcccagaacaatatgctgatacttcaagagagttgcattgatgctacaggctcatttgtggtttatgctcctattgatttagcttccatgaatcttgtgttgggtggtggtaatccggattacgtggccctgctcccttcgggctttgctgttcttcctgatgggcctgcattgaacgtagtgcccgggcccgtatgtgaggttgttggatctggacgaggttgtcttcttacggttgcatttcagatactggtggattctacaccaacggcaaaactctctgttggttcagtgacaaccgttaacaatttgataaagagaaccgtggaaaggatcaaagattcagtcacgcttgacggcgcctaa

SEQ ID NO: 76347 - DNA, 390 bp, Glycine max
  Peptide Sequence Number=SeqID_193125
atgtataacaaaagtcagaacacaaaattcgattctcaacaacaacagcagcagcaacaaccgcagcagcaacaaccgcagaatttgatggagatgtcaacacagaggacatcctcggaaggaaggaaccgagacgatcaggaacctgctgcgggaaacgaagtcaccatggaagctcctccttcgggtgacgaggaccaagatcccgatgaggggttcaaaaggaggcgccacacccgccacacactgcaccaaatttcagagatggaagctttcttcaaggagtgccctcaccctgatgagaagcaaaggaaagcgcttggccgcgagctcgggttggtgcctttgcaaatcaagttttggtttcaaaacaagcgcactcaagtgaag

SEQ ID NO: 76348 - DNA, 393 bp, Glycine max
  Peptide Sequence Number=SeqID_193126
atgtatgaacaggaaacatataacataggacctaagaatcaaaacctaaaactacactttgatagtatgttcaatccctttcagtatggtggattagctacatcaaccatttatgaacataatttttttttaaatgattgcattgctccaactccaagtattacccatttaccaaataagtccaagagtccaaccgttgtctatctggtggagctaggtgaaactagtctttattttggcatgaaggctatggagaaggctgttatgctcaatcgtaggaaggtgaaaaagaggctaagtcatgaagtgccaaaagtgacaattgagtttagcttagcagttgggctaagcgcgcaaccaccgctaagcgcagcttcaacgcgcttagcgtga

SEQ ID NO: 76349 - DNA, 405 bp, Glycine max
  Peptide Sequence Number=SeqID_193127
atgtcttgcctagcgatcataactccgatctccctctggctaagtgctagttggtgtatgccaccctccaggcaccctctggacccgaataagtctaacagggccctggggttttcggcattgatcatgggtctctgccagtcattcagggttcccgtcacccacagtaaagtgatccgaccgccgatcactcgggccttcatcgagaagtatctcacgcctaggcaggcgcagggttatgcacatcaggccgcagacgcaccgccaccaccttggcaggccgatcccactggatcactaggcatagagcgttatctacagcacttggttcgccagcaggtggccaaccaccgtgggcaggtgcagatacatgagtgtctctaccggttcagcctcagtcagtag

SEQ ID NO: 76350 - DNA, 1057 bp, Glycine max
  Peptide Sequence Number=SeqID_193128
gtcgactctagaggatcccaccacactcagaaggctacacgccctcaccttcagaggactacacgccctcaccttgaggaatacacgtccacaccttcagagagctgcacgctctcaccttcagagggcttcacgccctcgccttcagaggactacatgtcctcgccttcagaggactgcacatcatccccttcagaggactacacgtcctcgccatcagaggactacagggctgcacaccctcactatcagagggcttcacgccctcgccatcagaagactacacgtcctcgccttcatgggactacacgtccttgccttcatagaattgcacgtcctccccttcagagcgatacacgcccccgccttcagaggactacacgtcctcacctttaaagggctgcacgccctcgcattgaaagggctgcaagtccttgcttttagaggactacacgtcctcgccatcagaggactacacgtcctcgccatcaaagggctgcacgcactcaccttcagaggactactcttcctcgccttgaggactacacgtcctcaccttgagagggctacacgccctcaccatcaaaggacaacacgtcctcgccttcagagggctacacgctctcgccttcagaggactacacatcctcactttcagacgactacacgtcctctccttcaaatgattacacgtcgtcgccttcaaagggctacacgtccttaccttcagaggactacacgtccgcgccttcagaggacttcacgtcctcgccttctgaggactacacgtcctcgccttcaatgtactatgcgtcctcatcttcagaggactacacgtcctcgccttcagagggctacacgctctcgccttcagaggactacacatcctcgccttcagacaactacacgactacacgtcctcaccttcacagggctacacaccctcaccatcagaggactacacgtcctcgcctttagagaactacacgtcctcgcctttagagggctacacagaggactagacatcctcgcctttagaggactagacgtcctcgcc

SEQ ID NO: 76351 - DNA, 480 bp, Glycine max
  Peptide Sequence Number=SeqID_193129
atgtggctaccaccaaagcgttggaacgagaaaccaagagggcttgtagggaagaacacggccggaacaaattctgaggggctctgtggggtagcaacagcgagcttaaactccgaagagaggaaagggaccaatcacaagcttgctcgaggtccaaacgaagtttctctcagcgggttatgcgagacagagaccaacatgttagctattatcaccaagtaccaagaagaactaaatctagccgtggcccacgagcatagagtggcggacgagtacgcccaagtgtacgcggaaaaggaggctagaggaagggtgaccgactcgttacatcaagaggcaacgatatggatggaccgatttgctcttaacttgaacgggagtcaagaacttccccgattgctagccaaggccaaagcaatggcggacacctactccgcccccgaggaatccatagacttctcagctattgtcagcatatga

SEQ ID NO: 76352 - DNA, 1287 bp, Glycine max
  Peptide Sequence Number=SeqID_193130
atgcggcatcgagtttttaatactatgcgcttttcttcagaatatcctttggcgggaactgcactttggagattgggaagcgaggacagcagaatctggaatttttatgataaagatctcacttttgccggcctgcctaagctagatcttaaaaaactggagaatgtaaaaggccagaccatggtagattatatcggagatggtgaagtattggatgtcctgaatacaccccatgacggaaaaatagctctggaaacagatcctaaagaaaaaattattacggatgagaactatatcacgtatccaagttcttatgaagtgaaaaaatatggttgggcaccacagaaagaactggtactgacatttgatgatggtccggatgaaacgtatactcctcaggtccttgatatcttatcaaaatatcacgttccggctgcattctttttaatcggcctgaatgctgagaaaaatcttcctctggtaaaaagaatctacagagagggacatgaaataggaaaccatactttcactcatgaaaatgtggccaaagtaagtccggagagggctttattagagatgaaactgacgaggctcttatttgaatgcataaccggtcatagcacgatcctgttcagagcaccttataatgcagattccgagcctacaacctctgaagagattattcccgttgccttggccagacagcagaattatctcgatatcggtgaaagtatagatcccgaagactggcaacctggtattaaagcagatgagatcgtaaaacgtgtaatgcagggtatcaagcaggagagaggaaatattattctactgcatgatgctggaggagacacaagagaagagacgatcaaagctctgaaaattttaattcctactttgcagaagcaaggttatcattttacgaatctggcaagcattttacataaaagtaaaaatgagctgatgcctgcggttccaaaaaccaaatcgtactatattatgcagctgaatcttgtattagcgactgtgatttatgggattagtcattttttggtggccttatttaccatcttcattattttaggaattatccgtttgttatttatggtgtactgggcagttaaagaaaaaagcaaagagaaaaagctttcaaattttcccgtattggatagctatcctaaaatgacggaagtaaagatctcacttatacaaaggccagggaagaatttgctgaacatcctaaactcaagattttcacgaaagctaacggaggaaaagcaaccgctttaa

SEQ ID NO: 76353 - DNA, 297 bp, Glycine max
  Peptide Sequence Number=SeqID_193131
atggtaatgatggtggttgcagtagtgacaatggtgacaacaatggcaatggtggttacggcgacaataatgacagtgagtgatgacaacaaagctggtggtggttgttatgacgacaatggtgacgacgatgatagtggttgttatggtagtgatggttgttatggtgacaatggtagagtggtggtggtaatagtgatgacaagggcaaaggtaacggtagttgctgcagcggtaatggcggtgagtggtggcaacaacaacgatggtggtggtggttgtgatagttacatggaa

SEQ ID NO: 76354 - DNA, 345 bp, Glycine max
  Peptide Sequence Number=SeqID_193132
atggggacaaatcaaaacggcaaaaggttttatcaagtcaaggttaaaagtctagatgtcactagcctcaaggaattgggacgattgatgggacctctccaaaggcaagccttccgcaaagtgtacgggaagattctagatttggccgcagcggaggtatttacggaagttgtcgtatccctcgcccaatactatgaccagccgttgaggtgtttcacgtttggggacttccaaatggtaccaactattgaagagtttgaggaaatattaggatgccctcttggggggagaaaaccgtatcttttctccggctttcttccttccttgagcaagattgcagctgtg

SEQ ID NO: 76355 - DNA, 282 bp, Glycine max
  Peptide Sequence Number=SeqID_193133
atggatcacgcaatcatcccctttttgggcttctgggatgttatggaactttacggattgcgcactaacacttcctttcgacttccggcatgtcacggaacttcacgggttgtgcaaaaatgctttcttctgacttccggcatgtcacggaacttcacgaattgcctaacaatgggtgccaagtacctcaaagtagtcaaacgagggtcgcatcctaacaacggatggtccccggatgaatttagggtgacacacgtcaacagatgtgacttttcattttga

SEQ ID NO: 76356 - DNA, 225 bp, Glycine max
  Peptide Sequence Number=SeqID_193134
atggaagtcacgaatcggtcggtgttccccatatgggatccaacaaacatctggaatccagagtcagtccaagcgctccctgtacgccgatgtacgcacgcggtgaatcctcgtcgtagtcctgatcagtattggactctgcgactgagggaaagtgctcatatatccagcactacagagcagtgtgatgtaaccgtcaagctgtcggctgcggggatcctctag

SEQ ID NO: 76357 - DNA, 564 bp, Glycine max
  Peptide Sequence Number=SeqID_193135
atgatttcatgctattccggtctccagcggtcggggccctttgctgtgtattaccgaccagagagggtcatgcgacagtttggatacacccagaccattcctgctccgcctgtcgattcatgggtgtcgtatgatgatatacacgataggtggatgcactattcagatcatatgtttccagcaggtgcggtgtgcgctgtgacaggtcagtgtgccagcgactacatagactggttcttccgcatttcccatcctttcatgaaaccatgccaggcatcagttcctctgccagatggtcatgctccgcagccccgagtcgtccctcaggccccagagacagatatccctcacgtgtcggagctaggagcactattgacatctgcgaggcccgctgtggaagagcctagacatgcagaagtttgctatgggattgctgagaggttggagctccatctgagcctaggggtggtcacgccaagctcatcgatacatgaggtgattgaagaatgtctcaagatggccaggagtgtcacacaggaccagctagtatatgttaggtcttga

SEQ ID NO: 76358 - DNA, 305 bp, Glycine max
  Peptide Sequence Number=SeqID_193136
ctttattcaaggttgcactagaacgatcaccaccaatctgtgcttcttcctcgtctatcagtgtagtttacaaaagcaaaggtgaaacgaaagatattgagctggtagaggaggaacagacatggattggtgttgatccttctagtgagacctccaataaatctgagaattataaggaggaagcactgaagaaaacacaaaagcataaaccaaagagggtggagagtgtcaacgctgatgcagaagcctttgctgatgactggaaaattctaattgctctatgcattgtgaagctgaagcagtag

SEQ ID NO: 76359 - DNA, 366 bp, Glycine max
  Peptide Sequence Number=SeqID_193137
atgaaagctttggtaattggcgctacaggtgctaccggtaaagatttagtcaatcaattacttaacgataaggaattcgatgaagttgatgtatttgtcagaaaacctcttgatatcaggagtgataaattaaacgttcacatcgtaaactttgatgcaccggaagaatggaaagaagcagtaaaaggtgatgttgctttttcgtgcctgggaaccactttgaaaacagctggaagtaaagaagcccaaagaaaagtagatttcgactatcagtatgaatttgcaaaagctgcgaaggaaaataatgtggatgactacattcttgtttctgcatacggggcaaatcctaaatcaaaaattttctaa

SEQ ID NO: 76360 - DNA, 456 bp, Glycine max
  Peptide Sequence Number=SeqID_193138
atggtgttcgggaagcaccaattgaaggtggagctagctgtaaactgcttccactgccacactagcgatagcaacaatgcgggatcgatcgtcgaatgtgccttcgggatacggcgtcaactcgaccagtccagtctatccgttgttcccaaagtcagaccaccatcagccattgcattctggaacgtccgtacacccctggctatagcacgtactcgatcgggaaccaatgagctagatgcccaaccgctactacttcttatgcctgaccacttcctatccacccacgagctgaaggcaatagggacgctctctactcccagctactactgtatctactctgcttacctcctcctaccctgtcctccatccatggccatcatgatgcccctactactctactataacaaggtgaggacctcaagcctctactatatagacaacacgctaagatga

SEQ ID NO: 76361 - DNA, 586 bp, Glycine max
  Peptide Sequence Number=SeqID_193139
tccgagctatgaagtacccacctctggttcagctcctaccaatggtagtaaaacctacttgtttcaaccggttcaagcggtacattcagtagtgaaccctcatgttctagtgacagtagtagaaggtagaagctggggtcaggtcatagtagtagtcacgctccctacggctggttcggtccctcaccacgaccctactcaacagcagctaggttggatgcaactagctgttatggatagtagtatcaaggcgagttcagctaggattcaagtagtgcaagtagtgcatcaacacgcgggcatcatgatggccatggatggaggacagggtaggaggagcgtccctattgccttcagctcgtgggtggataggaagtggtcaggcataagaagtagtagcggttgggcatctagctcattggttcccgatcgagtacgtgctatagccaggggtgtacggacgttccagaatgcaatggctgatggtggtctgactttgggaacaacggatagactggactgtggaagcagtttacagctagctccaccttcaactactggcatgtccgataaccacgactgctag

SEQ ID NO: 76362 - DNA, 1213 bp, Glycine max
  Peptide Sequence Number=SeqID_193140
atggcgggagcgttttttcaccaccgggatgcgacgcgcagcggtgagttcaccaccgaacgcggcggctgggcaacggcgcgccgtgattcggccggactggcaccggatccgcagcgcttcgccagtgaggcgattgtgcaggtgtatgctgcgccgacctacggctggaaaggtgcggtggccgtgcatccgtggattatctttaagcgcgccggagaaacccgctacaaccgttatgaggtgatcagctggggcagcggcgataaagtgcggcgcaacagcaatctgccggacggctactggtacggtgcgcgtccgcgtttgctggtgtcacatcgcggtgcggctgcgcaggcgatgatcccgcagattgaagcggcgattcaatcctatccgtggcccaacacctatcatgcgtggccgggccccaacagcaacaccttcctcgctcacattggccgtgaagtgccggcgctgaagctcgatttgcccgccaatgccatcggcaaggattttcctgtcgctgctcggcgtgctgggcgtcacgctgggagcggaagagggcgtggaggtgaatctgctgggactgaatctggggctggatttcaccccgttgcgtctgcggctgccgtttatcggcggaacgccgaaatccccgtcttcatgatagagattgacgctgtcggccttcacctcgatctcttttttgatcggatcgtcaacgcgggcgcaccacagcgtatcgcccgcaacgcgcagcacctgcatttttggaccaccgtggccgtgcagcagaaacagcgtggccagaccgaggaagataaagaagccgccggtatcggtgatggcggtgatcagtacgctggagccgaccgccgggtcgcgtttgagtttggtcataatcagcggaatcagcacgcccatcagcgccgccagcagcagattcagcaccatcgccagcatcatcacgccgcccagttgcagattgtcgtacatcagccaggttacgccgcccatgatgccgccccagaacaggccgttaagcagcgccacgccgagttcacgcgcaatcagaaacgaaaagttgccgggttcaacctgatgcagcgccagcgcgcgcacgatcatggtgatggtctgattgccggtattaccgccaatgccggcgacaatcggcatcagcgtggccagcgccaccagctgcgaaatg

SEQ ID NO: 76363 - DNA, 1893 bp, Glycine max
  Peptide Sequence Number=SeqID_193141
atggaggaacataaatctgttatctccacctgtgaacaagatcaacatgtggttgctgccgctcagcacattttgaaggcactagcagcaagtaagaatgtatctgatgacttgagaaaaacccttttggatattgagacacaattgtcttcaatttccatagtcaatgagagaaaaggaagagaaatcaagcatttagagaggcagcttaagtgtgttgaagacaaggtaatgaggtgggaggcaaacccttccaacgagtcttctgagtatttgaaagttgttggtgaaatccaagtactgattcagaatttggaaagcttttctgtgaatgaaaagtggaagcagaaggaacttgttcggagagcaaacgaaattctgcaggttgctatgtcaaggcttgagaaagagttggtccacattcttctccaacataagcaacacttagagcctgaatacctgtatttccattttaatagggtggatatggtgtttgatgaatcgtttcgttcggttgaggatgaacaaatcgacgaggcctcccggagtagcggtgctagccaatccgaggccagcactgttgatttggtgaatccagcagtgcttgaacgtctcaagagcattgcaagtgtcatgtttgcttcaaaataccatcaggaattctgtcaggtctttgttacatcgaggagggatgccttggccgagtattttgtcattcttgagatggaaaagttaagaattgaggatgtgctaaaactggagtggcattgcttgaaccatgagataaggaaatgggttcgagccatgaagatcattgttcgggtgtaccttgtcagcgagaaacgattatgtaagcaggttcttggtgactttggatccttttatcaatgttgcttttctgaaatttctcagagttttatgctgcacctcttgaattttggtgaggccgtggcaatgggaatgcacacaccagaaaaaatgtttcgtttacttgacatgtatgaggttttggagaaacttgatgtggacgtagatgttttgttctttgaagaagttggttcttttgtaagaggagagtttcacaagcttctaaggagctttggtgacactattaagtctacacttctggcattcagaaatgctattgcatccaatcattcaaagaccccttttcctcaagggggtgttcatcatgttaccaagtatgtcatgaattacatcatggctctagttgaatatggtgacacccttaatctccttcttgttgatgacacctcaattgatcctgcaggcaacaaagatgacacaccatgtctctcattgtgtccagtggcttgccaatttcggtcaatcaccgcaactctagaatccaacttgagcaacaagtccaagttatacaaagacgaggctttgcaacatattttcatgatgaacaacattcattacatggtgcaaaaggtcaagtgctctgatctaagccatttctttggggactgttggcttcgccagcacattgcgatgtatcagcgcgacgcaaggtgttacgagaggatctcttggggctcggtgctttccatgctcaaggagggtagtgtgtcaaattgtgtctcacagagaactttggagaaaagatgcaaagagttcagcactgcctttggtgaagtttacaggatccagacagggtggttcatcctagaccctcgacttcgcgaggatctacaaatttcagtgtctcaaaaactggttcttgcatacagaacatacattggtagaaactcatctagcattgctgagaagtatgtcaagtacactgaagatgatcttcaaagttacattttggacctttttcaagggtcaccaaaatctttgcactatcctcagcacagaaagtga

SEQ ID NO: 76364 - DNA, 297 bp, Glycine max
  Peptide Sequence Number=SeqID_193142
atggctgtcattgcatcctttggttatcaaaaagagcatgatggctcttgggtgaaaaagggtgctcgacctgttgatgaagaaggacatggtggagaagattcctctcttcttcaaaagattttggataggttcgatggtcttcaaacctttgttggtgaaaggtttgatactttggagttacaattggacatgcgcttcaatgagatggagtcaagaatcaccaaggtcgaagaagatgtttcttatattcgtacaagctttgatctaccaccaccgccgtcaccatcatcttag

SEQ ID NO: 76365 - DNA, 363 bp, Glycine max
  Peptide Sequence Number=SeqID_193143
agcttgttcaaggaattgagcaagatggaagagaacatgtgggccatcattgaccaatacaaagagaagttaagtctagctgcaacccatgaacaaaggttagaggatgagtacgcgaaggtatcggtcttgcaaacggaaagggaagcaagagagagagtgattgattcattacacagagaagcaatgatgtggatggataggttcactttcactctaaatgggagtcaagagcttccaagactgctagccaaagccaaggcgatggcggatgtgtactcggctcccgaggaagttcatgggctcctcgattattgtcagcacatgattgatttgatggaccacataattaggaaccgctag

SEQ ID NO: 76366 - DNA, 489 bp, Glycine max
  Peptide Sequence Number=SeqID_193144
atggagcaaggggagagcttgccctcttactccaagtttgctagactgaggcctgatcctcaggagcttgtagcccggctgtgtatccctgggaggggatttgcacttaatgccaaagagcctgcaccagggccagctcctgattatgcagagtttgcagattatgcagagtttgcaggatgtggtccagcaacggccatttatgagcctggaggagtttgttcagaaggagggggtgaggcctctgcagcccaagagcctcagccaggtcaggaggatgacattctagaggcctcagagcccattctatcggagcctgtcattgttgagactagtctagccattccacagaaggatgttgcagtagttaccccacagcttgagccatttgcaccagtgccagacctgcctctttctcaggattcaccatcaggcactactacattggacctgaatgagcatgccacagactctgcacaggatcattga

SEQ ID NO: 76367 - DNA, 156 bp, Glycine max
  Peptide Sequence Number=SeqID_193145
ttgagcttagctcatcactgggccaagcgtgcatccaccgctaagcgcagcttcaacgcgcttaacacgatagaagaatctggcagagcatcagtttcgaggtcggacgctaagcgtgagattagtgcgctaagcacagcagttgtctgcagctaa

SEQ ID NO: 76368 - DNA, 546 bp, Glycine max
  Peptide Sequence Number=SeqID_193146
atgactaatgcaaactgtccgcaagaatcattgcattcagtctcaaatgggaatctaagggtctgtgtgtatcatgaggatgtgtgtagttgtgatgctaattatggaaatctatccactattgctttaagtgtgaaggaccctgttagtgtgaaggagaggagggaacattttctgcagggtttgggcttagttaattcttcttccaaggtttgttcacaacagaaaatgagcttagatgactcatctatcagcttgggattggagaggatcagggagtgcagtggggcaatctcaaatgcttgcattttgcatactgatgaagtagtatctgagaagttgattctctctggaggcaaagcaggatctaaagaaaaaatctctttggatgaattcacagggtgtccccaagatgaagcagaagcaaacattcaaggaaaagagcatgagttgtcttatacagctcacgagcatagacccaaagaaggtgtttcacaagaagaatttcaggattttcatatcagtaaaagaaagaggataaactag

SEQ ID NO: 76369 - DNA, 441 bp, Glycine max
  Peptide Sequence Number=SeqID_193147
atgggggagtatttggacgaggtagcgaagaagactcgtctacacgttatcgacaaacttactccagatatggtgtatgagatggggtttgacaaccctgctgaactgaacaagtctctcagcttggggatgaagaggcagggggcactcatagtcgccgtcacaaaaagatggggtataagtggggaggaggttatccctgttctttttgcaaaacgggcggccggaatcgttgagcaaaagactcatgaattgctacaattgcgaaacgaaataagcctacctcaagggagctacacctcccttgaaaaagaaataagagcgttagacgcaaggcacgaggaacgtgtgcaatcaaggttctccacgttcaaaagctacttaacagagcaccggtccaatctacttgcgcttcaaaacccttatgccccagatagtgcg

SEQ ID NO: 76370 - DNA, 444 bp, Glycine max
  Peptide Sequence Number=SeqID_193148
atgcccactatccatcaaattataaagaccaagaatgagcggcctccaaagagggtaagaaggaagacccctgccctgaagcaatcgccacagaagcaaggagtttgcttgcgtgtctttactagaacaccaaagaaaccaaattcagccttgcgcaaggtagccaaggttaggttgaccaattacgccgaagttagcgcttacatcccaggcgaaggccacaatctccaggaacactcagtagtcctaatacgtggcggcagggtgaaggacctgcctggggagaaagtcatagaaggctgcaatcaacggattgcaacagaaagtggcggcattgatgcaaacatagggaaagggaatctttcttgtcggcacttgctagatcccactcgcttctgccagagattcacgtctgttgcgtggcaagaagctgcattgcttggg

SEQ ID NO: 76371 - DNA, 237 bp, Glycine max
  Peptide Sequence Number=SeqID_193149
atgactcatgccccgttgggttctcttaactctgttggtggggttgcaactgaaatcaacgccgtgaactttgtttcaccacgtagttggttggctacttcacacttctgtttagggttcttcttctttgttggccatttgtggcatgctgggcgcgcccgtgctgctgctgctggttttgagaagggtattgaccgtgacaatgagccagttctatctatgcgaccgctagattag

SEQ ID NO: 76372 - DNA, 435 bp, Glycine max
  Peptide Sequence Number=SeqID_193150
atggagaagccttctaagggagcagggaaagatgcagcagaaaacattgataaggtagaggcatttgacatggaaattggcgataacccgatggtcgaaaaccgtcttatgcccgcagacccagagtttggggagggctcccggtattgttggccactagacaggaatgatgcagagtcgatgcttttgcatggccaatattatgatgacatcgaggggtttctggaggaacaccccttctattgcacagatggagcagacaataaagaatggatcaaagactcttgtcaaagagtggctaacaccgatcaaggggcaagacaggcccaggaaggagattcattgggctacctggcatcgcctcttcatcttcttgatccgtccggacaccgggcctctgctagctgccctattagagcgaaacaatttggttga

SEQ ID NO: 76373 - DNA, 606 bp, Glycine max
  Peptide Sequence Number=SeqID_193151
atgtcacttattattgctaggatcccgtgttacaagtgtggcagtgacaaggagaagcttcatccgaactgcgcaagttcagaacgcttgactcgctgtgtaggttgtgattatattatcagattctattcagaaggtctgacaaaggacgaatacggccacgacgctgttgccgactgggtcttcaaacaagaggcaagggtgccattgcaacgttgcaatgccgtggactcaggggtcagatatttccatcagagctgccttggccgagatgaaccttcagcattgtccagagctaatggctactattctattcgcgggaagattgagagcgaaaagtatccagagctcagaaatattacccacaaatgctgtgaggactgcgtcattgcagcccaaaccaggggcaaggatctcaatgaggataagttgaattttatcatgcatcaaggagtgattgaggcagagaccggcgacttggagaggaagagagccgataggcgatcaagcaagattcgaggcatcattggtggtcagcaggctcgcctcgaagacaatgggacgacttcgaccgccatctttgcaacgagacacctcaatcagaaa

SEQ ID NO: 76374 - DNA, 428 bp, Glycine max
  Peptide Sequence Number=SeqID_193152
ctcccactgctgtcttacatggggttttgcttgggcttcttgagccccgacctcttgataaggaggaggagggttctcttggccctgtcaatggtgacagctgccctgttgtctcccccagatctgtttactcaatggctggtaactgtcttcatactgttctggatcgaagcaatcatttggctgggaatggttttcaagaggagggaggcccttgcaacgcaaggtggccacatctagtggcgccagcggtgcaacgcaactgtccacagcttgatgtggagggggttcgatggcgacccctctgcccacagggggtggccatcgagcacaatgacccggggggcccccccccggccaactgctatctgtcaaggtcccaaaaaactatgttttgtgtttccaataatggggacaacatcggctag

SEQ ID NO: 76375 - DNA, 566 bp, Glycine max
  Peptide Sequence Number=SeqID_193153
atggggctccgagtcacgtgcttccactggtcgagggacctgtcgagctcggcccaacacggccccgggggtgcctccttcacccctggggcactggcctcgccacccagtgccggtgcaagcctagggcatgccaggatgaaagattgcatcacatcgatttcacacgatttctccaccgatacaccagcatcttcaatggtagctaaacagggttcaggggcaggagggaagtgtcacaagggaggaagagtgcggggaggaaataggggcaggggaaagggagctgccacagctcttgaacaaggccccaagacctcctcggcggacggtggacgccctaaagagctaatcagcaggagcaatcagcacaggggagcacaaggtagtagagaggagcacagcagcagcagcagcagttgcccagcaacttgggtcccccacctggccagcctgatcagcacgatgcagactgtcaagtcatggcagttggagcctcagagagccctggatgcccatgcattgagcactccccggccaaggcttctccggccgcggccagaccg

SEQ ID NO: 76376 - DNA, 805 bp, Glycine max
  Peptide Sequence Number=SeqID_193154
atggcaattatttcctttactcgcggattcctatctgaatcgtgtaaagatgtgccagatggagagggtgagacatctggcgcatctttgcaatctggtcgaggactactagataatgggccaatatttgtcaaactcactagacgtcttgatgaggcccgcccgcgcatattcaaggcgcttcttgcgatgcagctccctccctgcaccgacgtgggcgccacaccaggggcagtactttatgcagcccactgggtgcccagaagggtggacgatgacgaactccttgagccatccatcgtactggatgtacccaagccatgtgccatcgagcccgccctccactgccgtcgtaagggactggcagcaataggaggcgggtcggtcgttgtaccttctttgataagcggggatccgatagggctcagcaggttgaataatcaaatcgttggcctatcaaaccttgaaactcttaatgccctccgccacagtgccagggataaaccgagccgtgtgagggcaaacaatccctacgtggttgcctctgctgtcgtgggtttcgagatggggggttttcggatgggcccttttatcaaaccatgcgaagagtgggctctcagacgcatcaacacccggattgtcgagtgtactcgcaatctgcccccccctgatttaattctttctcccgaaggtgctcgacaattcgctgttacctaccctcttttctctacatgctctcctggagttgcgaaggaagacgtctctgttcaaatgccaggaaggaacatgttggaccaattcattg

SEQ ID NO: 76377 - DNA, 471 bp, Glycine max
  Peptide Sequence Number=SeqID_193155
atgatctgtggatttctctcaaatgagcagatcagtaatcatgctgtactgccattgccactactcagtcttctcttggcatgtccagtaagtttcccagataatcttctgcccttgcgctggggctcggtgcttctgcacgtctcatgtctctcaccctccttgcttccattgtgttataatgtttacacattttccagtcctacggaccagtatgaagctgcgctgagtcaggcggagggaacgctggcggaggacggccttgccttcgacctcttcctcaaagaatccgacgagaaggtgcagcaggcgatgcgcaaagcagacgccgaaatgcggctcaagcaggaaaagagggatgactctgtgctggaagttatgaagtcctgtgacaaggtgtggatcctaagggtctgtctaggtgcactagacagtgtgcctactgctagtctctcacttgaaaggagataa

SEQ ID NO: 76378 - DNA, 564 bp, Glycine max
  Peptide Sequence Number=SeqID_193156
atggaggcagtcatctgtatgacacaaagattaaggaatttctacaacaccagcattgttcccaaactgatgggagaattcaagtacaagaacagattgcaagttacacgcattgagaagattgttatcaaccgggggctgggggacgcatcgcaaaacgccaaggtcttagaatcttctttaagggagctaagcttgatagctgggcaaaagggagttgttacccgatcaaaaaaggctattgctgggtttaagctcaggcagaagaacccggttggtgtttcggtaaccttgcggggtgaacggatgtacagcttcctagacaggttgataaacttggccctcccccgcattagagatttccaaggagttagccctcggagcgtggatgggcacggcaactttagcttgggattggaggagcagctaatgttcccggaaatagattatgacaagatcgatcagatacgagggatggacatttctatcgttacaacctccccgagtgacgccgagtgcctagcactcctaaaagaatttggaatgccatttcagaccgtctaa

SEQ ID NO: 76379 - DNA, 763 bp, Glycine max
  Peptide Sequence Number=SeqID_193157
atgcggcacactgcgttttttgctgcccgagagagtgccatgccgaacgatgccctttgccgccagctggcgcagcgcgtgatcacgctgatgcgcgagccacaaaagccgctgtgtgcggtggaaaacgtacggttgatctacgctgaggaaccgctgccgcgcacgccgatgttgtatccggcgggcatcgtgatcctgtttcagggacacaaaaccggctacctcggcagcacggtgtttcgctacgacgccaccaaatatctgatgctcacggtcacgctaccggtggagtgcgaaaccgacgccacgccgcagcagccgctggccggcatgagtctcaccgtggatccggccagtttgcaggatctgctgttaagcattggcgatgacgagcagtttcagccgcagccgcaaacctccggcattcactctgcgtttcttagcgaggagatgctgtgcgccgcggaacggctgctggatgtgatggataaaccgcgtgatgcccgcgtgctcggcccgcagctggtgcgtgaaatcatctattacgtactgaccggaccgattggcggcgcgctgctgtcgctggtcaatcgccagacgcagttcagccaggtggcccgggcgctgcgccgaattgagaaccactttgctgaaagcctgagcgtggaaatgctggcggcggaggtcaatatgagcgtctcggcgtttcaccataactttaaggcggtgacccagacgtcgccgctgcagtatctcaaac

SEQ ID NO: 76380 - DNA, 381 bp, Glycine max
  Peptide Sequence Number=SeqID_193158
atggtacacgcacgcgatgtgtatcaatcaaatgtgccacaagcgacagaattggggtgtcaatttgctgcacagcgtgggtgcccctccttgatgggcacatctctttacatcgagcagccatctgagatcgccagggttgaggacgtgctgaaacctagtaatcttcaaccactgaacttccttgaaggcgggagccatgcatgcacacaccgccctcattcactgggcactggtcatgtacaggtgagatctcaggaaagcaagagtgcaacccatgccatgcccgtggccagtgggcacgtacacatgtgcatcaacgtttcaggcaattgcaagttgccacaatggctacccaacaccggtgttggtagcaagtga
